United States Patent 10,240,205 (METHODS FOR ASSESSING RISK OF DEVELOPING A VIRAL DISEASE USING A GENETIC TEST) - sequence listing, part 3

SEQ ID NO: 93 - DNA, 2526685 bp, Homo sapiens
aacagatcgcatgacctttagttcatggactttgaaaaccaatttgatataagagactcctctatttttttctaaatgatgtccaaggggatcgaggttgctagatagataaattccagagaaaggctgttagctaacaataacacactaaaactagccagctacatttatttcccttagtcatttcaaatttgtcaccaacttccaaaaaacacaatttacttaagatttaaaacaatatattcaatacttccagagtttggttatctgtaatcctttctcatatccactgcaactaagaacttaccttaactggaacttaaggtactcctgttgtaccaagtatccttttagttaaaagaaaaagccctggccgggcgcagttgttcacgcccataatcccagcactttgggaggccaaggcaggccgatgacttgaggccaggagttctagactaccctagccaacatggtgaaaccccatctctacttaaaaaaaaaaaaaaatacaaaaaattagctgggcatgctgatgcacccttgtagtcccagctactcgggaggctgaggcagaactgtttgaacctgggaggtggaggttgcagtgagccaaaattgcaccactgcactccagcctgggtgacacagtgagattctgcctcaaaaaaaaaaaaaaaaaaaaaaaaaaaaaaaaaaaaggaaagcccttattttaagtgcagagtaggtgagattattacttttgattttggctagtccatcaagaagaaaagttgacccacaaggtccagaaggataacatgtgataaaatgctaaccagattttcaagaatcttttatgcctccagctttgcttgcactgcttcagccagtttaactggtatcatcctacatgcacccattttctccaccacagttaaaatctctggtttaactgtcctcctataaagtttttcctgagttcctcttatgctgaattagccactgcactttttgcaaataatacctatcatagaaacctcctggggtagagattgtaccttattcacctattatctccctcacctgccaaaatatctgccacataaaaggtactccattaatgtgtcaaataactaaatgttgttaagaatcctttcttatatacataattacctcatagaaaaaagtaatttttggtctttctggtgcaaaaggttgcattattttataagatttataaaatattttttaaaagctatgtttcctttgtttttggaataccatagtgattttcaaagaaaacacattatcaggatcatctgagaaattcttttcagcctgaaaatgggcagcgcttcccctaacttgctcccctcctcagcctttgttacgtgcagcctcagatactgggaaatactgagaaatattttcggactgatccactgttacttatgagagtatgtcattctgtcaccttcctcaagtctaggggtgttaaaacaaaaattgagacagtctgagattcaagttctaacgctgtatattttcctgaatagggacaataactgtttatatgcaaagtctttttccttttttttttttggcggtggtggggcagggacgggacagagtctcactctgttgcccaggctggagtgcacaggcatgatctcggctcactacaacccctgcctcccatgttcaagcgattcttgtgcctcagccttccctgtagctagaattacaggcacatgccaccacacccagctagtttttgtatttttagtagagacagggtttcaccatgttggccaggctggtctcaaactcctgacctcagtggtcaggctggtctcaaactcctgacctcaagtgatctgcccacctcagcctcccaaagtgctaggattacaggcgtgagccacagtgcccagcctcaaagtcctttttctaagtaagagcaaagtattttatactaaagcattttaatacatccattaatgaaacattaacaaaataataaaaatataacttaccaatgttggaataatattcacttaatattttgatttcatggcaaaattgatacaaaatattaacttaaatttctgtatttatttacaaattcacaaaaagacagctgcaaacaggaagagaaaccacgcagacttcccaagagcctcttttccttattgaaacttcctttaagcatgcataattaaagcaatccatattcccttgtagcataaaaagttaagcaacaccgaggcaaggaaaaaccagctattttgagcaacccaaaaccaagctgctaaaacaaaatatacaggacccacagtaacactggagtcattaagaagttcctgtcctcttgtttcattttcatcgtgcactttctggtaatgctccaataaatcaatagcagttatacatcttttcatacataaggggcagatgaaaccctgtgaaataacaacttttagaaaaatatacagaaaaatatttttataaaacaagacaatgcaaatagaaataacaagaaaataactagtgtatctcttctggtatacgtaaggaaaattttcaagtggtaactgtacaaaaggtgaaaatctatccaaagtaggacttctaaaattagttcccatccttatgctataaatttgcattggttcaattccttttcattatggtatccagttgcttcagttagaatattattttgtttatgacacttttaaaaaattctttctgcttatgatactttgtccttacctatgtaagacctattatcggcaagttagcttttattttatttatttatttatgagacagtttcactctgttgcccaagctgtagtgcaatggtgccatctcagctcactgccatctccgcctccggggttcaaggggttcttgtgcctcagcctcccgagtagctgggactacaggcgcgtaccaccaggcccagctaatttttttttttttttttttgagacggagtctcactctgtcgcccaggctggagtgcagtggcacgatcttggctcactgcaacctcctcctcccaggttcaagcaattctcctgcctcggcctcctgagtagctgagactacaggcatgtgccaccacacctggccaatttttgtatttttagtagaaatggggtttcaccatgttggccaggctggtctccaactcctaacctgagaagatctgtctgcctcggcctcccaaggtactgggattacaggcgtgggccaccacgcccagccgagatcaagaaattactggcaagtataacaaatacttttatgtcatataatgtgttcaacaaagaagttctctttgaaagtaatttaatgaaagtaatttttagtctttactatattccactaggttgagatcccattcttccccacacccataattcccagcagatgattcttccttgtaattttctgagccaaataaaaccatcttcaaacagtattttaaattacatatacctaacaatatctatattttaaaatatgggctgttatactgatgtatgtatggcttgaggttttgtcaaataagaataataggatgaggggctgggcatggtggctcatgcctgcatccccagcactttgggaggccaaggcaggcagatcacttgaggtcaggagttcgagaccagtctggccaacatggtgaaaccccatctctcctaaaaatacaaaaattagccaggcatggtggtgtgcacctgtaatcccagctactagggaggctcaggccagagaatggcttgaacccgggaggggggaggttgcagtgagccaagatcacaccactgcactccagcctgggtgacagagtcagactctgtctcaaacaaaaaaaagaataataggatgagagactagaattgaaagcatcagggagaaagtaaataaaatgaagacagcaataagcatgaaatgttataacatcatgagtgtcagtgtcaaaaatagatgtggacttgggtcttgggtctcaaccaatgcctgattatatgaccttaaggaaatcactttgctttgcttaaatgtccttatctataaaatggggctaatactagcacctattcttctagagtttttgtgtatataaaatactaaatacagtgcttgagatattgtaagtgctcaacgaatatgaattgtcattagatgtacgcttaaagatgaaagggaaagactgagagactagatgaaaagatagcaattaaaaacctagattactcagcaaggccaaggaaatgaagtaatgagaatatgaagaagaaagtttgtgaaaggatagacaattatagtaaagaatggggagatatgactttaatatttcaggtgaaactattgtgcctgatgatacagtagaaggtactgccatggaattaagtagcaagaaaagagatacgaaagatcattgacattgacaacattaaggaactgggaggttaaaatgttccttgagttatcaaagtcacttagaatagcaaggagagagaggaagactgaaaacagatgccagatgggaagcaagacagggtagcaattaagagctaggcttgggcttgaatcctggattcatatcactcttagtagctatgagaccttcaattgcctcatctgttaagtggaataacaataacacctacttcatatgaatctcatgacaattaaataagataatacatgcaatgcatttatcattgtacctggtacaaagaaaacattcagtaaatgttagctatcattactttaattattccttttgttaataacctttaaaggagattatccaggggatgaaaatgaggaatatgagttcatctttttttttaactgatgaaagagttgtcttccagatgaccacagtctcaagtgctagaactacagaacaattcttctttaaaagatgcttcagcccagcacagtggctcacacctgtaatgccagcactttgggaggctaaagcaggcagatcgcttgagcctaggaatttgagacctgccttggcaacatggcaaattcccatctctacaaaaaatacaaaaaaaaaaaatttagccaggcatggtggcatgcacctatagtcccaggtacttaggaggttgaggcgggaggatcacttgagcccaggaggtccgggctgcggtagccatgttcacaccactgcactccagcccaggcaatagagtgagaccctgtctcaaaaaagaaagagaaaaaagaaaaaaagaaaaagaaaatatgcttcatttgttttgtattgtttgagacagagtctcgctctgtcacccaggctggagtgcagtggcacaatctcggctcactgcaacctctgcctcccaggttcaagcgattctcctgcctcagcctcccgagtagctgggattacaggcgcttgccgccaggcctggctaatttttgtatttttagtagagacggggtttcaccatgttggccaagctggtctcgaactcctgacctcaggtgatccgcctgcctcagcctcccaaagtgctgggattacaggcgtgagccacagtgcccagctgttttgttattgccaccatagctttaggctgcctttcactttactcttgtttttcactgttaagtttccatatacagtcattcattcaaaaagtatttacttgctggtattctaccatgcagtagggtaactgtggttaacagtgaaatattgtatatcacaaaatagctaaaagacagccttttgaatgctctcaccacaaagaaatgatacatgaataaggtgatggatacactacactgatcggattattatacaacatacatatgtattgaacatcaaaatgtaacccacaaataggtgtaattaaaatgtgtcaatttaaaaagtaaataaatttttttaagtaatatacgattttttaaaaatcacatgggcatgtgattactatgttctagctgttgtggtatggtgctaagaatacaatgataaataagacaaggtcttcaccctcaagaagcttacagcctctctgaaaaagttacccaaaaaaatgacattttaggccagacacagtggctcatgcctataatcctagcactttgagaggctgaggcaggcggatcacaaggtcaagagatcaagactatcctggccaatggtctattaaaaatacaaaaattagctgggcatggtggcacgcgcctgtggtctcagctactcgggaggctaaggcaggagaatctcttgaacccaggaggcagagattgcagtgagctgagattgcaccactgcactccagactgggcgacagagtgatactctgtctcaaaaaagaaaaacttacattttatgccccactaatcagaaaatcctattaaatccacattgaaaatgcatccagaatctcagcacctctactgttaccactctgctccaagtcaccatcacattgtacacagatcattacaacagcctcctaacactctttgctcctaccctcaccccactaacacacagcagctagagtgtatcccataaaaatgcaaatcaaatcttgtcgtttccttgcttaaaattatccgatagctttctacgacagtaacagttaaaaactaaagtctgtataatagtctataaggccctacaagaggcagacccgatcgctgacccaatctcccccttgctcactatgctacagctacaatagcctcctggttgctttttcaacatgacaggcatattcccaccttagagacctgctgttccacagacctggaaaaatacttgccccagaaatccacgtgactcatttcctcacctccttcagttctttttgtgttatcccctcctcagagaagtcttccctgataactatttaaaattgcagccaccaagaacactttatatgcctcctttcctgctttatttttttcaataacaccaactgtctaacttgatacattttttatttatttatttttgagacagggtctcactctatcatcccagctggaatgcagtggcagaatcatgattaacttgcggcctcgaactgctgggctcaagcgatcctcccaccttagcctcccgagtagctgagaatacaggtgcatgccaccactcctggctaattttcttttttattttttgtagagatggcatctccctatgttgtccaggctggtcttaggcgatcctcccaccacagcctcccaaagtgctgagattacaggcgtgagccaccatgcctggccaatacatgtttagtatgtttttatttttgcctatttccacccacttgaatgtaagctccaccaggataaatactttttagtttatcctaacaaatgggtaaaagggagctctttaacccatcccaccacgtgaggacacagggataagaccctatctatgaaccgggaaatgggccctcatcagacatcaaatctgccagcaccttgatcttggacttctcatactctagaactatgagaaataaatttctgcagtttataagctaccaagtctgtggtattttataatagcagtctgaacttactaagataagcaggtgaggtacagagattagcttatggaaaagcccaagaaaagaaaaaacttggcacactataaaaacagagaattcgatatgcccggatcagagtatcaagaagactatgagaagaaatgaagctatagaggtaaaaagaaagctgatcaccaaaaaaaaaaaaaaaagataaataaacaacaacaaaaaaacttctagaacaagctaaagaatttagactttattctaaggacaattaattgaaagccattaacctgggtgttgttttttttttttgtttttgagacagagtcttgctttatcacctagactggtgtgcagtggcacgaactcagctcactgcaacctctgcctcccaggcacaagaaattctcgtgcctcagcctcccgagtagctgggattacaggcatgtgctgtcatgtccagctaaattttttttcttttttcttttttcttttttttttttttttgtatttttagtagagacagggtttctccatgttggccaggctggtctcaaactcctggcctcaactgatccgccagcctgggcatccaagtgctgagatttcaggcatgagccaccattcctggcctaacctgggttttaaccaggaaaatggcatcataaaatcctagcgatattttaaaagaatagattcaattggaagagagaggagataggaggtgggtaacatcagataaaaggaggacagttacaataatatgtgagggttaatgattgatggtagtctgtgttaaggcagtaacagaatggattaaaattattgcttaagcaatttcaatagaaaaggttttctgagaaggtgataattgaactaaaattaaaataattttttttttttgagacaaagtcttgctctgtcacccaggcgggagtgcagtggtgcgatcttggctcactgcaacctccaccttctgggttcaagtgattctcctgcttcagcctcctgagtagctgggactacaggtgcgtgccaccacaccctttagtagagatggggtttcaccatgttggtcaggctggtctcgaactcctgatctcgtgatcttggcctcccaaagtgtttggattatagccatgagccaccacgcctggcctaagaaatgagatttgataggtaggtggaggccacaaatgcagggccttatagaccatgataagatataatggaatttattttgcataataggaagccaatgaattttcttttttcttttcttgctgggaagcatagcctccagcagaagctggaagcaggcatttcctaaagccaatgaagattttaattcagggaatggcctgatctgattccagtccttgtggttgctctttggagaagtgacctaaaatgataaggataatacacccttatgatcatctaggtgaccagcagaaacagaaagaagaagataagaccaggcacagtggctcacacttgtaatcctaacacttcaggaggccaaggtgggaggattgcttgaagccaggagcttgagaccagctggggcaacatagcaagacccctcgctacaagaaaattaaaaattaaatttccatacagctacctttggaaaaaacaaaaacaaaaaacaaaaaaggtgggggaacggactgaagatatatctgggggctaaaatgaataggacttatcatgtactgaatatggtggatgaggaaaaggaagaatcaagtttactctgaaatcctgagcttcaatatctgagattttctacaattttcagctttctgagacagctaaaagaatagcaagttgaatgttggggtaggaaagactggagggcaagaatttagcttaaacaataaatttaggacaaatattaaatttaaaatgcatattaaagtcctaagcttccaccttaagaatctagaaaaaagatgagcaaactaaatccaaagtaagtagatggaggaaattaaatataaaagcagaaaccaataaaagaggaaagcaaaacacagagaaaattaacaaagtcaaaagttggctaccttaaaaattaataaatggataaactaataggaataattaggaaagaaagaaaaggataaaatattttatctcttaccaaaatcatgggatatcactacagatgctatagacatttatgccaataaattcaacacattagatgaaacaacagattccttaaaaacacaattcaccaaaactgactcaaaaagaaacagagaatctgagtaataatcaatacacttcccaaaaagaaagctccaagcccagatggttttactagtgaattctagcaaacattcaaggtatacctccctaatttatgaggccaggaaaacccagataccaaaacctgatacaaacatttcaaaaaagaaaattacagactgatatccctcatgaccaaatgaaaaggtcccccaaaaatacataaacaaatgaaatctagcagtatacaggctgagcacccattatctgaaatgcttgagacacttttggattctggattttttttttttttttgtattttggaatatttacatgatacttaccagttggacatcctaatccaaaaaaatccaaaatctgaaatgaacatcatttcggcactcaagtttggaattttgcagcatttcggattttgaattttcagattagggatgctccacctgtattaaaatagtaacaacacagcaagaccaagtggagcttatcctagaaacaagagtagatcaacattcaaaaatcaatgtaaatcttcacagtaacggaaagagaaaatcatattatcatctcaatagatgtgggaaaagcatttggcaatattcaaaattcattcaaagggaagggggaggggaaaagaagggagagagggagggagggaaggggaaaagctctcagaaaactagaaagcatccttaagctgatcagaaaaaaacccatggctaccatcattctcagtggtaaaaaccttaaatgctattccctaagttcacaaagtaaaatacttactctccccaattctatttaatatttgacccaaattaaggcccaatattgtgtgctgccttgacatctggtgaaagtgggagggcctcaaatggcctaaccagaagtttgcctccccattctcctcccacagataaggctgcctactcaaacagcccttctgatcacagggaccaggcacagtccctgcttatccctacgtagtgggtttcccatgtcctggtcccctgccagcccacagacttatccaaacaatccaatcatatccttctttaggaaccagaaggcaccccagactcttgatactaccaagcctgcctcctacagcccctggttgttcattttgttcccaaatgtaatctacatgtagccatgcatggcatgtagtgtcctactcccctaggctgtaaacataaaacaaactgctgttgatctcaactgtccagtgtcacgtgttacatgttcagccattcccataacctggggcaaaatccctccttcactacacagtaaataggaggcaatgaaaacactggcaaatgcaaatgacttgcacccagtataaaggagtctcacaattcaataataaaaagacaatccaatgtttttgtttttttttgagttgtggtctcactctgtcactctaactggagtgcagtagtgcaatctcggctcaccgcagcctccacctcacaggagcaagcgattctcctgcctcaacctttcaagtagctgggattacacgcacacgccacagtgcctggctaattttttttgttgttgttggagggggcggagtctcactctgtcgcccaagctggagtatagtcatgcaatctcggctcactgtaagctccacctcccaagttctcaccactctcctgcctcagcctcgcgagtagctgggactacaggcacccaccaccatgctcggctaatttttttgtatttttagtagagacggggtttcacagtgttagccaggatggtctcgatctcctgacctcgtgatcagcccgcctcggcctcccaaagtgctgggattacaagcgtgagctaccacacctggcttaatttttaaaataggcatttccaattccagaaaaaatggcatagatgcacttttccttattccttctgccaagtacagctaaaattcatggacattacatataaaacaaatgtaagaagactctgaaagatacagaggggaaggcagaccagttagtgatctcaggagacaaggaatgacagactgatgagttctttgcctcatatattctgaaatgaatactagagaagccagcaatctggaaacaccagactatgctaacaagaaaagcctgctctctctaggcacatgatcagggatgaggtagtcctcccactgctaaatctgactggctttttagaaaacgggctcagtgtagtagatcatgcctgtaatcccagcactttgggaagccgaggcgggtggactgtttgagcccaggaattcaagactggcctgggcaacatggcaagaccccatctctatgaaaaaaaaagaacaaaaattatcagggccatggtgatgtgtgcctatggtccccagctacctactctactcgggaggcagtggtaggaagatcacttgagcccgggagatcgagcagtgatcacaccaccacaatcagcctgggcaacagagtgagatggagaggaggaggggagggaaagaaggaacggagggaaggaaaggaaaaggaagaaagggaaagaaaggcgatgcagtactgagatactacaacatctggaggtcagttgaagaggtaggaaaaacaccagaagagaggtatcagagaagcacaagaaagactgcgttattagacagcaagagtcgactggactaaatgcgtctaagaagtaaagtaagatgaggacaaagaagtacagatgagaattagtaaaagacaggccattagtgagtagtttcagtggaaaaactgaggatggaagccagcttggaataggataaacaataaacaaagacatttacttctagcaatatggtgtactaaacagtctgaactgtcctgatgaaaacaatgaaatgatataaaatatcacttattacattatgtattacatatattatatatgttattacagctgaccctcgaacaccgcaagtttgaacagtgtgggtccacttacacgtggattttcttccacctctgcctcctctgagacagcaagaccaactccatttcttcctcctcctcctcctcatcctactcaacataaagacaaaaatgaagacctttatgaccttccacttaaagaatagtaaatatattttctctttgttatgacgattttccttttcttttttggctctatggaatctttctagtcatatgatttttcttttttttttgttgagacaaagtctcactctgttgcccaggctggagtgcagtggagtgatctcagctcactgcaacctctgcctcctgagttcaagtgattctcctgcctcagcctcctgagtagctgggattacagtcacgtgccaccatgactggctaatttttgtatttttagtagaaacatggtttcatcacgttggccaggctggtctcaaactcctgacctcaggtgatctgcccgcctcggcctcccaaagtgcaggattacaggcatgagtcaccgtacctggcatctttttttttttttccacttttattttagattcagagggtgtatgtgcaggtttgttacctgggtatattgcatgatgctgagctttggggtacaaatgatcttgtcacccaggtactaagtatagtacccaacagtcggattttcaaccactgcccacccccttcccttctcattctagtagtctccagtttctgttgttgccatctttatgtccatgagtacccaatgtttagctcccatttataagtgagaacaagcagtatctggttttctgttcctgtgttaatttgcttgggataatagcctctagctgcatcagtattcctacaaagaatatgattttgttatttttatgcctgtgtggtattctgtggtatatatgtaccatttcttttttttatccaatccaccattgatgggcacatagtccgattccatttatttgctattgtgaatagtgctgtaatgaacatacaaatgcgcatgtctttttggtagaacagtttgttttgttcagatatatactcagtaatggattactgggttgaatggtagtcctgttttaagttctttaaatctcgaaactgctttccacagtggctgaactaatttacattcccaccagcaatgtataagcattctcttttctctgcagcctcaccaacatttgttttttaatattttaataacagccattctaactggtgtgagatggtatctcattgcggttttgatttgcatttctctgatgattagagatatggaccattttgtcacgtttcttggccatttgtatgtcttctgagaagtgtctgttcgtgtcttttgaccattttttaatggggctttttgcttgttcaattgtttaagtttcttacagattctggatattagacctttgatatctgcaaacttggctgcacagtttgcaaatattttctcccattctgcaggctatctcttaactctgtcgatagtttctttcactgtgcagaggctctttaattagtccggcttgtcaatttttgattttgttgcaattgcttttgaggacttagttataaattctctcccgacactaatgtccagaatgatgtttcctaggttttcttctaaaattcttatagtttaaggtcttacatttaaatctttaatctattttgagctaaattttttatatggtgaaaggtagggaatccagtttcatttttctgcataagccacatgattttcttaataatattttcttttctctatcttactttatcgtaagaatacagtgagacacgttcatcagcttgttcttttctgcccgcggacgccactgaagaagcatcgttaaagtctctcttctcccttccgtcatgtctaagtcagagtctcctaaagagcccgaacagctgaggaagctcttcattggagggttgagctttaaaacaaccgatgagagcctgaggagccattttgagcaatggggaacgctcacggactgtgtggtaatgagagatccaaacacagagcactccaggggctttgggttcatcacacatgccactgtggaggaggtggatgcagccatgaatgcaaggccacataaggtggatggaagagttgtggaaccaaagagagctgtctcaagagaagattctcaaagaccaggtgcccacttaactatgaaaaagatatttgttggtggcattaaacaatgaagaacaacacctaagagattattttgaacagtatggaaaaattgaagtgactcaaatcatgactcactgaggcagtgccaagaaaaggggctttgcctttgtaacctttgacgaccatgactccgtggataagactgtcattcagaaataccatactgtgaatggccacaactgtgaagttaggaaagccctgtcaaagcaagagatggctagggctttatccagccaaagaggctgaagtggttctagaaactttggcggtggtcgtggaggtggttttggcaggaatgacaacactggtagtggaggaaacttcagtggtggtggtggatatggtggcagtggggatggctataatggatttggtaatgatggaagcaattttggaggtggtggaagctacaatgattttggcaattacaacaatcagtcttcaaattttggacccatgaagggaggaaactttggaggcagaagccctggcccctatggtggtggaggccaatactttgccaaaccatgaaaccaaggtggctatggtggttccagtagcagcagtagctatggcaatggcagaagattttaattaggaaacaaagcttagcaggagaggagagccagagaagtgacagggaagctacaggttacaacagattgtgaactcagccaagcacagtggtggcagggcctagctgctacaaagaagacctgttttagacaaatactcatgggtatgggcaaaaaactcgaggactgtatttgtgactaattgtataacaagtcattttagtttctgttctgtggaaagtgtaaagcattccaacaaagggtttcaatgtagatttttttttttttttgcaaacatgctgttgattgctaaatgtaagtctgatcatgatgcagaataaatgtctttttttaatgtgcaaagaaaaaagaatactgtatataatatatatataacatgcaaaatatgtgtgaatcaactgtttatattataggtaaggcttctggtcaacaataggctattagtagttaaatttttggggagtcaaaagttatacatgaatttcagctgcacaggaggttggcactcaaattgttcaagggtcaactacacgctataaaatataaaatattatataaatagaaccaaagttagctttcaccctgaatatttctttaatgtcctggagaccatgatatttccaatttaacttagaagctgttaaaggcacaatgttaaaacctacagcttgtccaaagtaggaagccaaagtcaatgtaaaggtaaaaaggaaacaaacctcagagagacagagacagagaccaaccaagaccttgtctgtaccttagtattggtggcatatggaaaaaacaatttcccctgagaatccataaccactaatagccctcaattagattagcagtcagaatgtatgctattgtataatctgaagaatttcaagctcagaacttaatttacggcagtccccagttaacagcacctctctaatgttccccagttaacggcacctctctaatgttcccatccactaagtggaagtggatcatgacaaagtttttcatccttgttgtctctgagtaggctgaaaagcaagagaaagaagtggaatgggtcttgctgtctcagaggtggcagaggtggaagaaaattcacatataagtggacctgcgcagttcaaacctgtgttgttcaagtgtcggctgtaataacatatatgtaatacataatgctgagcaaatcctcgctgcaagaacatcgacatagcccacaaagagtttccactagaaaagttccaaggaacataaattcacaatcgaaaaaaattcacaaaatacacaagagaaaaagccacaagccattacgagtgacatccaacagaaagaactggcaacagagtcaaacctataaagtttcaaatactataatgctataaacattaccagacagaaaatatagaataatcatatttgaatgttttaataaataaaagggaagcttgaaaattaaagcaaagaacaaggaactaagaaaaagaaagatcaaatttgaaaaaaaaaaaaaacaatcagaactagctggacatggtggcacatgcctataatctcagctactcaagaggctgaggtgggaggaatgcttgagcccagaagttcaaggctgcagtaaaagctatgattgcaccactgcactccagtctgggtgacagagcaagatcctgtggaaaaaaagaagaggcgaggagaggggaggggaggggaggggaggggtggagagaggagaagggaagagaaaggaacgccaggaggggactggaggggagaggaggggaaaggaggggaggagaggggaggggaggggaagggaagagaaaggaagggatgggaggggagggagaggaggggagggaaggggaagggaggggagagaagggaggggaggggagagaagggaagggaggggaggaaagggaaagagagaggaggggagggggaagggggaaggggagaagggggaaagggaggaagaaaggaaggaaggaaagaaggaaggaaggaaaaaagaaaaagaaaagccagtcacggtggctcacgcctgtaatcccaacactttgggaggccgaagcgggcggatcacaaggtcaggagatcgagaccatcctggctaacatggtgaaaccctgtctctactaaaaatacaaaaaattagccgggtgtggtggcaggcgcctgtagtcccagctactcgggaggctgagacaggagaatggcatgagcctgggaggaggagtttgcagtgagccgagatccgcaccactgcactccagcctgggcaacagagcgggactccatctcaacaaacaaacaaacaaacaaacaaacaaaaacaaagaaaaaaagaaagaacttctaggaatgaaaaaaagacatttaaaatgaaaattaatggcatattaaacagcaggtattctccatagctgaggaaagatttaattaattggataattcattttttaatccaaaatgaaaaacaaaaaaaaaggatataaaatataaaacaggccaggcacagtggctcatggctgtaatcccaacattttgggaggccaaggcaggaggatcacttgaggtcaggaagtcaagaccagcctgcaaccagagtcacagatggagaccccatctcaaaaactaaaacttaaaaatttaaaaaataaaacagggaggggtgcagtggctcacatctataattccagcactttgggaagctgaggcaggaagactgtttaaagccaggagttcaagatcagcctaagctacataatgagagcccatctctaccaaaaacaacaacaacaacaacaacaaaaagccaggcatggtgatgtgcacctatagtcccactactggagacgtcagattgggagaattgcttgagcccaggagtttgaggtgcagtgaactatgaccacgctccagcccaggcaatagagcaagaccttgtctcaaaaaataaaaataaaaaaaatacctatgatagaataaatgataaagggagaaattttaacatacaggaagcccccaacttagaatagtttgacttaaaatttttgactttatgactgatttatcaagatgtaaccccatcataaatcgaagagcatctgtatatctaatctaggtttcagatggcaatatcagaaaaaaattgaggcaatagtcaaagataatcaccgagaattttccaaaacacttcaaatacacattggtgtgtacagaaagcccaatgagtctcaagcaggattaaacacacacacacataacaggaaatgaaagaaagagactagaacagattaatttattggctgattaattataaaaaacaaccacaggagtagagaaaaggatcccttcaatagaaccaaatagactaaaagcagtcttctcaacagtaacaatgtgacccagaaaaaagacagagatggaagttttcaatgtgctgacaaaaaaaaaggtctgtatgtagaattttatgctcagcaaaatcgtgtttcaagaacgagcatgaaataacattttagactgaaactgagagtctagcaaatcagtcctcattttaaaaaaatcctaaatgatgttctataaaacgaataaaataggccgggcgcagtggcttacgcctgtaatgccagcactttgggaggccgaagcaagtggaccacaaggtcaggagatcaagaccatcctggctaacatgaaaccccatctctactaaaaatacaaaaaattagccgggtgtggtggcgggtgcctgtagtcccagctactcgggaggctgaggcaggagaatggcgtgaacccgggaggcagagcttacagtgagccgagatcgcgccactgcacttcagcctgggcgacagagccagactccatctaaaaaaacaaacaaacaaacaaaaaaaaaaacccaagaaaacaattgtaagtggaaggctgaagatgcaataaggaatggtaaacaactacactggtaaatacatggataaatctaaaaataataataacctctaatttgtgaagataaaagaaaataagataaatctaaactaatgaaccacaatataagttaggaagtagtgatccatatcaaagcattcaaaaatcctcgaaacggaaggaaagaaaagtatgttagacattatgtatgttacaaaagaaacaaaaatgggccaggcatggtgactcacacctataatcccggcactttgggaggccaaggcagatggatcacttgaggtcagaagttcgagactagcctggtcaacatggtgaaaccctgtctctactaaaaatacaaaaaaattcgcagggtgtggtggcacgtgcctgtaatcccaactacttaggaggctgaggtgggagaatcatttgatcctgggaggtggagattgcagtgacccaagatcatgtcactgcactccaaggcaacaaagcaagactctgtctcaaaaacattaaaaaaaaaaaaaacactaaatgaacagaatatagtgcataatatccaaactagtagcagtacccaggactaaacccagcaatgtactccaccaccatgtgaaggttgcttaccaaagggccagcaaataaggagaatgaacagctagagaggtaagaaaaaaaccagaagtgtgtggtattacagaagcacagaaaagggtgtgtagtaaggaagttaaatccaaactaaggcaaaaagagaaaaagaaacagaagagcaggacaaagagaaagtacataaagagtaataaaaataaatcaaaatataaccaaaataattcaaaggggtttagcggttttcccagttaaaagacaagtgttaacgctctttgcaaaaaaaaaaaaaagaacaaaccaaaaaaaaacccccacctaaaacaaaaggaacaagaaaatacgaaaatgaaaagaaagataaagtccgggagcagtgactcatgcctctaatcccaacactttgggaagctgaggcaggcagatcacccgaggtcaggtgtttgagaccaggctggccaacatggcaaaaccccgtctctactaaaaacaaaacaaaacaaaacaaaaaaattagccaggtgtggtagcatgcacctgtaatcccagttactcaggaggctgaggcaggagaatcattcgaacctgggaggcagaggttacagtgagccaagattgtgccactgcactccagtctgggcaatagagtgagactctgtctcaaaaaaaagaaagaaagaagaagatacacaaaatactaatcaaaacaaagctggggttattccactactattaaacaccaattcatcaaaaagatataacagatctaagtagataaaatatgaagccagtgactgtaaacagcatattagagaagtttggctctgaaggaaagcaaataacacatggtacctgaagacgggatttcaagtcaaagaaagagtttttggtcttggttttattcatttttgattttttggtgttcttttcttatttgttttcatatgaatcatattgaacaaatttgtatgttattgggaattatatgaagtagaggtaaaaagtgaagtagcaggagggagagaggataaattaaaaatgaaaaagaatggaatccacagaacaagagaaaggactgaaattttataaaaaggactttttttcagtgtaataaagtaagaggaaacaggtatggtataggtatgataaaataagaacatttatctaatggttcctattttctcagttatatatacggtgactgagagaaggttaaaaagagacagatttcaaaacaaagaaggtacaaaataactatctcagaaagtaggaagttaatcctactaatatgatattaacagtattgccaggcactgctcaataccaatacccattggaattgttttttggtgttgttctgattgaggtcaactaaattattactagattcctttcagttcatcatattatgaacacagtttagaacatttttcttaaagacatttactgaaacttgttcttaataaagtccagctgatagttttcctcccctctcgcaaatctgtaaaatcttactatggttaaaatacatacacatggagacaaaaaataaacacatggtcagagagagacaaaacagaatgatgaatggacagaaagaggacatatccagaaacgtatgcacaatacacagactcatcaaccaagaggtggagaagaggatagcagagaaaaaaagactgggtaaggactacagctaggccttcaaaggggcaactgacaaaaactatcagagcaaaatttgagcatcttcatctcttcgtggcagtattatgggtgagtgttatgttcttcacattccttatctcctttttctataatcatccaatattacttatttattaaaaataatattaatgcaactaaagctgacttttcaaatttttggaatttttttacttatttacaataatttcttcatttttaatataatgtatttatatttaatataatgtctttaatatcaaagacaaaagtccttacaaagtcatacatgaagacagtaaataatatgtaaattttatagataacccaatttttccttagtccaataacagttcatgacagtacacacacataaatagatactaattaacctgtaattctttataaacagacgttttaaaatcttcagtgagatgacattagcattaaagacaaattggcaatattatttttcagagtcttaatgtacactttctcagtctcacaactaggcacaggcatatagctacaagtatgtttcaaaagtcacattccaacttttacaagaaaaacttgtgagaacttttcctatacaaatcaccaatcgttacaccaaatatttgctcattttcccttaatattgaattttattgccaagttattattttcatacctctgaagagctttcattattgacgtccactgtgtttataggagttgctgatgaatctaaatcagaaccttgagagccaactctcccaggagtctggaacacaaacagtagggaggaaaaaaaaacaaagcagacattaacaatatattcatcggccatttaataatctaaaccttttcacataagaaaagtagatgtctttacaataataacagtactaacagtatcatttatggaagagtgtacctaatgctgtatcaaaatctctatatatgcatttctctcattttaagtcactttaaacaaaatgtatacaacactttacaaagtcttcaagtcaccttcacaaaacatcatatttaatcaaaatgacatctcttaagacaggtaagatggatgttatctctgtagagaagaaaacagatttaaagcaggaagtgacttgttcaccattgtactcttttgttttggttgttttttgagttggggtcttgctctgtcacccaggctggagtgcagtggtacaatcttggctcactgcaacctccacctcccaggctcaagcgatcctcctatctcagctacccaagtagctgggaccacaggtgcacaccaccacacccagctaatttgttgtatttttggtagagacgaagtttcaccatgttgcccaagatggtctcaaactcctgagctcaaacgatctgcccacctccgcctcccaaagtgctggggttacaggtgtgagccataacgctcagtccaccattgtactgtcagcaaaaatcagaaagtcctcaagatgcaagttcaaggaagaagaaaaaaaatcagaaagttctcaagatccaagttaaagcaaaaaaaatcagaagatgcagaactaaaatgcagatcttctgattcctttgacaatgctttctcttttctttttttttttgaaacaagagtcttgctctgtcatccaggctggtctcactctgtcatccaggctggagcatagtggcacgatcttggctcattgcaatctccacctcctgggttcaagcaattctcctgcctcagactcctgagtagctgggactacaggcacatgccaccatgtccagctaatttttttttgagtagctgggactacaggcacatgccaccatgtgcagctaaattttttttgtatttttagtggaaacggggtttcaccatgttggccaggctgttctcgaactcctgacctcaagtgatccccccaccttggcctcccaaagtgctgtgattacaggcatgagccacagcgcccagccggcaatagtctcttttctacacaaactaaaactacagtgattcaagtggtgcaaaaaagaccaatgcagcccaagttatcaagtccccatcacctaccactcaaaccaatcattaccatccagctccaatacttgatatgacaccatcagagacacattttggagggttaaaggtcttttccccctgtaccatttatcacttagcattatcattcattaaaatctaggtgttacttttatatcaaattgctttttggatgaatctgaaacctagtaaaacactgggtaaaaagagatttagagcacaaaaactgactcaataatactcatcaaaaatatatatggtatatgctagcattatccacactttacaaatgagggaaccaaggcatagagactaagtaaattgcccaaggtcagatgggtaataaatgaaagaagggattttaattagagcagtgtggctcttaatcactaaccaatactgcttctctgttagacatctccactgaaatgcccctcaatcacccaagattcaaaacacctcactacatatttgcctcaacatgtgaacatcctgtacatcactactaaatgttcaacctaaatccaaataaggatgaattcataatgctatattcatcaaaatgattataaaaactatatacaatggaaaaatatacacagtatgatttaaattatatataaaaactactgatataagaaaaaagattaaaaagaaatattccaaaattcaaataatgatttctgtagcaagacaggaatcttcatttttatttttttcagttttcattttgctactttttttttcagaattttagatccatacttgaattgcttttatcttgaaaaaaatgttttatgttaaagataagcaaacctccagtttaatagccagcattcctttttttttcctcatgcagatactttgcacatttatttacaggcatatctcattttattgtgtgtctctttattgcactttgcagatgtggcgctttttagatattgaaagtttgtgtcaactctgccatcaagcaagtctattcctgccatttcttcaaaagcatgtgctcactttgtatctctgtgtcacattttggtaattatcataatatttcaagcttttttattattatcatatctgttatggtgacctgtgatcaatgatctttgaagttactactgcaattgttttgaggcactacaacccatacccatataagatggccaacttaattgataaatgttgtgtgtgttctgactgctccactcactggccatttcccagtctctctcccttctccttgagcctccctattccttgagacacaaccatattaaaattaggccaattaataaccctataatggcctctaagtgttcaagtgaaaagaagagctgctcatttctcactttaaatcaaaagctagaaatgattaagcttaatgaggaaggcatgtggaaagctgaaacagactaaaagctaggcctttgtgccaaacagccaaatgtgaatgcaaagaaaaagttcctggggaaattaaaagtgctactccagtgaacacacaaatgataagagcacaaattgctgagaatgttttagtgacatggatataagttcaaaccagccattaacgttcccttaaaccaaagcctaattcagagaaaggcccttcaattgtacgaaggctgacagagatgaggaagctgcagaagaaatgtttgaaggtagcagaggttggttcatgggatttaaggaaagaagctgtctccataacataataatgcaaagtgaagcagcaagtgatcatggagaagctgcagcaagttatccagaagatctagctaagataattgatgaagatatctatattaagtaacagattttcaattcagaaaaaaacagccttctattggaagatgtcatctgtaactactatagctagagaagagaaatcaatactgggcttccaagcttcgaattccaagcttcaaagaacagggtaattcttgttaggggttaatgcagctgatgacttttaagttcaagccaatgatcatttataccgttctgaaattcctaggacccttaagaattacgctaatgctactctgcgctctatacatagaacaagaaagcctaattaatagcacatctgtttaccacatggatcactgaattttttttttttttttttttttttttttttttttttttttgagacggagtctcactctgtcgcccaggctggagtgcagtggcccgatctcagctcactgcaagctccgcctcccaagtacatgccattctcccgcctcagtctcctgcctcagagtagctgggactacaggtgcctgccaccaaggccgcctaattgtttttttgtatttttagtagagacagggtttcaccgtgttagccaggatggtctcgatctcctgacctcatgatccacccgcctcagcctcccaaagtgcagggattacaggtgtgagccactgtgcctggctggatgactgaatattttaagcccactattaagagctgccactggaaaaaaaaaaaaaaatcctttcaaaaatatcactgttcattgacaattcacctggtcacccaagagctctcctggaggcatacaaggagtttaatgttgttttcatgcctattaatataacatccattccgcagcctatggatcaaggagtaattttgactttcaagtcttattatttaagaaatatattttgtaaggctataactaccatagatagtgactcctctgacagatctgggcagagtgtgtggaaaaccttctaaaaaggtcaccattctagatgtgattaagaacatttgtgattcatgggaggaagtcaaaatatcaacactaacaagagtttagaagttgattccaaccttcataatgactgtgaggggttcaagactccagtagaacagatacggtggaatcagcaagacaactagaattaaaagtggagcctgaagatgcgactgataattttcttttttttttttttcttgagacggacttttgctctgtcaccaggctggagtgcagtggtgtgatctcagctcactgcaacctccacctcccaggttcaagcgattctcctgcctcagcctcccgagtagctgggactacaggtacgtgccaccacgcccagctaatttttgtatttttagtagagacagggtttcaccatgttggccaggatggtctcgatctcttcacctcgtgatccacccacttcggcctcccaaagtgccgggattacaggtgtgagccatcgcgcctggcatgactgataattttcacaataaaactttaatggaggaggaatggcttcttagggatgagcaaagaaggtggttccttgagatgaaatctgctactggagaagatgctgtgaacactgttgaaatgacaacaaagaatttagaatattccataaatttagttgataaagcatcagcagcttttcggaggattgactcaagttttgaaggaagttctactgtgggtaagatgctatcaaacagcatgctacagggaaatctttcatgaaaagaagagttaatcaaagcaaaacagcaaacttcattgttgttttattttaagaaatgccacaactccagcctgaccaacatggtgaaactccgtcactactaaaaatacaaaaattagccaggcgtggtggtgcgtgcctgtaatcccagctactcaggagggaggcaggagaatcgcttgaatccgggaggtggaggttgcagtgagccaagatcgcaccactgaaagaaaagaaaaaaagaaaaaaaaagaaattgacacagctatcccaaccttcagaaacctccaccctggtcagtcagcagctatcagtatagaggcaaaaccttccacaagcaaaaagattatgactagctgggcaagatggcccacatttgtaatcctagtgctttgggaggccaaagaaggaggatcgcttgaggctaggcatttgagaccactctgggcaacataatgagaccccatctctaccaaaaaaatacaaaaatcagcaaggcgtggtggcgttcacctgtagtcccagctaccagtgaggcaggagaatagggtctggaggcaaggaaactaaggctgtttcatggcaacttcctagaactaaattgaaaggaaaaccctaactttccacacctaagtaacaaaaggaccacaggctactccctttgacctttcctttgaccttttctgcacagatgggaaattggctatccacaacaaatcagactgattgtgggcaagtcttcatttgcatagaagtataactgtgtagctttaccctaggctctgattggttgccttttgcaaccaatcagatgtttgcacaggagtgtgacctttgtaactttacttcagcctctggttggctgttttctgcaaccaatcagactgaatgtgggttaccacttcatttacatgaggtgagcgtgaagtggctaatcagaaacgtctagggggtatttggacccaagaagatgctgtatccaggcccttgagctgctgctcaggcccactcccacactgtggagtgtactttcgtttccaataaatctctgctttcgttcttttgttgcttcattctttctttgctttgctgggcgttttgtccaattctttattcaaaacgccaagaatctggacaacttgcagtcacgaccctctaccagtgacaataggaaggctgaggcaggaggatcacttaagcccaggaattcaaaaatgcagcgagctatgatcacaccattgcattatagaccggatgacagagcgagactctgtctcatcaaagaaaaaagattacaaatcactgaaggctcaaacgattgttggcattttacagcaataaaatattttttaattaaagtatctattagacataatgctattgcacacttaatagactacagtatgccgtgaatataatttttatatgcactgtgaaaccaaagaatttatgtgactcgttttattgcgatacttgttttattgcagtgatctagaaccaagcccgcaatatctccaagatatgcctatatacaagtatgcctatatacttgtataatttttatataaatcaggaaactagaacaagtacaaaataacaaccagtaattaaagctacagagaaattcccaaactcttctcaaacatacttcctcaaagaagggtataagattaaacttttattttatattctggatagagtattaacctagcatgccatgacaaaggggaaataaaatgatcttgaaccttttttaaagtacttatgttctttaggattctcagaagaactcagggttctgtgaggttctgtcaactaaagaatgacaaagaaggaacattatggctgggtgaaatggctcacgcctgtaatctcagcactttgggaggctgaggtgggtggatcacttcaggttaggagtttgagaccagcctggccaatatggtgaaacctcatctctactaaaaatacaaaaattagctgggcatggtggtgcacacctgtaatcccagctattcgggaggctgaggcaggagaattgcttggacctgggagacagaagttgcagtgagccgagatcgtgccaccgcactccagcctgggtgacagagcgagactccatctcaaaaaaaaaaaagaagaaggaacattacttgtgtaactatgtcttcttttttttttcctttttttcccttttttttttttttttttttttttttttagagacaggggtctcagaatgttgcccaggctggtcttgaactcctaggctcaagtgatccttctcccacttcatcctcccaaagtgctgagattacaggcatgagccactgcatccagcctatgtttcaataaagatggctagagaacatcagaggcacacttcagaaagagacaggtatcttactcatgagtgaaaaaaaaaaaaaaaaccacaaacattgtttagagatggaggaggcaataactgtatcctgtccaagaatagtagcaaccaccacaccaaggcttatccaaaacaggtagaaagtggcagaatttcaataaagtactaaagatgaagaatgcaaaatgaatctctggccaaaggcaaaaaaaaaaaaaaaatgagaggagctggatatgaggggtctccatttggttgtcgataccaggagacagtacccactacccgaaatgatgaaattgtaaggctttcatcctcagagaagtcagagaaggttaagccaactgaatacatgagtgaaataaacatgaattttagataccaccaatctagatcaaatctcacttcagcctaacttcaatttgctacaggctttagagaggctgcactttattgccaggtcttggagcctgagcactacctcctgcctcagcgtggtcgctgacccttcttctgggaggtttccactttctagacaagcagacaaagcttgtgaaataatcaaagcagtgatgccaaggatgtcatggcagaaggcctgggttcctgagtcactgagagctcagagggctggatttgacattcctgatgcattacacaggcacattcatcctgctgacactgtaatctgtcctcattgggaaagttaggatcatcttcctgggcactgaatagggtcagcttttaatctggtctcttcactttgtagtgggacaaaaggtgttggaagaattaggggagagggtgcagtgggcctctactttctccttcctcttgctcgttctcattttctttgtccttacaatcttcctaaaatgcctatgcttttttggaagttgatctagctttcttttctggactggaggcacagcaggatattgtgaaacctcagccacatgactcttgggtgtctcctccaatggctctgataatgattccaaacttctcttcagagggtgaacttccattctcccttgggtggaatttatcttccacatcttgagtatttggtgatgaacgttcaagtctttagtgacatgtttgggagactggagattcctaaagtctgtcactgaggactttttttttaaaacctactatgctgatcctagccagctttgcagaaacaaggaatcacaacaaaagggaccaaaagtcaaatgatatttttaaaatggtagttagcaccctgactgtttccaatgacgtatccttagctatcactgatacaggagatatactcatttcagatttctcccctcgacttatctaaaggcattcaatggccttcagaaataaagtcctcaagttgttcttagcctagggaatctcagatttcctagtatagtatggaagagcaggcctcagtctctacagtccctttaaactttcccaaaatctaacattctaaaactgtctaaatttatccagagtatgtctttactgtgtgtttttttttttacatttaatgcccacaaaattttcttgttttaatatcagctacagttctgcaaacaccaaagcaaaattctttcccaaaataatataattgagacatgaatttataaataaataaaagccagctctggatttaatgatacactcatggatgtggcaaaaagtaaatggcgaaaatgttttaaaagagcatttaaatttttttttgtagttgttttttttttttgtcttgttttatttttttgaggcacagtctcactctgtcacccaggctggggtacaatggtgtgatcttggctcactgcaacctctgcctcccaggttcaagtgattatcctgcctcagcctccccagtagctggaattacaggtgcccgccaccacgtccagctaatttttgtatttttagtagagacagggtttcaccatgttggccaggctggtctctaaatcctgacctcaactgatccgcccacctcagcctcccaaagtgctgggattacaggcgcgagccaacacgtccagcctaaactggatatttaatataaagaaccgttctataaaactagaaattcatttttgattcattaacatttcaataacttcacactacgatggtattaagaacaatgaaagacactggaaacaggaagttatacttccaaagaactgtattttcctcatttctgtttcctttatttttccagatgccagatggcttttcaccaaggttttccttgactgagccgaagtaagcaattcaaagaaatattgtacttttttttatttttgtaaagatgaggtctctgtatgttgcctaggctcatctcaaacctatgggctccagtgattctcctgcctcaccctcccaaagtgctgggattacaggtgtgagccaccatggccacctgaaataaggtacttctacataaacctattatcatcaccaaaaataccctttctcaaatttgcctacaataatcctagtaaatatacctaagtaaagcccaagaggcatggggagtaaacagagaaaaaaacaaggaaaccctcacaagtcaggggtttttgatgtccatattttaaatatactcctcatgattgctgttaaattatctaagaacttcttgtttttttttttttgagacggagtttcactcttgttgcccaagcgggagtgcaatggcattatcttggctcactgcaacctctgcctcccaggttcaggcgattctcctgcctcagcctcccaagtagctgggactacaggtgcacgccaccatgcccagctaattttttgtatttttagtagaaacggggtttttccatgttggtcaatctggtcacaaactcctgacatcagatgatccgcccacctcagcctcctaaggtgctgggattacaggcatgagccaccgcacccagccttcattcttattctatttttaagccactaaaattcctttatttcaaggagaagcccaaaaacaataacactaaccctaaataaagcatataaagcattctaactttttcacttataaaagttttattttgcaaaaagaatgggattggaatgatttatgctaaaaatttaaagtgataggctgggcacaatggttcacatctgtaatcccaccactttgggaggtccaggtgggaggatcacttgagcccaggaagtcaacgctgcagtgaactgtgattatgccactttactccaccctgggcaacagagtaagaccttgtctccacaaaaaaaagaatttcaaatattattaagatggaaccaatcttaaaaacaaggtacacaatggaccaaaaataaaatggaaacatagagtatccaggattctggaacctaaaacaggtagaggcagctaagttcagtaataagaaccaaaaacgccctggatgcgcaaggtaacaagaagccaggcccactgtgagaacttagtaagcggggcaaggcaactatcccttgcaatgaatagaaactctttaaaaagctgtaaatccggccgggtgcgatggctcacgcctgtaatcccagaagtttgggaggccaaagtgggcataacacgaggtcaggagttcgagaccagcctggccaacagggtgaaaccccgtctctactaaaaacacaaaaattagctgggtgtggtggcgggcgcttgtaatccaagctactcaggacgctgaggcagtagaatcatttgaacctgggaggcagaggttgtagtgagtcaagattgtgccactgcactccagcctgggcaacagggcgaaattctgtcttaaaaaaaaaaaaaaaaaaggctgtaaatcctgccacacactgtttaggcccaaagtttgagcagagcttttccaggtagagatgagagggcattccaaccaaagcattatttgtaacagcttataaatcataagcaacctatatgttcaaaatgaagaaactgttaactaaactacgacgtaactgttcaacagtcttttttttttttttttgagacggagtctcgctctgtcacccaggctggagtgcagcggcgcgatcttgacttactgcaagctccgcctcccgggttcacaccattctcctgcctcagcctcccaagtagctggggttacaggcacccgccaccacacccggctaattttttttgtattttttagtagagacagggtttcaccgtgttagccaggatggtctcaatctcctgacctcgtgatccgcccacctcggcctcccaaagtgctgggattacaggcatgagccaccgcgcccggcctgttcaacagtcttgacaattaatgggataagtgtgtaggttataaaagcatgaaggttatgtagaaaaatgagaatgcagtcggaagcggtagctcacgcctgtaatcccagcactttgggaggctgaggcaggcagatcacctgaggtcgggagtttgagaccagcctgaccaacaaggagaaaccccatctccactaaaaatataaaaattagccaggcgtggtggcacgtgcctgtagtcccagctactcgagaggctgaggcaggagaatcacttgaacccaggaggcgaaggttgtggtgagctgagatagcaccattacactccagcctgggcaacaaaagcaaaactccatctcaaaaaaaaaagaaaaatgagaatgcatatgatatatgatacatctattgtgagaaattaaaaaaagaaaaaacaaaaagaaagaaaagaatgtatatgatataaatcctgaatttgtcaaagaggtaaatacaacatttgtatatattatgacttcaattacataaaaatacatacacataaagagattaaaaggtaatcatataagaccaatgagttttatgttaggatgatttttttgttgctacttttccccctcatattactgaatagatgagatttgtgttaagatgattttattaaccacccacctacttccacccataattttttgttagtgttgtcatattactttttaaagttttctgatttttttttttttgagacggagtttctctcttgctgcccagactggagtgcaatggtgcaatctcagctcaccacaacccccgcctcccgggttcaagcgattctcctgcctcagcctcctgagtagctgggattacaggcatgcaccaccaccccggctaattttgtatttttagtagagacggggtttctccatgttggtcaggctggtcttgaactcctgacctcaggtgatctgccagcctcagcctcccaaagtgctgggattacaggcgtgagccaccatgcctggccaaaagttttccgatttttaaaaaaccatttggccttgacaaaaagatccagagaattctaattatcaaacactcaccattaatgtttaagtagctacaaccaaacagaccaactaaaggaaaaccagctacaacaaaactatttctctattcactatacttctgaacaaatgtttgagttttccacaccaattctctgcagccaccaactgtatgtcccacaatttaattgaattctgacactatctggaattagcacagacctcacagactaagggatcagtcccttaagactgccctccccttctaacaccaatagcaaataaaaggtccccaggttacccacacttttgtctactttggctacatgtcgggaaccctcacaactcccctcctcaggtttgataatttgctatagcagctcaaagaactcagggaaacattttacttatgtttactctaaaagatatcttaaaggatacaaataaacagccagatgaaacagtatgtaagggaaggtctgcagggctcccaagcacaggagcttctgtccccatgaatttagagatacatcaccctcccagcacatgaatgcattcgacaaccaggaagatctccaaaatcactgtttaaagtttttacagaggttccattatgtaagcatgattgactaagtcattggccattggtgattaactcaatctctagcccctctctatgcctgaaggtcagagggtagggtcgaaagttccatagccttaatcttgtggctagtgtctatggcaacaagtccccaacctgaagctatctaggggcccatcaatatcaccttattagcataaactcaggtattgccaaaaggtacttattatgaatgacaaatgacattcctttcacctccatcactcaaggaattccaagttttaggagctccatgccagaaacaagaaaaaagaccaaatatatatttcttattataacaatattacatcaatatttgaaattatgaaaaaaatacatagtattccaagtatttacttcaaataagaacagatgttggctgggtgtggtagctcacacctgtaatcccaacaatgggaggccaaggcgtgcggatcatttgaggtcaggagttaaagaccagcctggccaacatggtgaaaccccatctctactaaaaatacacacacacacacacacacaaagctgagcgtggtggcacacacctgtaatcccctggggagcccagggcaggagaatcgcttgaacccgggagaccgaggttgcagtgagccgacatcacgccactgcactccagcttaggtgacagagagactctgtctcaaaaaaaaaagaacagatgtctgcaataaacaggatatcctagactgctggtaataaaaacaaattcatactacaagatcagtataaaaccgcattaatctctgcaaaaaactatcaaagaagcaaacacaaatttgagaaagaacagcactttactgggagaaaaaatgttattgtttacttatgcaatatcttaaaaagaaatatcactgtcacagaagttttaacaacctaaaacttttttgaaataaatgatttatctattgcagactagttgtttactgagtataatttagacatatatatatatatatttttaataggcaaaatctcactctgtgacccaggctgaagtgcagtggcacaatcatggctcatcgtagcctcaaatttcctgggctcaagccatcctcccgcctcagcctactgagtagctaggactacagatgagtgccaccacacctggctaattttcttttcttttcttttcttttttttttttttctgagacagggtcttactctgtcacctaggctggagtgcagtggtgtaatctcggctcattgcaacctctgcctcctgggttcaagatatcctcccacctcagcatcctgagtagctgggactataggcacatgccaccacacctgactaatttttgtattttttttatagagacggggttttgccatgttgcccaggctggtctcaaattcttaggcgcaagcaatccacctgcctcagcctctcaaagggctgagattacaggcatgagtcatcatgcctggccctggctaattttctttaagcaaaattctttctaaaactggaaaggatacaagtattagaaattaaataatatacaactcaaaaccttggggatttataagctatctataaggatttcttataaaatgtaactttaggggccgggtgcagtggctcacgcctgtaattccagcactctgggaggccgaggcgggcggatcacgaggtcaggagatcgagaccatcctggctaacacggtgaaaccccgtctctactaaaaacacaaaaaaggttagccgggcatagtggcgggcgcctgtagtcccagctactggggaggctgaggcaggagaatggcatgaacccaggaggtggagcttgcagtgagccaagattgcgccactgcactccagcctgggtgacagagctagactctgtctcaaaataaaaaaaaaattaaataaaatgtaactttcaacactgattttgttactctatttcatctgcatcccaccataaaaacaaattagaaagattttcacaaaaagtttgaaaagccatttactatatgcagaccttaagaacaatgctttaaatacattatgcaagccttatactaaatggatagacaaagggctctcactaacccttttctactattaagagctaaaaacgtaacatatagataaagcgagaagttatctttgcaaataacaaatactatttcatgaaaaaaaattcatgtaaagtaattgaggggttcccagggagttttcatacttgacctcttagcttatcacatactctttaggtaaattcatttactcccttaattttcattaacaccattgctgaaaataataaaacactaactttaatccagacctttgctgagtttccaattcatattttcctgtcctgccaaatatatctaattgaatgccttgagagcaccacaaagtcagcttattcaaaaccaaattcatttatctttgctcaaagctttcacccatctacattctccatctcagattatagaaccatcacacactcattttgcctaaatccaaggcatcactcttacttgtctctattccttaaccttcacatccaatcaccaagttaattcaactgcccacttaaattttgaatctatccccctttctccatctccttggccactaccttaattcatgttgcaatcatctctcacctggacgataaaagagacctaatatagcactctatacctctacatccacatttgtagttgtttactaagaaatcaagcaatggatttctcaaagcattgtaaccaaaccaaactcttcattcatctcaacactttaccatcctaggaaaaagtttactttcctcactatgttctccagcttagtcaataatatcctcatttatcaagaacttcagttaaaacctaaatgaactattaaccaggcatggtgatgggcacctgttatcccagctacttgggaggctgaggcaggagaatcacttgaacccaggaggcggaagttgcagtgcactgagatcacaccactgcgctccagcctgggtgacagagtgagactgtctccaaacaaacaaacaaacaaaaattaaaacctaaatgaactaaaacagatatttgcacaccaatgttcatagcagcattattcacaatagctaaaacatgtaaataatccaatgtctgtcaacggatgaatggataaacaaaaggtagtatatacatccacaatgaaatattattcagcctttaaaaggaagaaaattctgataacatgctgcaacatgaagctagaaataattatgctaagtgaaataaaccagacacaaaaggatcactatcgtataattccacttatatgaggtacctagaacagttaaattcatagtgacaggaagtggaattgtggttacagtgggttcaggggaggggaggaatgaagagttattgttttatgagtatggagtttagttgtaatgattgtacaacaacgtgaatacatttcatgccactggattatacacttaaaaatggtaaaaattgtatcttttaaattacgtatattttgtcataatttaaaaaaaatttttttaaaacctaaataagtattatattgcaggcattaccatacagacaaaataattattttaagtatttaagaatgcagagtttctactacatatccttttgggatatagcacaaagccaaaaaaaattgctaaaaaaagaaacagtaaaattaattcaataatcttagccataatattcatattgttaattttaaagctatttatgtatattttagcaaaaaacatttgctaatgttaagaaccaagatattcagtataagaaaaaatgatataaatacagaatcaaataagtaaaaaaccattttatatcttaaatttgaattatcatttgggtttttgtttcatttttttcctgagacagagtctggctctctcacccaagctggagtgcagtggtacaatctcagttcactgcaacctccgcctcccaagttctagcaattctcctgcctcagcctcctgagtagctaggattacaggcgtgcaccaccacacccagctaattagtaaagatggggtttcgccgtgttagccaggatggtcttgaactcctgacttgtgatctgcctgcctcggcctcccaaagtgctgggattacaggcatgagccaccgcgcccagccctgtttcttaacaataattcttatcattcaaaagcttaaaagcaaagacaacccaaaagcaaagcgcaccctacgtgcttatactatggtctctaaccatcactccccactcaaaggaaccagaattttctagagaaatggctgattccagacatgggagagggaatttacaagataaatctgaaacatattattgtgccaaaaagcaaggaagctttttgaacacaaataaggtcctgtcaaaatgacaaacgtcaccttgaaggtactcccagtagctaaagctgagatcattttcacatcagcaaaacacattgactgtaattgactgaaacatgctaaacatatgtaaatccgtgagttcataatataaaaatccatgagttagtcaactaatctttgacaatggaacaaaggcaataaaatgagaaaagatagctgttatcgcttgaatgtccccaccaaaactcatgttgaaatttaattgcaaatgtaatggtattgagaagtgaggcctttaaaaggtgactaggtcatgggagttccaccctcatgaatggattgccattattgtgaacatggatcagttatcatgggaatggctttgttataaagacaagcttgtggccgagcatggtggctgacacctgtaatcccagcactttgggaggccgaggtaggaggatcacttgagctcaggagcccaagaccagcctgggcaacatggtgagaccccgccttaataaatttaggttgggcacagtggctcacgcctgtaatcccagcactttgggagaccgagaagggtagatcaccggaggtcaggagtttgagaccagcctggtcaatgtggagaaaccttgtctctgctaaaaatacaaaaattagccaggtgtggtagcagccacctgtaatcccagctacttgagaggctgaggcagaagaatcacttgaacccaaaaggtggaggttgcagtgagccaagatcacgccactgcactccagcctcggcaacagagcaagattccatctcaaaaataaataaattaattaaattttaattttaaaaaattaactcaaggtcaggcgcggtggctcacacctataatcccagcactttgggaggccgagatgggcagatcacgaggtcaggagttcaagaccagcctgaccgacatggtgaaacccatctctactaaaaatacaaaaattagccgggcatggtggtgcgcacctgtaatcccagctacccaggaagctgaggcaggagaatcgcttgaactcgggaggcggaggttgcagtgagccaagatcatgccactgcactacagcctgggcgacagagcaagactccatctcaaaaaaaaataaataaataaactcaaaatggatcacaaacctaaatgtaaaacacaaaactataaaccctagaagataacataggagaaattactgtggtttgtccattatttttttaggtagaacaccaaaggcgcaatccatgaaagaaagaattaataagctggacttcattaaaatttaaaatgtcagctcttcaaaagacattgtcaagagtaaaaagacaagtcacagactggagaaaaatatttacaaaagacaaacctgataatggactattatccaaaatatacaaacaactctttaaattcaacagtaaaaaaataaacaatctaatttaaaaataaggcaaagaccttaatagacaggcatcttacaaaagaagatatacagatggcaaatatgcatatgaaaagttgctccacagcatacaccatcagggtaatgcaaattaaaacaatgggataccacaacacagctagtagaatggccaaaatccagaacactaccaccatcaaatgctgacaaggatgtggagaaataggaacaggaattcattgctggtggaaatacaaaatgttacagctactttggaagacagtttggtagttccttacaaaactaaacatactcttactatacaattcagtaatcacactccttggtatttacccaaatgagctaaaaacttctgtccacaccaaaacgtggacatagaagtttaaagtagctttattcataatagctaaagcttgtaattgaccaagatgtcccccagcgggtgaatcaataacttactagtacacccagacaatattctccagcgttaaaaagaaatgagctattaagccatgaagacaatgaagaaacttaaacatatattactaagtgaaatacaaagtgaaaggagccaatctgaaaatgctacatactgtaagattccaattatatggatttctggaaaaggcaaaactatgaaaaaagtgaaaagatcaatgtttgccaagagttaaggggaagggaaggatgaataggcaaaacacagtggatttgtacagaagtgaaagtactctgtatggtattataacggtagatactaaaaatttgtcccaaaatctacagaatgtacaacaccaagagtgaaccctactgtaaactgcagactctaaatgataatgatatgtcaacataggttcacgaatcataacaaatgtaccactctagtggggaatgttgataatgggggagtctatgcatgtgtaggggcaggaagtacatgggaaatctctgtaaccttcactcaattttattgtaaacctacaactgctctaaaaagtaacttgtttttcaaatctatgaatttccttttctcaagaaagagaaaatcaaaagaaaactaagaaaacctcagtgatcactgctggagtagctagtgtaccaactcttattctaacacttagtaatcaatgaaaaacaattaagtctttatcctgccttccaagtatgcactgaaatttgggataaccaaatagccctggttgatatcgaaaagttctttacagaaaaaatttcagttaatatatgtagaagcaatgaaagatttagaagatcattttgcaaatactgctgaaatctaacccaaatgacatcataaaatcttctttgaatgttcttactcaaataagaagtctttccatcctttaaactcgactacgtcccttatttatatttcctcttgcagcacttactcataatacaaggaagaacaaagtggtgtcagtggtagtttgttatggtaattaccatcaatgaatcaggcctatgttttcatgcccttgtaattctcttatgtaatcctcccctacataaactctgggctggccatgagacttgccttgactaatggtagtagcaaatgagacacaagcagagacttgaaaggcgtctgtctgcacaatgggatttgttctcttgttgctggaaactcctctgccaccacataaacccagactagccttagacacatgtggcccaatggataaaaccagcaatatgactgaaggtaccttagatcatccattctgttttccaccttattttctttttatagatttagtgggtacaagtgcagttttgttagatgggcatattgtatagtggtgaagtctcggcttttagtgtacccaccaccctaataatgtcactgtacagaataggtaatttttcatccctcactctcctcccaccctcaccctttccccatttccatctttacgtctatctgtatccattgtctagctcccacttataagtgagaacatgcagtatttcactttgtttctgagtgatttcacttaggataacggcctccagttccatccctgttgctacaaaagacatgatctcattcttttttatggctgagcagtattccatggtatacagaaaccacattttctttatccaatcatctgttgatggacacttaggttgattccaagactttgctgtggtgcaaagtgccatgataaatagccatgtgcagctgtcttttttatacagtgatttgttttcctttggatatatacccagtactgggactgctggattgaactgtagttctgtttttagctctttgagaaatctccatactgttttccacagaggctgtactaatttacattcccatcaacaatgtatgggcattcccttttctccacatcctcaccaacatgttgttggttttgttttttaattttttgtaacagccattctgactggtgtaagatggtatctcaatgcatttttaatttgcatttctctgattagcaatgttgagcattttctcatgtttgttggtcacttgtatgtcctcttttgagaaatatctgctaatgtcctttgcttactttctgatggacttgtttttttcttgttgcgttccatgtagattccggatgttagtcctttgtcagatgaatagtttgcaagcattttctcccattctgtaggttgtctgttgattatttctttggctgtacagacaatttttactttaattcccattttttttctatttttgtttgtgtatttgcttttgaggtctcagtcataaattcttcgcccaggctaatgtccagagagattttcctaggttttcttccagggtttttacttccaggttttttgtttgtttgttagtttgtttttgaggcagagtcttgctctgtcacccgggctggagtgcagtggcgcgatgtcagctcactgcaacctccacctcccaggctaaagcaattctcctgcctcagcctcccaagtagctgggattacaggcatgtgccaccacatctgactaatttttgtctttttagtagagacatggtttcactatgttggccaggctggtcttcaactcatgacctcaggtgatccgcccgcctaggcctcccaaagtgctgggagccatcacacttggcctagtttgaggtcttacatctaagtctttaatccttcagttaatttgagttatctttcgtatatggtgaacaatatgggtccagcttcattcttctgcatatggctaattttctatttattgaataaagtatcctttttctatttattgaataaagtatcctttccccgctgcatttccctacccccaccacaccctcaggtctccccttaccactcacccaccagcccatgcccccatggcctctgcccctgcctttgcttgcctctagccctgcactcagatcccaggcccataatcagaaaccacagtgcatatttttgtcaacttcatcgaatatcaattagtataagtatgtggctttatttctgggttctctcttctgttccattgacctgtgactatttttataccagtaccatgtttactgtagccttgtagcataacgtgaagtcaggtaatctgatgcctcccactttgttctgcttaggattgctttggttattcgctctcttttttggttccacacgaattttagaattgttttttctaattctatgaaaaacaatgttggtaatctgacagaaattgcattgaggctgggtacactggctcacacctgtaatcccagcactttggaggctgatgtgagagaatcacttgaggccaagagtttaagaccatcccctgggcaacataacaagaccttgtctctacaattttttttttttttttgagaaggagtctcgctctgtaacccaggctggagtgcagtgatgtgagctcagctcactgcaacctccacctccagagttcgagcaactctcccacttcagcctcccaagtaactggaagaaaaggcgtgcatccccacgaccaactaatttttgtcttttcagtacagatggggttttgccacattggccaggctggtcttgaactcttgacctcaggtgatccacctgcctcggcttcccaaagtgctgggattataggtgtgagccaccgcacctggccaagctttgtaaatttacttaacttctctaagcatgaaattcccatttgtaaagtgaaactaataatgtcagcctcacagaattgttgcaaagattaaataataaatataaaatgtttaaattagtgtctggcattatggtagatacactataaatagacacatattattattaagtacatctctctacacaaaaaagacctagaatcaaaatttaaaagctgtccaggcacagtggtttgtgcatgtaatcccagcactttgggatgccaaggtgagagcatcacttgagccaaggagttcaagactagcctggataacaaagtgagaccccgtctctacaaaaaatacaaaaaagtagccaggtgtgctggtgtgggcctgtaatcccagctactagggaggctaagccaggaggactgcttaagcctggaaaggctgaggttgcagtgagccgtgatcatgctacttgcactctagcctggacaacagggcaagaacctgtcttaaaaacaaaacaaaacaaaacaaaaacaaaaaaagctggaaggtactcagaaatcatttggtccaattgcagtgacttcatacatgaagaaactaaaagaaagaatagctggcttgcctgacaacgctctgctatctaatggtagagttgcaattaacacttaggtttctgggatctcaactgatattttccctacaatctcaaaatgtttcttgttcatctctctgataacaattaagcctaacttttctaatctcaatttcttcattgataaactctaaggacaggatgaattcacaggatcttccaactccaaaattctcattctatgattgatttggagccataaattggctgacctaaaaggatgtcaaacatatttccagtatctgtatatgcttagttttcttatggtcatatttaaaattctaaaacttaagttattagttacatgaaaataatttgtctctcacaagcagccaagtcagtaagagactgagactatcagaactcattatagataagttcctagtacctaaattgagtttacatatatcatacaattaacttaatattaagtgaaatattaagtgaatataagtattattaagtgaaataataaaagttttaaaaatacccaccatatgattaaaattgacctacatatgttaggcaagtttaaagtatagggtgttttgattcatcaaatatgaatagacagctacaaaaacataccaaaataagggttaacagtctgctttaaagaagaagccacttttcattttatttaagtcttaaactcacttaagggaacagggaaaggtactgacaataaaatttcttgaacagagatctgtggatcatgctcaaaatcatggactgtgaaacaaacttaaaaatctgggccgggcgcggtggctcatgcctgtaatcccagcactttgggtggctgaggtgggcagatcatgaggtcaggagttcaagaccagcctgatcgaaatagtgaaaccccgtctctactaaaaatacaaaaattagctgggcgcagtaccacacacctgtaatcccagctactggggaggctgaggcagaataatcgcttgaacctgggaggcggaggttgcagtgagccatcatcaaagaccaaaagtagataaaaccacaaagatggggaaaaaacagaacagaaaaactggaagctctaaaaatcagagcgcctctcctcctccaaaggaacgcagctcctcaccagcaacagaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaacgcagaagcctcaggagccgacgcgatcaactggaagaaagggtgtcagcaatggaagatgaaatgaatgaaatgaagtgagaagggaagtttagagaaaaaagaataaaaagaaatgagcaaagcctccaagaaatatgggactatgtgaaaagaccaaatctacatctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaaggtcagccagagagaaaggtcgggttatcctcaaagggaagcccatcagactaacagcggatctctcggcagaaaccctacaagccagaagagagtgggggccaatattcaacattcttaaagaaaagaattttcaacccaaaatttcatatccagccaagctaagcttcataagtgaaggagaaataaaatactttacagacaagcaaatgctgagagattttgtcaccaccagacctgccctaaaagagctcctgaaggaagcgctaaacatggaaaggaacaaccagtaccagccattgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatgaaactagaactcaggattaagaatctcactcaaagccgctcaactacatggaaactgaacaacctgctcctgaatgactactgggtacataacgaaatgaaggcagaaataaacatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaagacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaatgaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagggtccaggaccagatggattcacagccaaattctaccagaggtacaaggaggaactggtaccattccttctgaaactattccaatcaatagaaaaagagggaatcctccctaactcattttatgaggccagcatcatcctgataccaaagctgggcagagacacaaccaaaaaagagaattttagaccaatatccttgatgaacattgatgcaaaaatcctcaataaaatactggcaaactgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaagcctttgacaaaattcaacaacccttcatgctaaaaactctcaataaattagctattgatgggacgtatttcaaaataataagagctatatatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaacaaaagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatattgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactatctgacttcaaactttactacaaggctacagtaaccaaaacagcatggtactggtaccaaaacagagatatagataaatggaacagaacagagccctcagaaataacgccgcatacctacaactgtctgatctttgacaaacctgagaaaaacaagaaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatatccaaaacaccaaaagcaatggcaacaaaagacaaaattgacaaatgggatctaattaaactcaagagcttctgcacagcaaaagaaactaccatcagagtgaacaggcaacctacaaaatgggagaaaattttcgcaacctactcatctgacaaagggctaatatccagaatctacaatgaactcaaccaaatttacaagaaaaaaacaaacaaccccatcaaaaagtgggcgaaggacatgaacaaacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacgagaggtgctggagaggatgtggagaaataggaacacttttacattgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgtggtggggttgggggaggggggagggatagcattgggagatatacctaatgctagatgacgagttagtgggtgcagcgcaccagcatggcacatgtatacatatgtaactaacctgcacattttgcacatgtaccctaaaacttaaagtataataaaaaaaaagaaaaaaaaaaaaaaaaaagaatcgcttgaatccaggaggcagaggttgcagtgagccgagatcacaccactgtactccagcctggcgacagagcaagactctgtctcaaaaaaaaaaaaaaaaaaaagaaaaaaagaaaagaaagctattagaagatggtcagagaatgacagattacattaatgcatttaatatttcaataatttccatgtagtctgtactccctgtttctattcccttacttcctagtcattcatttccccctgtgactctcttgaaactgaaataggtatgacccaattgtcacattcagcggccacttctcagtccttatttgactcaacttctcttcaacatttacacatacccaacacctggcctctacttgtcttctgagtgctggacctgtattttctcctgcctactgaacatctccacttgggaagtccagacctctagttcacatttatcttcttccccaacattttcttcctcctctacccttaatcttacatctattccaccaccctcacagctacccaaactactcacaagtcaacaagttctagcaattctatccctcttattgaaaatcaatttattctttctccatccccaaaactgctgcctgaattcaaactttcgttatccctagactgagggccagaggtccagaaattctgattcaattgagaaactcaaaaatctggtttgtttttaagaattccaaatgactccaatatgcaacgattttaagaacgacaacaactttctagctgatctctccctaatgaagtcatcctctctacagggccaacaagtagtcaatatatactactgaaaaaccaccaggcatcaagcaccacgttagacctaaacataacaaagaaagacaacaaaatctctaccctggcggggtgcggtggctcacgcctgtaatcccagcactttgggaagccgaggcgggcggatcgcctgaggtcaggagtttgagaccagcctggccaacatagtgaaaccccatctctactaaaaatacaaaaaaaaaattagctgggagtggtggcgggcacctgtaatcccagctactcaggaggctgaggcaggagaattgcttgaacccgggaggcagaggttgcagtgagctgagattgcaccattacacttcagcctggccaacaagagcaaaactccacctcaaaaataaaataaaataaaataaaataaaataaaataaagattacctgggagaaatatttttggagggtttttccttattacagatttgataactttaaaattctctggccgggcgcggtggctcacgcctgtaatcccagcactttgggaggctgaggcaggcagatcacgaggtcaggagatcgagaccatcctggctaacacagtgaaaccctgtctctactaaaaatacaaaaaaattagccaggcacggtggtgggcgcctgtagtcccagctactcgggaggctgaggcaggagaatggcgtgaacccgggaggcggagcttgtagtgagccgagattgcgccactgcactccagcctgggcgacagagcgagactccgtctcaaaacaaaaaaaaaaattttctgtggctccttactgtctacagtataaggtccaaaacccttcaagctacctgttgcaaacatcccatccacatccagaaatacgcacaatccccctactctatactaaactatatcatgctcttggatttgtctggttcctatctctaaaatgcccttctgtcctttttccctccttgcctgagtcactgccatcctctgcaaagacttccacaatctctattccttgccctcccctaccacaccccctctccaccacatagttactttttcttttgtgcttacaaacttttcctctgtgtatctattacacttatcacattgttttgtaattatttatctgtctcctccattaaaactcagcaggttttttttttactctcaagagtgttttgcacagtagttagcacaaaataaatattcggtagtacataaaatgaatgtacctatgttctaagtcctcatctacctcatctacaaaaaaaaaaaaaaaaaatggagattagaaaaataaaggaagtgataagaaaagtgttccttaaagaaatttggagtttataattataataacactgaaacaccattttaaaaaaatcagccaggtgtggtagttcacacctataatcccagctattcctgaggctgaggcaggagggccacttgagcccaggaggcaggggctgcagtgaacgtgacggtgtcactgtgtcactgcactccatcctggctgacagagcaagaccctgtttcaaaaaagaaaaaaataagaaaagaaagttaaacaccaaaaacaacaacaaaacaccaacattagcagcagctaacatttaagactttttttttttttttttttttttgggatggagttttgcttgttgcccaggctggagagtgcaatggcacaatctcggctcactgcaatctcagcctcccaggttcaagcagttcccctgcctcagcttccctaatagctgggattacaggtgcccgccaccacgcccagctaattttttctatttttagtagagacggggtttcactatgttggccaggctggtctcaaactcctgacctcaggtgatccacccacctcagcctcccaaagtgctgggattacaggcatgagccaccgcgcctggctgagacttttatacatattagttatctagttctcaactttataaggaggctagtattattacaactattttactgagacacagagaagtaacttctccaaaactacacagatagtaaatgaaacaggatacaaacccaggtagtctggcatcagagttcatgttcttaactactaaattacattatttctttagctcaagcaaaaggccactggaattagagaagaaaattgagtactagccctggttcttttcatttcttaacgtcttctttattcttagttctagtcctggttctttaatatcttaatctcttctttattcctaacatgctaaaaaaaaaaaaaaaaaaaaaaaaaactactcaaaaagaaaatcattccattagctgtcactttttaaaattcacttcaataaattagcaatactttcatcaaacttagatgggcaactaatctgggaagccttcccaacatctaaaaccagggccctcttgctgggtgttcttggggcatcctgagtttgtccttcctagaactcattcaagagtatagttgtatgaatctctgaacaattcctctctcttccactggacgctaaactccacaaaaaattcatgactactttacccatcattgtctgcacagcacacagttggcccacaaaagatgtctcaaaaaaaaaaaaaaaaacactaatcacagtttttttgttttgttttgttttgtttttaacacagggtctcactctgttgctggagtgcagtggcacgatcttggctcactgcaacctctgcctcccaggttcaagcaattctcccacctcagtctcccaagtagttgggactacaggcgtgcaccacgatgcccggctaatttttgtattttttggtagtgacggggtttcaccacattgaccaagctggtctcgaactcctgatctcagtgatctgcacgcctcggcttcccaaagtgatggaattacaggcatgagccactaagccagcccacagtaagttataatacttaagaaagaaatggcaacaaggtttacaagctgcctaaggtactaaacgttgattaaatttctaaccatcaagtactttaaattcatgtttttctttgaaggactattaagtaaaatattcaatacatacatattggagctacttcactttggttttgttttgaggtttttttgtttttgttttccagcttctttcaagcctcagagaaacaccttagtaagctaatgaaaaaggaggagcaggaggagggacaaaagcaggagaaccagaaaccaaatttccgtaaagtatcctgagacttattgatgatgttcaaacactttgagttctaattgatggtaagcagtttgtctgtttcttcttttaaaaaatgctatttaaaggaaactattcagaagaaaataagaatagttaaaatgaaaagttcatctaaaaacaaaatgctaaaggaatgccacataattttttttttttttttagacggagttccggtcttgttgctcaggctggagtgcaatggagcaatctcagctcactgcaatctccacctcccgggttcaagtgattctcctacctcagcctcctgagtcgctgggattataggcatgcaccaccactcccggctaattttgtatttttagtagagtcagggtttctccatgttggtcaggctggtctcgaactcccgacctcaggtgatccgcccgtctcggcctcccaaagtgctgggattacaggaatgagccactgcacccagccaaggaatgccacataatttcaaagcacagagtccatttcaaataaatctctaaattaacaatagctttaatcttatagcttaatatctgtgctgagaaataagattagcagggaggggtaaaataggttgccatgttacacaatttaaagattcaagttatacttgttggtaaataccacttgtagagttaataaaatatatattctaccttctaaactagtaaatcaccagatttaagacatttatcaaaatgtccctattaaatactcagcattaacactgacccaactacaagataaaagctgaactccttcaaagggactcttacgtcctctcacaatttggtctctagccaccacggtagcttcatctcttactaattgctacagaccatctcacttcctaagcttcattgttcacactcctcacagtactacctgcgccttttatgactccatctctttgcatttgctgttccctctgcctgacatgcccttccctcttctgagctgtgaatatgcccccgtccctgaagcttttcctaattgccctcacctcccacagagtgcctcctgggtcctctgtcctcttcattattctattacatagcactgtcattacttttaaatgttcacctcccaaacagcctgtgagttctaaagggaggacccacagcttaatcaactgtttcctaccccttagcatgaagcctggcatttactgaaactcaatataaatacactgaataaaagaaaattaagtacttaactgtgagaaacacttcaaactttcctactaaagagttaatgcatttaacacagtgattctcaaccagaggcaattttgcccctaggggacatttggtaaaatctggagctatttttggttgtcacaagggggaagggatataggggaatgctactggcatctagtgggggtagatgccagggatgctgctaacatcttacaaggcacagggcagcctcccacaacgcagaattatccagtcacaaatgccaatagcgccgacgttaagaaactcagttgtcaactgacttattcagaagtgatgattcaatatcacatctctgcaataaccacaatcaatttcacttttgtagtttcaacagaagcttctttaacagttgataggtatgcaccaacattaaaaatgatcttcatataatctcgatgtttaactttaaaccaagattactagaaagcatcccatatttctgaaaaccaatctataactacagctgagctacccttaaaccagtaaacacttttatttgtaaacttcaaagcaaaccacaggcaaactaattttcacttgcagaactatgacagaaacacaatctgaaacatgaggtaatcagttcctccaggtctgataaaagaaaaatctcctaaagcctgaaagtaaatcatgcacagatgtctttactgctgaactaaggaagtgatggggaaagtaaaggacatgcccttgttactgccaaaatcatcgcttaccgggatttcaaaattcacaaaacactgcaaaatacaattaaatgtcaacacaggttgtcagataaagaagttaactatttctccctctaataactgaccaagtttcacatgacttcattctttcaggagaaagctaggcagaagcaagagcactcccttcctatctactggatgactcaactctcttccgcacattcctcggctgaatcctacaaattcactaatttcttttgtcctttgaactagttatcctactccctcggtaaagaactaataggctcggcacctacttttcaatcatttacattttgttacaccctatcagcctcaaaaagaaaagaaaaaagctataccaaaaaaaaaaaacaaatttaagttgacaggtacaataactcttacaggaaaagagatgtgaattatgttattctagtaactgattcttaaatgatacacctacagttttctaatgctctaatctttctatcctcaaggttttccagatttcagagacagcacaggcagaaactaagtgtatataccacttgatcaagcttactgcggatttattcttggatagctaaaataaggtagtggggcttgcacagaaaacatatttttaattaaaaaaaaagtttccaacagtgagtaacatcttccttctcggctgactgtgccagtgtcagtcccacgcctgggcccaggctaggccggggctcaccacaccaccctccactgtggtccaaaggagaaagcagggccgtgtgtggcaggtgcgcatcgtgtcaaattggggggcacggggagtgcggcgggtggggaaaggcgaagcaagccgcccgaatctcccatggggcgttctccagcccggcaggcggcggctggcccgtcccacgggcaccaactctccattttcactcccactcagggttcccgggaggaacgcgccggcaccacaccctccagctcgcagcccgctcgcacacacggagccccgcgccggagcgggcgccaggcctggacgcgcggggccaccagggctctgcctgccgccccgccgcgccggccccacccgccctccccgcccccgggccgggcgaccgaggcctaagcgcctgccgggctgtggggcctagggaaggaaggagcccgcgctgaggaggggcgcccgcgccgcggccccgagctccggctgtcccgctcacgtgctgccagaaagacggtttcactctcttaccctctgtaaaatcctccttaacatggtttaaccaccacccggcgccgccgcggtgactctccagaccctgcgcggggccactcactactcggggtgcgcgggcgggagggactgggccgggaggggaccgggaaggaggtcggggcgaggcggtggcgacggccgctcgggcggccccgacttccccacaggcggcgagagggagcacgcgagagagagcgagcgaacgactaggcagcctgcgagcgcctccagcccgcccgccgggcagcccccgtaactgacagatgggcgggcccgcccgcggccgccggggggcggggcggtggcgggcccgcccctcgcctgtccattcgcgggaggcggggctgaagggggccggtccaggccagcgaccaatcggaagcggtggcaacgtgggcggctgcgtgacagacaggcggcaggacgctgtcgccgcagcttcttccggctagctgggggacgccgaggctgcggagtgcacgcctgggctccgtcagagggccgcgcccgcgcgacgaccgcgtgcccgctagtgggaggcgggcgaggacccctgggggtgtccctccctgacccaggcgggaggaggggacgccttaggctgttttgtaaaatgtgtcggtgtgacccttccggcgatggctcctgactcgacgtggtattgagcctgagctatatgctagtttctgctggaaacgctgactctgcctcttagcccctgggttgaagccgactagagaatctcagacgtgcttaaccggtctgttgggcttccctgcccttttccagtcccaggtttcctttccctgctcccttcctgcttctaatttcagccaaagagaaagcaaagatttagaaaagaagggtaggaagaagctggaatttgaattggcaagagaagtttgaggttgtcttttctagatcaaaacaatttttaataggctgatgttcacatgttgcactttctaaagcccgtgcttgacctcctaaggaattttaagtcctattctgataatcgatttatgaagtaaattgtcattaacgcctctgttttatagattaagaagaaaatgaggtcacagataaatatcgtgccaaaacgacgtggtctttgaactgacctccaggcacgatgtcattatttaactcgagaaatcacagcttctgcgtcctaccattctgccaatattcacagccaagaggctcaacttaacaccctggtagaaaaagagaagcctttaatattgcttgaatagggaaggagagggaataatggaactaaccttgctgggagggaaaaaaaaaaaaaaagaaaaaaccaacagaccactgaatgaagcctatgaagcaatgaatggagtgctttttggaaagcacttccagatcttttgaaaagcagcacaaaattaaatattatttgcaaatcagttaatgaataggaaaatgttttgtaaagtataatgcattatataatgtaatatgatatttctatcccaaatatatttggttttttattatgtgtgtgtgtgtctctcgatggtgcagcagcacggtcatgcctacagctaatatatgagtaatcactagtgataatgcacttacaaagaacatacttttccatctttctaaacatgaggtgctttattttcagacaatatgggaaacattctcagcgacatggggtgataaaagtgactttttttctcttttttgtttgtttttcaaaaattagtttagggtcaggcacactgattttatgcctgtaatcccagcacttcgggagacggaagcagacagattgcttgagctcaggagtttcagaccaacctggacaacatggcaacaactcgtctaaaaaaatattagctgggtgtggtggcatgcgcctgtgttcctagctactcaggaggctgaggtgagaggatcacctgagcccagggaggttgagaatgcagtgagctatgatctcaccactgtactccatcctgggtgacaaaatgagaccctgtctttaaaaaaaaaaaaaaaagtttaaaactgcttattaatgttacatgctaagaccttctttactggaattctcatgtagaatcctttgaataatataataggctctcatctacagctgagctagatggattattggaaaatctgtgtactcccctgcacagttcatgataactccatcactgggataatacactggagaacttaattactccaaaagaaaataagcagtgggtgagagctaaccatgtaagaatacccttcactaatctagcagcttcctatacatagcagttctgcttaccctgtctgaccactaattcccatccgttcagctcttgtgcattaatattcccccaccatctatttactttgatccccagcaagacctcaaatccattggcccttcttactttcttaatatcagtcatttccctagcctactcgtttccatcaaaacccaacctaaagcccatggtccaactttacaatcttccctttgcaaatatgcttaacttcttcacctttctttttttttttttttttttttttttttttagatgtagtctgtcgcccaggctggagtgcagtgtgcaatctcactgcaatctgtgcctcctgggttcaagcaattctcctgcctcagcctcccaagtagctgggactacaggcacccaccaccatgcccagctaattttttgtattttagtggagatggggtttcaccatgttgcccaggctggtctcaaactcctgagctcgggtaatccacccacctctgcctcccaaaatgctaggattacaaacatgagacaccatacccggccacttcttcacctttctcttcctccattgcttttgtctagcagaggccaaaccctggttaagttcaattaaccacctactctctgctgcacaggatccataggaatagaaggctgggcacagtggctcacacctgtaatcccagcactttgggaggtgaggggcgtggatcacctgaggtcaggagttcaagaccagtctggtgaacatggtgaaaccctgtctctactgaaaatacaaaaattagccggacgtggtggcgcacgtctgtagtcccagctactggggaggctgaggcacgagaatcacttgaaggcaggaggtggatggaggttgcagtgagctgagatcacgccattgcactccagcctgggcaacagagtgagacttcatctaatacgtatatatatatgaataggaaagtgtctaaatatcactagagatacacatatataactggggttgttgggctcattctgcattaataaccacagatctcaggcatatgtctccacaacaagaatatcaattttctgagcacaaggatcttgtcccccattcagtgctgtgaccccaaaactaaaacattgctcaattcatggtaagcactaaataaatatttgttgaacgaatgaaggaaggattgaaggaatgaaaggtatgtaattactcctttaacagttgcccagcagcattcctgttacactttatttctgtcttctttctcaagatcttcaagatggcctacacatctatagttgctgcactttcttactgtatattttcttctcgacccattccaatcaagcctctgtagcctgtgtcccactgactccaataaggctgttcttatgatcactaatgacctgcatgtttcctattccagtgactactttgttgtttcgacttcgactgtttcctatatagaaaacagttggccactctctccttgagttactttattctcttggcttccttgacactatactttctggtttttctcctcattgcccattccctctatgtctgatggcttctctactgcgtatcttaatgttggagtgcccctactctgttctggggcccttgcttttatctgtcatactcagcctagaagtaatctcaactagtcccctgacttttaatttcatttatcaggccagctacggtggctcacacctgtaatcccagcactttgggaggccgaggtgggtggatcacgaggtcaggagttcaaaaccagcttagccaacatggtgaaaccctgtctgtactcaaaatacaaaaattagcccggcatggtggtgcacatctgtaatcccagctactggggaagctgaggcaggagaatggcttgaccccaggagacggagattgtggtgagccgagatcgtgccactgcacaccagcctgggcaatagagcgagattccatctcaaaaaaaaaaaaaaatcatctacttcatatttcttcttggatgtctagtgagcatatcaaacgtaacatggcccaaacaaaactgtttcatttttatcctcaaaacatcgtcaccagttttcctgtctccatatgtatcactacaagatacttagttgattcaaaccaaaaatctctttatctcaccacttctcctccttccagcgaatccatcaggatatcctgacaaatccacctccaaaatatatcccaaatctgacacttcttgccactttcaccctagtttatagccccttcatctcctgtcaagactactagaatagtcttctagttggtctcccgccttttactttggcttctctgtaatccattcattacacagaagccagggacgactttttaaaatgcaaatcaaaaatgtcactgccctcctagattgtagcttccattatcatcacaatgaaatccaaataccttatcctggcttacacgccctgctgatctgggcctgcctgcttctctgctttccacttagaatatcctccccttgacccactatgccccagctgctctggacttttctcagttgcacaaaacctgttcctgcctgtacaccaaccagttcctatttagggaatgctttctcctgaaatctcatagttaattttgtgtcattcagattattcccttaaggtcacctccttagagaggccttcaaggaccacctcatccaaagtgcttcgaatctctggtcacccattctaattctctacatggtagagaaactaccatttctgacttctcttgtttgtctgcatatgtcttcccaacaagaatgtcaattttctgagcacaaggatcttgtcccctcttcagtgctgtgacttcaaaaccaaaacattgctctattaatggtaaatactaaataaatatttgttgaatgaatgaaggaaggattgaaggaatgaaaggtatagaattactcctataacaattaacttccaaggttcctcaagctaacatcttcctatttatgaagaagtgatccaaatgcaacaatcctgaaagcaacccaacaatcttttgatcctatctgacaatcttttttctttttacataatgtgtatgtatgtttcttgactcttcaaaatttcccaatatttatgggaaacaacctatttcttactttccataaattagaacattgggccaggcataatggctcacacctgtaatcccagcacttgggaggctgaggcgggcaggtcacctgaggtcaggagttcaagatcagcctggccaacatggtgaaaccctgtctttacaaaaatactaaaattagctgagcatgatgacaggtgcctataaccccagctactcaggaggctgaggcaggagaatcccttgaatccgggaagcagaggttgcagtgagccaagatggggccattgcactccagcctgggtgacagagtgagactctgtctcaaaaaacaaaacaaaacaaacaaacaaacaaaacattgttaaggcacctttcttgtcaatttcctgtgctataaccaaataattcatttccaaccagaagcaagtccatgaaaaaaatcacaatatcacttgaacccgcaaggcagaggttgcaatgaaccaaggtcgcgccactgcattccagcctgggcaatagagcaagaaaccatctcaaaaaaaaaaaaaaaaaaatcacaacaaaaataagcaaagtgtagatgatggctctgtataagtaaggccaaaacagtttatggattctttagaatccagacatgaccactaacccaactaaaatagctttttctttcttttttcttttctttttttttttggttttaaattaactgaattgttcacaaattatgttagcatcattgaactaacttgttgaagcctagcatcaagcctatgcttctttcagcccttgagggcagggtagggagggcagtaaagatgaggagctcagaggagttgggagatacatgaattctctagtacttcctgctggttttctccaggccctaggtgacttgcataacctcaaaaaaagtatctggtctccattgaatttatttgaaggcaggattagggaaaattcagaataatagtgaggactaagttctgatttttttatcttgcccaaattcctacctaagggtcctagggagtcatgtcctacaaaccgtaaattctcatcagatgggttttatttgatcctatatatagtgacttacttttcttttttctttttcttttttttttttttttttttgttgctgctgttgagactgagtctcgctctgtcgcccaggctggagtgcagtggcgcaatctcggctcactgcaagctccacctcccgggttcacgccattctcctgcctcagcctccggagtagctgggactaccggtgcctgccaccatgcccggctaattttgttttgtatttttagtagagacggggtttcaccatgttagccaggatggtctccatctcctgacctcgtgatctgcccacctcggcttcccaaagtgctgggattacaggcatgagccaccaatcccggcctatagtgacttacttttcagtcttactctggcataacattatgacacaaggagaaaatattaaaccgcaaaatatattttcttgccataccttgaaaatgtcctgcaaagtctcttgtgggaaaaatccacatcctgtagagaatcccctttcccctttggtttccttctttcctttccagatccaggagataatcaactaagagccaggcacccttttaggtccaataagaaacattttacaacctactctctctctctgtctctttttttttttttttttttttttttttgagatggagtttcaatctttcgcccaggctggagtgaggtggcgcgatctcagctctctgcaacctctgccccccgggctcaagtgattctcctgcctcagcctcccaagtagctgggattacaggtgcgtatcactacacctggctgatttttgtatttttagtagagatgaggtttcaccatgttggccaggctggttcacctgccttgggctcccaaagtgctaggattaccggtatgagccaccatgcctgaccacaacctgttgtctctctgaagtctgctgagagattcttctgcacaataaaacttggtctccacaatcctttatctcaacctgaacattcctttccattaatcccaggtcttcagataaactcaaccagttgtcaatcagaaaatttaaatttacctatagcctgctttaagttgtcccgcctttctaaaccaaaccaatgtatttcttaaatgtatatgattgatgtctcatgctttcctaaaatatataaaaccacgctgtaccccaaccaccttgggcacatgttctgaggacttcctgaggtctgtgtcatgggccatggtcactcatatttggctcagaataaatctcttaaaatattttacagtttgactctttttgtcgacaataattacattttaagatatattataaataatgcccttccagcctaggcaacatagcaagaccctgtctctataaaaatttaaaaatcagccaggcatggtggcacacacctgtagtcctagctacttgggaagttgaagcaggaggattgcttgcatgcaggagtttgaggctatagtgagctacgacagcaccagtgcattgtagcctgagtgacagagtgagacattgtctctaaataaataaatacatgttttaaaataaatgaaaagaaaaatgatgttcttggctgggcgtggtggcccacgcccttaatcccaacactttgggagaccgaggcaggtggatcacttaaggtcaggagttcaagaccagcctggccaacatagaaaccctgtctctactaaaaattcaaaagttagctgggcatggtggtgcacacttgtaatcccagctactcaggagactgaggcactagaatcacttgaacctgggaggtggaggttgcagtgaactgagatcacaccactgtactctagcctgggtgacagagtgagactgtgtctcaaaataaaaataaaataaaataaatattttaaaaatgatgcttttaatatatgaaaagcaatagccaagtctatcacatttaaacttcaagtttgtagagtacaaaatagacaatgtaaaggtggcacaacaaaaattcccatctatgataacagggtgactcttgaatgccagtgtctcctaagcaagacctgcctgtgggccccaagctgagcagcaacaaaatgtaatacaacatataaagtattacaaaagtggtgtgggtacattttagaaacagaactaatatctgaagctatttcctgaaatatgtctgtgggattgtggaagctaaagcaactccatcttagatgctaatccaccatgttgacatctgattaatctgtgttcccggaaggcctctaagatttctactttttccattgttacagtgaatccttcccttaggtcaaaacaaccttgaccataaatcctaccttagccagactcacacagcattcttgccttccccttggaagtcaacttcaattgtgctacacattttttccctgtgatatttaagccctgggtctgaagggtaatggaacgggagtccaccatctcccttttggacatctgagactgtgccttctttttgtaaatccctgttaaatgtttctttctgagaattggttgtatcagcctctttcttcagcctctcagcttcctcagacgttggggtaggtttgcatagacctactcaccacagaacagtggtcaggtgaagttatttagagtgcagtatagagatgtcatcccagcattagtcagagcttagatttctttaaatttgtggagtgtagtgtttttgaaagtgtgttccttgaagccctagagtcctcagaagccacctcagtggatggagaaaatcgagcaattgaggccctgtgctattcacctttgcattagctggtatagctttacttttatctttatgtgttttacataatagggtgatgaagaagaattctttctttctttgttttcctttcttttttctttttcttttttttttttttttttttttttttttggttgtagataggatctcactctgtcgcccaggctggagtacagtgctgcgatctcagctcattgcagcctcaacctcttggcctcaaatgattctcccaccttggcctcccacagtgctgggattacagatgtgaaccactgtgcccagcctgacattattttctttacactgtacacttcaggcatgctgaactattacacatttctgggctcatcatagtctctcccttacttctgaaccattatatatgctatttcatatgcctggaatgttccctacacccatcctactgttacttgtctaattcctactcatctgcaagtctcaccttgcctcccaaacgaaactacatggcctacgtatacctacatttttgtactcaaccctgtaactacagggaagaagagaccttgggtcaaaaactcaaaacactccgggccacatgacaaatttgacaaaaatgtaaggtacgtcttccaactaccttctcttgttctgaatacacacccccaaactgtcaattataattggattcccatgtagttttgtctttaaagagtaaatgcactggtcccattggtacagcacaactcacataaaaaatttgttgccctttgtaaattaataccatttcagcctctgtacgtttgaatattatgagtctgctaagagaagaatttactttcaacatgctgacaaaaattcaagttttgaagctgctgagcaaagattcagagcctggaccacagtgaatttaccaatttaaatgagcatcctgaggtctcttgacagctagccagctggcctccctacatgatataattaggatgatgggctgcatacaatttagacctacagcacttctatctccccttagaatttgatagaaactcaatgatagatgattccagaggctaattctaacaataccattgattaaactcatagattacttagaatggtctgaacatttaaagtaatgcagtaaggactcaaataaatggtttttgtgaaatactaatctgaaaatgtcttgctagcatatagatggcagcataagtaaagaatagagatggtaaagtactctaaagtattattactagtgacattattattttgtaaaaatatattctagtggccgagcacggtggcttatgcctgtaatcccaccactttgggaggccgaggcgggtggatcacgaggtcaggagatcgagaccatcctggctaacacggcaaaacctcatctctactaaaaatacaaaaaattagccaggcgtggtggtaggcgcctgtagtcccagctactcgggaggctgaggcaggagaatggcgtgaacccgggaggcagagcttgcagtgagccaagatcgcgccactgcactccagcatgggcgacagagtgagacactgtatcaaaaaaaaaaaaaaaaaaaaaaaaaatatatatatatatatgtatatatatattctagtgaaagaggtacatacacacattccctctctcatttacatcattgtttctaagtgatatcaaatgaaatttaatattaaaatttgtaagataacataaacaacacaatacactttttttttgttttagatgaagtctcaccctgtagcccaggctggagtgcaacggctcaatcttggctcactgcaatgtcttcctcctgggttcaagcaattctcctgcctcagcctcccgagtagctgggattacaggcgtgcaccaccacgcccagctaatttcttcgtatttttggtagatacagggtttcaccatgttggccaggatggtctcgaactcctgacctcctgatctgcccacctcggcttcccaaagtgctaggatcacaggtgtgagtcaccgcgcccggcccaatatgcctttttaaaactttttcaggacaatgcttgttatgagttaattggctaaaaatgggacccaaaaatatattctattgacatattttggttaatataaaaaatagacatttagatgatgaaaaaaagcaacaaacaaattaacctgaaaagaaaattaaagaacaacttgggaaacatacagtactcctcctcttccttttccctaatgcctctttcctcaggttgtagagcattgtgtggccttcaggaaaaaatatcaatttgctcaattaaattaaaatccagtttgtaatgttgttctgttgacctaaagggaaaaactgaggcaaacggaatgtaagtagagagtttatttgggccaagtttgaagactgcaacctaaaacatagactcaaagttccctgaatatgtactccaactagcagcaattacaagtagctggggttttgttttattttattttatttatgagaaagggtctttctctgtcacccaggctgagtgcagtggcacaaccatggctcactgcagcctgtgcctcgtgggctcgagtgatcctcttgacttttttcttttttttttttttggtagagagagggtctcactgtgttgctcaggctggttttgaactcctgggctcaagcaatcttcctgcctctgcctcccaaagtactgggattacaggcacaaaccaccacacccagccacaagtaggtttttaagggacaagaagaggtgatcttacactgtttactgatatggtttgtctctgtgtccccacccaaatctcatgttgaattgtaatccctacatgtcagagaagtggcctggcaggagtgactggatcatggggggcggatttcctccttacttttctcataaaagtgagtgagttctcacgagatctgatggtttaaaagtgtggcacttcccctttcactctctctctcttcctgctctgctacggtaagacgtgctttgctttccctttgccttccgccatgattctaagtttcctgaggcctccccagccatgcagaactgtgagtcaatctaacctctttttaaaataaattacccagtcttaggtagttttttttttttttttttttttttttttgagatggagtctcgcttcatcacccaggctgcagtgcagtggcacaatctcggctcactgcaacctccacctccagggttcgagtgattctcctgcctcagcctccccagcagcttggattacaggcatctgccaccaccctgggctaatttttgtatttttagtagagacggggtttcaccatgttggccagtcttgtctcaaactcctgacctcaagtgattcgcccacctcggcctcccaaagtgctgggattataggcatgagccaccatgccctgcctcaggtagttctttatagcagtgtgataatggactaatatatgtaccaataatttacatttaaataatataatttattgattggctgtaccatgttctttgtatcacaaatttcaggaacatgaagataatgggcagttcagctagtcagaaacaaaatggctttttttttcttcaaaataggtgtatttaaacagagacagggtttctctatattgccgaggttgatctcaaactcctggcttcaactgattctcttgtctttccaaaatgctgagattacaggatgaaccagcatgccagccaaaatgcctttaaacaattgtccctgactgggcacggtggctcacacctgtaatcccaacaccttgggaggccaaggcaggaggatccctcgagcccaggagttaaagaccagccggggcaacaaaagccatgatcatgccactgaacttcagcctgggcaacagagtgagaccctgtctgaaaaaacaaaaaacctgataaagggcacgttggctcatgcctataatgcgagaactttgggagaccaagaaaggaagattgcttgagcacagcctgggcaacatggtgagaccacatcttcacactcacacaaaaattagccagacatggtggcatgcacctgtagtcccagctactcttgaagctgagtggggagaatcacttgagccagggaggtcgaggctgcagtgagttgagatcatgccattgtattccagcctgggaaacagagcaggaccctgtgtcaaaacaaaaacccaaacaaaaaacaattacccctgggcatagatgcaagatggtggggggttgtaggatgtgactaaagtcacatactcatgtctctctgggcctggcacctcttgcagacctcacatagctcagattgctctgagctatatttctttcctcaattcactcaagaaactgcgctatatatgttgttactgcataacatgatgggaagaaatgtaaaactaataaataatttagtttttttatgagaagtgacaaaaatctttaaaccctttcatatactgaagaaaaagtctgaaatagcatatatcgtaattttaagtagaaaagttaggggtattgaaaccaccttcgcaaaaataaacactgagaaaattatgaaagaggtctgacctgactgactccagcttgcttacactctccaagctgcccttcttcattcctgggtgcaggccaaactaactttgggaggaatttaatttatagtctaactttgaaacaaagatgataacagcagtttcctgaaacaaacctccttcttgccagggggaccagactgcctttgtaagactaacatattaaccacaagattagaaatgatggcttaggagccatgcagccagaagccacaggatttcaaccctccccagttgctcctagggataatattactattgtaaaacctgagattggtgctcaagatattttttagaccctgcattatggtgcatcagctggcacctcctgatcaatcagcactctccactccctggccctctacccaccaaactatccttaaaaaaatgcagtctctaaattttgggggggactgatttcagtaataaaactctagtcttccattcagctcgctctgtgtgaattaaactctttctgtattccaattcccctgtcttaataaatcatctctgtttggacagtgggcaaggagaacccactgggcagttacagtattattaggttaataaatatatttgtccaggagttcgagtccagcctggacaacatgatgaaactctgcctgtacaacaaatgccaaaaaaattagctcagcatattggcccatgcctatagtcctggctactcggaaggctgaggtgggaggattgcttgagcccaggaggctgaggttgcagtgagccgtgatggagcaattgcattccagcctggacgacagagtgagtctctgtctctagaaacaaaaacaatatatatttgtccctccatattgacaatcttgctaaattttaaatactgtgaggtagagtagattaaagggatctattgtaccttttgctctgagttaaaaagttgaaaacacttggaaagagcaagccatttttaaaagctgaaggcattcggaaacaccaagtcatttttcaagcttgcatagtagcttctgacctctagtgggaacttggcttgaataactatgcctacagtgtagagggagccatatctactcttgttttgtttcattctgttgaatttttattttcgtgtcttgtttctgtggtttgaagaataactactaaaatttggtttaagtgtaaatcctctaaagaaattcttgccagagcttttctttatattttaacttgcttactcaagcaacttaagcaacagttaacttaggaagttttttgttgaggtttttttttttttttttttttttttttttccccatgcaaaagaggtatcgtttgtgttgaaacctgggtttcactggacaacacaatttacctgtggttgacctgagtttcactggacaacacagtttacctgtggttggttgtaaaatgttctgtaattcaataaaataaagataaaatacaagactcttttggtggataaaaattaatcaatattttgactttaaagaagctttgtgtttctttttaaaatcaatgttttgactttaaagaagctttggtaagaatgtttcaacactgagtaacattctgttgaactttgcaaacattgtatatgattttaaaagtaatttatgataataggaagttgcattggttatttacttgctctgtattactttatatattgtaacttttcattgcaaagataaaaataactaaacagaaagtttgtaactaagcatttggtagcaccgtctaagcttcttacttatttcatttattcctcacaacaatcctgtgaggtaaaaagtaatgaggtgttttgttgttgtgattgtttgtttgagacggagtttcgctcttgttgcccaggctggagtgcaatggcgtgatcttggctcaccacaacctctgcctcccaggttcaagcgattctcttgcctcagcttcctgagtagctgggattacaggtatgcgccaccacacctggctaattttgtatttttattagagacagggtttctccatgttggtcaggctggtctcgaactcccgacctcaggtgatctgcctgcctcagcctcccaaagtgatgggattacaggcttaagccactgtgcctggctagtcatgaggtttaaaaagattaaataacttgcccaaattaagaagtgattgagcaaagatttaaaaccagacaacctgactcgagagcctgcagtgtcaatgatttctaatacttaaatacctagtatgctggttacactagtaaagaggcaatattattctaggagtttaaatgttttatttacttttttatctatatattttttaaaaaacattctcataagctttcatcacatataactctatggtcttcataattttaatttctaatgcctaacagtctatcaacattagaatgtagaaaatcaatccacaaggaagtttgtttttttatctctattgtttcatttttagtatatatattttaggtttttgttcgctcattaaaaaatgtataacaaatcagaagcatataaagtgcattccatgtgtcattgtataatttttaaaaagctaaaaccatggctctcatctagtacgtatataaagagttgtctgagcatgctggctcacatctgtaatcccaacactttgggaggccgagacaggaggattgcttgagcccaggagtttgagaccagcctgggcaacatagtgagaccttgtctctactaaaaataaaaagaacttagccacctgtggtggcatgtgcctgtggtcccagctactcaggaggctgaagcagaaggattgcttgagcccaggagggcaaagttgcagtgagccatgattgcaccactacattccagcagcctggctgacagagcaagaccctgtctcaaaaaaaaaaaaaatccaaaaacaaaatcaaagagctcatagataagagagtcaacaacaggagaaagccaattcaaaggggcataggacaggtagtcactgaaagaaaaaacaaatgctagactatactagaacaaacaaaaatgctagactacgattactaaattacataaaaactggttagtgccgcatagggtaataaaactaactgttgggttgtagtctgtttaccagcctcacaacatctgcatctctatgggacaaaggttatttgcacttatattacacaatgattatttgcatcactatctggttttctacaatttactttctgctcttacatctttaccaattatcactatctattatattgcatatcttatatatttactttgtttgctgtcttctccattagaacattttcccacttctgtacactgctatatccccaatgcctagaacactgcctagcacatagaatgtacttaaaagtatgtgtggaataaataaataagaaaaaatttttccatgctggctaacacggtgaaatcccgtctctattaaaaatacaaaaaattagctgggcatgatggtgggtgcctgtagtcccagctactcgggaggctgaggcaggagaatggtgtgaacccgggaggtggaggttgcagtgagctgagaccgcgccactgcactccagcctgggtgacagagcaagactgcatcaaaaaaaaaaaaaaaaaagaaagaaagaaaaaaattttttaaatgcagatcaatttgcctttaaaaccacaagctattttttttttaactttttacctttttctctttttttttttgagactgggtcccactctgttgcccaggctggagtgcagtggcatgatcttggctcactgctgccttgacctcctgggctcaagcgatcctcctgcctcagccccctgcgtagctggaactacaggtgcatgccaccatgccctgctaatttttgtatttttggtagaggcagggttttgacatgttgcccaggctggtcttgacgttctgggctcaactgattcacctgtgtcagcctcccaaagtgctgggattataggtgtgagcctctgcacctggccccacagttattttaaaaggaaaaatgggggaaatgtaaagtaaacaaaccccaagtacatttaaatgtaagttaaatcagctgtgtaaaggacacccaagccctcatattggtgattgaacagagaaaagcttgtttctacctatttgtggagagatgaatagaaacgacgtgtgatgaggaaataaaacatggagaaactggagaaaatctactaacccctcgttcttttttttttttcttttaagatggagtctagctttgtcgccaggctggagtgcagtggcgtgatctcagctcactgcaacctccgcctctcgggttcaagcgatcctgcctcagcctcccaagtagctaggatttcaggttcatgcctccgtgcctggctaattttagtatttttaggagagagatttcaccatattggccaggatgatctcaatctcctgacctcaagtgatccacccacctcagcctcccaaagtgctaggactacaggcgtgagccaccgcgcccagccttactaacccctcattctaaaggtaaatggaaggatacaacttgagaatgtaggagagaaaaaaaatttcttttcctctattctttttcattgtgtgggtccctgcaagttagcctgacaaaagatagattaacagaagaaaaggcatacaaattttatttaatgttaatttttagcaaacagaggtgctttttgttttttgaagagatgggatctcactgtgttgcccaggctggtcttgaaaccctgggctcaagcaatcctcccacctcagcctcccaaagttctgggatgacaggcatgagccaccatgcccagcccacaggggcttttctaaaaaatgaagtgaagactcagtaaagcagataggcctaagagcttaagtaccactttaaacaaagaatgataaattgtggagatggaacaaggcaacagaaaagtgttttaggtttccaagggcaaatggtgggaaggtaaatatatgggaggagaaactaatggagtaaggttgatttgtgcaggtccactttggtattgacaatctacagaataggagaaaatttttgcattccatccatctgacaaaggcctaatatccagagtctacaaagaacttaaacaaatttacaagaaaaaaaacaaccccattaaaaagtgggcaaaggacatgaacagacacttctcaaaagaagacattcatggagccaacaaacatacagaaaaaaagctcaacatcactggtggttagataaatgcaaatcaaaaccacaatgagataccacctcacaccagtcagaatggcaattattaaaaagtcaagaaacatggcaaggtccacatcggtggaagaaagcaagcaagctagggtggtagattattacctgtaaaattatctggccctggtgggttttctttgtatgtatgagaaaatttttaaatactaatttaatttttatgataattgtgatttctcctaaattcattcattatattctcttcttttaatttctgtttatcattattgaccttttccctctgtcttttaaaaattattattattttctttttgagtcagagtttcactcttgttgtccaggctggagtgcaatgatgtgatctcggctcactgcaacctctgcctcccaggttcaagcgattctcctgcctcccgcatagctgggattacaggtgctcaccaccatgcccagctaattttttgtatttttagtagagacggggtttcaccatgttggccaggctggtctcgaactcctgacctcaagtgatccacccacctcagccccaaaagtgctgtgattacaggcatgagctaccacgcccaactcttattttttattatttgagacagagtctcactctggtcacccaggctggagtgcagtggcaagatcacagctcaccacagcctccatcttcccatctcaggtgatcctcccatctcagcctcctgagtagctgggactacaggcaggtatcaccaaacccagctaattactgtattttttgtagagacagagttttgccatgttgcccaagctggtctctaactcctgggctcaagcaatcctcctgccttagcctcccaaaatgctcagattacagacatgagccattcttcatttttctggcctattcttcatttttagtttcccattctggccgacttgaccattatcttttgcctagatgactatagaatcttcctctctaaatgattgtttggctgggtgcactggctcatgcctgtaatccaagcactttgggaggccaaggagggaggattatttgagcccaggagttcaaaaccagcctggcaacaaagtgagacactgtaagaaagaaaagaaaagaaaagaaaaggaaagagaagagaagagaaaaagaaagaaagagaaaaaggaaggaagaaaggaaggaaggaaagagggagagagggaggaaggaagggaggaggaaggaagagagggagggaggaagagagggagggagagagaaagcaataggagggcaggggaggggagggcaggggagggaagggaagggcagggcagggaagggaagagaagggaagggaagggattagccaggtgtggtggtagacgctggctgaagaagtaggaggatcactcccaggaggtcaaggctgcagtgagccatgatcacaccattgcactccagcctgggcaacaaagcaagaccctggctcaaaaataaaaataaaaaagtcattgtttatatcacagccagaatggtcatatttaaacataaactagatttcttttcctaaacataacctagcctataaatcattaaccagtttatacacataattctgctccttgttctattctcacttaacaatatattggacctcactatgttcaaatatgacatgggacatacatttttttttcttaaagtattctttgtttatatgaaattcaaatgtaactgggtgttctgtatttttagttgctaaatctggcagccctacttctaccattggtccaacacaaggtggctgttccagttctagcctccactcagccatgggaagagcttaagtaggcttgaggagcacaagtccagttctctttagggcaaaacctggacatgtcacatattacttctgtgcatataccatgggtcaaaacatttccacatttagcttctaaggaagctgggaaatgtagtctttagctaggcaggcatgtagccaactaaaaccctattgccaagaaagaaaagaagaatgggtacgggaaaacaactagtagtcccacattgacaataatcttggccaggtgcgtcggctcacgcctataatcccagcactttgggaggccaaggcagggggaatcacctgaggtcaggcattcaagaccagcctgaccaacatagagaaaccccgtctctactaaaaacacaaaattagccaggtgtggtggcccatacctataatcccagccactcgggaggccgaggcatgagaattgcttgaacccaggtggcggaggttgtggtgagccaagattgcatcattgcactccagtctgggcaacaagagccaggaaggaaggaagaaggaaggaagggagggaggaagagagggagagaagagggaggaagggagggagggagggagaaagcaataggatgggaggggaggggagggaagggaagggaagggaagggaaaggaagggaacggaacggaagggaagggaatcccagcactttgggcagctgcggcaggaggatcacctgaggccaggagttcaagaccagcctggccaacatggagaaaccctgtctctattaaaaataaaaattagcaaggcatggtggctggtacctgtaatcccagctactcgggaggctgaggcagcagaataacttgaacccaggaggggaagtttacagtgagccgagatcatgccaatgcactccaacttgggcaatagagcaagactccatctcaaaaaacaaagaaactaaatgagaacatagtgagaaatgaaaattaaatctgattaggctaatacttaggtttactctgccaggtgctttgcgaaaccttttacacacattatttcattaaatctttttctttgagacagaatctctgtcgcctaggctggaatgcagtggtgcaatctcagcttgctgcaatttccgcctgctaggttcaagagattctcctgcctcagcctctcaagtagctgggattacaggcatgtgtcaccacactgcctaagttttgtatttttagtagagacggggcttcaccatgttggccaagctgatcttgaactcctgacctcaaatgatttgcccacctcagcctctcaaagtgttgggattacagatgtgagtcaccatgccctgcttcattaaatctttattgcaacaagaggaattattattattattattatttgagacacagttttactctgtcacccaggctggagtgcagtggcaccatctggctcactgcaacctctgctcccgggttcaagtcattctcctgcttcagcctcccgggtagctgggattacaggcatgcaccaccatgcccagctaattttgtatttttagtagaaatggggtttcaccatgttggccagtctgctctcaaactcctgatctgaagcgatctgcccacctcggcctcccaaagtgctgggattacaggcatgagcgaccatgcccggccaagaggaatcataattcttatttggcaatagggaaaatggaggttgtaagggttaagtgactttcctaagtcatatagctgataaaagatgtagccagtattcaaaactgaggttaacttcattatgccatattacattcacaccttaaaaaaataaaatcaaggtatctgatatctagacagagtcttactctcttgcccaggctggagtacagtgctgtgatcatggctctctgcagcctcaccctcctgggctcaagaaatcctgccacctcaacctcccaagtagttgggactacaggcatgtgccaccacacctgtctaatttttgtattttttgtagagatggggtttcaccatgttgcccgggctggtcttgaaactcttgagttccagcaatctgtccacctcagcctcccaaatttctgggattacaggcatgagccatggttcctggcctttaaacctttcattatggaaaatttcacatgtgaaaatagaaagaaaaatgtaacaaagccatatgtacctattgcccagcttcaataattatttacaccctgccattctttttttatgaatcttcccttaccccctaaattctcacaattttttcttttatcatggagtattttaaaacaaatcccagtcatcaaatttctctacgtgtaaatatttcagtatgcttccctaatgcctaagaacttgaaaaaagaaacataacaataacattgtcatgcctccaaagaatcatatttaacatccagtccaagtttaacttttcttgattgtctcaagagtatttttatggctgttcaaataaaaattcaaacacagtgcagacattacatattttacatattctcttaagtccgttttttgcttgcgtcagcagcacatataccaaaattggaacgatacagagaagattagcatggcccctgctcaaggatgacatgcaaattcgtgaagcgttccaaaataaataaattcattaattaaaattaaaaaaaattttttttagtctacgcttggtggctcacgccagtaatcccagcactttgggaggccgaggtgggcagatcacaaggtcaggagattgagaccagcctggttcacacggtgaaaccccatctctactaaaaaaaaaaagtacaaaaaattagccgggtgtggcggcgtgtgcttgaagttccagctactcgggaggctgaggcaggagaatagcgtgaacccgggaggcggagcttgtagttagctgagatcgcaccactgcactccagactgggcgacagagcgagactctgtctcaaaaaaaaaacaaactttttttaaagtctcttttaatgtatgacagttccccttcccttgtgtttcctcgcttttctaatgcttttaactctgggatcatgaattaactttgtaacctgctatgtgttcattgaagaagtaaggctgtttgtcctgttgaatttcttacattcagaattgggctgacagttttctcctggtgtcattaatgggtttttccatcacctatacttccagtaagctggtagtttgttgaagaggctagtctaaattcaggttcaagttttttttttaatttgtttttattttttctttgtgggttttatatatatatgcaaggttagaccataggtggtacagtagcttacttttaaaataaactgtgtaactaatttattgaatgtgctgaattggttattataatcagtaaactactttttcttatctactgctaccttcaagcaagcagatctcccttctttgccccagatgacatttcagggagatctcttagctttggggccattctcagatgtgagaagagtctcattttcagctatggaaaattctagttcagtctatattaaactttaatttctcatccaatttaaatctcctgtcctctcttctcatccctattcctcccctgtcttctatgacagctgacaggcaggaccagcattgaggaaatggtacatgatctgtccttttactccatctggtgaacagtctccacagtgtccccgtggttcatggataaccttatgcattcttgcccagtcaaacaatggtggtgtaattgctgccacagcaaccctgtgtacttgccctgtcactagaggtcactctagttcctctataccccctcaaactccaggagacctgatgcaggatttttgctccttagctcagctaagtctgggttcttgtctcacgaccaggaagaattaggcacacaaacatcaaacagtgagtggagtagaatttattaagtgaaaggaaagctttcagcaaaaagaggggacacggcaggaggtgggggtagttctcctacccgaagacaggaaagttccccgatatggctgagcctggggctttttatgggctcagaatagggagtgtgtgctgattggtttgtgagtatccaaaaatggtcatagcaaagacaccactcaaaggtgggcacaacagtgtagaaaaccaattaggaaaaggtaggtatatgtaaaataggtgaagagtggggatcaatcaaaggaaagtgcaccaaacaggaaggtgggttctcaatcccatctgagtatttacccaggacagtttctgtcttgaaggttgggtttcaccagggacctgcccctatctgcctaggcatttgcctgcctcctgcctctatcagacccttgtcaggttctccccaaaacttaattgcctttcagtcctgtagtagcactgggcaggcctacacactcctccagcccagcaggcatctggccaaggagtaaaagtccctcacctgtttctggctagcccctcgattctctaaggggtgctcttactgtcccccttcacttggctccatcccatgtggaacagggaataaatgccagtgtgttctctctttttgtgaagtccccccaaagatgcacctgtcttaatgaaacaccagccttctccgctataggattttgggagtgacaattcctggacgagaaagaatgactgtgtcatagtaaggcctgtgcacatgtgtgcagatacccttttcaaaatgggggctacttcccacccattgtcagcaccactgaggattatcctaaaaataaacaggaaagtcctaatctatattcagacaagtttgttaagatttaccccttgacttcattttataaagtagcttagctaaacatacagaattttctagtttattttaaaatgaatgacttaaagaaactataattttttttttttttttgagacagggtcttgttctgtcacccaggctggagtgcagtggcatgatcactgctcactgaagcctcaacctcccaggctcaagaaatcctcccacctcagtcttccaaggagctggactacagatggacaccaccatgcccagctaatttttgtatttttactagagatggagatttcaccatgttgcccaggctggtctcgaactcctgagctcaagtgatcctcctgcctcagcctcccaaagtgctgggattatagttgtgagccactgcacccagccaagagaaactcaaatataaatgatacccttcaggacatgttttcatgtgtcattgggatgttaataaacatcatatacaagagctaacaaattcttatcttttgtccgtattttagaagacctgggcggcctaccaaatattaacaacaacaaaagcaacaaaagaaaataatttctggcagagcgtggtggctcatgcctgtaatcccagcactttgggaggccgaggcaggcagatcacctgaggtcgagagtttgagaccagcctgaccaacatgaaggaactccatctctactaaaaatacaaaattagctgggcgtggtggcatgcacctgtaatcccagctactcgagaggctaaggcaggagaatcacttgaacctgggagacataggttgcagggagtcatgattgtgccattgcactccagcctgggcaacaagagtgaaactccatctcaaaaaaagaaaaagaaaaagaaaaaaaaatcatttctaaaaacagcagaagacatggaagcaggtccacagtgatagatcagctatgttaaacatactcagtcttgttttctattttagcctttgtacatagaaatatttacttgtttgattcacatctttgttagacacaacctataccattttaattgatgtgttaaggtctatgtgtatttttttaattaatgggtttaattacaattgctgtgtagataattgcttattcaatcctgaagtagaactggaattaggaaatgaaaagagggtccactgactcactacagtcagctgagcacactcttattttgctctcagagtagaggtgaacaataatctaatcaagaactgcatggtggtgagtcagtattcaaagatgaatgggccaaaataagagtttaaaaacatgtgagacgtgtggatggatattacaataggtcaattgcatcacattaaacttattctggacatggctggttaagtatgcttgaatctaagtattatatcttccaaatgtgtgcacttagaaaagcttcaggctcataaaaggatgaatgtttgtggaagaaaggaaggaggaataaaagaggaaaaggggggaaaggaaaggagggagaaagaaagggagagagggaggaaaagcaaaatggttttcactacttcatttcaaccactgagtgagtataaattgctaatgattttttcatggtgtggttaaaatgttgattttaggcctagtcacataaatgaaataaaagtaagagtttaattaaaattatgttatggtaataatcgaaaggatgacagcacagcttgtgtttgaaaaaggaatgttaagagtttatatgtttttgggtttttttttttttttttttcttttgagacagagtcttgccctatcacccagactggagtgcagtggtgcgatcttggctcactgcaacctccatcttctgggttcaagtgattctcctgcctcaccctcctgagtagctgggattacaggaacccaccaccacgcccagctaatttttgtatttttagtagagatggggtttcaccatgttagccaggctggactcgaactcctgacctcaggcaatctgcctgcctcggcctcccaaagtgctgggattacaggcgtgagccaccaagccccgtcatgtttttgtttttaactctggcatcatgaatttactttgtaacatatttaacattccagaatatcaatgtcatgcccctctgtgtgaagagagtccactaacaggctttgtgtgagcaacaaggctgtttatttcacttggatgcaagtgggctgagtccaaaaagagtcagcaaagggagataggggtggggcagttttataggatttgggtaggtagtggaaaattacagttaaagggggttgttctcttgcaggcaggggtgggggtcacaaggtgctcggtggagagctccggagacttaatgtccaggagaaggaatgtcacaaggctaactgatcagtcagggtggggcaggaacaaatcacaatgtcatcagttaaggcaggaactggctattttcattattttgtggtttttcagttgcttcaggccatctggatttataagtgcaggtcacaggggatatgatgggggctcagaggcctgacaatcaagtcattgctttgttctcttggaaactccatttaccaagtcgcttgaatatagttacaaatgtatttaaacacaaagacatggtaattaatagaaaggaaatgttccattaagaaatacaacgtagaatgcatgtttaaagcaaacttgtagaaatagaatttcagggcaagacagtacttcagtcattctcaattctgtgtcacatgcagcagagttaatctttgtgtaagtcttgagtcttggatacagatgctgcagagagggtcacagccatggtcttgtggggctcacatagaggctgcatcccttgaattgccctcccccttctccctccattgcatgggaatatcgttcaacctgctgtgaatttgccatgtggtgctgtcacccttccttcatttcagtcccttgaagtaatctacaaggacatggaaggagatgagaaattgcctcatggccaaagtaacccttctcttcagggtgttcctatggtattttattttgttttatattttttttatttatttattgtttgtttgtttattcttttgagacagtctcactctgctgcccaggctggagtgcaatggcatgatctctgcccactgcaacctccgcctcctgggttcaagcaattctcctgtctcagcttccagagtagctgggattacaggtgcctgccaccacacctgtctaatttttgtatttttaatagagacagggtttcaccatgctggccaggctggtctcgaactcccgacctcaggtgatctgcccgcctcagcctcccagagtgctgggattacaggcatgagccactgcacccggcctattttattttttgagacagagtcttactctgtcacccaggctagagtgcaatgcatgatctcggctcactgcaacctctgcctcccgggttcaagcgattttcctgcctcagcctcccaagtagctgggattacaagtgtgtgccaccatacttggctaattttgtatttttagtacagatggggtttcaccatgttggtcaagctggtctcgaactcccgacctctggtgatccacccgccttggcctgccaaactgctgggattacagatgtgagccaccgtgcctggtcccctctggtattttatatgactatattgcactgatcacattgatcattttaatttcttgcccctaaaatattcactccatataaattgagttcatattcattttggaatcctcattgaacaggctttcttgtatgcccatactgatcaaggtctgtgttagatattacatttaaaattgaacaaagtaggtgtggtccttaaattttggaagggttgctggcatctgaggaagacagtcattatctaaatcaacaggaaaaatagaagattgcaagttgtattatgaaggaagagaccagggttccaggggctagaacaataggagaggcagaatcaaactgaggatttagcaaagcttctttgaggaaccaacatttaacttgaggcccacaactaggagctattccggttattcaggctttgagtgaaaagaggaatgtgcctgccatatggggcaccacatgggaagctgggggcaactggacctggaatacattgggcaaggagtgagtgatgggggagggtcagggcccaggggctgtggggccttagaggccacattagggattttgtattttatcccaagtgcaaactatttaaagtttgaagcaggtaagttgcagtggctcatacctgtaatctcagcactttgggaggctgaggcaggaagatcgattgaggccagaagttcaagatcagtctgggcaatatggtgagacccccccgtcatcgctacaaaaaatttgtttttcaaaacattagcaggcctggtgccacatgctatagtaacagctacttgggaggttaaagcaggaggatcacctgagcccagaagtttgaggctgcaatgatccatgactgtgcctctgcactccagccttggtgacatagcgagactgcatctcaaaaacaaataagtaaataaaaaataaagttcaaagttggcaattgatgtgatttgcataccctgccttgtgttcactggccagtattgaatatttagaaataaactaaacatgaacaatgaatcaatgatacagttcatctatgccattccctagttttaccaaccacaggcaattagattaatgcaatatagtttgttcttagaaaatatgtagtagaggccgggcacggtggctcacgccttaatcccagcactttgggaggccgaggcaggcagattacctgaggtcaggaattcgagaccaatctggccaacatgatgaaaccctgtctctaccaaaaatacaaaaattagtcaggctgtggtagtgggtgcctgtaatcccagctactcgggcggctgaggcaggagaatcacttggacatgagaggtggaggttgcagtgagccaagaccgtgccattgcactccagcctgggcaacagggccagactcagtctcaggaaaaaaaaaaaaaaaaaaaaaacctgggcgtgatggctcacgcctgtaatcccagcacattgggaggctgaggcgagtggatcacctgagatcagcagtttgagaccagcctggtcaacatggtgaaatcctgtctctactaaaagtacaaaaattaactgggtgtggtggtggcaggtgcctgtagtcccagctactcaggaggctgaagcaggagaatcacttgaatatgagaggcggaggttgcagtgagccaaaattgcaccattgcactccagcctgggcaatagagagagactccagctcaaaaaaaaaaaaaaaaaaaaaaaaagagagaaaagaaaagagaaagaaagaaaagaaaaaaaagaaaacatgtagtagaaatttgttttttttttgagatggagtttcgctcttgttgcccaggctggaatgcatgacgcgatctcggctcactgcaacctcctcctcctctcctacctcagcctcccgagtagctgggattacacgcatgcaccaccacgcccagctactttttttgtacttttagtagagatggggtttctccatgttagtcaggctggtctccaacttccgacctcaggtgatccaccaaccctcggcctcccaaaatgctgggtttacaggcgtgagccaccgcacctggctgttgacttttagtcactcaccattccctttccttttctactaatccctcattttattttggataagtacactgtgatggttaattatatgagtcaactcgactgagctaacagatactaggatagccagtaaaacatcatttttggatgtgtctgtgagagtggtaccatttgaatcagtaacggagtgaagaagatctgccttcaccagtgtgactgttcagagcacaaacgaaacaaaaaggcagaggaggggtgacatcactttctcttcttgagccaggacatctatcttctcttgtccttggacatcagaattcctcgttctcaggcctttggactctaggacttgcaccagggttcccaccaccccgtcccagttctcagtccatcagtcttggactgggatttgcaccactggcttctctgcttctcaagcctttggcctcgactgaattatatcactggctttccaggttctccagcttgcatcgttcatttgtttcttggccatttgggagtctatacatttttttacacttcctttccaagaaatcaaatacagggctgccagttgggcacaccctcaatgagtatggctgatgctacttgccatgacaacgttgcctggtttcctaatgttaacgttagctcctaccttctaagttgggtcactgaagtccacctttataagtgggtgtgttctggaaatagctgtttttctgtagacacagtatctgtgatccctgtattggatccactgagttataatactctcctaaatctcactatgggaggctagtctatgtaattgaactattgaacttctgcctcaagagctaaaacccagctctacccaactagagccctgtgaagtcttagcattccccttcctgggggcctagagactctctactaatccccaattgctgtctagggctctactctaaaaagatgaacaggccaggagtggtggctcacccttgtaatcccagcactttgggaggccgaggcgggtggatcacttgaggttaggagttcaagaccagcctgaccaacattgtgaaaccccgtctgtactaaaaatacaaaaactagcatggcctgggggcgcacagctgtaatcccagctacttgggaggctgcgggaagagaattgcttaaacccgggaggcggaggttgcaaagggccaagatcacaccactgcactccagcctgaatgacagagagagacttagcctcaaaataaaataaaataaaataataaaaagatgaagattcataagcaagttccatgctaatttgaggcattacctcttcatggaggcctttactgacatgcttcaactgtaaactggactctcttagatattagcattggatacatttatgtcaagtctgccacttccctttgaacaccaaattggaccacctgctagcatccttgcgggtctgagtcatagtcatgtcatgtgccccatcctggctccaaccactactttctccccaccagccaggcaccaggtccctgcatgccttgaggctgacctactagataatgacatctgtcctttttcctcggttattaatgtctcgattaaatataatttttattgatttgaacttttaagcaaataaaaaaattgttttgcttcattgaaatctccttctttgaggtcaaaaaatgataatgcacaaatctttttcttttttttgagacggagtctcattctgtctgtcacccaggctggagtgcagtggcatgatctcggcacattgcaacccccacctcctgggttcaagcaattctcctacctcagcctcccaagtagctgggattacaggcatgtgccaccacacctggctaatttttgtatttttagtagagacggggtctcactatgttggccaggctggtctcaaactcctgaccacaggtgatctgcccacttcagcctcccaaagtgctgggattagaggcataagccaccgtgcccggctgacttactttttttaaaaaaaaaactttaaaaaattttaatatagatgggatctcactatgtttgcccaggctgatcagaaacccctggcctcaagtgattctcctgcctcagcttcccaaattgctgggattccagatgtgagccaccatgcctatttttttttgttgtttgtttgtttttgttttgttttgttttggtaactctcatagcttttattgttttcctgcccaggattcaaacatttcaatccaagttacatactgaattaaaatcattttggcaaggataagcaagtatcccttaaaatttaaacaagaaaaaattttgtctgatatttcaatggattttcatactttaggtcagcatatttctttgaatttagatatgtggaaatactgtggcatttggtttacaaaataggccattcagtaagaccgtaatgtggacagaaagttctgtagaacacagcagcatggggaagcaagtgattttttgccaagcttactccaggtacttaaacatggcccaattctgcagtgaaggagaaaagcataattaaaatttctaaccttgtaccttcttcttctgttcttatgcacaaaatttcactcccaactatgccctttacacctcttttccaacctctgctcttccagggtatgactatgctgtttggtttcatttgtccagaaatatatcaggcagattccagaattctgagagaggaaaccattgtttttttaggaaattatattctctcttttttttttttttttttgagatggagttttgctcttgttgcccaggctggagtgcagtggcgtgatctgggcttactgcaacctccgccttccggtttcaagcgattctcctacctcagcctcccaagtagctgggattacaggtgtctgccactacgcccagctaatttttgtatttttagtagagacggggtttcaccatgttggccaaactggtctcgaactcctgacctcgtgatccacaggcctcagcctcccaaagtgctgggattacaggcgagagccaccgcacccggtcggaaatgctattctctattggcacttggaacaaatcatttacaagctcaaaatgtttccataatatattttagaaaagaaaagaaaaaaaaaagatcaagttgcacatcaggaagtttttcagagaaaatattatcactgccaatcactagtcatgttttattgcctcggcaaaacaaatgaataagaaatatttgttcccataaaagcacaactgtgattgcaagaattctgaaatttgatttggttgctagtggaatgagtctgaccattaatctctgaactatgacccttttcatacgttaggatttgacgtcaacccgaaaatgggaggattagccacatttttgaattctagaagtttggctagttcataagcgctatccaagtgcttttggtgaggactaacctctaatttttttaatcttgcccaaattcctatctaagaggtctggggagtcatgccctacaaatcataaattctcatcagatgggttttattcaaccctatatatcatgatttactttccaacctgactctggcataacattaggagacaaagaagaaaatcaaaatattttacccccaaaacatgtttcttgtcatattttgaaatggccctgcaaagctgttctttgtggggggaaatttgcatctgtaaagaatctctattaatatagctagatctttttcttccagaccctcccaatcctaaagagattaactaaaatctgaatagaaaacatttgtcacctattgtctctaaatgcagccactataagacttcaaaagaactttggtctccacagtctgttatcttaacctgaacatcccctttctgtttatcccaggtctttagacaaactcaaccaattgttaaccagaaaatgtttaaattcacctacagctcccactttgagttgttccacctttctggaccaaaccaacgtatttcttaaatatatttgattgatgtctcatgcctctctaaaatgtataaaaccaagctgtgccctgacctccttgggcacatgttctcgcatgttctgagggctgtgtcacgggccatggtcactcatatttggctcagaataaatctcttcaaatattttacagagttcgactctttttgtctacaggtgaatggtggtttttagatagcaagttttagaaaattgaaaactgtttgaccactcacttggtcgttctttattgtatcagcctttgagtgtagattgccctgactagtgttccagttcactgttcccatagaaaggtgatatttcttttctttctttttttttttctcttaaataatatgttatttatttttgctggtttgggagttgctttttgttttgctttctgttttttttttttttttttaatttgactttaacttctgggatacatgtgtagaatgtgcagttttgttacacaggtatacatgtgccatggtgttttgctgctcttatcaacccatcatctaggtttaagccctgcatgcattaggtatttgtcctaatgctccccctccccttaacccccacaccccaaaaggccccggtgtgtgatgctcccctccctgtgtccatgtgttctcattgttcaactcccacttatgagtgagaacaggcagtgtttggttttctgttcctgtgttagtttgctgagaatgatggcttccagcttcatccatgtccctccaaaggacatgaactcattcttttttatggctgcatggtattccatggtgtatgtgtgccacattttccttatccagtctatcattgatgggcatttgggttggttccaagtctttactattgtaaacagtgctgtaataaatatacgtgtgcatgtgtctttatagtagaatgacatataatcctttggatatatacccagtaatggaattgctgggtcaaattgtatttctggttctagatccttgaggaattgccacactgtcttccacaatgggtgaactaatttacactcccaccaacagtgtaaaagtattcctatttctccacagcctcgccaacatctgtggtttcctgactttttaataattgccattctaactggcgtgagatgatatctcactgtggttttgatttgcatttctctaatgaccagtgacaatgagctttttttcatatgtttgttggccacataaatgtcttcttttgagaagtgtctgttcatatcctttgcccactttttgatggggttgttttttcttgtgaatttgtttaagttccttgtagattctggatattagacctttgtcagaaggaaagattgcaaaaattttctcccattctgtaggttgcctgtttactctgataatagtttcttttgctgtgcagaagctttttagtttaattagatcccatttgtcaattttggtttctgttgccattgtttttggtgttttagtcataaagtctttacccatgcctacatcctgaatggtattgcctaggttttcttctagggtttttatggttttaggttttacatttaagttaatttttgtataaggtataaggaaggggtccagttcctgttttctgcatagggctagcctgttttcccagcaccatttacttaatagggaatccttctccattgcttgtttttgtcaggtttgtcaaagatcagatggttgtagatgtgtggtgtttttctgaggtctctgttctgttccattgttctatatatctgttttggtaccggtatcatgctgttttggttactgtagccttgtagtacagtttgaagtcaggtatcatgatgcctccagctttgttgtttttgcttaagattgtcttggctatacgggctctttttggttccatatgaaatttaaagtagtttagaaaggtgatatttcttaaggatggtgtgacggttaatactgagtgtcaacttgattggattgaaggatgcaaagtattgttcctgggtgcctctgtgagggtgttgccaaaggagattaatatttgagtcagtggactgggagagacagacccgccatcaatctgggtgggcaccatctaatcagctgacagcatggctaggataaagcaagtagaagggctgggcacagtggctcttgcctgtaatcccagcactttgggaggccaaggtgggcagatcacctgaggtcagttaaagaccagcctgaccaacatgctgaaaccccgtctgtagtaaatatacaaaaattagccaggcatggtggtgggcacttgtaatcccagctactcgtaaggctgaggcaggagaatcacttgaatccgggggacggaggttgaagtgagccgagatcgcaccactgcactccagtctgggcaatagagtgagactcagtctccaaaaaaaaaaaaaaaaaggcaggcagaagaacatggaatggctagactggcctccatctttctcccatgctggatgcttcctgccctcgaacatcagactctaacttctttggcttttggactcttggacttacaccagtggtttgccaggggctctcaggctttcggctacaaactgaagacttcattgtcagcttccctacttttgaggttttgggacttggactggcttccttgctcttcagcttgcagacagtctattgtgggactcaccttgtgatcgtgtgagtcaatactccttcataaactccgtttcatttatacatttatcctattagtcctgtccccctagagaaccctgactaataaggatggagagtgggatacacttttcccaactcactctatagagccttctgtcacacatacataaaaatgtgtatcctcagctggaagggggatgtcaaatttatatactgattaaaatttgtcaacacaccataaaaattcatggaatagtactgtgccatgcattcaggtacagaactattgtcttaggtctggtttgaaaaagcagcttactctggctaagaaggaagctttccttgacaaataaaaaatccatctttgtggctgagggtcttggctggttagtgtaggccagtgttttcaaagtgcctcacaaatgagatgagttttagtagtatatagacacagcaatagctaaaatagttatcctgtgatttctttccaaattctctttaatccttctgattacatcaagaagaaaattttgatttggtactgctacttttttttttcttttaaccacttctctttttttgtttgtttgttttttgttttttattggtgctgcacaaattaaaccacttctcttctaaagaatgacagagagagaaggtgcaaggaagccttaggctcagagctttcagtagacaatcctgtcttattaggatttaataacactgttttgctttcgttgtgattagttttacaattaccttccctttctgacaaatgacaccagtcgtgtaacatattggtggagcacatggcagcttgcttcccccagagcaagcgctggggagtggggacccatgatggaagtgagtctttttattacctaatctcaaaatgacatcctatcactctaccatattctatttgttaatagcaagtcataagttgagtcaacactcaggagagggggatcacacaaggacatgaataccaggaagcagtgatcatttgggccatttcagaagtgtttgccacagggatatattgcaattgctgttttccttcttttctccaagaaataatatgctccatgggaacagagatagtgtcttgttcattgggagcattcctagcactggacatagtgcctgagacttaaactgctcataaatgtttctttgaaggaaacgaaaaaggaagggagggaggaaaggagggagggaggcaggaaggaagggaggaaatgaatcagcatgagaagatcagggcactttgctaatccatagaaaacaggagatggttctttggggaaggaaaactcaaccataaaaaggattgtgaagaacagagtcagtacttttatttatttcctagtcttgagcataaatgagcttctaggaaagtggaagcactctgtgaagagacaacgcccaccatcttgctcccagggtagcttctgtggatggtggagagctgagctataaaatagcacaatgtgttacccatggaagggcagtcctggttgaggttcttaattgtgaatgtacagattctgttgaatgaattgtgataacctccaattatcaggaaagaatcaattagggagaactccttggtgctttttttcacttgcacttgcagagtgcagcaagaagttacactgaatgcacatagactgctagactgctttggcatttaaaattatagaataaacatatcactttgttagcataattctttttgtgtgtgttgtgggggtgacagcatcttactctgttgctgtggctggagtgcagtggcacgatctcggctcactgcctcaagggtttcttgaggcacctcgacctctgttcaagggtttctcctgcttcagccttccgactcgacctctgttcaagggtttctcctgcttcagccttccgagtagctgggattacaggtgcctgccaccatgcactaatttttgtatttttagtagaaatgaggtttcaccatcttggccaggctggtcttgaactcctgacctcaagtgagtgatctgctcacctcggcctcccaaactgctgggattacaggtgtaagccaccatgctcagcctttgctagcataattttaatggctccataatatttaatctaacagatatggcacaagctgtttggtcattactctactgttgcatttatgggttgtatccattttcttctttttttttttttttttgagacagagtctcactgtcgcccaggctggagtgcagtggcgtgatctcagctcactgcaacctctgcctcctgggttcaagcgactctcctgcctcaggctcccaagtagctgggattacaggcatgcgccatcacacctggctaatttttctatttttagtagagatgaggtttcaccatgttggccaggctggtctcgaactcctgaccttaggtgattcacccacctcggccttccaaagtgctgagattacaggcatgagccaccgcgcccggctgggttgtatccattttcaactgttatataaaatgcttcaataaatgcttttgtaaacttatctttccacaattgtataaatatctccttaggttgaattcctagaaatggaattgcagggtaaagagtatgcactctgtgtgtgtgtgtgtgcatatgcatttgtgtatactgtcaaattgcccccagaaattacgtataaactttcattcccaatttatagatgtttatacacatttgatgagacaagattttagctgggctgggtgcagtggcttacatctataatcccaacactttgggaggctgaggtgggaggatcccttgagtccaggagtttcagatcagcctaggcaacatacggagaccccatctctctctctcattccatatatatatatatatatatatatttttttttttttttttttttttttttttgagacagagtttttgctcttgttgcccaggctggagtgcaatggcgtgatctccgctcactgcaacgtccgccacccaggttcaagcgattctcctgcctcagcctcctgagtagctgggattacaggcgcctgccactgcacccagctaatttttgtagttttagtagagatggggtttcaccatcttggccaggctggtcttgaactcataacctcatgatccacctgcctcggcctcccaaagtgctgggattacaggcgtgaaccaccgcgcccggcccccgtctctatattttaacttttttgtttaaaaaacgttttagctatttttttaaagttgccaatctggtagctgaaaaataataacttattgttttgattgtatgttatagtcattaatgctccccccaagcacatgataagatttaattttatgagctgggcatggtggctcatacttgtaatcctagcactttgggaggctaaagcaggcagattgcctgagctcaggagtttgagaccagcctgggcaacatggcaaaaccccctttctactaaaaatacaaaaaaaattagctgggcgtggtggcacatgcttgtagtcccagctactagggaggctgaggcacgagaatcgcttgaacctgggtggctgagtttgcagtgagccgagatcacaccactgcactccagcctgggcaacagagcgagactctgtctcagaaacaaaaacaaacaaaaaagagatttaattttatggcccttgaggttaagcggggccatgtgacctggtctggtcattgagttgtgaatagcaatggtatgtgtcacttctgggttgagcaagacctttcagagttctctttcacttctgcaattgattaccaacaatgtttcagaaaatggcctgggtcccataattgattaacataaacatactctgttcagtttgatagaacaacatggaataaagactctaagtaaggcatgatgagtatgaacaaaaaatatgacttctttgttgtaagccactgagacttagggttgagcgttatggcagcattatctacaccatcctgactaatacattaaacatctttgctcactactgagactaaacatattttcctgtatttattgaccatttatttggacttccctttttgtgaattttctgctcatgtccttgcatgttaattttttaaacatatgacgctcagctacacatttgttaaacctggacctgatcatcactgaggtatcagggagaaagatgaagtctgtgaactaagaaaaatagatgtatcacaatagtctctaatacccagggcaagatttctccaatctacctttaaggatctgaaaatcctttgccacaaattgtttttttttaaagccatgtgctttcattcaatgataatgtcaaaattaatagaagcatattttggatcatttgaatggtcactttataactgaaggatgttatttacttttatgatcaaaatggtttcttatgggcatcaataccactacttttatccacacagactcataagaaaaaaacaaatgtgaacataatacataatgtaatgtttttgcaccaagtgagggacaagtggtatttcagcatattgtacacagtaagatcagaggttgcacagcagaattactaaagaaaattgtgggagcattgggtcatcccacagtctgcaagcaggctcagctcaaaagaatctggcccagaacacagcaccactttcacattgtcacttatctcagttatggtcctttgcttgcaaacaacagacatagattctgactaatttaagcaataaagaactgattggaataatacaagaaaacacagtattcaagcaacaaaaagaacaaatcaggctcaaaaagaaccagactaggggatctccaggggcttcagtaccagaaattcctgaatcagtacattttggatgctgccaagaaaatgactcaatgactcaatccagtcttcttttttttttgagacaggctcttgctctgttgcccagacaggagtgcagtaaccctatcatgcctcactgcatccctgaactcctgggctcaagaaaatctcttgcctcagcttcttgagcaactaggactataggtgcatgccaccacgcctggctagttttttaaaatttattttttgtagagacaggatttcgctaaattgcccagcaatcctcctgcctcaaccttccaaagtattgggattacaggcatgagccacagtgctgtgtccatcaaccccagtcttctatctgtgtgtctttatgttctagattcaaatttctggcttcatttgggtcatatgctcttcatatgagtggggtagggggaggatgtttgagacttcaaaatactcaagacatctggatgcttaatgaagaaaaaaagttgttacagtggggcacagtgagttcacacctgtaatcccagcacttagggaggccaacacaaaaggattccttgagttcaggagttcaagatcagcctgggcaacatggcaaaaccccatctctacaaaaatacaaaaactggccatgcatggtggtgtgcacctgtagtcccagatactcgggggactgagatggaaagattgcttgagcctgggaggtcgaggctccaatgaggtgagatagcaccattgtactccagcctgggctgagatcccgtctcaaaaaaaaaaaaaaaaagtttatatatctcaaagaatgtgtgagatattaagggtcactcctagaaggtatatgggatttaatccttcctgaacagaagagtggatgggacctttttcttataaagaccttttcttttcttgctttttttttttttttttttttttttgagagatggagtcttgctctgtcacccaggctggagtgcagtggcgcaatctcggctcagtgcaacctccacctcccagattcaagtgattctcctgcctcggcccctaccagtagcaggtacaggcgtgcgccaccatgcccagctaatttttgtatttttagtagagacggggttttgccatgttggccaggctgctctcaaactcctgacctcaggtgatccacccagatcggcctcccaaagtgttggaattacaggtgtaagccactgcgcccagcccatgttattttatttatttatttatttatttaagacaggctctcactctgttgcccaggctggagtgcagtggcatggccatagctcattgcagcctcgaaatcctggtctcaagctttcctcctgtgttggcttcccaaagtgctaagattggggaactgtgagccactgttcccacctgctatgaacatctatgtccatatttgtacatgtagacataagttgtcaattgcgaaatatggttaggtaatggttggactgcaattttcttaactgactggaacttgtaagtctctcagtctttgctaaggagctctatgtgcatgttggaacttgcctttaacactcagccaggcagttttcaactctgacttagcattcacttcctgctaatatagtttcaagatcagccagaggtgagagttcagggccttctcaattctttcctgaacttgtacacagccctgggcatgcatatagttctactcatttgtattgctttctttttttttttttttttttttttgagaccgagtttcgctcttgttgcccaggctggagtgcagtggcacaatctcagctcacctcaatcctcaatctctgcctctcagactcaagtgattctcctgcctcagccttcctgagtagctgggattacaggcatgcaccaccacgcccggctaattttgtatttttagtagagatgggtttctccatgttggtcaggctggtcacgaattcccaacctcagatgatctgcccaccttggcctcccaaagtgctggggattacaagcatgagccaccgtgcccggctttattggtattgctttctagactcccaggaatctatcacagcatgtcaaagccccctgtggacatctcattccccttcttttccttttttaaagttttttcattattctattattttgccctcatgtttatctactacctcagtgtaatcacctaatgggttcctcttgcctgctgtccagaaaagcgaatgcactcagaacagcagatttataaagcaaagaaggaatttaataattgcaggtctggccaagtagaagctacaaatcttgtgacatctggccacatgactcttgagcagtaatgcattatagaaaagcaagctagggaacaaatggctggttatcatttaactgtacctacattttagcagaaatcagctctgcccctcaccataatcctaatcttgtggcctttcattagtcttaaaaaggtggtttcagttttaaggaggaggtcagttttagggaggtactattatcatccttgatgcaaagttaaactataaactaaatgtctcccatggttagcttgacccacacctaggaataagtgaggacagccagcctgtgaggcttgaaacaagatggagtcagctatgctagacttcttttgctgtcataatctttacaaaggtgattgcatccggcagccatgatgttaaacaattgcctctaattgtttttaataaacccccatagagaaaaggctcttttcactgcatgagctccaactcaagtcaaacaatgacaaccttgcaattggggtcttccagggacctatgagacaggttaaataatgaccattccctggggatggggttttgaaggagccccagtaacattctacctttccagtggctgacaggctgctggtttccactgtgatcattacaaatttgttgcagcttgttggttttgtggcttgtggctgccttgttgctttttaaggctttcttcgagctgcaaaaagtgggaatggaaatagaaaaagttaaaatgacacaaactctccctttctgagtttcagtcacttttcttgaataaatattctccagattgctgaaagcttttgattttccagaattctgaaaaagttgattgcataaatgtttgaatcattctcattgtttttatggaagagagaatattgggaaggtccttactccaccacttcactgacatgaccttataaaaaccttttgatctaagaataatcaaccattttatagattagtagtattgtagtgcatctcatccattatctagtttccaagctgtataaattatgctaatttttctgcccttttttttctctaagtccattgtatttctctttgatgttaagtaaagtacttactgattccacctgatgatcagattgcctcagaggacatcaagccattctagccaagagattagctgtttcacaagcattaaaattaaaggatgcttgaagattgtaaactaagtagttttaaggtagggttgccagattagcaaatataaatacgggacccccagttagattttaatttcaaggctgggtgaggtggttcacatctgtaatcctggcactttgcaaggctgaggttggaggatcggttgagcccaggagttcaagatgagcctgagcaacataatgagactccatctatacaaaaagtttttttaaaaattagctgggcatggcagtgaacacctgtagtaccaactacttaggaagttgacatgggaggattacttgagcccaggatttcaaagctgcagtgagccttgatcatgccactgtgctccagcctgggccacaaagcaagaccttgtctcaataaataaataaataaaatgaaatgtgaatttcagataaacaatgacaaaatatttgggacacatttacactaatcattttcttgttgttgttgtcgcttatccgaaattcaaatttaactgggcattgtatatttgatctgaaagccctgttttcggtgaaaaataaacaaaacaatacctgtaaagtcattctcagatgacttgatggtgatcctttcttctgttttcttttaaaccactgttgaagctcttttctagtctataagagataactagttttgattaatgtaggtttagttcttttatggaaaaatatgttaatttggcatggtgacaatcctgtccatatttcttatacattcaacaagtatatttaagatggtctacttatatatactaatcaagatttgtagtctgtacaaccagaattttaagttcagctcagctcctaggaaaatacatgtatagaacaaatatgcttatgaaagacctctagagagccagaacactcaaatcaggaaaacaagccaaatcagtaaagtcaaggacttgcaggtagatagataaatatgtagggagagaaaaagagaaacagagagagagagagagacataaatttaagcaattaaatacaatggcacagtttattccataatatggaatttattattcattaatagcaatcatttacaaatcatacaaagcatcagtaatttggaatctagttgtcactaaggaagacaggaactcaagaaaactcagataaaaaaaaaaccctcaaaatatgtgttgtgaactaagaaaaaaaatcaaaacaccctccagacatagataaggctttgaagaacctctttgggactcagaggcagcttttaacccccggtaacacatactttcaatccactgtagtcctcttacttaatcattcaaaaataatttcaaaatacccttaagaaattgaaacccagacatgacagaatttatatactatttccaactctaattgcttttcatatctcttcattaaccatgtattaatcaactagtctgtgtcaagcactgtgctatcactctatcttttcagaatcaatttctctttggtcatcagtcaatcattttgccttataacgacactgggcagctctaaacatggaagcaagccctggaagagaccaatttgatcaccaaatgttttctttctcactattctcaccacatcccaggtgcccccgtgactgccttatttccgtttggcttctctttgagacactgctttgttccactgtctcgagactagcaacatcatgagggaatctggtgtggagaggcagagaggagtgtgtatgcgacactgcccagcccagttgctgtccaggggtgtcaagttgccctcaaaatatcactttgtgcaagactcagccaggaggaaatgacattctcagcctcctacgtaaagactcaatcacaatacttcctttgattaaaaatctaaccagaattctctacagctgcttgatgtcctgagtgtaagctctacatggagaagaaagcatcaaacattcataaaatggaactcatttctttgcttccacctgctgctctgagcagcagtagccactctgcacaggcagataaattgtgagttctgagaagctaaaaagatcacccattcaaaactgcaaatatccttacccaagctaccaactgtctaccccatcaccaccactgtggtgatctgttgaccagattttctgatactgccacttccaaggtgattaagtctgggcagtggcaacagttcaatttttttttattttattaaagttatttctgaagatggccaactagacgcagccaggaagagcatctcccgccgaaagaccagaccatcagggaaactgggtacactctgagcagatctttggagataaggcattgagagtgaatgcagggaggacgtagaccccgggctgaaggcagaggaagctgagaaccatgcacagggctgccaagcaccaggacttgttcctggcccccagtggttccttgggaaggggtgagttaaacaggtggggagcagcttactctcaccacggacctacagacttctagtgcagcagaccccatgacccccatttgagctggcaaggagagctgttcagagaggtggcaggggcagaactctagcttgtgtggagtccagagggtttggcatgagaatggctacagtggagcatggccagggaggcccatccttcagggcttgccatgctcctctgggtggctttgcctcttggtgactgccagacctagacgagcagggcagtcttccctgtgggatggggccaatctaatctgagtgctccactgtcaaccagcttcttctggggccccagccttgctgtgcttgcttgcagcatagccttggatgcccaatcagggtgcttcctgagggccttcattttagctctttcactggcagagcactcttaaccattggagaattccagcagactgacctatgctaaatgcacccacctgaagcctccctgaaccacagcctccccctgccactttacctgtgtacacttgcccatgcctgccctcatgccaacacatacacacactgctttgcatgtgtgtctgcatgggtggaacctacttctcttttcccacggatatgtgtgcgtgcattccaccaccccactgccagtgtgagcatgtgcctggatgccaccaccctgcccccaccccacccccactagtgccccacctgtgccactgctgctgctgaaatacacatgagcacaaatcctgtcattaccaccacaacaaagcactttggccagcactctccatcagagttttgttgccacctagccaggaatacttcgaccccctaccagcgcagcaagttcttaatctcaaggggccaaagaacaaagctggagccctagtaccagccccacagggttagaacacacagctcaggagtgctgagctgagccttgggcccctaaaatcttccagaaacaaagccagtcagctgaacccaccttatatcacaatcaaaccctcaaggatgtcaaagaatataaaagcaaaaaactccatccaaaggactgcagcttcaaaggttaaggaaacatcagcccacacagatgagaaagaaccaatgcaagaagtctggcaactaaaaaagcaccttcttacctccaaacgactgcactagttccccagcaacggttcttaactggctgaaatggcagaaatgacagacatagaattaagaatctgaataggaaagaagatcattgagattcaggaggaagtagaaatccaatccaatgaatattaaaaatccaataagtcaccaggcactgtggctcccacctgtaatcccagcactttgggaggccgaggcgggcagatcatgaggtcaggagctcgagaccatcctggctaacatagtgaaaccctgtctctactaaaaataaaaaaaaattagccgggtgtggtggcaggtgcctgtagtcccagctactcgggaggctaaggcaggagaatggtgtgaacttgggaggcagtgcttgcagtgagctgagaccacaccactgcactccagcctgtgtgacaaagcgagactccatctcaaaaaaaaaaaaaattccaataaaactatacaagagatgaaaagtgaaacagccattttaacaaagaaccaaactgagttgatagagctgaaaaacactacaagaatttcataatataattgcaagtattaacagcagaatagaccaagctgagaaacaaatctcagagctcaaaaaccagttctgaaatcaactgaataagacacagatttaaaaaaaattaaaaaattaaaaaatgaacaaaacctttgagaaatttgagattatgtagaaagatcaaatctgtgactcattagcatccctgaaagagagacagagaaggcaagcaacttggaaaatatatttgagaatattgttcatgaaaatttccctaacctcactagagaggccaacattcaaattcaggaaatgcagagagcccctgtaagatactatacaagataactatctccaagacacataggcattagattctccaaggtcaacatgaaagaaaaaatattaaaggcaactaaagagaagaggaaggtcactcacaaagggaaccttcatcaggctaacagcaaacctttcggcaggaaccctacaagccagaagagattagggcctatattcaacaatcttaaaggaaagaaattccaaccaagaattttatataagtttcataagtgaaggagaaatccatttcagataagcaaatgctaaagaattctttaccaccagacctgcttttcaagaggtcctcaaaggagtgataaatatgggaaaaagagatcattaccagccaccacaaaagcacaaatacatagaccattgacactataaagcaactacacaatcaagtctgcataataaccagctaacatcatgatgacaggaaaaaagtctgcacatatcattaaccttgaatgtaaatgggctaaatgtcccacttaaaaggcacagaggctgggcacagtggctcacgcctgtaatctgtaatcccatcctggcactttgggaggccaaggcagttggatcatttgaggtcaggagtttgagaccagcctggccaacatggtgaaaccccatctctactgaaaatacaaaaattagccaggcatggtggtgcacatctgtaattccagctacttgggaggctgaggcaggagaatcaattgagcccaggaggtggaggttgcagtgagccaagagtacaccactgcactccagcctgggtgacagggagaaactctgtctcaaaaaaaaaaaaaaaaaaaaaaaaggcacagaatggcaagttggacaaagaagcaagacccaactgtatgctgccttcaagagatctacctcacatgcaatgacatggataggatcaaagtaaagagatgaaaaaaaatctaccaggcaaacagaaaacagaaaaaaagcagggattgctattctaatttcaggcaaaacaaactttaaaccaacaatgatcaaggaacaccaagggcactacataatggtaatggataatggtaatgggttcaatccaagaagaagacttaaccatcctaaatatatatgcacccaacagtggagtacacagattcacaaaacaagttcttaaagatctacaaagagacttaaccccataataatagtgggaggcttcaaaatcccaatgatagtgttagacagatcaatcgaggcagaataataacaaagatatttgtgagctaagctcaacacttgaccaaatggacctaacagacatctacagaactcttcacccaaaacaacagaatatacattcttctcatctgcatatggcactaccttaaaattgaccacacaattggtcataaacaattctcagcaaattcaaagaaacgagaatcataccaactacactcttggaccacaggatgataaaaatagaaatcaatactaaggagattgttcaaaaccatataattatatggaaattaaacaatctgctcctggatgactttttgcgttaacaatgaatttaaggcagaaatcaggaaattatttgaaactaatgaaaacaaagatatagcatatctttagatataacatatctctgggacacagctaaagcagtgacaagaggaaagtttatggcactaaacacccacatcaaaaagttagaaagatgtcaaattaacaacctaatatcacacccaggagaaaaaaaaaaaagagcaaaccaaccttaaagctagcagtagaaaataaataaccaaaatagagctgaactgagtgaaattgagacatgaaaaaccataaagaagatcaacaaaaccagaagttaactctttgaaagaataaataatattgatagaccactagctagactgtgatggttaatattgagtgtcaacttgcttggattaaaagatgcaaagtattgttcctgggtgtgtctgtgagagtgttgccaaaggagtttaacatttgagtcagtggactgggaaaggcagacctaccctcaatccgggtgggtactatctaatcagcttccagctcaaccagaataaaagcaggcggaagaacatggaaagactagactggctaaatcttctggcctccatctttttcctgtgctggatgcttcctgtcctcaaacatcagactccaagttcttcagcttttggactcttggacctacaccagtggtttgccagagactctcgggccttcagccacagagtgagggcagcactgtcagcttccctacttttgaggttttgggactcagactggcttcaattgctcctcagcttgcagacagcctattgtgggacttcaccttgtgatgatgtaagtcaatactccttaattaaatgccctttaatacatacatctatcctattagtgctgtctctctagagaaccctgaataatacctagactaataaagaaaaaagagagattcatataaatacgagcagaaatgtcaaaggggacactaccacctaatccaaagaaatagaaaaacccctcagtttttgttcatagaggtgttcacaatagtcagaactattatgaaataaaaggcatccaaataggtagggaggaagtcaaactatctctcttcataggcaatgtgattctttatctagaaaaccccatagcctctgcccaaaggctaccagaactgataaacaacttcaataaagtttcaggatacagaatcaatgtacaaaaatcattagtatttctatgcaacaataacatccaagctgagatccaaatcaaaaacataatcccattcacaatagacacagacacacagacacacacacacacacagagacacacgtataaccaatacccaggaataccatagctaactaggaaggtgaagaatctctacaacaagaattacaaaacactgtgaaagaaatcggagatgacataaacaaatggaaaaacattccatgctcatggataagaagattcaatgttcttaaaatggccatattgcccaaagcaatttatagattaaatgctattcaatatataaatgtttatatattcattgttatttttcacagaattagaaaaaaaacattctaaaagccatatgcaaccaaagaagaagctgaatagccaaagcaatcgtaagcaaaaaaaaaaacaaaaaaaaaacaaagctggaggaatcacattactcgacttcaaactatactacaaggctacaataatcaaaatagcatggtaatggtacaaaaccagacacatagaccaatggaacaaattagagaacctagaaatatagccatatcccttcaaccatctgatctgcaacaaagtctacaaaaacaagcaatgaagaaaagtctccttattcaataagtggtgctaggataactggctagccatatgcagaagattgaaactggacccctttttttcaccatatacaaaaatcaactcaagatgtattaaagacttaaatgtaaaacctaaagctataaaagccctagaagaaaacctaggaaataccattctagacataggtcctggtaaagttttcatgatgaagacatcaaaaacatttgcaacaaaacgaaaaactgacaaacaggacctaataagttagagagcttctgcacagcaaaacaaacaaacaatggagtaaacagaaaacctacagaatgggagaaaatatttgcaaacgatgcctgtgacaaaggtctaatatgcgaatctataggaaacactatacacatattaagcaaaaaaatcaacaatcccattaaaaagtgggcaaaggacatgaacagacacttttcaaaagaagatatccaacaaacatatgaaaagatgctcaacatcacgaatcattacataaatgcaaatcaaaataaaaatgagatactgtctcacaccagtcagaacgggtattaaaatagtcaaaaaataggctgggtgtggtggctcaagtctgtaatcttagcactttgggaggttgaggagggcagatcgcttgagctcaggagttcaagaccagcctgggcaacagggcaaaaccccgtctctacaaaaaatatttaaaaattagccaggcatggtcatgcctgcctgtagccccagctacaggcacgtaaggtgggaggccaaggtgggagtatcacttgagcctcagaggtgaaggctgcagtgagctgagattgcaccactgcactccagcctgggtgagagtgagcccctgtctcaaaaaaaaaaaacaaaaaaacaaaaaaacaaaaaaaaacaaaaaaacaaaaacaaaacaaaaaacagctgggtgcagaggctcatgcctgtaatcctagcactttgggaggccaaggcaggtggatcacctgaggttaagagtttgagacaagcctggccaacatggtgaaaccctgtctctactaaaaatacaaaaattagctggacgtggtagagcacacctgtagtcccagctactcaggaggctgaagtaggagaattgcttgaatctgggaggcagacgttgcagtgagcggagatcatgccactgcactccagcctgggcgacacagcaagactccgtctcaaaaataataataataataataataacatgctggtgaggctgtggagaaaagggaatgcttacacagtgctgttaggactataaattagttcagccactgtggaaacctgtttggtgatttctcaaataatttaaaacagaactacccttcaacttaacaattgcattattgggtatatacccaaagaaaataaatcattctatcataaagacacacacatgcatatgttcattgcagcactattcacaatagcaaagacatggaatcaacctaaatgcccatcaatggtagactagataaagaggtggtacatatacagcatgaaatactttgcagccataaaaaataatgagagcatgttctttgtagaagctgtaggtcgttatcctaaatgagctaatgtaggaacagaaaaccaaataccacatgttctcacttacaagtgggagctaaacactgagtacacatggacacaaagaagaaaacaataggcactggagtctacttgagggtgcagggtgggaggagggtgaagatagaaaaactaaccatcaggtactatgcttatcacccgagtgacgaaatcatatatacaacaaaaccccgtgacatgtatttacctatataataaatctgcgcatgtagctctgaacttaaaagtttaaaaacacaaaacagccgggcacggtggctcatgcctgtaatcctagcactttgttaggccaacgcaggcagatctcttgaggtcaggagttcaagaccagcctggccaacatggtgaaaccctgtctctactagaaatacaaaaagtagccaggcatggttgtggatgcctgtaatcccagctactcgggaggctgaggcaggagaattgcttgaactcgagaggcaaaggttgcagtgatccaagatggcaccattgcactccaacctgggcgacagagcaagactccatctcaaaaaaaaaaaaaaaacaaaaaccaaaaaccaaaaataacaacaacaacaaaaaaacatctgatgtatctctcagaaagcaatattccatttatgtttcaggactggatttctctatgggcttattggtgtatatgggagacagagcacgttctaataaatattgtcaatatttgcttacaacaaatttctttcttcttttttaaaattttctttattttagtttgaaaaaaaatagagatggggtctcactaggttgtccaggctgagcttgaacttctgagctcaagtgatcctcttgccttggtttcccaaagtgctaggattataggcatgagtcattgtacctagtatctctctctctctcttttttttttttttaaataaaatagagacagaggctaggtgcggtggctcatgcctgtaatcccagcactttgggaggctgaggcaggcagatgacgaggtcagaagttcaagaccagcctggacgacatgacaaaaccctgtctctactgaaaatacaaaaattagctgggcatggtggcacatgcctgtagtcccagctactcaggaggctgaggcaggagaaccgcttgaactcgggaagcagaggttgcagtgagccgagatcacaccattgcactctagcctgggtgacagagcgagactctatctcaaaaaataaataaataaataatagagacagagtatgactatgttgcctaggctgttctttaactcctggtcttaagcaatcctcctgccttgcccctgctaaaatgttgggatcacaggtgaagccaccatgtccagccttttttttttttttttttttttttgctttctctctctctctctctttcataaattagagatggagtctcactatattgcccaggctagtctcaaattcctggccttaagtgatcctcccacctcgtaatctactttttggggactaatgaggtgtagccaaaatacaacatgtgggaggcagtaaatgtagagattaggagtagatttggcaagccagactgctgtggtcacaccccagcacagaatttatgaatccggctcctctccattcaaatctctgccaaaaatcacctccttctggaggcccaccatgactattctatttaatacagcttaccccactgccctatcactctctacaccattctcattttattatgctcagagtatctattattctccgaagaagcatttcttgaaatctagctggtaatcttctttccttattagaatgtaagctccatgagagcagggatctctctgtatcagaatctgtattgtgcttggtaggtagttgactcaataaacatttctgagtgaatgaatatattatatggaaattgaagaatacaagcttctccacataagcacgtggcagaaaagacaaaaagagaggtagagaaaaagactctctttttatttaagcttccctcccctgttgaaatccactactccaaaaaagggagacactgaccaaaacagaaacaaaagaaactaattcttggtttttatgcttcctgataatttaagggattttcatagataggtttgacaaatgcaatttttttgccttaggcactggcactagaaactattaataaacaagattggcctacagagggtgctagttctcttcaaaaaagtaaaagaagtgcatgcgcttttccactgggtctgggaaagagtttacaaaacaagcagagacacagcttagtaacaactaatgaaacgtctaaattgccacattttgcttcataaaaaaaaaaaaaggaggaatctgtgaaagtgccagaggcattcaaagacgtcccctgaggaaaagaattggcatcatttttcaaatgcaaagagaagctaagctaagagaagcatccatttaaaaagtttttttagttcttatttttgatagagaaggggtatcactatgttgactggcctgattttgaactcggaggctcaaaggatcctctgcccctcagagtgcttggattgcaggtgtgagctaccaagagaggcatccagaagttgaaaagactgaatctgttgtgaaacagaagacccaggtcgggggaagttgttgccagccctggagggaggagaggtgacaggcctctgccacattccacccccacttcatgctgggacatggggacctggagacctagtgtgagatgcctgtagactctgtaactggaggagtgttctgacagctgtgtttcctgaaactgagtcttggtttcagagttcagcaagggatatgcatggtggtggtagcgttgggacagaagcggggcactacttgagagttttgaaatatgtaatttgtcacagcaaggacaagggcaagtgagcctggcaggagggaggagcctcttcaaagtctggatctgcaaaaaaaatcttcagaagaggaaatgaaacaaataagcgagttcttaaaaaagcttttgagctctctaaatgagcaatagttgaggcagctttgatagtccaaagctaacctcaaggctgggattcttttatttatttatttatttatttatttatttatttatttatttatttattattttgtagagatgggaaggggaggggtctcactatgttgcccagcctggtcttaaactccaggcctcaagcagtcctccagccttggcctcccaaagtgttggaattacaggcatgagccactgtgccaggaaaaggttaagagtcctttttttttttttttttttaacttcaaggctgagattcttaatcctagtactctagacgtcatattccagtgatcagatgcagaatccataagtgctctgacaggtcttatcattatgtgtggtgttttcacttagtgagtgcccttgttttgtcagttcaaggtggcttgcttagttactttattgtaatgttcaatggctaaactttaaacaaaaatcaataaagggcaaggaatgagtttgcaaaaactatcagccacttccctcaatttaattgtaaaatcaatcaaatctgttttttggcacagtgcaaggaaaacatctatttgtccaataaactgtctcattgattaaatggttcatttggaagagataacaaaagtctaagattttaatctcaaggaaaaatgtatcttgcaaacatgttttcaagatcctgagatcatattattttcctttaaggatttgcttcatcccaggtgttcatctaatcctacttttgctatttttaatcattattcatctatgtaaaatggaaaatctatttagatgcttaaaagtcaacgtaagctcacaaacctgaatttcagcaactaaaaagggagaagtaataatgattcagttcttactgggagctactttatacactattttatttggacctcataacaactatatgagagagaactgtgcactctctgccaggggttagggttaacataaagccaaaacccaggcaggtcacgaaaatgagcaaagcaggccagttatgagtgctgtcaccttacaaggaggtggaaacaatgtttccggatcctgtttcttaagagaagccaaaagatttacgtaaagtctcctgattttttttcaatggtggtaattgattaaaataaatatttccaatactgtatgtactgaataaagaaaatttggggctgaccctggcccagcaactgccacttagcaatgtctggtattgaagtgaaaataaggctcagggctgggcacggtggctcatgcctgtaatcctagcactttaggaggccatggtgggcagattgcttgaacccaggagttccagactagcctgggcaacatgatgaaatcctgtctctacaaaaagtaccaaaaaaaatcagccaagcatggtggcaggcacctgtagtctcagctacttgggaggctgaggtgggaggattgcttgagtccaggaggccgaggttgcagtgagctgagattacactactacacttctgcctgggcaacagagcaagactctgtctcaaaaagaaaaggctcaggaaggtgacatcactatgctaattcaaggaggaatgaaagagtgacctcatgggacagtagatcagagaatgttctacctggtggccagcctatttgtggggaggggtccctaagaagaggctgtatgctggcttgggttatggagggccaaagctcaggggcctgggggaaggagagaagcttaaccaaagtttggctaacaggcattttgttctgattgatcagtggtgacaagcagttcagctagtcatttaggaggtcaaaaacagaagactggaagatccctatctagttttgtcatcagtagacaaaggggcactcatgaaacttgtctaagtcatacggggaagggtggccccttgcagtaagtcattttccagaacgtaaaagggcaatgggctttcttaaccttcaggtaaaattccactttgtcaaaacataagcatgatgtagacaaaggttgagagtgagatcaggcttattgcccagtcttaagccatttaaacccaaggtggactttcccctcaggaaagaagggaaggaaagaagctaggaaggccctggctaggttctgtgtgggttggggaatgtgaatcctgatggagcagcctaaagaagtcaagcagtcctgtagcagcagccgtgggggaggttcctcctgggagtggaggagggcgagtgctgcaggtccatcagtggaaatgggaatggaccattaggcggagaagacttatcgaagctgcgaagtccaagatcaaggtgccagcagattctgttcctggtgaaggctatcttcctgttttgcaggtggctaccttctcgctgtgtcctcatatggtggagagtgagacttcatctaaaaagaaaaaaaaaaacccactccggacatagtgactgtagctgggtcttggactgcaagaagaccatcctggtgagaagatcttgaccacaggtgatattcaccttggataaaaaacattctgataattcagaatgtttgtgcaaataagatttctaacccagttctatggaggtataatttatatatggtaaaattcacctctttaggtattcagtttatgaattttgagaaatgcaatcaccagccactacagtgaagattcagaacatttccatcaccccagaaagcctcctagtgaccctttggagtcagtcccctcccctcagcctgagctcctggtgaccagtgatctgatttctatccatgtacttctcccttttccagagcatcacctgagtggaaccgcacagtattccaccacagtattttgcatccgacttcttttccttggcatgtgcttttgagattcatcctttgctgttatattatcagtggtttgttcctttttgtggagagtattttattgtttggatataccacagtgtgtttattagtttatcgccagtagatggacatttgtattgtttcctgtttctggctgttaggaataaagttaatataaatataaaaaaaaaaaaacccaataaaacaagaagctagaaagttgctagttttcagtagagggggacaggctgctgtagaagctcaggactgctctgcttttggcacccaaaggtgagagtgttttgctgaaggcagcagctgtgaggagtgacaactccaccaaagtcaaggaagcaggtgtagaacaggcaggtcataggtggcaatctgtggtcctaaaataccctggaaaagaccgggagcccttacaggattgagaaaccaagagaaaatgtggggcaaaaaaattcctcaggtttcattcacagtcatccccacagccatcttaagtcatcaagaaagattcggaaaagctccgagaatcagcagatgggggctagtgcaaaataatactttttgtcttaattattagtaatctcaatccctcactcaattcttaggttgatgcctgggaggtaatatttactaccttgcatttccataaatggtgaccttttttatatggatgttggacaccagggaatgctcttaagttaactgcatttcatcagatccccctactatttaaattgatcttatttctatcatttcacctcaagatttattgttcttatcttacattctaaagaactgagggctgtctttgaagtggatatgaaaagtttcacctcagtctaccaatatatcattgaaagtttaaaataacaaatacaagaacaaaaatactctccacttgtccaagcatcccaggaggtctctgtattgtttaaattacttctgagtttaaattgcaattgctctagtaaattagctaacatctgctgtctgcctgatgatgaagaccaccctactagaaaccaaatacactctttgcttgagtcatttatttactatccaggacaacactgactcacagcagtataatatgagccacattttattttaaatgttgtaatagtaaccacattttaaaaagtgggaacagataaaattaatttaataatacatatttagctcagtttatcaaaagtataatttcaatacataatcaatataaaaattattattattattttgagatgggatcttgctctggcacccaggctggagtgcagtggagctcactgtaacctcaacctcctgggctcaaatgatccttctgtctcagcctcctgaatagctgggaccacaggcacacatcacaatcctggctaattttttaattcaacttttcttttcttttttgaaatggaatttcactcttgttgcctaggctggagtgcaatagcacaatctcagctcaccgcaacctccaccccccgggttcaagcaattctcctgcctcagcctcctgagtagctgggattacaggcatgagccaccactcctggctaattttgtatttttagtagagacggggtttctccatgttgatcaggctggtctcgaactcccaacctcaggtgatccgcccaccttggcctcacaaagtgctgggattacaggtgtgagccaccgtgcctggccttatttaactttttaatttaattttttattaattatttttttatttaattattttatttagaaatttttatgtagagatgaggtctcactatgttgcccagactggtctctaactcctgacctcaagtgatccttctgcctcaaccttccaaagtgctgggatcataggtatgagccaccacactcagccaatacaaaaattattaatgagatattttatattcttttgtcttcatactaagtcttcaaaattatgtgtgtattataatcttatagcacatctcaatttggacctgctactgaaggagattagccaccccaaaatatgccactttggcaaaacgattattttgagctgaaagcaattatgaattaacagacgctggaaggaggtctctgccctctccttatctgcctaaaatcagagcataaacttcccttggtgcaggtcccctctccaaccctcccctgccaggaaaggaagaatgactattatcattggagaggaggagtcaacactgagatgagtttgcacaaacagaacttactaaaataacctttaccttccattggttctctcatcattttgtagttacttccctatgatttaccatcctttgaagcccaaactcttttctctttgttaaaatggtatataagccctcaagtctaactgcttctttgagtttcacttctattatgtgaactcccatgcacataactattaataaacattgtgtgccttttctcttattaatctgtcttttgttagtttaatttatttaacttaagaagatggaggaaaagtttttcttccccatcactacatttcaagtgcttaatagccacataaagctagtggctatatattagacaatgcaggtctaggagaatatgtagcataaatcatttctaatctacactttatttttttttcttatgcaaaacctatttttgtcagtactttttccatggttgcagaaaatcagcataaacagtgttacattttagcagctaccagcaattagtaacgtaatggagtctgtaatactttagttttatattcttgaaggtttcagagcatgagaaaaagaccagtcctttcccaaatttcttcgtactttggtcctgaaaaagctattactaatagttctgcaaagtgaaaaaaagtaaatctcaatttaaaaattacacgtggttttaaaaacaaataaatacaaaacgagactatatcaaaaagccaggcacggtggctcaaacctgtaatcccagcactttgggaggctgaggtgggtggatcatgaggtcagttgttcaagaccagcctggccaacatggtgaaaccccatctctactaaagatacaaaaattagctgggtgtggtcataggcacctgtaatcccagctactcaggaggctgaggcagagaattgcttgaacgtgggaggcagagactgcagtgagccgggttgtgtcactgcactccagcctgggcgacagagcgacagagtgagactccttctcaaaaaaagaaagactaaatcaaagtaagaattcactttgtactttgctggaattttctattctgtagtcaatggtggtttctagtagtgcagggtagggaaactccagagcccaactaaaataaccacatgttctgaagttaattaaaagtataaattagtgttataaatagcaagatgtcccattcaatggttttaattattttacttctttgaaacaacaaatggatttgattaaagaataatttgatctattaaaatgtaattaaaggcatgtgtttgagcacttccattatttctccaaaaatataaagatgtgccctttatccctttgtatatatattttggctgcatttaaaatttacacaagtgttcaatacctaaaatctaaaagtaggattagatgtaaaattcccacatgattgttattttatttttcccaccaccatatcagacatgaaagatgaattgcgaatcttcttcctacttttctttcatgctctgctctgctctgaatgaagactcatgctgtagcagttaaatgaaaataagatcttttttcctttggcttatcgttactaacaaaggattttttttggggggggggtggtaataattcctggtaaaggagaagaaaaaaactcatcattaacaggcccagcagactttatggtgatatcaattaaatttttgataaatgaatgactctctgagtaaatgaatggatatggccatgacataggatgtaacaaatactcaggaacctggtattagaatcaatgcccagttctgagaaggctctgagtgtcatccatagtccttatgcagtcttccacgtgtgattactccatgatgactattctctggaagcttatataaaaataaatctgcagaaggttagggatgtttggggctgttagtacaattcttcaaaggagctgaaggtctgatcagatctgtacaactttgcacatcttgcatcctgccacttccccaaatctctgctgtttagttcagctattactgcaactattcacttaaaaaacgaactgtcaagaaaacaagttgtggctctactgaagcctaaagccaaccacactgtgttgcttctagccttgttttgtgttctgattctatgccaggggtttaacttacagttcacggactcctacttggatcatggctttgggaagtctatgaacttccggaaatagcatgagtcttctttttttctttttcatttttataccaagggctttcagtggattcttgcagaaccaagaaccactgcgcaaagcacacgtgcacactgggaactgagaagcaacactgtcataatcagtcaactgagaagagcccactgatgcctgactgccaaggaccctgctaagctgctttgcgtcaagagaacagacaatcctggcttggcacattacatttcagcaatggggtgtcctttggactagcggcttccattcagtccacacacaactgtaaaccacactgggctttacggatcagaatttttaactatagagaaaagatcgtgcacgggggtagtatatcaaattgctgtgcccgggtcttctacaccacacctatacaggggtggtgattgaagttaagagcatcacttttttttttcttttttgagacagaatgttcctctgtcgaccaggctggagtgcaacggcgcgatgtcggctcactgcaacatctacctccctagttcaagcgatttttgtgcctcagcctcccgagtagctgggattataggtacctgccaccatggctggctaatttttgtatttttagtagagacagagttttgccatgtcggccaggctggtttcgaactcctaacctccagtgatccgcctgcttcggcctcccaaagtgctgggattactggtgtgagccaccgcacctggtcgagagcatcaggttttgatacaataaacaaaagtagaacttgaccgtgaggtaattgccatgtcataccatggaaatagctgcatgagggatggctgaggatattcatctctacaaatcattttcaaagtttatctaggttattgaaccaaaaaaccatgggaaaaaaacaatggtatgtattctttcacacttgatcttagaagccatggtatgtattcttttattccaaatacttatcaagctcatctaataagagcaatttatctccctgagaaactttgtgcttctgccttggcccatgttaatgagccatgtttggctcatggtggctcattcccataattccagcccaccttaatgtactaaaggacaaaatcacacgattttctcttatatatgagaatcaattgtgaacttttgaaaaaggtgtttacaaagccagtaatagataaaaagttttttaagttgccaaaaatcagcagcaaatttaacatttcttgggtaaatattagaagcatttcctttaaggttgagaatgagctaggatgcctcttgtttttttgttctgtcttaaaaattgttttgagacagtcctgcttcagccccacaaagtattttgggattacaggcatgagccagcatgcccggcctctatgaggccttttaaattaccttttcttccatgtaatattgggaattttgatcaagagacataagtaagcaaaaagatcagaagaaagagagtcaggagactcagctgtcattatttacagatgatataaatattcacagaaaactcacaagagaattggcagaatctgtttagaattgtgaatagagttcagcagagttccagaggcctttctgagctctattaacctaggaattaacctaacaaaaatgcccagcttctcttgaagaaatctttaaaattctacgaaagctgtatttttccaactttaacgtacctccagataacctggggatgtttaaaaagcagattctgattcggtagctcgggggtggggcggagcctgcgttgacatttcaaagcctgtcaggtgatgcagcaggccctgtacaacactttgggttgatggtcctgatgcacttaaagaatacatgcagacagaaggcatgctcatgtggggactctttaccattgcaaagactctcattctctccaaactagtctatgatttttaataccattctcaccaaaatcccagtaaaatttgggggtcagaggtacttacttaatttacatgaaaaaggtcaactttcagaaaaaaaagtggggaaaatggagaatttggctaccatatattaagacatgtaacaaaaccagggtaattaaaaaacaccaccaccaatttgataatgcccaggaacagacaataaaacaatggaacagaatatagaaacaacccagaaacagaccacatgatattgatttatgaaagagatggcatcaaaactttgtggctcatgcctgtaaccccagcattttgagaggccaaggagggaggattgcttgaggccagaagttcgagacaagcctgtgcaatatagtgagaccccatctccattattaataataaaaaaaaaaaccttggtgaaacaaaaaatacattgataaatggtatgcacaaaactggcttactagatggagaggataaaaaattctctctctgacacacacacacacacacacacacacacacacacacacacacacagtctaagctaaatacctgaagttgtttatgcttctggtagagattggtcttgggcttctgattcagaggcagaaagcagaggcgaaagacacactctttctttttttttttcctttttttttttgagacagagtctcgctccactggcaggctggagtgcagtggggtgatcttggctcactgcaacctccacctcctggattcaagcaattctcctgcctcagcctcccgagtagctgggactacagatgcgtgccaccacaccggctaatttttgtattttcagtagagacggggtttcaccccattggccaggatggtctcgatctcttgacctcgtgatccacccgcctcggcctcccaaagtgctgggattacaggggtgagccaccacacccggccaagacacactctttcaagcaagcttcctgcatcagcacatgggatccactacttaactccttcagttagtcactcttggccttgccattcatggaaattcctctgagattctcacaacaagccagttctcatacattgtctcagtatatggtattgtgaattgagttttatgatttcttttttttggtcttcattagtattttattgcaaacttggaaaaaggcacgtgaggagctgataatcttatccaggtttaactacactcaactttttgattattgaagccaatgcattaaaggttttctctaactctgtgttgttcacaaattttattttcatatccttgttttcattcaagttcataatgactatttgaataggtcagagtcatagacaaagctctcagacaaataattaagagctttcccacaaagctggtatagacctactggttgaccctacgtggggataaggcacttcctgattctttccctttgtatccctcctctctatagcttaggccacctgacttctctctatgggcgtggtctcccccatttgtctagggataatactcagaatttgaaggtctccagaccaaaaatctagaactcagcacaggattgtgattcctccttgtacagtgctggcccttagggctaacagccgagcttctgccatgcatgtgaccctttcttttttctttttctttttcttttttttgacagggtctaactgtggcccaggctggaatgctgcggcatcattacagctcactgcagcttcgacctccccagctcaagtgatcctcctgcctcagcctcccgactagctgggaccacaggcatgtgcgacaccaaccagctaatgttttttttttttgttttttttttgttgttgttgttgtttgtttgtttgtttttagtagagatgatgtcacattatgttgcccaaactcatagctggtcttgaactcctgcccccaagtgatcctcctgccttggcctcccaaagtgctaggattataggcatgagccattgcacctggccaatgctttctgaaattaccgtttcaataaactgctttttatccccattattctctaactggagtacctttatatttttttaaaaacatgtttaaacttgggatcttttcatccattttgcatatatcctcatgcagagacttctccccacccataccccaatactaaaattacaagcctgtggcctgtccatctttctgtggtgcccattcttgcctgccgaggactaccatttgctcctgactcaagtacactgcccacttattagtgtgcccaccattcccattagacacttgccaacctcccccatcctctttgtttgcctgaaccatgtatctgtttgttacctgtcacagtatctttattttttaaaatttattttaattgtaaattgacagattatagttgtatatatttatgagattgttgtggctcagaaaacaatatcccaaagtgaaggcctcagaggtagcctcagaagcaagttctctctgaccttctccttccctcctgtctctggcccatcagtctcccccgaggctagccataaaaactataatccttcttccccaaggtgtgttatagaaactagaactcctgttcctcaaagccagccataaaacctaaaaacattactctaacctcctgccactccccgaccttcctgtgtaagacctggccataaagaaatctctgacttacattgtttaacgataggtcataagacactcattccaaaaagggttctgcctcatacctggaaggaagacagctgcacagagaggccaggaagaaccttaacagacaggccttgctgggattccccactcggtctatttccataagattataccttttctgtccaaacacagttctacactgcggtccattcttcatggaacctaagtataaaaatggatggttttacctgtatctttgggtcttcattctaaaggctcccatgtcatataaaactatgattaaataaatttgtatgcttttctcttgttaacctgtccttttttataggagtgtcagcttggaccctcaggatggggagaaaagggatcaccccctttctatccctatgaggtacaaagtgatgttatggttctctttttctttttttttttttgagacaggatctggctttgtcacccaggctagagtgcagtggcacaatctcggctcagtgcaacctctgtctcccgtgctgaagcaatcctcccacctctgcctcccgagtagctgagactacaggtgcacgccaccaagcccagctagcttttgtaattttggtagagacagggttttgccatgttgcccaggctggtcttgaactcctgggctcaaagcgatctaccgccttgacctcccaaagtgctgggattatagacgtgagccaccaggcccagcccatgatgttatgacttatgaatacaatgcggagtaattaaatcaagctaaataacatatacatcacctcaaatactttttttttgtggtgaagacattggaaatttactgtcttagcaattttgaaaagtactatacacgattattaactaccttcaccacgcagtgcaatttatctcaaaaccaaaccaaaacacaaccttgctcctcctgtctaactgaggctgtatactttgaccatcaactcctcattcccccagcccccagcctctggtaaccaccattctactctctgtttctatgagtttgattgttttagattccaaatataagtgaagacatacagtatttgtctttctgtgcctggcttattgcacttagcataatgttccctaagtccatctctgttttgcaaatgacagaatttctttctttttcaaggctgtcactgtacctttaaaatgccatgatctgttaaccagtcttgtcttcctcagcatcttgtctttcttcagcactacatcatctcctcaatatttttccatccaatattggccaaaatattataagcaattttatcaaatgcttgctgaaatccaatatgtgatggtggtgacttcctccggcatgtaatctactaatcctatcaaaaaaggaatgtttagcttggcacgcttggtctcagtgaatccgaagtagttaccactgtttacctctcctttctttaaatgcttgcatgtcaaatattgttccattctctggaatgacttttacctgtgaatggaatcttgaatgtcattctacagtaaaattctcaaccaaaaaaaaaaaacaaaaaaagccactgatttctagtcatcaatctataaacactaaagacattttactagttcacatagcaaaaaaattctgaggtagggtggtttcaggttggttgattcagcgtctcaataatattatcaaagactcagattctggccaggcacaatggctcatgcctataatcccagagctttgggaggcctaggtggatagatcatttgagcccaggaagttgagaccagcctgggcaacatagtgaaaccctgtctgtataaaaaatacaaaaattagccgggcatggtggcatgagcctgtagtcccagctattcaggaggccaaggtgggaggatcacttgggcctggcaggcagaggttgcaatgagtggagattgtggcactgtactccagcctgggtgacagagggagaccctgtctcaaaaaaaaaaaaaaaaagacccatattttttccatatctgtgctctgccaccatcattatgatggccttatctttggctggttctcttcatggaggcaagggagctatggcagctatgacctgcttttctacaggtcttcttttaggagcaagaaaagcatctaggagctccccttgcctgacctgccacggttttatttcacagaactgggtcactttccccctccaaaccagtcactggcaagctgagacagatcagaatttaatcccgagacatacagggaagagatgggtaaacccttgaaattggctgtttaccaacaagagaaagtcgacaaatgctctgggctaggaaaccctactgtctggtccagactggaggaattactgtctaatttggagagtggtcatatttgaagacggttactgatgaagacctattaaaataacatggactttttatctattcaaaacagcttaaaacaggactgtgtccagaacaaaggggtagattaagttatctctaaaattcccggccaactgtttaatgctgtgattctgttctcattgttttcactgtggaaactgcttgcaatttggaagagtgcgtgtcagcaatgtttgtgctgccagcaaaagtgaatagttgctgatctgtgtgcatttccccaaatagcacatttgtggaaaactgagtcatggggattctaggtactgtgaatccatcatctgcacaattttctgaatgccttacatcttagacactggcggcttccctgtaaataaacaaattgtaatgagacagttgacacataacatgggattggccaaagcaaagcaggtttagctaactggttttcctctggcaaattgttccttttttttttttttttttttttttttttgagacagaatcttgctctgtcacccaggctagagtgcagcggcatgatcttggctcactgcaacctccgcctcctgggttcaagcgattcttctgcctcagtctcccaagtagctgggactacaggcgcgtgccactgtgcctggctaacttttgtatttgtagtagagacagggtttcaccatgttagccaggctggtcttgaactcctgaccttgtgatccaccctcctcagcctcccaaagtgctgggattacagatatgagccaccttggccggccattgttcctttttatttattttgccctgaaagcagatgatggtgttaaataaagcaacaaattaaatgtggatgttagtgctgcaatggaggaaaacttgcagaaaaattgacctgacttatttaatcaagtgcagagacattactgtgctacctggggagctattcaaatacaatacaatctatatgccttccacctgagcaaccaagttcttacagcgctaactagagaaggtgcaggggagggggggaggactggataaagttatttttgtggcagttaagcttcgattacttgtagatccataaatcatcagccaaggttctcttttctccagcagtgagcacagggaggaggaggtgcatgcaagcgatactgcagggccagaatcagaatcatcagcacgtagcaactgattggatttctggagcaagaaagaagagttgaagataatgttgaactttctcattgggagattttactaacattattgagcaattactgcatgatggatgttacgctaagagcattctacaattattatacctcttacgtctcccagtagttctgttaagtaagtactattgtttttgttttagagacagagtcggctctgccactcaggctgtagtccagtggtgcaatctcagcttaccatagcctcgggctcaagcgatcctcccacctcagctccccaagtagctgtggtcccagctggctccatatgaaaagcctcttgcttccttaattactaaccaatggtaatagtttttttcttttttgtttttttcaagagacaaggtcttgctctgtcacccaggctggagtgcagtggtggtaacatagctcactgcagccttgaactcctgggctcaagggatcctcccacctccgcctcctgagtagctgggactacaggcatatgccaccatgcccagctaattttcaaatattttgtagagaccagggtcttgctaattgcccaggctggtcttgaactcttacctcaagcaatactcctgcctcagcctcccaaagtgctagtacttcaggtgtgagccaccacccccggtgaccaacagtaattctacacttcaatctcttgcatccttacccttatcttgtgtccttatgatcatcataaatagctcatttggccgggcacagtggctcatcctgggcagcacatgaaacctcatctgtacaaaaaaatataaaaattagccaggtgtggtggcacatgactgtgggcccagctacttgggaggctgaggcaggagaattgcttgaggctgggaggtcaaggctgcagtgagccgagatcatgcttctgtactccagcctgggtgagagagcgagaccctgtctccaaaataaaataaaataaaataaaagctaatttgtctcaggctttgaattaatctgcattagctcatgtaattgttgcaataactctatgtggtaggtactctcagccctgttatacaatgggtttgaaatgactactgatatacagaggtttgaaatgatgttacttgcccaagtctcatggtgaatggaggagcaaggaatggaactcagctcatttaacaccaaaggtctgaccaccacacagcactgccctctttagccaaactaatgtttttgtctttcttacttttgacccattttattccacctttctgaggtattttcagcattttcattaagctaatgaatacaacaattatttaagcagctaatccttaaatatgcttctataaaatgtccttttagtttcattttctccttatcactccccaaacccaccagacctacacttcatattttcccaaacgtgtatacacaaggcattcacctgcttttatatgatgtcctttcctgttcatctcaacctggtaaggttaagaaggaaaatgattttacatatcagaggggagagtgctacaaaagaatatgagacacagacaattttgtaaaaaaaaaaaaaaacaactttgtatgagataccttatgtacatacacagaacagttaaatcctgggcaacatgaaaaaacctcgtctctacaaaaaaatacaaaaattagctgggcatggtggcacaggcctgtagtcccagctacttgggaggctgaggcgggaggattgattgagtcctggaggtcgaggctgcagtgagccatgattgacagagtgagaccctgtatcagaataaataaataaataaataaataagaatataataagccaaaagtgaagtacagtgaatgactaagtgttctaaagaaaaataaaagcaacagtccatggaagaggtagaccttaaggatgagtgggatttgatgggaaaagggtggaagctagagtgaagacagaaatcaacatctcattactgacagctatttatcaagcacctccatgtgtttggccattaaattaaagttttgaggatagagatggaaaagctgcttgctgtctttctcccaaatactctgtgtttgggaaaggcttaaacagatagcaaaatacacagtgacacaaagaggcacacaatacaccgagcaagagtttcaggcattctgaaaatgcaggggacatatcccagtaagaatggtaagccctgggacagagggtgagcggtttacatggatcaaagggctcgctcatgataacaacagccttctctaagccaggcactgaatactgtggatacaaagagcccagagtcatcaagaggaaccaggaactctaacatgatgtgtggagcaggctatgcaaagaggggtacctctcccagtcagaggcatcagagaaggcttcctggtggaggtgagtaggaatcacgtgcaatcgtgcaggcgaggcggggagaggacacttctgagcaaagaaactggttagaaaatgtactggtgtgtagggagaaagagggcctccaggtcactcagggttgctatgagagcacgaagtttaaggccaggagcagtgagatgacatggaagagagaggtggtgactggctgccttagggagcctgggcttgatattgagccaggaaaatgttttaagcatcctttaggttagggagctgtatgaattagattcaggttgagccaaggttttagcaagcttcaaatgccaaactgagcaaatcttccctcactgtgagtttgctgtgatcactgttcttatggttcagagaataactgtgctgtagatattaggctcaattcaaagtggagctgctgaaaaatttattagtgctggagtgcataggatgctgttcatgcatgactagcatttcaaagggctgtagattaaaagtgagaggtctctgaagtccaatttcaaaacccagagcctctccgccacttatctcctacttcgcaccaatcctggaatgagtctatagaccactgtaacttctccttctcaacttccacatcttttcttctctttctattagcaacctttatattccctttgggtgttttctttttctttcttttaccacttatgatgcccacatggtcatactatgggaaatgcagagctgaatcccattagagtccattgagagcctgctgtgctccaggcattgtttggggcattttaaaacattatctcatttaattatcctagcaacagtaaaaggcgggtgtcattttacatgaagaattcgtggcacagacaggataaattacttgcccaaattcacacaactagtaatggacagaggtttttcacataagctttttggatgtgaattggaacacactcgtctctgtgaattcccaaagctcttgggataacaatacaaaactttgtcatgacctacaagggtttggatggcgatttctccgctctctcaccctacaaccaaacccagacaattggcatccagggcccaaggtcctggccactctggcatactgtctctgggtttcgaaacagttcatttaggatcctttatatacaacgagttacaaatcatattctgtgagtttctgatctaagttaacagttctttcttaccaaggagacgatgaacacacacacagacaagaaagagctgcagggaagtaacaataacctccaacaggttcttagttggaacggacccatcacaacagacaaacaggagaaaaacagaagtttattaatatggatattttatacacgcatgggggacatccagagaatgagttttcaaagaggtggctttaagttccagtttatatatagcatcttcaacaaagaacaatagatttttagacaagtggcaagacaacaagaaaggactttttgagtttctgtgagcaggctggcaactcaaggaaaagcaaacaaacagcagataaacgctagttaggaaagcctgccaatgcaaattcctctggttccgactctaggctgatgagggtctaaagctgtcttcagtggttaaacttttcttgagggaaaaggcgggggttggtggccaggatattttttgcctttgtaaatctatgtcctccttttggacaaattgaggcagagacctctcctgtacctgtttcttcttgagcatcttcagctcaacaatccttcatattttggggaagatattctggtctcccacagagcctttcaaagaaggttcagctctggtctgggttcctcgtctctcactattatctgagtttgtgtctcccaccctcctctgagtccatactggtctgtggaagaaggctgcttccctgaataaaggccctaatgttctatttgcacaaagctcagtctttctctatgctgaacttggctttattactaagtggctgtgagattttcatgttgtcaactctcctatctcagtttcagtttcctcatctgtgcaaaatcagtcatccccaaagtgttgcccagatcaaaaattttagaattctatgaagagctttacccactagtagaagagagaattaatacattcatcaacgaggaccccatttgcactattgtccagtataattatttaaactttctatctttgtggcatttatgattacttattgtaaatgaaactggtgtgaaggacacacatttttaatgcctttaattgtcatccaaaggcgctttccagctgaaaaattccatgattctaaatgtgtatcatcaatttcatgtcaggcaggatcagaggcttggtcaatattattttttccacagtgaaattgtgtaaggcaggagatcctacttaagctaacatatgtgtatccttcacaatggaagaataaataaaagtataagttgtggatttgctaatagtttcttcctgctaaaaatattaacctcttctattccttaacaataacttaacacatgtagttttagcttaaaattttggggaacttttggtgtcttgaagtattttctgcaaatttatttctcatctccaaattctatgtcccttttctgaatgttcttgatgctacattttcatgtattcatcaacttgagatgtttggctccttttttttgtttgtttgtttttgagacaaggtctcactctgtcacccaggctggaatgcagtggcatgatcatagctcaccacagcctcgacttccctaccttaggtgatcctcccacctcagcctcctaagtagctggaactacaggcacgggccacaatgcccagctaatttttgtattttttgtacaggcggtgttttggcatgttgcccaggctggtcttgaactcctgggctcaagtgatcctcctgcctcggcctcccaaagagctgggattacaggcgtgagcgaccacacgtgaccttttctactgttctctgagctccccaacattttcatatttgccaaatcactgttatgtacagagaaatctccatcaactatttcattatttgaaagaagcgacgccaataaagaatttactctctgtttacttggacataaagagctactccaaattaagacctgacattttctcatctccttctttgcaataaaaataaaattgaaattaaactgggataagtgcaacacattgtatctaagcagccattgtcaaactgtttctaaatatcaacagtaaaagctctaatctgagtcaattttggaatgcacatatattccaaagggaaatgaattttcaaaatggtataggactcaacatcgcatattttagtcttcaggccaagcaggaaaatactaacaagctacttcttccaattttgctattaatgcaaattgatgtaaaactacctgctatgggcgaaacactcagcctctgcaaatggtctcattctgaaactgtcagtgtcagagaaatggtgtttcccttccgcagctcattgaaatggagatggcatggaatggagtaaagggatggggatctgctttctaatcaggcaaaattagattcatttgaattggtgcatggactgaaatgaagggaaaatccaaccagtgcctatttttacctccttagacagcctttgagcagctaggcatagtaaaaccatacatgctaaaatttcccacattgatacagaattcatgaggaaattattttcacactttaatggaatgggtctattgcttacattatacaatgtaagggaaaaaattactaaactcagaagcacatttccatatttctcatcaacttagtttctttgatacaaacataagaagctaccccaactattacagagcacattttgcaaatttcactaatgcatcgtactcatgtgacatcaaaagcaaaaatatcaaagcaaacacacagacaacaaatgaaagcaaacctttatagtgtatcattcagtgaaaaatacatgttctaaagagttgtgatatatgatactacggaactataatatattccagtttctacaatttcagttcttttcagatttggtgtttataaaataacctagtaaagaagtggtaggagaaagtgaaattttacacagtggattatgtgaaacacaaactaatgaaaccagccaaagtttctgagttctttttttttcccagccttcccccagccaaatgagtttttaattcatataggatttttaaaaatcatttatttaattctcctatattttagaataatagcgttcctaggttagtagttttcagactttaagttttcaggacagcaaaatttcccaaggcagtagaaagagctaacatagagttgccaaactgttaattttgccaataacaacaataacaaaaagctaccattgccatcatttcagacaggaaaggatatttccacaccaaaaatgtaggaagttcataatgtcagaatacaaaagagctcttcccaagaaatacaatttgttaaccgtagataattttaaaggatatacttatagttttatatacatttagaaacatttataacattaaaatttattttatactacaacaaatattatgttcccttggtacaatttttttttaatttgatagcactatatgtatttcatactctggtatttgatagcacccatgatgaagggctctaaggtgtcatttgttttggtgttatatttttatcagtgccatcatgaaaaattctgttttacagatatgagcaaaaataaaaacaatagtcttaatagtgttttgttttttgtttttgagatggagtttcactcttgttgcccagtctggagtgatggtacgatttggactcactgcaaactctgcctcctgggttcaagcgattctcctgcctcagcctccagagtaggtggattacaggtgcccgccaccatgcccagctaattttttgtatttttagtagaggcggggttccgctatgttggtcaggctggtgtcaacctctttagcttgggtgactcatccacctcggcctcccaaatatgctgggattacaagcatgagccaccatgcccggcctaatgccgtttcaattattctgacatagtctaggcaaatcaatatgctcaggaacagtagctcccacattctcaagtccttccttttaccttgcttacaatgggcaggtagaaaggccggttgagccaggccaggtgggtggctgggactccgcaggaagtaagctcaggactctcctcagttattgcccctcactttcagggcagaaccatatggtctccttgccttacagagagaagctgggaatttttacaataggtgttctgtgggccagtaaaaactctggcccttcccggcatttgggaaccattgaaatgggtcctttagtctttgaattcctgaattttgtgtaatccagaggagcctgagactctgcgtggctatgggttgaatccacagccatcaaaaagcaccttcccactggtaagttaaacacagtacaaaaagcactggttctagggacagaaaagttgtgttcaagtctctatttaacatagacagttgactcttgaacaatgtggaagttaggggtgttgacccttccaggagttgaaaatccaagtataacttttgactccccaccaaaacttaattattgatagcctgctgttaaccagaagccttactgttaacataaatagtcaattaacacatattttgtatatgtattatatattgtattcttacaaataaagtaagctagagaaaagaaaatgttattaagaaaatcataaggatgagaaaatatatttactactcattaagtggataatcacaaaggtctcatcctcatcatcttcacattgaataggatgaagaagaggaggaagagaaggggttggtcttgctgtttcaggggcagcagaggtggaagaaaatctgagtttaagtagactcacacagttcaaacccatattgtttaagagttaactgtacttgatttcataatgttttctaatgtttttctcatgttcagatgggggttgtggggaggaagaccacacagataaagtgcagtcaagaattcttgatagaatttgggaggccgaggcgggtggatcacgaggtcaggagattgagaccatcctggcaaacacagtgaaacaccgtctctactaaaaatacaaaaaattagccagatgcagtggtgggagcctgtagtcccagctactcaggaggctgagacaggggaatggcatgaacctgggaggcggaggttgcaatgagcggagatcgctccactgtactccagcctgggcgacagagcgagactccatctcaaaaagaaataaaaaataaaaaagaattcttgatagaattctcatcatattctatcaaggttacatagtatcaatagaacatcactattgatatcaaccttgctcaactggttgaaatagtgtttgtcacatttcttcattgtgaagttacttttccctctttccacactactcttcagaaggaagtcacttaaagaatgggaagctatgttccacctccttcagggtacagtaccctcataaattgtttgaaattcatttacatggaagatttgtctattctcctccatctatttatttatttgacaatttatttatatcaatatgttgtcattagttttcatttcaactgttctaatatgtgtatagtaatggtcttaatttgcatttcccttaatggctagtgatattgaacatatcttcaaatgcttgtttgccatctttgtatcctctctggtgaactctctggatgtcttttgccaactttcaactagattctttttaatgttgaggttcagagttctttatatattccagatactagtcctttgtcagatgtgtgatttgcaaatatttctcccagtctttagcttgtctttttatcttcaacagggtcttttgcagagtaaaacttttaaatttttgataaagtccaatttattatttttctaacggtttgtgcttttggtatcacattcaagaacactttaccaagcccaaggtcccaaagactcttctatgttatcttccaaaagcttcatagttttgcattttacatttacctctataattcataatcagttaatttttgtataaggtatgagatttagatgaagatttatttttgtctatgaatatctaatgagccaagaataattttaaggaagtgatatcaatggaaatgaactctaaaccagatgggaagaaaatgaagatggggccaggtgtaatggctcatgcttgtaatcctagcactttgggaggccaagtcggggggatccctcaagcccagaagttcaagaccaacctgggcatcaaagtgagaccccatctatacaaaacaaaaaattagcctagtgtgatggtgcagagtactgtggtcccagctactctggaggctgaggtgggaggatccgaggcagaggctgcagtgagctgtgatcatgccaccacattccagcctaggcaacagagggagaccctgcctccaaaaaataaataataagtaaagatagaaggctaacagataattcttaagtgtcagagtccatgcttaaggtaaaataaatgtagctacgggctgggcttggtggctcatgcctgtaatcccagcactttgggaggccaaggtgggtggatcacctgaggtcaggagttcgagaccagcctggccaacatgggaaaaccccatctctactgaaaatacaaaaactagccaggcatggtggtgcgcacctgtaatcccagctactaaggaggctgaggcaggagaatcgcttgaaccagggaggcggaggttgcagtgagccgagattgcaccactgcactccagcctgggtgacagagcgagactccatctcaaaaaaaaaaaaaaaaaaaaaagtaactacaaagccagtcagccaaagactaagaaatagatagtagttggaaatttcagaaagaaagcaggtactggtggtgtaaataaaaagcccagtagtggccaagggggtgactggctgagatgaggtggagtggggtaaagaagttaaggaactgagatatcagggtgtagagaggcagcctgtgaaagctgaggtcagagaatgatgcaggagtgggtggagagaaagcacattggtcaggggctcaagtgtttttgaatgagcaggaatgagcggaggtcaaggagatgactggtccaagatggggggaaaggagcaagaggagacagtgtcaggagggagggagagaaatgctttgcagtcaacagtgaggagccagggggatgctttttctacttcttggccttagggtgcaagggggatgagaaagaaaaaacaaaacaaaacaaaaaactatcctgtccttgaagaggcagtggggaaggaaatggcctcagaagtcttccaatgtccgttagagcaaacaggtgaaaggaatatttggagaaaatgctgcatgagatgatcccaggacaagaggcaggagggcagtttcaggaactcagaaataccaggaataggaagaaggctttgagtcacactggagagcagagcccaagtgacagagctgcccttggttatcatgaaattctgagggatacgtcgttgttagactgggcctgaaagtcaagagtggaagttctaagagtcctcagagaaaaagagggtgagctgatgttcaggcctctaactgagataattatgtgaaagcactttgcttatttatttatttgtttatttgttttgagacagggtctcgctctgttgcccaggctggattgcagtggcatgatctcggctcactgcagcctccggctccccagttccagtgattatcctgcctcagcctcccaagcagctgggattacaggcatgcgccaccacacagctaattttttgtatttttagtagagattgggtttcactacgttggccaggctggcctcaaactcctgacctcaggcgatctgcctatctcaacctcccaaagtgctaggattataggcctgagccactccactgcctaagcacttcatttataaagctgtgtcttaaaaagctggaaatcactagctattgttaggtggtgaaaggcattacacaaagcaaattaatatgtttgatacttgttgtccagaaattatatatttatgattatatctacacacacgataatattaaaaaatatccattgttgctgggagcagtggctcactgctatagtcccagctattctggaggctgaggatggagaattgcttgagtcccggagttggaggttacagtgagctatgatcatgtcactgcactccagttggggtgacagaacaagaccctgtctctaaaaaataaaaataaaaaaatccattggcctagacataacaatttcatggttagttatatagacaaatatataaatacacacatacacgttagccaaaaatggtaagttcaagcagctgtaaaataaaatgcaatcggacattttacagcttgtattttaaggtcctggctcagttcaatctgtcttctcactggttcctgcttctctcttctttgttctacttctatttctcaccatgttttgacaggtgaggttgttcatgcaaagggatccaacaaaaatacaggaatgccacctttgcctcctcaaccaggacagagcaaccctccctttcctccttgcaacaaagcaggcaaaacacacattctcctaccgccccaccatgaagctgaggcacgaatggcagtgatgctattgttttgcttgcagggagggaattttcatgcaatcaataagtcacctgccctctttgcccaggatcagctctccacccaaacccctgtgagcttcagtggtagaatacttcaagcttcagccagcacaaacatgtcacagcaagagggacagcgattgtatttgcacacacaatttgtttaagtacaggctttatttgatccttaaaaaaaaagaacagctttggtattacattacaaccaaaggaatttagcctttaacctgcagtttccctattctcagtgatataaaacctttttctgataagaggtgaggcccagtgaaattttattcttttccctctttcccggaggtgaggtaatgaactaacaacttaattagaccctgttttataccaactaaaataatagaagggagtctttggtaacatggcaaaaaaaaaaaaaaacaaaaaaaaaaccccaggaacatcaggcatcataatacagagaatatatgattagaattaatcaggatatggaaagatatgtttatcctgtagatacttcaccctgaagccataccatttttatttcccctccattgggcataatggaagggacttgaaccctctgcaatggactgaatatgcattcccctgaaattcatatgttggagttctaattcccaaggtgatgatattaggaatggggcctctgggaggtcgttagagttagatgaagtccggagggtggaaccttcatcatgggattagtgccccatataacaggcctcagagagatcccctgcttcttctagcatgtgaggttacagtgagaaaacgactggctatgaggaagcaggccctcaccagacactaaatctgtcaataccttaattttggacttcccagcctccagaactgtgagaaataaatttctgtgtttataatctacccagtctatggcattttgtgataacagcctgaagggactatgacattattccccactgcccagctccactgagagcttgagagctaggactctagaggacacccgagagagagaggctggctggagaacaaagggagataggcttttttttttttttttttttttttttaacaaaggccttcttgttgctcacaaaggaggaggattctcatagactaatttccaccaatggaaaaaaataagagcagctttgccccatcctctgaacccagtgtctctccaatcatcacacagcaaggttttttgtttttgtttttgtttttcaggtaatggtctgtgtatttgttttctatgctgtgtgacaaactaccacacgcttaacagcttaaagcaacacatgcttattatctcacatgctctttgagtcaggagcctgaacacagctctgctgggttctgtccttagggtctcacctggtggcaatcaaggtgttggtcaaggttgggttctcatcagaggcttgaccaggtaaagatctctgtgcatactccctcaggttgttgaatttatttctttgccattgtagggttcatggcaactcaattcttcaaagtcagcaacagagagagaaagagagagagagagagagactctacctgggtctactaagaaaacagagttctacatgaacaaacatgatcttgggaatgacaccccattacctttgccatattccactggttacaggcaagtcacaggtcctgcctacactcaagagggcagaaacttcaggagatagagatcctgggtaccaccataaagtccatctgtgtctctctagtctagaaatttaagggtatagccaaggagttctagaagcaacatttgtagaagaatcataaaacgagggtagatattttaagtctacacacatattcacacaccctaacctacaaataaaataaaggtaggagtttttcttggtggtcaatggcatgagatattgtagtcatgcagtgtggctttgcatctctgatctataatttattggttgcttaactttactaagcctcagttcccatctttaaaatgggaatcatggtacttatctttgaagctgttatgaaaattaaattagataaagtagacaaaacacttagcacaatgtctggcataaaagtgctcaaaaaatgattgctattgtatccgggtaagatcctgaggtgcctcaaacaaagtagaattttatttttttagttttatatacttaattaactaactaatttttggagacaagatctccaaaagtcactcaagctggagagcagtagtgcgattatggctcactgcagcctgtagctcctgggctcaagctatcttcccacctcagcctcctgcatagctgagactacaggcatgtaccaccatgctaacttttttttttttagtagagctggggtctcaatatgttgcccaggctggtctcaaactcctcggctcaacccatactctcaccttggcctcccaaagtgctgagattacaggggtgagttactgcacccagcccaaggtatgatgttctctagacacagataacttaatcttcaaggttgggttccttctgagatctaagaggtttgacaccattttggctccatgcttccctcaaaaccatggtctttttaacctcctgagtggctctaccaggatctcagcctaccttttcctgtatcttcatcaatggaaccggtaaacttttgcaatgctgagttcaaagtccctgcagaccttcacacttcataactggaatgccctggaggaggctggcctctttcctacccacctatgcctccacccatcctgtccttaggcagacacctacgggtcctagctgactgtcttagcacaagcttcctatatgctagacctgcttagaccttggaacctggctcctgagatggattcactcaattattcactcactaaacacctaggtgacacttaccaagtgccagacacagagctagtttgaaagagagagaagagtgatgaagacagaaccctctcttcaagcaggccattggccaatggagaggcagacacacaccaacagagtaaagccaacacttgactttggacaggaatatatcggacatcttacaccaatccctcagcctgtgaaaatgcaatgatcagccgggccccttgctttctcccatgtctcagttccatcaagattcatgctttctgtacggtctcacaccacttgtgcatttccaacttctactacagttttatgcctcacgtgataagcagtttttgtgctagctgtttagtaaatgtttagtacttactaaaacatttcatacaccatgttttcctttctccgcagaacgtgtgtgatggacttatggactcattcactgcatcgatcttgggcactgcccagcttcatgttccactctcccgtttatcccaaattgctgaggatttcctaagaaccatcactttccagagctcattattttctgttatttgcctcagcagcacaagctgttttcacaaagaaataaagggtcttctattccagaagagttcttctatgcatgtaggtgagcagacagtgcagagccatgctgaggtgtgtgtgccttgctgtcactgtctctcctccgggaggaacactaggctcctgtacaccaggcttcccacagcccaggaggaacacatccacgccttgccagtcatttgcatcttagtaagactaaaactaataaaactaacaataaaacttaaaatagattgaaggattacagtatgccaagcatatatgtattgtgttatttggccctcacagtcaccttttgagctaggcaccagtaccagctttaagagctcaggaagctgaggtgtcaagattttaagtcatttgctcaaggtcacacagctaggaagtgtagtgggagagtcagtcccccatttgtccaatgcagtgctgtcgcccaagtgtgaagagggatgtgcgggtctgagaacaaagttagcctgcttagtactttgtccaaggtcagccctggctccaagcccaagaaacaaggcaggatcagcagccacaaagtccaacagtcagccaggctcccatactgcaggggtctctatcacagcccagctctggatatgggcaaatgaaagctagcagcagagtacccaggctacctctgcacagggagtgactgcggaacttcaagaacaaaagagaggcaaaagatgtggggtggcctgtctgggagggactagggaacagggacaccttgcagataactctcaggactgaggagtaaatatcttttattaaacaaagcttataattctgactctaagcctggcgttcctaacaatggcagggactgatggctgtgaaaggcactaatcagacacagtagattcgtgtttacactgggaagggccgctgatcccgcataggcctttgaagccacccgtgctcacacagattgtaatgcactatgaagtcatgtcttcaaataaaagggaggagttgaaatagacctgtctagccagttatttctctaaggcacttcaaagaaacattttctttgatcgttttgactttccatctataagaaatgtgaacatattactcatagaaattgctgagagacctcaggctgatgggggcttcagtttgacccatcgccagtgaaatgggaaggataaggtagggaagggcacactggttcttaaaacttccaccaggaagtgacacacatcccccactccctcacatttcactggccaaagcaagtcacctggcttatctaacttcaaggggagcagagaaacaccatcccaccacatgctgagagggagggtgggcagatactcatgacccccagtaaacagcactgatgactaacacaaaggccaagtgataaggaggttgtttttaggaggtcaaatgaaggagtatattcttcaagaaaataaggcactgatgagctttgttacatctccacagtaatttctaaaatggaatttccccatgaaggcctttaatatgagcattacaattgtttaagaaaacaaagtgtcctgatttgactaaattatcaaggaaaaatgtggaaattacaaaactgggaccaaagcaattttcccatgtgtaactggaggatgaaacaatccgtctctcattctggattgttggtgggaaaatccactataggactctacaaaggaaaactaccaaaacttggatggcaccttaaaccttttctccctggaacttgcctattatctcgctttttctctcagcagtttcaacgcattttacatgtatcaccacgtctggagtttcagataacctgacgatgactatttatatttcactcacgtgttccttcattcaacaaacatttattttgaggatctactacacgcagcattcttctctagacactagggatacaaagataagacatggttctacctgtaaggtacttattaacaaatttagttgagggaagaaagaacatgaatcagaaaattatagaatattgcaaaagtacaggctggtctcaaggtagtgagatatcttaattgatttttcagtcagctgcagatcgaattattcgtcctactcttcccttctcattaccgtacttgactagactttaagaaaaaaaaaagtaggccaggctcggtggctcacacctgtaatccctgcactttgggtggctgaggtgggcggatcacctgaggtcaggagttcgagaccagccgggccaacatggtgaaaccccgtctctactaaaaatacacacacacaaaaaaaaattagctgggcatggtggtgggtgcctgtaatctcagctactcaggaggctggggcaggagaattgcttgaatctgggaggtggaggttgcagtaagcccagattgcacctctgcactccagcctgggtgacagagtgagactctgtctcaaaaaaaaaaaaaaaaaaaaaaaaaaaaggtgccagctattatgggagagctgaaatgatatttataaggacatcaccttccttgcaagggagtagtgtccgtgtaggggtcactcagtacacagggacatggcttgaggcagtgcaggtgtgcattgcacaatatcaaggcacactcatccccttacaggcttcttagatttatgcagatgtcacttaggtgtcttgaaccacgagtactcctatctgtgccaccatttgaactgcgaacaggacagccagcaacgaaccaacccttagttctctgaaatatgttcatcatatgcttactcttatttttattagtatgatataatgataatctctaacttgctgaacaattttttttaataatcatcgattatacatccagtctgactaagactgttctaaccacattggaagtccgagataaagatatgccacagtccttgacctcaaaaagctttaaaactagatggggaagagagacaaaagcacataaatcagttcgaggataattaaatgctaacttgtgtaacactaagtttaaatacaatctgagttatgaagaccaagacatcagccttagatgggacttcatctggagcttaaaggacatggaatatttgggtaggccaggggaaagaaaatgatgagaatgtatgactctatcgatctttggccattacttcctgggcaaaacacctcaaagctcacgccttgctgatggagagtagcagctgcccctgttgtcacagcaaagagggtggcacagctgataaagggtagggaactctgcccatcactctctgacctgctctaactcctttcagcacatcaagttaccctgtgccattgtcccaggttccttccgtgtagagcaagtccttccttctgctattaccttgcagcagttaagagcacacgctagttcactaattctccaagtgtggtccccaaccagcaacatgagcattactggggaacttgttagaaatgcaaatccttgacccctgccccagacctagtgactcagatagtctgggggttaggtccagcaatgtgtggtttcccagtccctccaggagattccggtgcacacatgtttgagaaccactgggctcagcagacaccctggcttcaactcctggctctgttggcactcatcaactccgtgcctcagacagatggttaatcctgctaaatctcaaaaggatataatagtagcacccatccccatggggctattgtgaagaaaaaataagttaatgcataatgcaaggcccttagcctaattaatccttgataattggtaagcactcagtgacttagtacaattatcgcctgataagatttccctttactttttttttttttttcatccaggctggaatgcagtggcacaatcatggctcactgtagcctcgacctcctgggctcaagtgattctcccacctcagcctcctgagtagctgggactacaggtatacgccaccaagcctggttaattttttgtattttttgtagagatagggtttcaccatgttgcccaggctcacttcgaactcctgggctcaagcaatccatctgcctcagcctcccaaaggggtggaattacaggtgtgagccactgggcctgactcgttttcttaccataacatggttgggaaatcttatctaaagatatgtttctcaacatatctaaagatgtatttcattgctccttctcttctccttcaccactgtcatctccaatagccccattctcaccactctttggcttactagtctttttttcaatagcataagatttaccattttaatcaatttaagtgtacagttcaatgacattaagtacattcacattgttgtgttatcgtcaccaccatcgatccccagaacttttttttttatctttccagactaaaactctgcactcattaagcagaaattcccatggccccttccccttctcatccctggaaaccagcagtcttctttctgtctgtctctgggaatttgactactctagatacttcataaaagtaaaatcatacagtatttatcctttgtgattggcttatttcattagcataatatcctcaagtttcatccatggtgtagcacaggtcagaatttttatcctttttaaggctaatattccattgcgtgcatagtacacatttgtttctccattcatctacacatggacacttggggtgcttccatcttttggctgttatgaacagtgctcctgcaaatataggagtacaaatgtctcttggactctctgcttgtaatttttttttttttttttttttttgagacagtctcactttgttgcccaggctggaatgcagtggtgtgatcttggctcattgcaacctctgcctcctgagttcaagtgattctcctgcctcagcctcctgagtagctgggattacaggtgcctgccaccataccaggctaatttttgtatttttaatagagatggggtttcactgtgttgaccaagctggtcttgaactcctgacctcaagtgatccacctgccttggcctcccaaagtgctgggattacaagtgtgagccactgcatccggcctctgcttgtaattcttttgggtttatacccagaagtcgattgctggtggtttactaatcttgatagcccccatctttaagagaagccttagtttcctgtctcctctgtcaaggtggcttagcctccactaccagagagcagtacatcctccttctgcatctaggagaatgttataggagtatcttgtattcttcaaaaacttgaaactgggtgagtaaagggccagttttcctctaaaacatacttaggcccctctaaccctagacttcatttcatcagagtaaatggtttttattgtctgtctacaaatacaaactcctcaaagagaaaactttattttctgccattccactggtgacaaggacctgagaataaaggaggattatagggcagactgtctgctatgataacttatttttcttccagttgtttccaaccaaacatacagtattattaactttgactgtggtcgtcattttggcttcaggcttaatctattttgactaggaatattgtcctcggaaacactacaatttcctgaagagactgcaaatcagcagtcttgactaaactcatacatggccgttatctttcctctgcttgaaagatgtacaaagacagtatgtcattgtgagccaggaggttttctttatttagcgtctgccttctggctcagctataaggtaaggcaattaggtacccaacatttataacagacatgtttaacttccctgatatgtcctgcagaagttaagcaaacacaaagataatagattttaactagcagttaggaagtttagacttcaaacctttgagactgtataaaatatgatggcgagacaatggacaatgtattcatttactacttaaaaccatcttgaactgaaatatttaaggtagaatcatttctacctgtgaggtccacaagaaatgtgtactaaacatcttttaatgcaagactttgatgttgagcatggtcaagaataagcaaaacaaatgtgatccctctaggaggcagtgttgtgtagtggagatatcttgattcaggttggctatgttgctgttagcctccacctcatactggttatatgaccttgagcaaattacttaagttcttcatatctcagtttcttcacctgaaaagtgtagatactattagcacaggaaggccatttcctgtcatttaagggtaactggtatctggaaattcccacattgattgattgattgagacagggtcttgctctgttacccaggctggagtacagtggtgcaatcatatcttgctgcaactcaaactcctgagtttaagggatcctcccacctcagcctcctgaatagctgggacttcaggtgagcgccatcatcccttactaattgtttcttactttttttagagacgaggtctccttatgttacccaggctggtctctaacacttggcctcaagccatcctccagtcttggcctcccaaagtgctgtgattccaggaatgagccactgcacctggcctctagggctacttaaaataaatgcaccaaaatatcatttggaaaaagtaggtgttattgggacattttcttgaaaaatgaactaaaaattacaccaattataaaactgtcttacatttaaccaaatttagtttaaaatttcaactgtacagttattctcagaaaaaaattcaacaaataaattagtttggagcaataatctattgctttggtattggattctcccttttgaagcacttgtcactgttcccatcattgttttcttcaattgttaacaggttgagtcatgtcaaatccttgtttgccattggcttgcaagtagttctagtagctctcctccatcactttcatcaacttcatgaaattctaaatgtttagcaaattgtgctttttccctttgcagtccttctgctttatattttcaatgtagagtatcatgttgtaaatatctgacaattaatgagactatggccaacaagggtgactggcccactggtcagaaaatatgatggatcaaacaggaatagacatttgaatggagactgattttaataaagggccagctcatgacaatttttactttcccaacacctattaactacagagacgtggaaaatgagtactcagatagcataaacgctccatttctcattaaattgtcaaatgccatggctcagcacagtgtcacatgagtaacatgtgtgccttagctgttaatattctcattatttatttaagaggacccacatgttcacaaaggagttgaaggcatttaaatacaaattgtatataagctaagaagaatattttccttaaatcactccacttttccatcaataaacaccatgattagagaacaaaggaatccctcactcttaaacctgcctctattccttattcccctttccccttattttgtcttatcttctctcggcaacacttattgccatctgacagactgaaagtttatatataaatacatgtgtgtgtgttttcatctttctcctgccactagaatctaaatttcagagtgcaaggatttcctttgttcatttatttgtccctagcaccaagaacaagatctggcagatggtgcgtgttcagtaagatttgttgaataaatgatgaatggaagactcctcattccagggcccaagtgcccagggaccatcacagcaattccatggctagggatcccaatgcactatgtcctgaaagagtctctgatgtgaataggaaacacaatcagtggatactgtgcaaatcctaagaagaaaagacagcacagagattccaagaagcacacggtagattgaaaggctgtgcacagttactgcaaactcagccctgatttgtggttgaactaggctccattctaattcaattcaattcagaaggaatagaagggtcttctgtggggcaaaggaagcaagttggaattctcccttccacaaagaaaaagatatgtgtttttgcatcatggtgtagtggaaagaactacctgtacagatcagaaaactggtgtgctgatctcagctctgacgtgacttgggtctgtaactcagcaaaatcacttcaagctttcagggctctacagcttcatctgtatgaccagagggtgtgactagatcagcatttcctaaagcacgatccttggaacaactggcactctagacctgcactcacaggtagtcgctagacacatttagctattgagcacttgaaatgtggccagggtcacattttaaaatataaaaactaaaacaacatacaaggaaaatttaaagtgtctcactaataatttttatgttgattaatgttggaataataatcattttgtagattgggttaaatacattattaaatttgggatagaaggggaggctgggcatgttggcggaaaggggtatatggggactgtcagtactttctattcaattttgcagaaaattgaacctagaaccaaaaaatgaagcctatttataaataaataaaatttatataaaaagttaggtttacgtgtttctttttactttttaaatgcggctactaaaacattgaaaattacatatgtagttacagatacagttggcagaatatttcaacttgacatatatttctattgctgttctataatctgaaagaagaaaaaatgtttctctaaccaaacactgtacatcatatcccccacatttcaccacccctctcccttgtcatcacgctcattattaaggtgtgaatatcgacatggatatagggtgtggaaaggtagacaatggagatttggaggggcgatgggatgggagaggggtggatgatgagagattacttaatgtgtataatacatgttatttgggtgatagatgccctagaagccttgacttcaccactatgcgatctatgcatgtcacaaaattacactcataccccataaatttatgcaaaaaaatacccaaagtgtgtttaatacacagtatggagaaacatgtttgattggcattttctagatgcatttgataatggaatctattttccactgaccatctattcatacccttcagttctgaggaagatattctggaaatgtcagatctagattctctgtaaagtctttttggagtccaataatttgtgacattaggattctaaggatgtggaaggaggccatgagtgagagtctaacatgcctgttcagatagggagagttttaaggagaaatcatgttcttcaccaacacctcacaggagaggtagcagctaactgaatgctgaaagggaagaaaattgggagaccagagcctggaatcaagggactggggaggagagccaagctcaggcccagggggtctcctaagagaagtaaacctggctctctactgtgtgggatgctgatgcttgagaaaccagcaccacaggaaatgtcaaagtcctggatagaagttggaaatggaaaacatgaagttccagcagcagcagcagtatgagcaactagagggctgcagaaatcccaccgttgaaagaactccttccatgtcagtgggtcaaacccagccagggaggctaggctgctccacacttccaccctctcacccccagggctccagagagcagatgaggagaaacccgtaaggatttatctagccagataaagcactgaagccacagcctgtggcctctgaccgagatttctacgtgagtgataggaaacctatttctgtgcctgacatttctgcctgtttccagacagggtgtcccaactcaagtgctatgtggcttaggatttctggggttccattatgaattgaagtttctctgggatgaacctcaaaaattttcctaccgtattgcttcctaacttctccttggtcctctgaaactgccaaagtcttgctttgtagaattactttctgtaagctccaagtgtgtatttattttgaattaacattgtttacagctttattgaagaataatttatatacaataaacttcaccaacttaaagtgtgaatggattttagtaaatgaaaatagtcatgccaccaccaccacaatcacattttggaacactgccataaccccgaaattgtcctcaggcccctttgcattcaactcctgtccatatccccagccccaggaaaaaaacaatctatttattgtccctttagttttgtctttttaggattttcattaaatattttgagacagccaggtgggaagggatccccagagagactccaaccggcctgctccccgggaggagtgcgcactggggtggagccttgggaagttcgtgccatttgcagggggaggagcctggcctttcttcttcctgggtggaacccgggattcaatctgtgaggcggaagcctttactagcaggactctcactctgctgagggtccctgtttgccctttttttccttttcacccaataaattccatttttctcacccttcaaagtgtctgtgggcctaatatttcatggccgtgtgacaatgacccggctcttagctgaactaaggagaaagccctacaacgatttcaggtaaatggaatcatacagtactatacatggtattttgtttttggcttctttcacttagcctggtgcctttaaaattcatccacattgttgcatcagtactctatagaggaggaaaaataatttttcctctacctttcatgagttcttaattggaacagacccttgtaacaaaaaacagattaataagagaaaaacaaacagaagattaatcacatgtataccttatgcatatgtggaagatactcagggaagagtgaataaaatcgccagagtagatctcaaaagcttgcttacacttgagactacagtcatgtaccatgtcccctgaaataaagaaagaagggtgtgggaaatgcctagttatggggaactggccaggaaaagccccataaacgaggtttagatttgttgtacagatttaagcctatgccttctccattggcaagagtgtctagtgatctaccatcctttcctcctggtacagagagggagacaatcttacaaatggagagttcctttatagatgtacatttctcttacaaaagggtaacctctactctcattttcagagcttctcctgtgtctgctgtttcccagaagaatcacctcaaataatccttatgccaaaaaagcatattttgaggtggtatattctggtctcctacagtcatattttgggggtattgtgccctgtagccccatcaactccattccttttagttgttaatatttaactgtatatcaccattttctttttatctatatatcagttgatggccattcagattgtttccagttcggtgttattatggaatgatgttatgaacattcatgtatgtctttcagtgggcatattttctcatttctcttgggtaatacctaagagtggaattactgggcggtaagtgtatgtttaacattttaagaagcttctttttttgaaacatctgtattgttttccattgccaacagcagcgtatgagatttctagttgctctatagcctcaccaacacttattattgccagtatttttaaccttagctattctagtgtgggtgtagtggtctcccattgtggttttaagttgcagttctgtaattactaatgatgctaagcattttttcatgtgattttttgacagttcatgtattttcttttgtgcattgtctattcaaatatttttctcattatattattggattgttttcttaagttgtaagagaaattaatgttatctggatacaaatcctttgttagatatatattttacaaatattttctcttaatggcttagcttttcattttctgaattgtgtcttttgacaagctaatgttttaactctttatgaagcccaatttatcaatttctcttttacagttcatgctttttgtaatctattacataagaaacttgccctaatccaaggttacgaagattttttactatatgttattctacaaggtttatagtattggctctgagatttaggtctactctctgttttgagtgaaatttgtgtatgctgtgaggaaaaggtcaaggtacctttcttaatatagagatccagttattccagtataatttattgatggctgttcttttcttaccttggcactttatcaaaactcaattgactatgttagtgtaggtctatttctggactctcaactctgctgcattaatccacatacctgtccttatgccactaccacactgtcctgattttctagcttttctagtaagtcctaaaatcagatagtataattccattaactttgttctttttaaaaattgttttgggtattctagttcctttgcagatgctgcattttaaataatgctttaatgattgggaaatatagcatatctaatactatacccattttatttatttatttatttattattttttttttgagacaaaatgtcactctgttgcccaggctggagtacagtggcaccatcttggctcaccgcagcctctgcctcctggatttaagcaattctcctacctcagcctcccgagtagctgggattataggcatgcaccaccatgcttggctaatttttgtatttttagtagagatgaggttttactatgttggcccaggctggtcttgaactcctgacctcagatgatcagcctgcctcggcctcccaaagtgcagggattacaggcgtgggccaccacacccagccatgcccattttatagacaaggaagccacagacttatagacaaatatctgacttcacatcacaagtctgagtttctgtctttttgtggtcacgtctcattttcctactggactgccagtaaggatcctatgacagcagaaactatgtaggttttcttcacttctgaatcccaggtaaagtagcttttatagtaggttttcaacaaatacttcttgaacaaaagaaggaatcaggcccaagagaaattcaatgacttgtgtctggtactaaggtcagtagcagaactgaatccagaacttgagtttccaaacccttcatttagtactttttctatcatgcaatgtgagtggaggagatagagaagaaatgcaaagaagaaaaaacaaagcaaatgatgttggtgtagataagagcattattagaaagtttgataaatgcttttgttttgatacatctcagcctatagcctgcagctgccagccactaaacacttagatgtttatgttttgcttgaaatactttttaacatgcagagggatatccagatgattcacagatcccagaccacagcctaaacaggaggcaacatttccttcctgagcatggttctaggaaaataaagaacaggtgcatgaggccagaatgagtctctggggctcacagcagacagaccccagctgaactcttctggactgacaatgcttccaatgaggaaagatcttcagggagcaatgtttggcaatgattttctccctacaatctaattataaagtaatttcaatcaaatatatacaaacatatatatatatatgtatatatcttgtgctatagttcttctttttttaaacctggaaaaccaggtgccagaaaaaataataacacggtgttaatctgagaaggaaagtaactggaaaagaggataaggaacgtacaacaatcagacagtggaggtggctccgactccacaacctctaattcatgtgacatgtaatcttcttaaacaatgattatagatactaactgtgtatttgaaggggatggaattgtcattaagtgctatgcaatatcctgtcaaccaaattctcccttcaggtaaacacatgtcgcttctgttgaaattagtaggtgtcacaggtaaccgggaggcaagtttggttctggaaccttacaaggcactgtgaagactttgatttacaagcgattattaaggaagatttccaccagaagtagtcatccataggggagaaattaagtatctttatttcaatagagtcaagaaacattcgctgatggtagactttgttcagagcaagatgctgagtgttgctgcgacaatccaagaagaaacacggacagccctgccccaacttgctcccaaatctgcaggtgaaaggcagaccatctcttgtgtctgcctcattccctcagttctcagcttaaatgtcactttccctggatgacattcgatttgcccagtaagatgcagcatatttgtaattacttatttaaggcttgttttcctctttacctccaagaagaaagggaccacgcccatcttatgttggcaggctgtggatgtcttgagaagaacacaggttctagagccagcagcctgtgttcatatttcagcttcaccacttatctcagtatgatcttgggcaaatcacataacttctctaagctttggtatcctcatctgccagacagaaataataattctctagtacttatctcatagcactgctctgagctatgattaaatgaggtaaagccactaagtggcctggcatgtattaagcccccaataacaatgaaataaaatgtcagcagataaatgaagttcatccctttagtgaataaaaaaaagacaatggttgccattctctggttattataatgatgatacaacaacaataattcttattgaatgcttactatgggccaggcactgtaataaatgctttacatatagtcagtgaatttaggacatgtggatatcaagccatcgatgacaacccggccttttaaactcttctctctgggcatatcagcatttattagggaagcaggaccatcagaagagccagtgttggtggcatacgaatgtctgtgttagtcaatgtcttggaaggaactgaatgacatgctcaaagggttaattgaggaggatgaaatgaaagaactgtgtcaaggatttgggcacggttaaggaaaacaataagcatcaaggaatacctagggactagcagcatttgggctgttacttcccctaagcttgaatggataagaaagagaaatggtgtttccagggtgcagtgagatctatagtcaagggaggggagctgccctgcagatgcagtagtgggagatagaggatcccagccatgccaaaaccatggtgaggcagggagcatccagagaatgctcagagcactctcctcctgcttgcttcatctcctgttgctacctctccatggccaaactgtgctagaagccagacagtgatggagccaaggtgatgcagcccataattatctcctcctgaagcagagaatcaaacagagaagggctgagaatgaatctatttagaagagcaaacagaataacctgcacaaaaccactgaccatcacatctagtcaaacttgagtaaattcatgttgactacatgaagaacattacagggaagtgaggaatctcaacagttaagccaagcaagactgtcagagcttaaaaagttaaaaagaggttggggatctggttctcagtctctttctgggctaccttatagcaatttgaggctccgtcatcagtttctgcaaggtttcaaagatccaggagaagcttagtgttgtgtcaagatgctgatggacccatcacagaagtttaatccaacctccatcccagagtcttcacaaatgctcaccaaagaaaattcccaggacgattcaggggcctctcaaatctgctccgagacgttgacaaaaaaccttaataacttgactgtcaatgctagtaacgaatccccttcccctctaccggaatgttcactccatgaacagtctacaagagcaacaatcctcagggaaatcacagatcacttgctttacaggaggagaggagtaagaacattgctgtctgtgcagagagagaggatggcaagattcagatacatgttactcggcggagttcatccgcatgaaagaatactaacaaacactgggcttaagggagttaagaaggaatcaagaccattcagatgtccctgcagtttctgcttgtttaacagatgggatccttctgagaatgctagaatagggaattttgacaccaagccacttcagccataaaccttattcttgtacctttttttcttgctggtaattttatatagcagattgagaaagctactctatgctactatagactatacaccaatacttttgataatgagttctaggatgtatttttcttcttgtatctttttcttcccgctatgatactagtaatttataagggatctgtgtaatttgaatgtatttgaataactttagctctactgtttgatttgacccaaagaagccaagacgacataagtattcccatgtgtcttagaagcccaaagtcaatgagatgaaacccaacatcaagaaattgaagcaaagttacttgtggataaagaaagcattaggtagtttggctatagcataataattagattttctggctttcaaaattttggattgcaatcacagcaaactttgttatttttacagttttcagtacaaaaaggagtttatatagaaacagtaaagttggcatttgagtacctttaaaaaacaaagttaaaaagaaagacaagcttttatttcctgctacaactactgaagatgcaaaaaaggtaagggccattagttagcaaccagtgtctattattcctctttctgctgtcattgttgaaagatgaaagttcatgcaagcaggctccattcttgcacatgacctaattatcatatttagttgaatgtaaaaaccctagttttgctgatgaatctgaaacatcacagccaatcactttgccttcccattttcctgtctaacatcaactgattaagattgggagtatcttctgtttgttaaatgaagcacaattcttctggatgatatctttatattttatttttttgttgtgataaaatatataatacctaaaatgtacctttttaaccatttttaagtttacaattcagtggcattaagtactttcacattgttctgcaaccatcaccactatctatcttcagaactttgtcaacatcacaaaaagaaactccctatctattaaacaatatgtcccatttcccttccccccagaccctgacaatcaccattctactttctgcttctgtgactttgcctattttaagtacctcacatgaatggaatcgtatagtatttgtccttttgtgactggcttatttcatttagcacaatgtcatcaaggttcacgcatgtcatagcgtgtatctgaattaccttccttttttaagacggaataatattccacattatatgtacataccatatttcatttatccattcatctgtcaatggacacttggcatgcttccaccccttggctagtctgaatagtgctgttctgaacatggctttgcaaatatctgttctagccctcattttcaattcctttggtcatctacccagatgtgggattgctggatcatatggtaattatatgttttagtttttgagaacacgccataccattttccatagcagctgcagcattcccacagcaatgcacaaaggttccaatttctctacatcctcactaatgttgcagaactttatccttagttcagctaaaaccaggctctttcacacgaccaggaaagattatgcttgcggacatatacaagagtaaggaaaacggaatttattgggcaaaaaggaaaaaggcaaaataattcttagcaaagagagagagagtcctgctagcagatttactgcctcacagattgaatcccaggtcaccacacaggaacaggagaggccaggctcctccccactgcaaacgccatgaatttcccgaggctccaccccgtcctcccagtgtgcaggtgggcattattcagaaagaatcagtcaggaaatggcaggcttcatccagaaccagcagtctggtttttcagccttcaggctgctttaggctcaagggcggggttttgccaggggacttttggctgcctcctgtctctatcactaacacatatttactgtttctattttattttattttatttttttgaagacagtcttactctgttgcccaggttggagtgcagtagcacaattatggcttactgcagcctcagccttctgggctcaagcaattctcccacctcagcctcccaagtagctgggactacaagtgtgcaccaccacactcagctaatttaaaattttttttctagagacagggtctcactatgttgctcagactggttttgaacccctgggctcgtgagccccctgcctctgcctcccagagtgctgagattataggtgtgacccagcatgtctggatttttaaaaaaataataataatagtcatcataatgggtataaggtggtatttccttatggctttgatttgcatttccctagtaattagtgatgttgagcatgtttaaatgtacttattggtcatttgcatatcttctttggataaatgtttgtttagatcttttgtccatttttaaattaggttatttgttttgttgttgttgaggtgtaagagttctttatatattctgggtattaatctcctataatatttataatttgcaaatattttttcttattctgtggatggccttcctactctgtggataatgccttttatgcacagaagtttttaattttaatggagtccaatctatgtattttttctggaagatttatctgattttattttaagacagagacctcagctcactgcaacctccgcctcccaggttccagcgattctcctgcctcagcctcccgagtagctgggattacaggcatgtaccaccacgcccagctaatttttgtatttttagtagagacggggtttcaccatgttggccaggctggtcttgaactcctgatctcaagtgatctgcctgcctcagccttccaaagtgctgggattacaggcgtgagccaccatgcccggccaaagatatcttttaatgtaggctttgcacggctaaaatttttgaagagcaaggctcagattggatgtggttttggttgtggtggatttttattctattcaatttacagcagagcaaaaagaataaaggcttaggtttcataactcacaaaagtacactaactgattcatatactttggatgattccatcatatgtccagcactgaaatttttcctcatggcaattgagggatacaggtctccctgcctcctctccagtctattggatgctctagcaccttgccgggaggcaccagaagggagtcagatgaaagttactctttcacttgtaggtcacagtgtattagtctgttcttgcatttctataaagaaatacctgaggctgggtaatttataaagaaaagaggtttaattggctcatgtctcctcaggctgtacaggaagcatggatgcatctgtttctggggaggcctcagggagcttttattcatggtggaagggaaagcaggagtagacatcttacatggaaggggcgagagacagggagagagagagaaaagagagatagagacggggggtgtgtcagacacttttaaacaaccagatctcatgaaaactcactattgggatgacagcaggaagcgggatggtgttaaaccatgagtaaccacccccatgatgcaatcaccttccaccaggccccacctccagcattgggaattacatttcagcatgagatttgggcagggacacaaatccaaaccatatcacacagtaacccaactcattttcttaagcaaagacaaacttaaaaatgcggaaaacatttaaattctgctcagaattaattagctcctataactgaaagagagagcggtatcctggcttcaggtatgggtggctccaggtttgcaaacaatgtcccagctctgctcttcttgggtaggcaccatttttagttagtacttctcttttttttttttttttttttttttttgagacagagtctctctctgtcacctaggctggggtgcagtggcgtgatcgcagctcactgcaagctccgcctcccaggttcacgccattctcctgcctcagcctcccgagtagctgggactacaggcgcgtgccaccatgcccggctaattttttgtgttttttagtagagacggggtttcaccgtgttagcgaggatggtctcgatctcctgacttcgtgatccacccaccttggcctcccaaagtgctgggattacaggcgtgagccaccgcacctggacagtacttctctttatgataacaaaatgatgcctgttggctcttaaattatttcttaccttctcagcagctccaagcagaaaataagttctcttttccttatagttctaagaaagtccttgtgtgatcttttatcttaaaactgactacactgttggccccacggatgagtaaacatcggtgggtcagctgaagtgctttctttgttggggagacacgttctctgatgaacaactatggtcaatattgacacctgttacactatgaatgtatttcttcccatcattaacttgcttcagctcttacatggaggaaatactcatactgatggtacactattcagggctgcatgaagatgcccctgctcccaagatgcgagggaccagtgggctaagagcagcagaaagaaaaatccatagatatattttgttttggaaaccaacatttaggcgtacatcactgcctcatgtagtatttcaaagtaaatagaatcagttcactaatcacccaattctgcttgtttttaaaaaatataaacaccagctagactgaagacttgaataggactgagtgtatgtgcatataacataaggagaaaagctgtgagtataagaaaaacgcctatcttattttctgacacctgtccaaacaagcagaggaaggtgaagacagaagaccatttcggcatattaaatatgagaaagaaataaaaatactctggggcctgtgagccagtgatctatcctctgacataactgttatttctataaagtacaattttgaagctccttgacagctgaaagttgaaaaattacttgtttatctttttcactcctccttaaatgccaagtttacattttactcttcgtaccactatgttactttctacctattctgcaggcagtcaatttaaaatatgatgtatttggctgggtgcagtggctcacacctgtaatcccagcactttgggaggctaaggtgggcggatcacccaaggtcaggattagagactagcctggccaacagggtgaaaccccatttctactaaaaatacaaaaattagctgggcatggtggcaggcacctgtaatcccgactacttgggaggctgaggctggagaatcacttgaacccaggagacagaggttgtagtgagccaagatcgtaccactgcactccagcttgggtgacagagcaagatcatgtctcaaaataataataataataataatgaaaagatttatttgcctccttatgaaagaaaattttaaaataaaataaaatgtaacatattcccaccccaggacctttgtacttcttgttcccgccacctggaacactctttccctagagagctatatagctcactcctccacttcattcaggtctctgttcagtcgccacctcattataggggcttttccaatcaccctatctaaaatagtctcctccaaccccatcactctctctctaccttttcttacaacactcattcctacctgatattttatacattaacttatttttatctgttgtccccaatagactgtaagtactacaagggcaaagacattgctttgtacccaggcactgctttatctccagcacacagaacactgccttgtacatagtaagtgttcaatgtatagtatacagtgaatatatctcaatctttttttcattgctacagacaagacagcattgttcccatgcaagggcacactcccacagggataaacacatcatggcaaagcttaaaattaattttctggcagtacaaccaatggtggattttgttttagttggaaattgggggtggaactcaaaagcattttacaattatgtcaatgataaagatcacttatttaaagatcccaaagctcttataagggaaaaaatagaattatgtcttacaagacaacacagcaaatcaaatttaaaacttttaaatatatattttatatatatatactttttttttttttttgagatggagtctcgctgtgtcgcgcaggctagaatgcaatgatgcgatcttggctcactacagcctccgcctcccaggttcaagtgattctcctgcctcagcctcctgagtagctgggactacaggcgcctgccaccacgcctggctaacttttgtattttcagtagagacggggtttcaccatgttggccaggctggtcttgaactcctgacctcaggtgatccacccacctcgggcctcccaaagtgctgggattacaggcatgagccaccgccccaggctcgcattttttaatttattcattcagtgcccatcacatggatcctgtcaaccttcagtggaccatgggcatacactttgggaaacgctgccgtaaaacaaatacctgattaagtattcattttagttcccagtatgtgcctgatacagttcactgcttatgaaaggaatataaaaatatgaacaggcctttgaggagcttataaccgagtagatactcaataaatatttagagagatcaaattttagagatcaaagcaatgtatatgtctagtatcattagaaagaatgaaaacactggccgggtgtggtgactcatgtctgtattcctagcactttgggaggctgaggcgggtggattgcttgagctcagtagtttgagaccagcctaggcaacatggtaaaactctgttaaaaaaaaaaaaagaaagaacaaaaggaagaaaggaaggaaaggagagagggagggagggagggagggaaggagaggggaggggagagcaggaagggatggagggagggagaaaaggaaggacggaaggaaggaaaacacctttgtccagtgttgagaataaatgcaatacttccaactctgtggtctcaagatttgttttgctgtatctaatgcggatgacctttatcagcaagacacccattaacacatagaagataagttgcagtgtgaatagtgccttgagactgtggcaataaaactggagccacgcctgagtttgcagtttatttggccgcacgtggccatggaaagtgagcatgaaccatcattgtatgatatactcaaggctcaggaatatgtatacaggttattaagtcaaagtagctgtaaaacactgcacgagagttgattcagtctgttaaatattttacacctcttacaaaaatatctacccaaaaagaaaattagatacagtgaataattcacaacataaatgctcttgtgtgggcaggagttgggtggtatttgtttttatgaggtgaaatctgcagttataacatagacttcttcctagaatggcaaccaggattctaaactggcaacaggcagctgcaggcctgatgtgaatttacaggttgcctagtagtgctactgaaaaatagattgtgtggtaggaggttttctcataacttttttctttgtcattgcttttcttcttcttttccctgtgcaggctgtaaacagattgtaaaatgtgtgacaccccagaatctgagaaaaaatacaaagctacttttagtatccttcaccatagcctacaagttctttccttcctcccttcctcccttcccccaccctccctccctcctccctcccttccttctttcctgccttccttccttccctccttcctttttttgagacagggtcttgctatgttgcccaggctgttctcaaactcctggacccaagtgatcctccagccctagccgcccaaagtgctaggattacaggcgtgagccaccagcaccaggctgctcttgcttttctacccaaaactgctggacatgtgcacttgatacctatgacttcatctactttcagacagccatgaggggtaggagctagggaatgaaggtggggcccgatgaatgagtatatcaatcatgtttttaattttagatatcttttggtatttcaacattttggggaatttacagaccccagaagagaccacccctcccggggctatctaattcctaaggataataacttgcctataagcatgcctttcacacacaaaccaaccaaactcaagcccatattcaccaaccacctccttatctatctctcacacactagccaatatttcccctgagctaaattatctcagggccaggtattaggcaaccacagaccacctagataaaccaaagcctgctgggattattcaaactaggcaaagctgaactgtttgccctgccttacctttcctgcagaaacaaggctctagcctaagtgttcccctcgctcctttgtcccttctgacagaatctgcatgatgtggcgtttctcctctcagaagagcaagtaataaattctactttcaatagcatcggcctctccttgtcgtcactcagtccgtacctccataagttaaaatctcacagatgcaaatggagaaaatggacttttgtagccatttttaggaacaaggcagcttggcttcaaatcttgctcagagacaaactactttccccaaggcatcatcagtgaccgtaacacacacctagtcacctagtgtaggatgggagccaggcattctctctgcatggcttcctacttcccacgtgacataaggttgcatggccatgcgcactcctgtgttgactttctacagcaacattaaggtccagaaaatttgtgtggcctcctgaagaaagtaggaatgcagatctgtagagggagtgtaaaggtggagccctgctcttccgattctcacacagagccactggaacaattataacgagcatggctgtaaacatttatttactgagtgcctctctctctgcttcatgttttacatgcatcgtctcactaaacccttgcaacaaggccattaggtaagtcctattattatcccattttagaaatgggaatttagtgttaaagacactggtcatatagctggtaactggcatcttgggacttgacagactaactctaaattcatagcccacactctaaatccctactctatatcatctgtccaagctgaatgaggctacctctccctcatgagacagaattcaagagtccagttccctttgtgaatgaaacatcagtctgaaaaccttaactcctagttgggcacctttaattggctgatggatggtaccatgtctccttccaaaccaaacatatttttggtaggttttcagaagcaagatcagctccaggcaacactgtgaaataggcaaccctcttggtttctggtgactgaaaccaagtgccctcactacctctgcagatgacccagatcactctactcccaataccgtcttctgtggtctgtgccttaggccccaaattcattctctgccttcctaaacttatcagaattctcattccacttttttgaaatccattaagggctctggattcaaatgaacctggtttctaattccagttgtacagcttttagctgtatcaccttgagacccaatttccttatttgtaacactgtcacaataacatagactttctcagttttttttaataagaataaaatgtggcatatccagtgtgttgtctcaagatcaattcttaacacatggtgctccataacgatagttcagccatgaggaatatttccccaattttcatatatgctatttaaacaaaaagtaataacactggcttccagaaccacaaaagtcagactctttccattgtagacatacatcacaaatacgtcttgatagaccaaccaggaaagtaagcactgacctagcacatttgctgggaattcaagtgatatggtttggctgtgtcctcgcccaaatttcatcttgaactgtagctcccataattcccatgtgtcatgggagggacccagtgggaggtaattgaatcatgggggcaggtctttcccatgctgttctcgtgatagtgaataagtctcatgagatcggatggttttataaaggcgagttcccctgcacacactgtcttgcctgccaccatgtaagatatgcctttgctcctacttcaccttctgccatgactgtgaggcctccccagccatgtggaactgtgagtcccttaaacctctttcctttataaattacccagtcttgggtatggctttattagcagtgtgagaacagactaatacacataggaagttctgttaaaactagacagtagaataaatgaaaattaagcaattaatctaataagagatgtaagagaatgcagtctactttacaattttgtcaaatgtttggagctctcatgtcataaaattctaaaaggagaattttgtaaaaaattcgtcacggaaaaagcactaaatcaagcatcataagacaagcatcctcatcactgctctgccacttattggccatatgaccttgtatatatcacttgacctctatggatgtcaatttccttctctgtaaaatgagaatgttggaccagataatcccaagatcttttccagttgtaccactctttgagtcaatgactccgccattatccctccccttgttctctggagattttgttgccaaaataattagtgttgcccccgagtaacatcacgtagcaaagtccagtcacgcacaggaattctaggcactgtgactgcgaattctaatccctctttggtcatgccatcattgaatgaccttgggcaggcacctaacttcagctaactgcctcaccagccctccagggatttgcccgataaatttccaactccttactctccacaagctgccctccaaaatgcctttacaatgcttaacttgggaccacccatgacaaatcatgaaattaggctttttctctgaataattctcaatcatagtatgtttctgcctcaaacataaaagccttcttttcttcctgttaaaatcataaccgtctttcaagggaggtgaaatacaagtgaaaacttaaaaggctgaaaaatttgtcaaatctatggcaaactcaagtctgggtagaagaactgatacacattgtataatagaaccaccatgatttcattaggctagaacaaagggtggaaactaaggagaaatacaagccctcagcaggtatttttgagcagatgtgtcttataataggattggcactacagtctctgacctaaatttaatggaaaataagtccaatatttctattaataataataatataatagctgtcatttgttatgcaaatattgacttaggcattctgataagggatttacatgctgtacctattagaatgctttcagctgcaagtaagagtacctaactataaggggcttggtggtttcctgtctcacattggctgaggaggagttggtcccagggttggctaattgagcagcatgacaccagggagcatccatcctccaactctgctattttccatgtgtgggtaatatcaccccttgtggttgcacaatggctgcaatgattccaggtgccacacagatatttcaacatctaccaaagcacacctcccacatatctctttttattgtttaggaaaactgtacccaaaaacttcctacaaatttcccctgacatctcattgtccaggattaaatcacattacccatacctaaaccaatcaacgacaaaggaaatgggactgccaatatcatcttagatcaatcatgattcacctctggttcaccttccttgaacatatggtatggtgaccaccctacccaaacaaaactgagccccactggcaaagaaggggagggtgagctgggaattggcagttgggtagataacagtgtccactacacacaaattattatttcaacaaataccctctgaggaattattatcttcattttgtagatgaggaaattgaaactcagagaagtcaagtaaattgcccatggtcacacagctagaagttgagaaattctgtgttcttaaccaccatattgatagttctgaagtttcagtgtatgcaagaaacattagagagtttagtacaaacatagattctcaactcaactccacacccagggattctgattcaacagtctaggagaggagccctcagtcttcattttcaacaaataatttcagttaatttggatacaggtggtgtatgaaccacattttgagagaataggattggctattacttggacagaagtccgacttaaaacaaaaacaaggccaggcatggtggctcatgcctgtaatcccagcactttgggaggccaaggcaggcagatcatgaagtcaggagatcgagaccatcctggccaacatggtgaaaccccgtctctactaaaaatacaaaaattagttgggtatggtggcgcgcgcctgtagtcccagccactcgggaggctgaggcaggagaatggcgtgaacgtgggaggtggaggttgtggtgagccaccgcacagtctgaacaacagagtgagactctgtctcaaaaaaaaaaaaaaaaaagagcaaaaaagccccctgattttctggaagtcccagactcactatctacaaaagccatccatcgtttttaagtaccaccacagaaacatctcatcccagtccctctatagtccgtacaggtcagcccctatatagtgtcaagatcttgctccctaatttaagaaggttatagataaaactttcagatgaggggaatgagctccatgagagatctaacaggtcatctaagtaaccattgaagaatgtgggaagatttacggttgaggacagtcaactcttgtgggtagggatgagagaaagccatcatcaccctttaaatattgtctaggatattacgtgtaaaggacactcagaggtaggatcaatgataagaaattatgaggcagctcattttgttttactatgtgggagaacagactaataattaacttggtcaacaatggtaaaggctctccacctcacaaaacactccgaatgcattccagcagaggctggcagaccctgtgcctgtcaccaatgctgtagaagggagtcctccattgaaaggaagcattgtgcagatgacttctaaaatatgctgtgatccttcaaccacatcctctgcaaactgacttgtattcttttttcactatagtcatttctgctgaatacctaggggtaccatttaatttcgaatgcattaatgtcctattttcccaaattgatagaatatgtctgactcttctttgtgtcttcatggtacctagctcaaaaccatgctcatcataggtacttaataaattgttggtaaatgtaaaaggatggcgtagaatggcgggtaagcacatccagatgatgggtagaagataactgttagtacttctgccctgtttaccaccattcttccctctctggacaaggggcatggaggctatatttgcaatatgcaccctcctcgctggccattattgattgggtcagaaattaacatgtgaggcaagctagggccataagactgacactaagatattaagacaatcttttaaggtggctataattgtaacatgtgagctaaaaagcatgatctactgaaaaagaatgaggcagatgacagacaaagactgagctccctggctttccatctcctgggtccccatcccttcctgaggctcatgtataagtgcgcctttggtctctgagatgaacccctctgtctttgtaaaattcttcctccctccttccctttcttcttttcttgttttagattttattgaagttggttttagttcatctcaatcagaatatttaatccaaagaaatttgttcctgagtttgctgttgaggccactgatgcaaataactcatgctcttagaattccaagaaaatccaggatttgggggaccccagtgactacagagcatttagacctttgcatgttaccagatattttagaaggttcgagactggttctactgcaggctgattttcttaccactccaaaccctaacctgcaggggcatcaaagctcttatgaaggctccaccatcagaccacaggtctccttataacgaagatcccatcccctgcagaagaaattttgaggtaggaactaacctctagcgcaatgaggcaaggccagcccaaataacagatgggaatatttagaggtatctagaactccgttatgctacaaagtgtttctccgtacaacatcttgggtctacataaggcagtatccctgtaagatgcaaatcgtctttcaaaaccacatttatcagtgagtagtcagtcacatgaacctttgtacttcagttttgtggcaaaactgtttcccaagatgcctgtgtttttcttaatctgtgccccatgctgttaagcagagcatgtggcctgtcactttgacatacttaaacaggctgtgaacaaatccagctgatgcttttccaaaacccatttcaatcttggctgcaagggcatccctggctgtgaggggtaggtagaaacagatagtccaggagtaggcaaggagatcattgagaaatccatgtttttccctcctgcaattaggatatctcttatgttggctaaagatggcaaatcattaatacatgggagataagaaagaaccaatcctttcccctttcattcttattccttagagttctgatgatcatactttgcctaggacattcggaggcccctgccatagtcctttcatcagcccttactgctttttgatccttttgtttttccccaggcataactgccccttgtgctgagttcccttaggaaaggaatcacgtttcaacaaggtcctcacattgtagaatgaaatctctctgactcattgtataaatatgcaaaaccctaaattctcttaattaaaaaagtagaaccagggaagccaactcaacttcttgctctgaatctgaacagaagtgctgtttggtgaaagcaactcctcagatgtgtgaccagttcggcatccacagacagtaatgaggaataactttaataaccaatattctataaggatagggactgtcatcagaagagacatcaataatcttctcttggcaaatgaacaaacaaaaatcactcccattttttcactgatgcttgaaatttctttaacaggaattaaatatttctggagaggctatatgtaattttggctaaaagtttaggtatttacttgttattgcaactaggcaataagtatcaaaatttttcaaaatatgcatacctttcgacctcacaattccacttccagaaatttatttctagtaaataatctgaaagttgtacaaaaaagtctgtacgtgaagcttcattatagctttttaaaaacttcttataatgcaaatttcaaacatacgcaaaattaaagaggataatatgatgaaccactgtgtatgtaccacccagctttatcagttatccacattttacccagctcctgttttatttattctccaccattctttttcattgctatttttgctggaatgttttaaatgcaattccagccatctggcattagtcttttaaatattttagttgtaatatttttaaaataagaatttttttggatcttattattacctggtatctttctttcaccatccaagttagcaataatttctgaatatcctccaatacacattcatgtgcaattgcagaatgtcaaaaatgtctttttacaatttgtttaaatctggatccaaaaattttcacaggttggatttagttgatagttctcttaagtctctgtaacctatgacattgtctccactttttattatgccatttatttgttgaaaaattaaggtcattttgtcctgtagaatttctcatattctggatttggtcaattgtctccctcttgtatcatttaatcattttttttccccctgtaaactggcaattagagcctgaggctcaattgaatccaggttctctttctttcttttttgggtaagaatactttgtagatggctctgtgtacttcgtattacatcacatcaataggcacatcaggctgttcatcccatttttagtggtgtgtacatcaattagcagattcaagtgctctcagcctaatccctccattatatactttttcatcaatttttcgcctaatggttttagcagttattgatgttcattgcctagatccattatctcgttagagattttaaagtgttgatgttgtaattttttaataccatattgttacattagctcttccttctgtaatgaagcttttgaaccccagctttttattttttaagaaaatgtcagttatcaaatagtaaacacctataaccttcacctagattcaccagttgctaacattttgctacatttgctttatcactctcgttatttatacttattttttgctgtttcattcaaattagtttacagacattatggcaagctttaaatatttcagcttgtgtcttctaataacgatgacattctcctcataaccatagttccacactcaataaatttagcattgattcaatattatctaataaagattttttaattgccaattgtcaccaaaatgatcatatatgtatgtgtgtgtgtatatatatatatatatatatatatatatatatatatatatatatacttttaaaatccagaatccttcaaaggtacatgtgctacagtggtatcatgtccagtaattttctacttccatcttctttctacatttattagttggcattcttttgtaaagaagagctttctcttttcctccattgccatcattattttttagatgctcatattgactcaaatttgtccaatgcgagcaaccataacctggttactgcatcattttgacccagtcccattggtctttgagcatttccttattttctggcacacgtgattctaggctcaccttacactttcccagtctcacacctagaatcagcagtttctccaaacttccctggttcttttcaatgaaaagtgctgtttagaaaccaagatttggctgctagatatgcttctagatatgctcattgtttctagaccctgtcagtgcacagagctaagaaatatatctttcaagaaacgtgagttcatactgatacctcttattcaaatcctatatcatagagaaatcttcctccattctccctttttatattttatcttctcccacagtaagaaccctcatttccaaaaaaattaagtgttttattgtttgctatatgctttaaaatgcacaaaatattcttagtattacttagcaatagtattgtaccaccacaaaaaacaagtaaaattaaatatttctttaaagttccttctcttcataaaatatattttattaaggtgtattaaaaatttatttgaggctggggatggtgtctcatgcctgtaatctcagcactttgggaggccaaggcaggcagatcacttgagcccaggaatccaaaaccagtctggccaacacaccaaaaccccatctctactaaaaatacaaaaattagctgggcatggtgatgcatgcctgtaaccccagctactcaggaggctgaggtgggaagatggcttgaacctgggaggcagaggttgcagttatctaagattgaaccactgcactccggcctgggcaacaaagagagactctgtctcaaaaaaaaaaaaaattttgaattaattctgctttctatgtaggaatacttgctgtagagttggatatatagttaagttcatttgtttctctttatattcaatttcagtgttgcccttttcattcttttgatttaattttattttttgaacatgtataatttttacatggttcaaaagtcaaaactacaagaaggaaaactctaaaaaataacaaccctattcctatcctttatattctattattgtccccaagcctctttggtgtctagttttatgaattcatagattatttttgatatgtttatgcttgcaaatataatcaaatatttcttcttttttattactgttatatatattttgctatttaaaaagatttatatttttaacacagtggttacctttttactaatatttaattttttaagggtcataatccctttttcttacatagacttctacaattggtttgtacctttaaatgatatcttctgtctgccacatactacctacatatcaatcaatagtcttattttacttcctcctttccctttctcttcttcaatgttttcagttgtattatctctaatgtatcagaatgtataatatatacatatttttctttcacctctgttcccatctttgtttaagtcttagagctacaattaaatataatcagcactcaccatcagtgctttgctgatatctcatcatttcctggtgggatacatttattgtctagtagatttctcaggatggaatcatgattatgtgtattctcactcttgtatgtttacagctatttgcctatagccttgatatttgaaggtcaactgggctagataacacagacttgtttttaaaagtgggaattgaaacaattcaaggaatcaacaaagattggtaatataaataaataatggtcagttaaataatggaatcctgtccattcaaccattatacatactataaacagtgtggaaaaatagaaaatgatacataaacttgcaatggtcaaatttgtgcatatgaagtataaggatgctacaaatgtgtgtgcacatgtatttagtaaaaagagggttggatatacatgaaaaagttaacagtaattttctctggttagtagaattattggtggtctttagcttctttgtgtgcttttctgtattttttaagttgtagcatttgtgggattggagagaatacaatttttttgaagagcaagacaaagatctaaagttttcaaggtttatttttaatgtgctttctttaatcaataccacaagatagggtgtaccaaggaaaaagcagtgtgatctaattagcaagctcaggacagcataagctggcctcagtgccctgcctgcgctaggcactcaatcagttggtgctcgtgatgatgaaaactaaaatgagtccgttccaagcaagaaccttttggggagtagagttaacttttctgagtcaagctcctgcctccaggtttgcaccgaggatgaaatgaagtagtattatatatctgtaaaacccctgtcacttcatccaggcagagaagatagattgttagtaccttattctcaaaactaacagaaatgtgttcagttttacttgttctgaagaatataaaaacaatatggatgaatggccagtaaaaggagccagaagcagcctatgagagtgttctagaaaaacatgaaggggacaagaaaaagatacgagggatagatggataaggagggagaaagagatagagagaggacaagataaagtttagagcctatcattagaatatgtaatacttgggactttgccttccgtttaagtaaaatggaggaaatctgtgcccttacatcctgactgtgctgtcgttatgataaaaagaagtaaatggagtgcagggtacactatacacctgcttctttaagtaatccttgccaggtaactaatcgctgggattccaaaggttgttcttccagtgggggtgaccgtgaactgtaccccagagcaactgaatcagaatttgaatgggaaatgtcagccatagaatttgtttaaaacatctcttccaatgattacgatgactagcctggtttaagaactgctggcccatacatagggctaccatctatcccctctgctgggacagtcccagagcaagtattactagcagccctttctcttacaaaaatctctctgcagggtatatattatgcagtttcctatctgtaccttgcctccgctattggcattctcagtgaaggtgcatagggatagccttgtaccattactttcagtccagaactgaacacaagacgtagagaaaaattaccccacgaaattaaatttgcatcaaagtgtagaccaaagtcagatcttccctgagagtggaatctgatgtatacagaaaacaaaggcataactttaagtgggggagagagaatgggaaacccgagacatctccaagacaattgcttctgctacttcaccatttggctcaagccaattgagagagccagaaatgaacataggtttggttttatctgctggttatttaagaacttttgcttgtttcttctttacctcttccccagtttctggaagagtcaaaataagataatcatttggcagtgatataacattgctcttcaactgctgagaaaccaatcaatattccccatctagctaatgtgtcattcaatattgagtgttaccttgttctagtttaatcctgatctgttacctctaaaataaggacatgcaaagataaagataaaaacttgggcactctcaaaaatattcatgttataaatatgtaagggaaaatatttcaggtcatagtcctcagtacatgccaatacattcttggggtacccactttcctgcagcaccagaaactttggcttcctcctatgctctggacattttcattcttcctctttttgctcatcctcttcctgtatcccatattatgggccttttccatggaaagccttttcaattaattcacttttaaattcatattcatgttaccaagtttacaaattttaaaacatggttttcattactttcaattcaaactatgactctatctacaaagccagtaaaacaagaagatcaccttcaaaatttctctgacaagtttctagaaactccagtcgacagactaaactgcttaaagaatcaatctcaggtacaaatttaatcaattaaatagtcttaattttaaactgcatttgtaagtgtaacatgttcagattcatttttacgtgcttcaaatgcttgacaggatgaagttataaccataacaagcaaaaacctccctagcatttaaagatctcttgttgcaactctgatcaaataaacttaaaaatataaattgaattatcttaactattccagttctatttacaaacttatctttataaacattcaccttacaaatcccaagattaaaatgttacagattttatattgctatcataaagataactttttagggtcagaacgtgttggattcttttgcaatagcaaacatactggcccttttagagcagcttaatttgggcagatggaattcagcaacccctagcctaggctggattcaactaatctctttaccgcctgattgaattcttcattcctttcatattctttttgtccagctccatccacaaaagcccccatctgtctaaaaacgatcagcctttctttgacccaaaatttcatcaaatcatagtcctttcttcacgttgtgtctgaaaatccctttgaaatgcacatatactatcttggatggagactgcatcatggctttaattctcataacaccatcaacaccacacacacattggtttcacttactcaacaagaggctcaatgaggtaacagactattatgaaatgaatttcaatgtcttctaaaaacttttttttgttgttgatatttgtttaaaacacactgtggaaagaacacaggcctttttgtaagcaatttttgaaaggcttgtctcctaggcagctacaaactcaagacattgctaggagaaattctgttatatgaagacagggagagctggaagggatctgatgaccatttggtcccaccccatgctgtacaaagaagaaaactgagccccaaagagcaggggcaaaggagggtaaaatgccttcacttcttctatgttccaatttgtgtgcaagttgaacttcagttgagatgcacaaagtggcactcaatcctttcccactcatgcacgttgcagacattgccatgctcctcaagctcactcatcccctggccctgaattcctagaagaccactcagccttcacctccactgagtcagtggcaggtatcatacattcactcaccaccctcaaacttctaacccagcctcacaagaacctaaatactttgtgaacagaagctaaatttcagtgaaccaaagggtgaaaaggagatgaataagtagagactctctttccagaaatctggagaaggagcaaggttgcacagcagctgagggagggatgcagggtcaagggcaggagggaggctggagagagttgagcctattcagcttttagagggagacagagggaaggaattgagcctgtccacagagacatggaggaaggtgaatacatagggcagagagggaatgattggcagggaaggaagaaccttgagaagcgagagcaggcatggagtgcacaggttgaaatattgattttgaaggaaggagagatgcttcattctccaaaataggaggaagaaaaggtggatatgggcataaatactgctaaggatgtgaatgagaaaacagtccagatgaccatgaggatgggggataagccaggagggaatgtagactgtgtggataaggaagagtctaggatctggacaccttcacgagctaactgatggggtagtggggataagggaatgagtgagctgggaggacctaggagtttgagacttggggatgagggaatcctgagtgatgacgcagcaagttagggctgttgaaatcccgcatggcaaagtataggctacgtgaaaacattgaggccgaaactaaagatcggaagagttagtgcatcaggaggactgtcttcctggacactggagttacccagctggcagttggcagaacatgggggagagaaaggtcgtgagcctgctgccaaaatctttttttttttttttttttttgagacagagtttcactcttgtcacccaggctggagtgcaatggtgcaatctcggctcactgcaacctctgcttcccaggttcaagagattctcatacctcagcctcccaagtagctgggactacaggtgcacaccacgacgcccggctaatttttgtatttttagtagagtctgggtttcatcatgttggccaggctggtctcaaactcctgacctccagtgatccacccacctcggcctcccaaagtgctgggattacaggcatgaggcaccatgaccagccccaaatctcatgtgaatattggagactgaaaggcagattgacacatgatagggataacataggacaaactgtgaaccacaaagccaatggaaatttacataagagagaaggaatagtgacctggcaatagctttggagagcaagagagatattaattcctaactcccagcccagaggggcagagggcaggtgagcatgagccctcgccacttgagaaggataaaagggaagcaggaaccttaggggagactaaggttcagctgatagcagaagacagaggaaacatttaggaaaaatgttaaagatatatgaatagagttccaaagggcacagttgaatgatgtggaaggaaaggagaaagggcaaggagacaaaaagcatccctttgtaacgggataaagattaaagaggtttttatccaaggcaatggctgagattgagagagacaggaggcagggagacctctggccttaactgactagctgtgtgaccttaggcaagttacttgccctctctgtgcctcagtttcatgattgtgaaataaggataatactaatacttacctcataagattgttgttgctatgaagattaaatatgttaatatatgtaatgcacttagaaaaatgatcaacacatagtcagttgtgaagaagcattagttttggaaggaaaaagattccactccgcactttccttcaagtgacagacattcaattatatcaagtcctgaagaatacatcctcatttcccatcacttacacacagcaaaagcccagcatgcaaaagaaaaaaaaaacccaaaaaacaaaccctatcagagtcagtgatagattcagtttctcagtaattaactattatctgttcctgtacagaaagaaaagagtgcttaaaaagttggttgaagacagaaagaatctagagctataaatgttaaagatgaacagttaatatcatcagagaaacagaaatcaaatcaaaaccacaaggatatatcacctcatgcccattaggatggctactatcaaaaaaagcagaaaataacaagcgttggtaagaacgtggagaaattgtaacccttgtttgctcttagtgagaaggtaaagtggtgcagcactgtgaaaacagtatggcagttcctcaaaaaattaaaaatagaactagaatgtgatccagcaatcccacttctgggtacatatgcaaaagaatcgagagcagggtcttgagcagatatttgaatactcaaggttatagcactactcacaatagccaagaggtggaaacaacccaaatgtccatcagtggatgaatggatcaacaaaatgtggtatatctgtacaatggaatagcattcaaccttaaaaaggaaggagatcctgacacctgctacaatatgaataaacattgaggattttatgcgaagtgaaataagtcagttgcaagcagaaagatactgtatggtgtcccttatatgaggtcataggaggggcatagaaacagaaagtataatggtggttaccagaggcctcaaaaaagagaagaaggagagttgtttcatggctatagagtttcagatttgcaaaatgaaaacgttctggaaatctgtttcataatgatgtgaatatacttagtactactgaaatgtacacttaaaaatggttaagatggtaaattttatatgtttttataataaagaaaaatgaaaacaaaaagatcatctagtatctccccccttcccctttacaggtgactgaagtaaagcccagagaaggtaagcgacttatccaaggtcacacagttcacggaggcagaatcaggatcagaacctgggattctgacccctgcagtaagggtccgtccattacatcctgctctctatgtgaggtgctgaggtaatggaaaagatgacactgttgatttatcagtagtgacagtgacattccaatgaacctgaaagggataaagattctactctgcttataaatgttcatgtgcctgtgctctttctccaaatctcatcaggattattcaaaccagcagtctctgacaggccacagtggaaacctcaagatattcacagctgctctagtctggagacaggccagaaagcagatgagagcagtttttccgttcctgggctgttgcccctgtaatttagaagttccgacactggaaaacaagaagaactcaggggctcacttaaaagcaagctcagtgtggggtctccaatgtcgtgcagggaagctgctagtcaaaacttgctaatttgaaatgggttcactgactccttcttcggactcagggaatgaagtcttttttccccacttaggagtttttcttcggctccttatttcaaattccataaaagagacaacaggaaaagctggccctagcccaagaagcagagatgaaaaccagatctctatttttgtaagtgtgatgtctataggttgccttctattttatatcagaaagttctattgtttccatggaaacaatgagtgtggctgaggatccctacaggacctcagcacttttggggcttgggtgattggtgctattggcttggtgattccaaaaacctccctaagtttcaaaattttaaagctcaagccaaccttctcacacccctgctgtgctcctcccatctctttgacacacagatacctcatgcatatggcactgctctgagctctgaaggtgttaggaaaatcctccctgcagaaatatgacctgtgataaagaactaaataaaacattttttggcaagaacatttctgaagatctttccaatccagaaatattttttttgttttcagtaaccctaccaaggctgaaccaggatgcctataaaaagccttctgtgttcccctaagcactcttaatgaatcctcaggaaggatggaataagaggggggtcagagacctgaagcccgtgccagaggctgagcatgccagcttggcttggtgcactggtggcagtgctcagggcccctgcctcctgtcctcccattggcatggtctcagcccacactccttaagggaattggctgtgctcctggcttgtctcgcctgtgtgtctgctagttatcgaacaaagggtgggattacttccatgcccagtttcccagatgctcgcaagcacagagccaagaatcagctgaaacagaagggacaactgagcagagaagccctcttgatgagactcggccacacttgagctgttgttcctgccacgagacacacctgtcatataaaagccaacaagccatacaggaaacatggtgtgcctcctgtttacagccgatcctagaaaacaaaaactttgctgagacagcaccaaacgtgaaaatggggagaccagccaaggggcctgaaccgtgcacagcccctctccctgttgcatagacaggaggaggagtcaaaagctaagaaggttttgctgcttccagaagctgttccctcacctcctcctctccttcactaggtatattttccccaatcttcaaggactagcttcagagcctgaaactccaggagctgaccccctgataaaactttttaccccaaagtaaacgcaggcaagatgcttgctccgggtggaatgatgggcacctcttggttcatggctaccttctgcaagctaaaaggacctacagggtaggggtgcatactatccctggaaaccgaaacacaagaaagtctcttaaaacccccttgatcacccaaatgtccagaagtcattggaccatctgaggctcctccagccccaattccttcaggagctaattgcagaagaatttcaaaaacgatctctcatcaacttgtccaaggaaaccaggactcaatataccagaaagttgtgaaaatggggtgtccagtgggatgactagatccaaggtttagggagaattagaagggagataggagaattgaagaaaggtaaggacaaagaggaagattattccagggcaagagagaaaaaaccaaaaatattaattggagtaaataagaaaagtattaattggagctgttttgagggatccagagaggaaaccattcccctggcacaaggtacatgttttaagggcaagagaaaaaaacatatgaagagcactgagtaaaagcactgaatttttttcctggctactcctttggaaagaagaaaggggaattgtgtccataattatgcattttttttttttttgagacagagttcactctcttgcctaggctggagtgcagtggcatcatctcagctcactgcaacctccagctcccagcttcaagcaattcttctgcctcagcctcccaaagtagctgggattacaggtgtgcaccaccatgcccagctaatttgttttttaaatttctgtagtagagactggctttcactgtgttgaccatgctggtctcgaactcctgacctcaggtgatccacccgcgttggcctcccaaagtgctgggattaccagtgtgagccattacacccagcctatgtcatattctttacaaagctgaggttaaggaaaccaacttggtccttggatcaagtcatttatttctataaagcagctccaggctgctataggtaaggagaagagacataataatatagatcaatactgacttgggagtcttctcttctgtgagtttccatgaacaaaatttgggagtcagggatatggaaacagaagggagctgcaactcattgagcatcgctctgctttgagccctgggctgagtgctttatattcaggacctttgtactccagatccatacaagcagctgcccacccaatatccccacttgggtgtctaaaggcatctcaaactcatcccaaattgagcttctgctctttcccccatatcctgttccagccacagtccttcattcagtggatctcagctccatccttccagtggctcaagccaaaagtgttggagtcatgcttcaccctgtactgctcgcataccccatgcctgcttcagtaagaaaatctgttggttctaccttcaaaatgtaatctggaatggctgtacttttccctacccctactggctccaccctggtccagaccatccttgtgtctcacttggatgattgcaatgttctccttgcttctactcttgctcctttgcaatctattcccaccacagtggccagggggatgttttttaacatgtcatatcatgtcattccactggtcaaaatccgccaacagcttctcattctactcagagtaaaagcccaagtccacccatctggaccacattccctccctgattccatctagtgataccccttgcccactcggcttcagcctcaccagcctctaggcatcaaagcttttgtgcttactgtttcttctgcctagagtccctgtccctagatctcaccccctcaagttttttctcaaacattactgtggggaggctttcccaactaatctgaataaaatggccttctttcctgcttaatttgttttccagagcccatatacagtaactcttatttattttctttatttatcatatgtctctcttccctagaatgtaagttcctgaagttaggattttacccactgctgtatccccattgcctagaatggtcattgacacacggtgaatgcatgatgagtgatctatgtagttgtgccctctgtaaaaagtctgctgggcacggtggctcatgcttgtaatcccagggatgtgggaggctgaggtgtgagaattacttgagcctaggagtttgagcctgcagtgagctgtgatcacatcactgcactccagcctgggcaacagaacgagactgtctcaaaacaaacaaacaaacaaacaaacaaacaaataaataaataaaataaaaaagctatgagttgatgaatctatctcaaatctattcttcatccagagtcctcattccaagtgaactacgcacccagcatcatgagctgcctaaactgttgaccagagcatcagctcacgcagccccagggagatccctgatgttcaggcactgttgggggaggaagacaaggtacaaagaaaccaacaggagtcaatgtcaagaatttcacaggggataggaaattttgatttggttcatgcagcttggattccttcagaaagccttgaactgccaccattagaaaaagatacacacacatacacacacatgcacacacccacacgccctgcctgggagaactgacattaccaaattccagaaaaccgaaaacaatcttatcctaacagggagagagacatcatggagaacatggcatttagtaaggagaaaaggaaatatagctcctgagtttgaatggaagaagaacctaaaaataactaggcggggcgtggtgcctcactcctgtaatcttagcactttgggaggctgaggtgggcagatcacttgaggtcagtagtttgagaccagcctggccaacatggtgaaaccccgtctctactgaaaatacaaaaattagctgcacatggttgcaattgcctgtagtcccagctactcgggaggctgaggctggaaaatcacttgaacccaggaggcagaggttgcagtgagccgagatcgcaccactgcactccagcctaggtgacaaagcaagactccatctcaaaagaaaaaaatatgaaaataaaaaaataaaaataaaaataacttgccctattcaaagatatcttgcttgccatatattttataataaaaataaatacatgagttgagggaatgaggtgagggtatctttaatactgccttccattaatatcttggctttctttctgagaacacatggtacattccaggaagacagccctgtcttatttctaattttctaaaatgattgttcctgactttagcagtatgacatgggtttttccaagcccaatcactcatgattttttagcctagtaatctttaaaaccaaagatgcgttttgtcttggagctggggaagaggaaggcaatgatcatttacagagccctattatgtgtcagacactttatacttcactcctcaaatttgaagttcgtatcattatccctgtttcacagatgaggagactgaggcttaagagcattaagtgatttgcacatgattgcccagatagccaaggcttgacctcaggactaatgaactccaaaaatgctattccttcaactatgcagtgttgcgtttttcctacagtgactaacagaagagtgagagctgtgcctggacattaataatgaattagctttatttgtaaacccctgaccaagaaaatatgtaatacacaatatctatacctgtagacattttccttcattcaaggaaatagcacttcaaaagaatggaaataacacaaaacagtttgatggtaaaccaaaataatctgttcaggtcaaaagaagtcaaacttgatccagccttcgaagggcattttctagcatcatctgaacaaatcttactccatctgtaaggtggagataattatttaatttttaaatttttcatgtatgactttttacacctttaaacatctctaacaattgaaagtcatgatgtgtatgattcctgagcgatccattgggatgctacaaatagctgttaatagaaaatccaggctgggcgtggtggtgcacacctgtaatcccagcactttgggaagccaaggtaagaagatcgcttgagcccaggagttcaagatcagtctgggcaatagagcaaaacctcgtctccacaaaaaatacaacaattagccaggtatgatggtgcattcctgtaatcccagctactctggatgctgagatgggatgatggcttgagccccaggaagtcaagacggcagtgaggcatgactgcaccattgtacttcagcctgggcaacagaggaagaccctgtctcaaaaaaaaaaaaaaaaaaaggaaaagaaaatccaaatgggatgacagagtggttttaggttggcaatgtcagtagctctgtggcatgaccaggacacaggtttctctcatcttgccactctgccaccctctgtgcaacggctagtcttcttctcaaggcaggctcttgtaatggtctcaaatggctgcctcagttccagccaacattcagatgacaatcttgagaggtggaaaaggaatattcctgtcttgggtctcttgggtctccttttacaagtgagataaaacttccatcattctgggccaggcatgaaattgcagggatgacctaggaacctatatgctcctagtgatacagaggcacgagcaaagtccaactgcacaagcacattgcaagcctcctttttcatcccatctgttaatattccattgctcaaggcacatccatggcagaacccaaagtcaaggagcagagaagtatactgctcctgtgttggcactgtgacgagggttctgatatatgctactacagggagtgaagaattgggatcaaggatttaaactaccagctacacgggctcatgcctgtaatccctgcactttgggaggctgaggtgggcagatcacctgaggtcaggggttcgagaccagcctgaccaacatggtgaaaccccatctctactcataacaaaaaattagccatgcatggtggcgtgtgcctgtaatcccagctactcaggtggctgaggcaggagaatcactggaacctggaaccttggctgcagtgagccgagatcgcaccactgcactccagcatgagtgacagagtgagactccatcttgggggaaaaaaaaaagaatttaaactacctaaactaccacctgtggttatattaggcagaaccttatgaaactgccatatttcaaatacaaaatagtcgaatgctgaccatcctgtatgattcggtgtaatgccatcactggaacttcagcatgaccttttgtccactggctatcagaactctctggaaagcagaggacacagttggtggttcagaaaaagcagatttactaaggacataggaagtgaaaaacaggtaattatctgtctctgatatagcagtatcattccctttaagcagagtcatgctacatttgaatcaagcacttattagaatttaaagattatgtgaaaataaaccttcaaggttgagtcccaaagatatttttccctgggaagtcagatgtgtcatggtcccataggaagactattacttttaagtagagatttaattacattttaggattgtcttaattatccccgctcaataaacttcctttccaatagaatccacgagcagcacatcctaacaaaagttccctagtttgtcatcccctcatcccttttcccctccaccacgcatatacacccatgaacttgatttccctgcctccaccttagttcattctcatctctttggaatacctgttagtcacttgctgacctccagtcatcctttccacactcctgtccccatgcaaactacctcctctgccttcccataatactctatatatctgtaatatagaatttaacacattgtaacaaaaatatgtaagtatacatccatttcaccctctagattatgaactccttgagttcagggactgtgttttatttatctttgtttttttgttttgttttggtttgtttttgagacagtcttgctctgttgcccaggctggagtgcaatggcacagtctcggctgagattacaggcatgtgccaccatgcccagctaattttgtatttttagtagagatggggtttctccatgttggtcagtctgatcttgatctcccaacctcaggtgatctgcctgccttggcctcccaaaaaattttgtatttttagtagagatggggtttcgccatgttggccaggctggctcgaactcctgacctcaagtgatccaccctcctcagcctcctaaagtgctaggattacaggtgtgagctaccgcgcccggcactctcagtttatttttggcttgtgcaaagtctaaagcagatgtgcctgcttgggcagctctccaccaagtggtaacgcagggatccaaccttcttccatcttgacactaccatcttcaacatgtggcttctaaaaacagtgcaaacatgagacatgtcatgggaaaggcacagcagatgctcaccaccttagctcagagatgacacaaatgactccttggctagtcacatggcctcagttagaaatgggggtgtggcgaggaaggcgggtgggagggcctggatgagcaacaactctacacgatggaaagggagcatgaatctttggtagttagctaactatctctgctacagggaggagagaggaagaaaggtagggaaaaagggagggagggacttactcaatgcctaaatacatacatactactttttaagtcctgtgcaaagacttctcaaattttctgccacttagatccttaaaaccagatgtagaaagcagttgaacaatatgctgagagaaaacacaccaaatataaaaactaaaaataaggaggagcccattgcagtttcatgtcttaagcacagtcaggaggaaggaaagcttcaggatctggggacagggtatacatatgtctgcttgagttccatgtcttaacttgagagaggaagagagaagaggagaatagcaggaatctgctcaactggaaagcttctaaggagaggaggcttatgggagaagcgttatcaagggatacatcctgctatgaagaaggcagagtgttcacagtgaaaagcaaaccagggaattggggggacatgactgggtcatgagagaatcatagtcatcactatttgggagtggatgaggagtgaatcaccaatatgagactacatgtccagctattgcagttcaatgcgaaacatctctaacaagtcattttagcaccagtaagctcctgctcttgagaaaagcaaccactatccaggaggttgcatacagtgaggaggtctgggattggaagccggggggtgagagaggaggagtaaaagcatctgtggtggagactgatagctgttcactcaaatccatttcctcttcttcctgagcacagggcctcccttgcagttcagcattgccatgtcaatgaaatatgaatagaaatagtatgggcccctttcagaatcagcctataaaatcctcctatgtgtgatcctccaagtgtcttcatcctctgccagcaagatgcacatggcagtgaggtcttatgttttggtgaagccacatttgaacctgggtccttgaatgacttcatggaagagagcctacttgcctagctggacacctgccaggactgttagatgagcaagaaattaatttctactcaatgatagacactgtgactgccacccagattccatttcaatcaaggacttattgccacagctgaggtagtgctgtcagcaaagagtcccttcaggggctgcctccctgaagaacaagagaatggttttatttaaggttatgcccttttgagaaaagcccacatctggggatcaaccaatgtgaggctccatgtccaacattgtggttcaatgtaaagcatctctaacacggcattttagcaccagggcttctgtagtcttgaccaaggtttaaagcatctggcctgatttacagatcaacttctcttttgcccagtgctgcttccgtttactcttttctacaggtttttaatgaaagaacactctttaatcaacatctggcacactaaaccctcagagtcgccttcctggaccccctgtctccccctgccatgccccgtaaatacactatgttgttggatgtgtttcatctatatgctgtgttagttcagataagccatggcatatttgatctacatatagatgaaacatttcttctgctgacacggctatgctaggttggccagcacacatgttccttgctatgtagaaaagtctaggccgtctgcaataggagagaattttgtcaagacacaagcagtagagacagaggcagatgggagagagaaaatccagctggagtgagtctcttcccagtttttgtagcaatgattcctaaaacttttccttcagcaactctagtatcttccccagtgacagaagccattgactcccttttccttcctactttttttttcttaagatggcttaaactgggtttctgtcatttgcaaccaaaaaagtcccaatacaagcggttttgtgctatgtaagtgaatgagtaccctaccctttcactggtactctctcaaaagaaaattagagacagatttacataaacttttaatgaaaccatcatttattgagaactttctacatgccagttccattctacatacttttttgttttgttttgtttttttaggcaaagtctcactcttgtcgcccaggctggagtacaatggtgtgatctcggctcactgcaacctccggctcccgggttcaagcaattctcctgcctcagcctcccgagtagctgggattacaggcacctgccaccacgcccggataatttttatatttttagtagagatgaggtttcaccatgttggccagactagtctcaaactcctgacctcgggctatctgcccgccttggcctcccaaagtgctgggattacaggcgtgagccactgcgccctgcctattctacatacttttaatatattaactcagtcctcacaagagccccacgagatgggtaccattactattattcccactttcagacaggaaaactgagacacagagagattatgaaatacacccgaggttacccagtttatgagtgatagatacccccagcgcctgtgctcttacccagtgatgctctcttgcctgtgttcacacagcctgagatggggacatgagaggcttctgtctcatatgggttatattcatgaatgactagggttctttcccttctctctctcttttttttttttttttggttgagatggagtctcactctgtcacccaggctggagtgcagtggcacgatctcggctcactgcaacctccgcctcccaggttgaagtgattctcctgcctcagcctcccgagtagctgggattacaggcatgtgccaccacgcctggctaatttttgtatttttagtagagacggggtttcgccattttggccaggctggtcttgaactcctggcctcaggtgatccacccgcctctgtctcccaaagtgctgggattacaggcatgacccactgcgcatggtaggtccttccccttctctttgtgcatccattataacttgcaagagcaactaccttacagaagttaacagcaaaaatgaaccagaaggcagagaaattgatccccaaactaacaagcaaaagaagtaattaggggtgctgtgagaggaaaagccagggctgggagggtgtgcagacctgaagttatttaaatgataaaggcacggggtgctgcaggagagacgttgaagggttaatgttggacatataaacactagacccgttgggaagagcccaagaggcagagcaatcagctctgaacagtacacaggaggctgaccaaagagcagtgctttctaagccaggacatgggctagaacctgccagatagaatgtggttttctcaagaaccaggagaatggggtcaagaaaggtcaagctggtagggaaactgagagaggctctgagtcaagaaaaccttggagggtaaagtgtcaggtctctaacttcacagtccctattatcatgtaactgtgaactcttcacaccccgagacttcacatattggagtgaagaattggtttcttaaacttcaagggctaggtgagtgtgatgtttccttactgagccaaggaataacagaagagtacggggcagagctacattcccagagaaaagtcaagaggagtccagtcctgaccctgtgtccaccatcacccatgggagacaatggtgaaggcttctgctgctgagtgtgggggactctggcattttgtcaccactcttaaactgagtttgcctccaaatatgttagcctgctttagaataaacagtgataacaatccatttatttgcagagaaggacttccctccacttgccctgggttaagctaaagtagaatgaaatattggtaaaggcgggcaggcacacatttcatccatcactgctttttttccaggatgcttttgactacatcttatgtgcatataatgtctctgatgataaatatttcaagattagaagattctccttatttaccactgcctacagtcactttttacagtttcacaccaatttaactatgaataccaactatggtaggtgatgacatacattagctcacttagtgtttgaaactacctcaagaaaagggcattattatatttcgattgtggtaaaatatccataacataaaatgtaccattttaaccgtttggaatttacagttcagtggcattcagtatatctacttgttgtacaaccatcaccaccatccatctctaaaacccttccatcatcccccaactgtcaccaccatccgtctctaaaacccttccatcatcccccaactgtcaccaccatccgtctctaaaacccttccatcatcccccaaccatcactatcatccatctctctaaaacccttccatcatcagccactgaaacctcacacccattaaacaataactccccattccctctttcctcccagcccctggtaaccattattttgctttctttctttatttagctactctaaagtcaaattgtacctcagataagggcagtcataatatttgtccttttgtgtctggcctatttcacttagcatgtttttgaggtttgcctatattgtagtttatgtcagaatttttttccctttttaaggttgaatatattccattgtgtgtgtgtgtacatacatgtaagtatgtattttgtttatccatttattctttaataaatatttgggttatccttttggattttgtgaataatgccgttataaacatggatgtccaaatttctgttcaagtccctcctttcaattcttttgggtgtatacctggagacggaattactggattatatgctaattctatttttaaattttttaggaacctccctaatgtcttccacagtggcggcaccgtttttcactcccaccagtaatgcacaagagttctaatttctccatatccttgaaagccattatatttcatccccaacattacagacaaggaaactgaggctcacagaaatgaggacttctcacagttacaagctactgaatatcagatcccctacgggaagccaggattcctgactccctgtccatcgcacttccccagtcctacagctgcctcagtcacagaacagcaaaagtagaagcccactgaaacccaaaaccagcagaattatatccaggaaagaatttgtgtctgggagttactgtggggaaaagcaagagagatcagattgctactgtgtctgtatagaaagaagtagacataggagactccattttgttctgtactaagaaaaattcttctgtcttgagattctgttaatctatgaccttacccccaaccccctgctctctgaaacatgtgctgtgtcaactcagggttaactggattaagggcggtgcaagatgtgctttgttaaacagatgcttgaaggcagcatgctccttaagagtcatcaccactccctaatctcaagtacccagggacacaaacactgcggaaggccgcagggtcctctgcctaggaaagccaggtattgtccaaggtttctccccatgtgatagtctgaaatatggcctcgtgggagggaaagacctgaccgtcccccagcctgacacccgtaaagggtctgtgctgaggaggattagtataagaggaaggcatgcctcttgcagttgagacaagaggaaggcatctgtctcctgcccgtccctgggcaatggaatgtctcggtataaaacccgattgtacgttccatctactgagatagggaaaaaccgccttcgggctggaggtgggacatgcgggcagcaatactgctttgtaaagcattgagatgtttatgtgtatgcatatctaaaagcacagcacttgattctttaccttgtctatgatgcaaagacctttgttcacgtgtttgtctgctgaccctttccccactattgtcttgtgaccctgacacatccccctctcggagaaacacccacgaatgatgaataaatactaagggaactcagaggctggcgggatcctccatatgctgaatgctggttccccgggtccccttatttctttctctatactttgtctctgtgtctttttcttttccaagtctctcgttccaccttacgagaaacacccacaggtgtggaggggcaacccaccccttcaagttaccaccccagttattcttataatggtgatagctcgaaacacactgttgctagaactcttcaagcagaaatgtatgtggttcaatgacaagattgatcctgttgatttagcaaacatttcatccttcagtcatccggaattcattaattcattcaacaagcatttattgagtgcctattaggtgccaagcatatttttaagagctgtgaacaagactgccaagctttctcctctcatggaactcacattctcgagaagaaaacagacaataaatagaaaagcaataaattggatcatttcaatgttataagcacactgaagtctatgaacagggtgatgggacagagtaataaaggcagggaggaagagcgactttagatactgtgaagcctgtctggaaaaggtggtatttaagctccatgtgaaatctggtagaagaacatgtgggcatacagaagagcaatgtaaaggtgttgaggtagaaagaattggaatgttctaagaaaatcagggtgtcagtctggtgggaccatggaaacaaagaatggagagtagagggagatgtagtcagagagaggacaggcaccagatcaaatgggtctttatatgataatagctaatgtttatttagcacttactttgtgtcagatgctattccaagtaatttttatgggttagttattcaatcattatgcaaccctataattaaatactattattattcccactcttcagatgagggcactgaggcccagagaggctacataacttttccaaggagctctagttgttaaggggtggaacgtagatttgaacccaggcaatttggcttcagagtctcggttcataaccactttgtcataggaccatcttgtgattagatgttattgcaagatcaataagatatcaatgaagggctttaagcagaggtgacaggacttgttttgtattgttgagatgatcaccctagctgctgcatggagcaaaaagggaggcagagaaaccagatggaggccattatggaattccagctgagagaaagtcatggtgtggatgagggaggtagaggtgaaacagacagaaatagacactgttaggatacctttttgaagcagagctgtaggggtttgctgacaccttggatgtggaggtgaggggaggggaggaactcaggctcactgctaggttttttacttgagccatgtgtcaagtggagaagacatctagtgagttgggggaagaacagggtgtagaggggatatgtgttgagtatttgaatgtctagcatccatttccctaacagcacccccatttcttgttagggaacaccacctccttttttttttttttttgaagctgagtttcgctctgtcgcccaggctggagtacaatggtgcaatctcggctcactgcaaactctgcctcccggattcaagcaattctcctgccttagcctcccaagtagctgggattacaggcgcccgccaccacatctggctaatttttttgtatttttaaagagacggggtttcaccatgttggccaggctggtcttgaactcctgacctcaggtgatccgcccacctcggcctcccaaagtgctgggattacaggcatgagccactgcgcccggcgggaacacctctttcttatgagttatagtcaagccgagaggccatacatgattgagatagtccaatcaggtaatcctttcctggaatgcgaatctgaagaaggacaaaattcagtccctccaggagctcctaacaagttttttcttttgcaaggcatttgctgtgcttcctagttccaagtccaggactccagcctgccatcaattctgcgagtcccaaagccttccagcacattctgcctgcctaagttagccagtgccagttcttcttgcttgtaagcaaagaaagtacaggttggggataggatagggtagaggtgtgatgctcataatcaagagatacattttggacagggtaagtgtattagtctgttttcacgctgctgataaagacatatccgaggctgggaagaaaaagaggtttaattggacttacagttccacatggctggggaggcctcagaatcatggtgggaggtgaaatgcacttcttgcgtggtggcggcaagagaaaatggggaagatgtaaaagcggaaacccctgataaaaccatcagatctcgtgagacttattcactaccatgagaacagtatgggggaaaccacccccatgatcaaattatctcccactgggtccctcccacaacatgtgggaattatgggagtacaattcaagatgagatttgtgtggggacaacagagccaaaccatatcagtgagattaagatgcccataagacgagtcaaggaagctgtttgatatatgaacctatagttcaggggtgaggtctggaccagaaagaaagaaatttggaaatcttcagcatatacatagtatagttctgtgtgggaaaatatgccatatcttttgctaaaaggatcctgattttctttcggggaaatatccctccttcttggctaagaatcatgacaggctgttaatcaaagttccagattctcctctagccaagaagtaaggagaagtctcaggcctgaacagtcagcacaagccatttacccagtcgtagtgattattcagggctatgcagataacccagatcatttcaataagaattagccaaaggacttttagtggaacaataaggaaggaaaagttgttctttacagaagaattgctaaactggtacagtgcaagcttggagctaccagagcctttttttttttttttaaaccaccttgggactgtagcctaataagaatgagaccaacacaacacaacaggaaaaaagacccaagtaacagagggagagaggccacgtgctgatgcagcattgaggcccatgaggctgtcagtcctggagctaacatcacaattacatgaatcaatgaattcccatttttgcttcagagttgagttagtttctgctacttgtaaccaagtgggttctgacaagtacaaatggcatttaaatgagtaagatcacacaggaggaaaatgtagctaggactgagctgcaaaacactaataattaaagctccagtagaggaggaggagccagcattttggttagattgtttcttgtctttgatgacaattgggaccagaaaggtaatgcaatgtattgtatcgctgaaagaaagagaatctgttagcagagtatcgcaaattttgtttaactgtctgataggtacaaaaagggccttatgtttgcaaattcccaatataaaaaattcgcttgtagcttagtgttggcacgttattcctgtgtttaaaagtcagtacctcattgctgaagagcaccattgctgctgagtcatgccatccaagacaactatggctacctgccttttcttggcacccagcattccgagatgctggaattcagtgattttggcgaagacaagtcagacatgtgcggactgttggtaaatatgcaccagccctttgtggcttgactgcccaaagtcagggaagagcttggactcgatctctgctggcccctgaattcattttggatgaggcaggttggtgtgtgctaaccagggtccccgttcctaacaatagccagactggcatcgttggcttcaaaatggattgttctggctcccaagtcaaaagcggctctgcacaaaactaatattttgagcaaattgtacagagttgtgcacagtggaatgatgagttttacccaatagggagtgctgagacagccaaatggtggctctgaagtgagtgccaggaagctggtcttggggatgggagcagagtcatcatagaaatggatgaatggcagggactgcagaaacaatcaagtaagagtctgcaattagaggaaagagtttgctcttttagccagacacaagaagacaaagggaaactcttccttttgccacacaggaaagaaaatgtggatttcaagttgttttattctgggttagtaggctctgagaagcacttagagccatccagccagcccatgctttgaaaaactatcatcattgactctgtgaacacaaggctcattgataaacagcacaatgatgctcttaagtactcaggcactggagccagactgcctggctcaccacttccttccttaatgttcctgcgcctcagtttcctcacctatgaaatgaggatgaccatgaacgtgggaagcattatgttaatgaaataagccaaacacaaaagggccaataccgcacgattccacttatatgaggtgcctagaataggcaaattcccacagacagaaagcggaatagtggttaccaggggctggggggaagagggggagaatggagttattgtttaatgagtatagagtttctgtttgggatgtggagaaagttctggcagtggatactggtgacggctacacgacattgtgaatgcatttaatggcactgaactgtagacttcaaaatggataaaatggtaaattttgtgttgtatatattttacaattttcaaattaagtttgttgctacaaacaaaaaattgacctaagaagtcatagacaaaagaattagtgctgtgcgacttcagtacataaagtacaaaaaaatggcaaaaatcctcattggtgttggattttaggatagtgttgtaactgcctgaggggttcttcctgtgaccgcacaaagaaaaaccatggcattatattaaagaaagagttttatagacacaaggccggccatgccacgtggggaccaatttagtactgaaataattctcttccaaagctcctaggttaagagtttttcaaaggcagttcgggggaagtgatgggggtgattaggcctgctgctgattggttggggcagagatgaaatcatagggggtcaacgctgtcctcctgtgcactgaattgtttctgggtggggccacaggagtggggttgagggtccaagtggagccatcaggtcaaggtgaagccatgggtgtcagacatgcaaaaaaacctgaaaagatatctcaaaaagccaacctacaacagagatgttatctgcaggaatcactggggaagctgcatctcctataacctctggaataatgactaaacaatccttcatgtctataccttagcaagagactcaggctcttctccttcccctagcctggaggcctccccttagctttagaaaagcaattgagtttgagggaaggcctattatcatttaaatttacccaaatgtccctcaaactcagctcagccccaaagcccaggaataattaagggaaaggcaagatgggggtggggcgagggtagcccagctcactgttacaatttttcttactgatataatttttgcaaaggcggtttcagtgttggtgttggatatcaacaccactgagggtggtggagactggaaagggagtcttaggtggctggtcatgttttctttcctgatctgcaggctgattgcctgagtgtgttgcctttgtgaaaattattgaactgtcatttatatgtgcactttatgtatattagacttcaatgaaaagcaccccccacctctacaaaagacaatattatcctcctcagagggctattttagtattcagtgaattagtgcagataacaaacttagaacagtatccggcatataagggcctcctaagtcatttccagcagtgttaaaaaaacaaaagaaaagctttcctccagaaagctttgtggactcacccctgcggttgagatgccaatcattcccttcttatccacacttcctgtgctttgagatactttgtatttgctcctccaaattctcctccctgccaccaccaccccagaccccagccccggcttggctgtgtccctttgttagagtaggtagttaggcagacataagcagcgaaggagaggggcctcttagcccagaaatgtcaggcaaccatcaggtgatggtagggctgttgttaaactgtctctctaaaataataattggggtcagctggcaccagggaaagctactctaacaatagacagaaaacacctgaagctggtgattagcaacttccagataagatctcaggagctggatgagcaggctcaagcatgtgcattaattaagatgcaaaatggtggagtttaactggtatatgaccttcctccaggaacgctcaacttgtaagggaaaaatgcctcaagtgaacatgcgcacaacttccgtaaacacactgtgcagtgatccttcccaagcgctggcaggccactgtgcgtgaggatagcccaccccaagggaagaatcaagggaggagaaacagaaacccaggaaccacgccaatggagaaaaccccaagtcaaggatcaaatagggcacttggatctctcaagttgcccgctcggccctcttccaagtgtactttgcttcctttctttccttcctgctctaaaactttttaataaacttttaattctgctctaaaacttgtttctcactgccttatgccctttgggtgaattctttccttcgaggagggaaggatcaagtttactgcaggcctgtcggattcactgctggtaacacctttattaaaggttgcaggtcctgtccagcaggcccctccacttggctctctccccaggttctggtaactgcctcttttggcccaggggtaataatggtcccctgcagttaatccccaaggatactgtactactatcccttgtggtttcttgtggttttcttatgcccagatctttataaatcacttcttattaaaatcttctccagttttcccaattgcagtgtattattaacttctgggacctgactgatatctacccgcttagaaaagctatggaaagcaggccgggcgcggtggctcacgcctgtaatcccagcactttgggaggccgaggcgggcgcatcacgaggtcaggagatcgagaccatcctggctaacacggtgaaaccccgtctctactaaaaatataaaaaaaattagctggacgtagtggcgggcgcctatagtcccagcatctggggaggctgaggcaggagaatggcgtgaacccgggaggcggagcttgcagtgagccgagatcgcgccactgcactccagcctgggcgacagagcgagactcagtctcaaaaacaaacaaacaaaaaaaagaaaagctatggaaagcagccatgtaggctacgggacctcaatcagtcagataactgctgactagggcggacacaagcagctgaccacgctgaaccaatcagaatcatagaaacagagggattgaaccagtggagaaccacagaactataagatcatgcacaggtagagccagggttggggccatggcagcccaaaggcaccagcaagcggaagctactgtagggcagttgaaaaaaattggtctgtggggaaaaaggaacacatgcaaagtatcatttattcatgttttaaatgcattaatatattcaaaaatgtgttctaacaatatgcaatcaaatgtaaaatcatctaatgtggtcttcccagttattaaactccattttttttttttaatgtgggcatggaggggatggagtttcactcttgtcacccaggctggagtgcagtggtgcgatcttggctcactgcaacctctgcctcccaggttcaagcgattctcctgcctcaacctccagagtagctgggattacaggtgcacacaaccacacctggctaatttttgtatttttagtagaaatggggtttcatcatcttggccaggctggtctcgaactcctgacctcaggtgatccacccacctacaccttccaaagtgctgggattacaggcgtgagccacactctatctttttttttttttttttttttaattcttcagctaaaacagtggaaaaggtgatttattatatggttgttacactcggccacaaataaacacagaaatagtccagaatgtcacaggtccagggcagaggaccaacatgggcattttgtttatgagcaaggtgggtctcagaggtgatcggcgatcagagggcgatgaagttctagatccattgacacaagctctagacagtagcatgcagtcccacaacttgtaccagcatccccagcgtctggcattccatgtttctgctcctgtggcctccacggtgcaacaagctagcggtttacttggacctctgcctcatctttcttcttttgcgcttcagcctgcgcattcgcttcttcctccacttggctctcatggcacagaggtttccaaaaaaaatggcgctaaggccgagagccacactctatctttttttaagagacaagatctcactttgttgcccaggctggggtgccatcatagctcactgcagcctcgaactcctgggctcaagccatcctcctgccatagccttcccagttgttaggactacaggtgcacatcaccatgtccggctaattttttaatttttcttagagatgggaatctcactatgttgcccaggctggtctagaactcctggcctcaagtgattctcctcccttggcatccacaaattactaggattacaggcgtgaaccaccatgcctggccttgaactgtatctttaaagcccctgaaatattgttcctaccaaagtaatataaatgagattatgtcctaaaatgaactgtatgaaatgcaagaaagctactcattatgaaatcctgttaatatatgtgtgttggggtggataaggtaaagaatgattgacgctacttaataaattgtggttatccattagtacatttttaaattaaattactaatgaaatacaacaaagtagaaaatatcagccttcatcatgcttctaagagcaaatactgatttgtgaaacttatttcagtgatacatatactgggtcaagtgtaaaatgtatttccactgggtcaaaaaagtttttaaaattctagttaactgtggttaaaatatgcagttcagaaattactgtgatgtactacagtgtgggagtaacacaggaagaaaacacagtagagttattataaataaaatcttgctaacatctatgggaatcatatattctgagccttaatatgttctttcatagatggttttaagttggaggtggtcatcgagctaccatttcatcatcatccttctcacttttctctttttacaaactggagaacggtactgtcatcatttaggtatccccccagtgcttggaacaccatatgcactagataaatgtttgatacatctctagaaaatggtcttttcacaaagccattgtgtttacatagaatcaatgatatgaataagatatttaaaatttccatatatgcactgctgtaatcaaacatcatatgatcactgtaatatcccataagcagtggttttatataaaaaaattttgaggccgggtgcagtggctcacgcctgtaatcccagcactttgggaggccgaggtgtgtggatcacgaggtcaggagatcgagaccatcctggctaacctagtgaaaccccatctctactaaaaatatgacaacaaaagaaaaattagccgggcatggtggcaggtgcctgtggtcccagctactcgggaggctgaggcaggagaatagcaggaacccgggaggcagagcttgcagtgagtggagattgcaccactgcactccagcctgggcaacagagtgagactccgtctcaaaaaaaaaaaagaaaaaaattttgaaagactacattttaaaaaaatgagctattattgttattctttatattatttttcattggcatttttatttagatgtaataatgttgatgctaataccgcgtcagtaacaaactttactagctgtagtgagttgaactgtggctcccaaaagttatgtccacctgaaacctcagaatgtgatcttatttgaatacaagtctttgtagatgtaattaagataagggtctcaagatgagatcatcctggattgagctgggactttaatccagtgagaaatgtccttccaagaaagagaaaagaagacacagagacaaaaagagaaagccatgtgaagaccagggcagaggctggagttataaagtcccaaaccacagaatgccaaggattgctgggagccaccagaatccaggagagaggcatgggatggattctccctcagaaccttcagcgggaacgtggccctggcaagaccttgattttgaatttgtggccttcagaacttagagagaataaatttctgttgtgttaagccaccaactttgaggtaatttgttaacagcagctctaggaaactaatataccagctgaataatatactgatagtttaaaggtcacaccaattatagatttggttttcctggcccttgcctgacctatgtctttcacttagagaatgttggtaagagtttattctgaagcagtagtattggattcccacagacaaacatacgaggtcacatggcagctgctttacacaggactgtcaactgggccattgctatggttagaatgtttgtgttccctacaaagttcacattgggattcaatccccagtgcaggtttattaagaggcaggacttttaggaggtaattaggttatgaaggctctgccctcatgaatggaattaatgctcttatacaagggcttgagagcctgtgcaatatagggggaccccatctctacaaaatatttaaaaattagccaggcatggtggtgcacacctatagtcccagctactctggaggctgaattaggaggatcacttgtgcctgggaggttgaggctgcagtgaaatgtgatcatgccactgcactgcagcctgagtgacaaagtaataccctgtttgaaaacgaaataaaataaataaaagggcttaacagagttcatttggccctttttgcccttccaccatgtgaggacaccacaagaaaccccccatgaggaataggccttcaccagactcagctgctggtttattgctcttggacttcccagcctctagaacagtaagaaagaaagtctgttcttaatatattattcaatctaagatgttttgttatagcagcaagaacagactaagacaactattgcttggattttcttttactcctcaaaagccaaatatgtccatggttgaaaccaaagaaactggattttcattccaactgaacgaccacagtagcagagcgatcaggaacatgggatggggtcaggtagttctggattggaatcccggctccaacccttaactgagggagtgaacttggacaaatacctgaaactctgggcctctctttgctcatttgtaaaacaagaattgttaaactccctcaaatgctgtcagacaatttaataaggaaaacaccatcttgacaaagtcttagtggtacctcagaaaaaagaagtcagggatggatatttatacagttttgagatcttggttcaagtaacctcaagagtctttaaagaagggaactgaaggtcaggcgtggtggttcatgcctgtaatcccagcactttgggaggccaaggcaggcagatcaactgaggtcggaagttcaagaccagcctaaccaacatagagaaaccccatcactactaaaaatacaaagttagctgggcgtgatggtgcatgcctgtaatcccagcactttgggaggccaaggcaggcaaatcaactgaggtcggaagttcgagaccaacctgaccaacatagagaaaccccatcactactaaaaatacaaaattagcccggtgtggtggtgcatgcctgtaatcccagctactcgggaggctgaggcaggagaattgcttgaacctgggaggcagaggttgcagtgagccgagatcgcgccgttgtactccagcctgggcaacaagagcgaaattctatctcaaaaaaaataaataaataaaagggaactgactggaattgggctaagatcatgatgtaaccttagcccaaggtggacgaagggaggatcttaaagcaagtgttgatgagtaaactatggcttgatgagagtgagcaatttgcccaagggagcagattgttatctcagataagctgatcagcaggaatttcctaatgcaaacagagaagttatttgttggcttacagtcttatctattctatgaaaagttttcagaacaagtaacttaagttatattgacacaggtggtctgagttctaagtccaaatagcaatgtcatgttgatggcagttgtcacagttctcaagagaatgatatctactttctgtggctgttgtcaggagtaaatgacatcatggttctatagtatctgccacacagcagggactaaataagatattattattatccattttaatttattttgaaagaccaaacagatgtaataggaaatttttatatctctcaaatttttattgcttttcataaataataagcaaagtaaatggcttgcggctttcctggagtttaggaactactaagttactaaggttatagtagaatttgcacttactgaaagaaaaaaaaaggggacaaaaggaaaaaaaacattgagagctctttttctttgccatgatgctagttgtcggcatatttgcattccccaaggacttgggagtaattagctctgcataagctgcacatcttcaggaagaaaacaacttttataaatgcagagaggtttcatgaaatggtgtgtcatatggaaatgcaataatttctggagactaggagtctttattcattccctctgcatattctcaattgaattagtaaaattttcttataagagaatgctacatctcttcagtctctgaacatacaaagcccagaggaacttcttgagtgtttgtatatttgagtgtttgacttcagaatctctagacggtggttgagtcttatcctcaggaacagaaagcaacatggtcagatgcctgtttgactccaagggcagtgctcattcaatgcccccaccccagctttctccactgaacctcgcagcagcattctaaagactgcaggagggactgccctggttttgcccccttcactccagggagtctgaacctgcttcactcaactttcccatctctaaaagagagacaaaaagtgcagcactcttaatgttttgatgcgtcattaaaacaaataaaataatccaaacgatgtagaagaaaattgttttactgacaaataataattatacatatttatggggtacaatgtaacattttgatacaccaagggatgattaaatcaagctaattaacatatccagcacctcacctacttaccttttttttcctagtgagaatatttaaaatctactcttagcaattttgaaatatgtagtaagttattattaactatggtcaccatgctgcgcactaacatttattcctcctgtctaactcaaactttgtaccctttgaccaacatctcctctttccctgtcccaccccgtacccccatccttgagtaatcatcattctattctctacttctgtaagttccacttttttagattccacaggtaagtgaaatcatggagtatttgtctttctgtgcttggtttatttcactaaacataatgtcctccaggcttatctatgatgttgcaaatgacagaatttctttctttttaaagggtgtctagtattgtgtagccaattcttcataatcccaagatatcattactatgtgataataaaggcaagcgtatgaagtaaaagaaactgtagtaggtcaaactaataagaaaaatgctgatctgaatgtctatacaatgcatagattgtgtttttaaaaatgcaacagtatataatttccggacctgctatagtcttgggaactaagcagtataaaacttggctagtgactagataaaatgatgatgtataacagacattagttacttatatgcttaattaatctgaacatttaccctacactcttattggcgttattaatttgttcaatttgttaaaagagtttcctaagaaaatgtggctttatttcagtacctattttgaatcccaaatattttttatattctggcttgataactgagtgactaagaggtttcagggccttgctacttgggtttgtatacaggcctaccattttctggctatgttttcttagattacttcacctctctgtaacttagtttcctcaatgataaaataaaaataataatcatggtcacctcatagggtagttaggaggattgaatgtgttagttcttataaagtgattaaagaaccaaatgcatagtatgttagttcttgtttatttttcttgaagttaactgtaggaattttaccacttacaatttacagtggcattgctctatgggaataatactacgtgggaggattctaccgtggtttttgatatagtttggatgctgtcctcctccaaatctcatgtggaaatgtaatctccagtgttgaaggtggggcctcgtgggaggtgattggatcatggggagtctttcccccttggtactgtcctcaccacagtgagtgaggtcctgtgagatctcattgtttaaaagtgtgtggcactcccccaactcctgctcctgcttccgccatgtgaaatgcctcacttcccctttgccttccaccatgattggaagattcctgaggcctccccagaagcaaaagctgctatgcttcatgtacaacctgcagagccatgagccaattaaacctcttttctttataaattacccagtcttaggtatttttttatagcagtgaatggattaacacattttatttcaaatttatatcctgtatagccttgcattatgaaaagagcacagaacaggaagttaggacatcttgctttgaggtctagaacagccatcaactatatgatcttgggtgagtcacttcacctctctgaacctgtttcctcaagaaaaataagcagagtaggctgcctgcgtgatctcaagacaacacactgtgctagaatgagtcttacagcaagagttcaaagttcaaattctaattctagaactcgttgagtgtaaaattcacagcaagtcatagaacctcttggaaccccagtttccacatctggaagaaggggcagaatagtatcaaaaatgcttcactcccaggaatgtggtgagcataaaattaaataatgaaaaagtcaactataaagcactaaataaatataaggtaaaactattaataaaatctcatttagtttaatatttctgctaaatctttttattttcctataatcttttccaagtatttgttcttctgcaggtagaattctgtgggttgaaaccagactataaaaatctgtgtgtttttttttttttttgtcactcagactatctgctatgaagaatgttttcccttagttaaggtaacagctataaatgttcagtttgcccctgagtcattatctgagtcatgattctgtatgagtcaagaaatctaagaaatatagaaattatctatttatcccctttcttttctttgtataaatatctctagatataaccaataaataacttgcctctatcttgggtttcttaatattttaaagagactgttgtagaggaatagggtaatgggagattatcttcatcaagaaagagcctgtgcatataacctgtacacacacacacacacacacactcacacacacacacacaaaatcaacaaaaccctatgctccagccagaaaaacaccttcttgccactaggcccctattagtgctggtccctccacctggaattcctgttcctctgatttctaactgttcaattatacctagaattcagggttttgttataatctcaaactttcagtgagatggattgagtggttctttgcccagtgaaaaatctttaaggccaatattcctttttttgcagatggtgaatctgacagaggaagaattaaatgacttgttcaaggtcacctttgaggaatttgcaggaagtttaacttatgtatatttttcccctgtagtaccccaggtatatcttttcaaatcatcctcgtctgaaccaatttatgctccccttacccatcaggttctcctgtaacacatatataataccacatgttgccttgcactatagttgcttgtgaatagatacctcccttcccagagagtaggtcccacagaagagtaactatcttattctccaaatcctttagagcttttagcactgagtacatacccaggtatcacaaattttgtatttgttgaattggagtggaacatctcaaggatatttttctattgcctttctatgaataagctcagttttgcatgagtccactttgattctcacctaaataagatcatgtagaaacaccaaaagcaccagtgtagatgcaagagatggtgaagacctgaggccttcactgctgcctcctgccagccctgcagttctcaaagaacaagggtcgttgggcaatccttccagacagcttctgggagtgacccgtccttgacacattgagttagctgtgctctgaaggcccaaagcgattcgaagcatgattttaatgactgtcattacttctgccattactaccacccaataaaaaccatcatcagcttgatgtgattatccctcggttgtgcagtgcctctggactccagcaagcaacagagcatatggtctttgccaatagcattattcatcaatggaggataaaattcacagtagcacccagcttgtcacagtggggaatggctttgggcaagtcacagcttcagctcagcttagctctttccaagatgtgggctcttattcacaatgcccttcataaaagtgaaaatgaaacacatgctgaatgggatttttagaacaataagaaccctataattaggaagcaatagctaaaattatattatccctgagagcaaagcatagtaacaagttaatgcaattactaatccagctttttccgaggtagaagcaaaccatgcaattatatccttagtctatattttttcaggggcctaatgacaggaaaacaaatgaagtggatccccatcttccacccttgcctccgctaagccatcagaggacaagtttcccaccccactctctccaatttcacttgaaaaataaaacaggcctccagctgtgaaatggattatgctctacaactatgtacctggaatagaagccatcattcttcatgaagtttgctgagaattatgtatcgcagcctggcagcttcctgttccctcgttagcctgcatatcccacttaacgaaagattcgccatgcactgacttgtatgtgactcacagtgtgcacagtatgcactgactgtgacctgtccccaaatgaacacagtaccagtctaacgtaccaccttacctatggctctctcccatacacacccaatccactgcaggcaaatgatctacccacaatctcccaaacacagtcttcactgtctggtcactgctcctttacacgtggcattcactctgcttgcagaggcattttagagtggatatctaaagaaggagatttctcccaagcatgcacataggagggcactggtctgatgctctgattgacagttcactactgcaaagaggacagatgagaaagcagctcagctctttgatgctaaggaaaaaacacagaacctcacttatctatatgtaatcacaaactttagtatccatcagtaccaagccaaaatagttcctgtttggacatacattattagaaattaacaacaaaatttagtaaatggttggccagttctgaacgcagaatagccacctctgagtgagcattttgatcaatctaactcacacatttctggttcaacaaagttattagatgagaagacccaaaacggtgtgtaaatgggacacagatttataaacagttaatttataatcatatatggcaaattaacctgtatgtcactaatgtgccaccaatcataagacatgccatcatttaatctgtcatgaagaagtgaaaaactcaattaaacggtgacatcatgcttcctgattagaaatgttcatttttttgttatgctaaatttacataaatacatatttatttaaacaacacggggccacaatatgaacatctatgcccaagtttctgcatgcccagcaatgactgccaccctgacaatggtgactgatatcatcaagtgtaacatgcatcctgattcaagttgttcaactgtgacacaacgggtaccttagcactgatgaaatatggtacccgcctgcgtcacatgagcttctcatgatccagcagcctctcctcacctgacactggctctagtccccagtaatgactctgatcctgtttgtcctaggagtcttctcttcctttgtttcccacttccctcactgggctactcagtaaccagttagctgttaaggcgcaagcctttttttattttaatttttattttttccaaaactcctcaacaattgcaattgccactttgtttctactattattgcccttgacttatttctttatttatttaagtttcttttgtttttaaacaagaaggctgggtacagtggctcgtgcagataatcccagcaatttgggaggccgaggcaggtggctcactggaggtcctgagttcaagaccagcctggccaacatggcaaaaccctgtctctactaaaaatacaaaaattacctagaggtggtggcacacgcctgtaatcccagctactcacatggctgaggcaggagaattgcttgaacctgggcagcagaggttgcagtgaaccaagatcgtgccactgtactccagcctgggcaacagagcgagaccctgtccaaaaaaaaaaaaaaaatctcaaggctgggcatggtggctcacgcctataatcccagtactttgggagtcacagtactcaggatcatctgaggtcaggagttgaataccagcctggccaacgtgatgaaacctcgtctctactaaaaatacaaaaatcagccgtgcatggtggcatatgcctgtaatcccagctacttgggaggctgacacaggagaattgcttcaacctgggagacggaagttgcagtgagccgagattacgccactgcactccagcctgagcaacaaagtgagactccatctgaaaaaaaaaaaaaaaaaaaaaaccaagagaatcttccatcatcaattgaaaaacagtaactgcccttattctcacccaggaggagagaatgaaaaaatgttatcattttaatatctttataattttagtaccatgtacataacatgaagtttaccatttaatcatttttattacaacaaaatattttttaatttttctgctattgttgtcatatactttacttccgtgcatgttataaacaccatgatacattgctataatttttccccaagaggctttcagaggtctgcaatgagttagggttgaaaaaacagtgatccaatgtgctagttcaaagactgcctctccttggcttccaggaagccttctaaacctaccttttctattagcctaccttttttttttctttccaatcttttaaaattctattacagatgtacagcaagatcaaagggaacaccttgtccctggggctttagctactggctggaagagaagcatagaaatgtctttaactctttccagtggatatcactaaggttatccaatcatcccatgaccactcggccagagggggtgagatcaccccaccacatcctttacatgcacacacacacacaaacacacacacacacacaaacacacacacacctttcaggcttactgttgcctttttatttactttgcttcaccttggaagagactgttaatgctcatgctaacctgatttcacctgtataaaaatgtccagggacatgtgggcattctgtgatttgtcctggttctaaatatccctgagggtggtcctgacccacataaaaacaagtctgcttcagagccagcttcaaagcctacctctctgatccccaaacctcaggtgatcgcactgtcctctggccagtgatggttcttagagtctgtacttcctatttgatatttatacgcaatggcgtgctggtaaatgtttagcacctggctctgggggtggagaggtaggagtctgggttcggcgggtttatagattcaatttctgtggtgtaaacactcccaccatggctatttcaagccaccagtatgatgtcactgaccacagtcaggaagagacgcagagtggcatattgttatgtagtatttctaccacacagatataatacacataaataacttcaagatcagagataatactgaaaggtaataaaacaattagtaatgagttttgactatttattatctttgttattagtatactttatttaattataactttatataatttaatttctaataatggctgtgtttaataaccagctcacaaaactggaaaacttagcaattggcttttgcaagccagtaggagcagctccagcccacaaaagtaataaagtatatgctatcttgtattattattttaaatcttttatgtccccaactaaattatatacttcagattatgaagttatttgtcttaaatacttctttttatttaccatgctgctaaacacaaataggtaattaacttctttttttttttttttttttgagatggagtctcactctgtcgcccaggctggagtgcagtggcaccatctcggctcactgcaacttccgcctcccaggttcaagagatcctcctgcctcagccccactagtagctgggattacaggtacgtgccaccatgcctggctaatttttgtagttttaatagagatggggtttcaccatgttggccaagctggtcttgaactcctgacctcaggtgatccacctgcctcggcctcccaaagtgttgggattacaggcgtgagccactgagcccagctggtaattaacttctaacattaataacgtttactcattgtaaatgtttttgagaggccactaaaattcaccaataacaaaatttagactgggccccaaatctgacccttcctgaatcatatctttaacctagaaagtttatgcactaaaaaaatttatcaaaaaagatatattggctgagtgaggtggctcacccctctaatcccagcactttgggaggccgaggctagtggattgcttgagcctaggagtttgtgaccagcctaggcaacatggcaaaaccctgtctctactaaaaataaatgaaaaaaaaaaaaaaagatgtattactgacagtgtaattgaatcatttctgctaccagctataagattgcctaccattaagagcagcggtgaccagctttgttatcaatgctgttaggaacattgattaactttcaaccccaacaagcaagcaagccaactcctatgactgctgaagtgagcgctctaaaagagagagtattcttggaggagggagccccgtggtgggtaaacaaactgagaaacttagctaaccaaacttgcaagaatgatcagtctctttataatttacggttaccaagaattggcatgtaacccaaaatgtcaacttattatcaaggagatactatcattatcctactgatggaatatcttcccagtaacaatgatattggtattcattaaccaggattcttccttcccagaaacaaggaatcagattagcaatgagaaggatatttgttgtgtatcaacatggagaatttaaaggtcttgaagcatatatcctctagatatgaaaaatccaaacgaactatctctcttccacagtggagtgtatctatttggtgcaaaagtaattgcagtttttgccattaaaagcaatggcaaaaacagcaattacttttgcaccagcctagtatctaatccccagactattaatatctaccaaagtgtgtctgtcatctatgaaaattactggtaaagtctgtgaaaattttcactgaaggtcagcaaaggcactattatctcatgctggagaagttacaagtgaatactagtactagtaactagtattcattaatactagttagctttgtacactacagttccatggcagagacagcttactgaaaatatgccccagttcagggttggcaaatacatagcacatgtgctgtccccatcccttcccatactcttggcagacatcactaattgatcactacactcttccttcattgagtcttacagttcttcccaacacagctctatatgcagcactaccaatcctggccctgagctccagaagaagaattaggaagcaaggcatgtgcaggtttctcacagggaggttaaggactacatggaactaagtgcattatttcaagttcattttgatagcttgctgttagaaggttaatgttgttgcctgctgctccttactgtaaacccctaggtcctgactaccgaggggatatcaagggctctatgttggctttggtttttctcctctccagtgttacaatatggagatgcctacgtcttacttacacagaacgaattgttcaccatcattttgtcagtgaatgtatgttttagaagtcagttactatgggtgcagcacaccagcatggcacatgtatacatatgtaactaacctgcacattgtgcacatgtaccctaaaacttaaagtataataataataattaaaaaaaaaaaaaataaaataaaaagaagtcagttacatatttaagcttcccttggctctttgccacttccactagagggcgccactgaaaaggaaaggaggtaaaactaaagggaagccatttttctccttagtgcctttctgttgcctctgctcagccttaccatccagaagaggaagtcctcaaccagtctgcacagcctctggtgtaccacggacatagcactctccacacaaacagaaacatctcttgctatacttgcccttctcctctgatcccaaacacccttcattcatctcaatcactttcccatggacttgttttccttctttcattagaaccagagctccatgagggcaaagctggtctttgtcttcccataccattatggtgcctggcacagagtaggtcttccatacacagttgtgtgttacaaacctcatgtgctgaaaaatcacaagcctcttattcaaggtgacagaaatggaaaccacaccaccttattaagtcgtagcaaattttccacaacttcataagcatgtgcttggaccctgctttctaattcttcaaaccaggaaataactcccacatgggcactagtgttctgctcttctacacagtggaattaagcttcttaactccgcatctataaggtttgatacaaaaggaaactctattgtcatttaacctgacgttctagcagttttccttgaagttctcacaggagaactttggggacaatcctctcatcaaaatgatttctagctgctacccttctcccaccttgaaattcttaaagtttcttgcccccttgttgactttaattatgttcttccaatagccttgtaaaattgagcaagttcccgacagcattttgaaaggccctgtgagctccctggtcagcattttcaatctctaattataaatctgcctgatggctttcacttaatacttctaaggtggggctgagggtaattgatggttttgaagctagctctttaatagcagccgtcaatgtatcaaggcttaatttctttcatgatctcagagaagttgctgcaagtggtgaggaacttatgttatcatccatcctaggaaaacagagagattttattagagtgtagtgaaatatttataagaacattagagcttgtgggactcaagaactgacttcacctcaaactttcatttgcatacttgcttccagggaaatctattatgggatggcctggatatatcactttaaaaatcctgcttttaatgaacaaatgagaaaaggtgagtagttttctctagaaagaacatttttctcacccactgtcttcccggaaagataaaaatatgctcaaaatatagcatagaaataaagggactattttgaaacagagacgaaaacattttaactcaagaaagaaacgtcagtgatgatggaggatttccttaacaagaagaagaggcttcactgtttgttcacaaagaaactcggtctctcagtctttagttgtgactttctgttttaccgaactattattttaattgtggcttctctgtgttctcgttgccttcccgtaacatttccatgttactttgttggtactcattgtccttctgacaagccatgtcagtctcttccacactgcctcttccatcaaatgtatactacagtaccttcattagcccattatagatgctatgtttattcattcattcaacaaacatgtcttgtgggtctactattggccagatgttatgaatacgaacacagaaagcagtccacactctcaaggaacttgcagttcagtgagaacttgactggttagaaaccacctggcaatgttacaaactatattacattttcaagctatattcaagttatcagagactgtcatcactcctccaagctagagattctgattagctgacacatttgcaacactgatctagtgaacaagatgtaactatgattccttgacctgaatttagaggcctttagtacaaaaacagtgctgggagagaaagctgagggaagactggtagaagtctggaacttcagcaaagaacagataaattcatagaaagacagatctgctttcctctagttcagcggttctagggtaagactttgtgcaactgggaattagaattttctggcagcaaagctgtatcagccctttacaggtttacctggaataattcacactcccttccttaacgttctacctggccaaactatccaggcctagcataaacctcagagcccacagtgagaatcatagtcacctagttgctctgacctactgcaataagaaaccaatgttttgttttgttttgttttgtttttatgaagtaaatgatgtttaatgccaaaaagcacactcgctttgggtagctcaagaggtgtaaattcagacagaagcctacctccaaagtacagagcagaaaaaagcattcccaaaaatgcattctggattttacctctccctcaagcccatgcttaaagtcagcatctgtgtaatgctaatgattagtaaatcaaaaggcatttatttaatggagccgcttcagtatgctgcagtaagttgccttctgccatatggctttgggtatgaaatgattaaactataatatctggagcctctgttgctggctatttaacggtgttatgcatcatgagctccgagatggctgcaaatctgttttcagtttgcattcccagcaaaaaaggactcctggcccagagggatttaaatcctcctccactaatcactagggcatacagaatcacactgatcctgcatatagttagtagctacagacaacccaatcctaactcaggaaagagacagggaccttcattaggcagccatttccggggtttaaaaacaaagaaaatgataatctgtaatggctaagaaagcaagaagaagggaaggaaggcccagcacagagcccttgagatgaggacaatttggggcacagtaaaaaggctgcaaactggaccttctcaaacactagtccattggctgatcataatcgctacctggcatggatagcatcttctctgccaggcactctgctaagcactttaacacatgctacctagggtgggtgtggtggctcatgcctgtaatccctgcactttgggaggctgaggcaggaggatcacttgagcccaggaatttgagacaagcctgggtaacatagtgagaacccatctccacaaaaaataaaaaacaaaaattagcagggcatcatggtgcctacctacttaagaggctgaagtgggaggattgcttgagcctaggaggttgaggctgcagtaagctgagatcgcaccactgcactctggcctggatgacagagcaagaccttatctcaaaaacaaaacaatacgaaacaaaaacatatctcacctctcttaatattcacaacatcctctatctagtaggtactactattgttcccattttactgatgacaaaacagaggctcagaggacttaagcaagttgaccgaggtcacagctggttagtggtggagctgaagttcaaattcaagtcggctagactgcagggccaaaattctctaactacagtcctagttgagcatcaccactagttccttaggtaagaaacactgatggtgaataccaccatcaggggatttttagtttcttgcttctaaatatgatcagtaaactatgtatgatcctcattgcaatgggtggacttagtcttttttttttttttttgagacagagtctcgctctgtcgccaggctggagtgcagtagtgcgatcttgggtcactgtaacctctgcctcccaggttcaagcgattcccctgcctcagcctcccaagtagctggaactacaggcggcatgccaccatgcctgcctggctaattttttttttttgtattttagtagagacagggtttcaccatgttggccaggatggtcttgatctcctgaccttgtgagccgcccaccttggcctcccaaagtgctgagattacaggcatgagccaccgcgcccggctgacttagtcgttttcaacaaatccttttgttggcttcataaaatccaaagttgagaaaccatttcaagtgctgttatatacaggcacctgatccagcaaaccatgcctagtatttaaatgatcccagaacttagaaagggcaaaaatagatagttatttcctgttcagaattctgcctcgatatggctcatgccattttatgtgctatccattatagtattgtaagtgttactaggaatataacccagttcctgtccccaagaatgttgcctttctactggagagactggaaacaaagaggtcagttatacttcaaagtataagcaatttaattcctcagtggaattaaagtaccatagacatggagagaatcaaaagagttcaaaagaaagccttggctactttgctatgtgcaagagcaactaccagagtaaaatcagaaaagaaactcttgttcatctattcaactcagcatgaataaatcacttaaaatcataattgttctggaactttgggtggctatgggcaaaaagtcctatagagaatttaataaaactgtaggctttgtatcaatcaattcctttggaaatttttagcataactcaggagttggaaacttccttcttacaaaagacagaggcactgtctcaccctcagccaatagcctcctccctcatgggtcctgcttcattaacttttaactggtgcttttactattcagtttgtacttttaaacttttaaagcttttatcagatgtcctttgaaaccaaagcataccattaaaacacacacatttccaacgtgaccagatttttttaaaaagacctattcacaaagaccttgagaggacaaagaatgtatttaatgataccaactagcatggcgccagtaatgaatggttctgttctgccaataatacccaaaactaaggcaatgatttttttgtaagccttgttttgctttagaaatttacagtaatatactttcccatatattatcttatttcatccttctgtcaaccatagcgccaagcagagttggttttattatccccattttaaaataaggaaactatggttcagagcatttaaataacagagccaggcttacacatgcagtaagcaacagagtcagcgccagaattccagctctctggtttccagcccattgccatttcaagtcagctatttatatcaaacaatataacttctattcttatgtgatctctgcaaggaaaggttgcaagtcctatttgtctttggatccctggcacctgacttgggacaagtcagagtttatggtggaccagaaataaaaacactttgttctagtgtctatgcttttcagtcactgttaccagttacgagggttaggctaacactaagaaggccaaagtttcaggttttaaatatgcatgggacagtgagttttctggtattccatggccacacaatcttgctaacctatcccaaaagggacctggcaggttaatggatagattggtccaatgtactcccctaatccatcgtccatgcttgaaatcagggactgtcactctcacaactaacttctcaggaaacatccttgcctgtagtctctcccaggaggattctgaggcagggccttgtagattggtagccacactctattcccagtgattctccctgtacccccagcctggtatagctaattagagcagagctggtgcttggttcaaaggctatggatgagcatccaaaaatctttgagatgtcctggcagaatgatacttcccaatggaaacagtgatttactgggcccatgaaatgttccttatcataaattcaaagtgaaggtgtatggtagaaaggaattcaccagggtgatgaaatgatgtacaacaaacccccatgacacatgtttacctgtgtaacaaacctgcatttatacccctgaacttaaaagttaaaaaaaagttaaggaaataaaaaagaatatagaccaaaaaaaaaaaaaaaggaatttgaggagaagtaatagagaaatttaaaaattaaaagactttaaaaaaacagagtgaatataatagaaaagagtaacttaggagtgagaagagagagaatcagagatgaagacacattgacggtagacccccaggggaggaaactcagggaagcttcccccctgggttccagccagggttacagagctgatggctgtctgctggaaccgaggttgggttttcttcccttcaagaccagttgctctttaatctttttggatcccaatcactttcatcatctgatgaaagatatgggtccttgtctcagaaaaatgtgtatatgcacattcagaccaatgactgcatttaatttcaagagacttctagatcccctaaacctgacttcagattcactagggacccatgggccacagggcaagaaatcttgtttaaactattagttcatctcagatagctatggtatcatagccatctctgaagctcagcatttagtatggggcctgaaacgtagcaggcattgcatacatcttggtagaatgattgagtgaatgaatgaatgaatgaatgaatgaataagtagatgaatgaaataaatacaacttgaagtttatgtcctactcagcacattgggagcatcctcttcttcttatgaaatactgtattaatgtaagctgagtagtatgtcaggaaggaatgcctttacccagatgatgtttaatatatccatcaacataattgatgggcacactgtcaccttctacatccggagctagaaggccattataccaccagttacatgcaaatgagaacttggaatgacatagcctagaagaacagctctactttcctagtagatatagaaatgaaaagcaactatgttttctacctgaaatatatgtgtaatgattattttgaactgtaagctactttttcctactatataacttgaaggcaaggttatgtgacatagctttgtacctgccccccttgctcactgccaatctaagtgtgttacagatagagagattttaattaaacttatctcatggactgtaacgtgggtagagaagacctgctttttggtttgtcgggtgatgggggaaaataaaagggaattatagcagaatataatgatctcaaactttaagtattgaagtcattgtttcaaactgattacatctaaaagtaagagtcaattctgtgagctattttttttatttcttaattcttgatcataaaactcccatatagtccaggcatagtggctcaaacctgtaatctcagcactttgggaggctgaggcaggaggattgctttaggccaggagtttgtgaccaacctgggtaacatagcaagaccttatctttactaaaaaaaaaaaaaaaaaaattagtcaggagcggtggcatgcacctgtagtcctagctacttgggaggctgaggctggaggatttcttgagcctgggagatcaagggtgcagtaagctgtgatcatgccactgcactccagcctgggcaacagagtgagaccctgtctcaaaaacaaaaaataaaaccaaaaagcctcctatataaaaagctgtgcttcaacctaaatcttcaataattagaattgcaaggtatggcaaacaattgcagttttcacgtagacagtcttcccctccttgtggatcccatgccctggtagcgcaagaagaacgagggcccaattcactcacagtgcaaaacttatggggttccatttgtctcagtacttccttatgggtaccagtggcataaaatattgtatggtgcttccacccaaggagcatgaacattctctcattaacatatttaaagcccagtaacagaaaatccatacttggcatgtgacatagctaaccctaaaaacctaatttttgctagctcttgagtcacttagcttacctaagcataacatttattttatctttttttttcttttttgatacagggtcttgctctgtcacccaggctggagtgcagtggcgcaatctaggctcaccagagcctcgacctcccaggctcgagctatcctcccacctcagcccctgaggagctaggaccacaggtgtgcgccaccacacccagcttatttttgttttgttttgttttgttttgttttgttttgtagagatgaggtttcaccatgctgcccaagctggtctccaacttctgggctcaagcggtctgccctccttggcctcccaaagtgctgggattacaggtatgagccaccacgcccagtcacatttattattattattttttaatgtgatttagcatattgctgctgtattcagcatgtgcctggggtgaaggacagtgaaaaaataattttctagctcggcacagtggctcatgcctgtaatcccagcactttgggaggccgaggcaggcagatcacctgaggtcaggagttcgagactagcctggccaacatggcaaaaccccatctctactaaaaatacaaaaattagctgagcatggtggcacatgcctgtaatcctagctactcaggaggctgagggaggagaatcacttgaacccgggaggaagaggctgcggtaagccaaaatcacatcactgtactccagcccaggcaacagagcaagctccatctcaaaaaaaaaaaaaaaaagaatttcctgaatacctttatgaggcaaggactttccaaagattatcttattgtattagtctgttctcatgctgctaataaagacatacctgagactgagtaatttataaaggaaagagggttacttgactgagttccacgtggctggggaggcctcaggacagttacaatgacagtggaaggggaagcaagcacatccttcttcacatggcagcagcaaggaaaagtgccaagcaaaaggaaagggagaaaagccccttaaaaaaccacaggatcttgtgagagctcactcactatcatgagaacagcatgagggtaaatcccccatgattcaattacctcccaccgggtccctcccacaataggtgaagattatgggaactacaattcaagatgagatttgtggggacaaagccaaaccatatcactcatcctaaggattttcttttttctttttttttttttgacccattttacagaccaagaaattgagctacagtgaggtcacacagccgagaatcacacagtgaagagttgggatttgagcctggaatactctgacctcagagtctggatgctagtctcttgctgcctcccctgtgttatgaggtcatgtctaaatcacctccgttactgaaaatgcttgtgaaagacctattctgctggatagagcagtcaccttagtcaaatatgatccaaatgttgccattaggtcctacccaaccccatcaaagatcagaacctggaggtgtggtaactccctccagtccagaaaaaaaaaaaaaaaaacaaacccagtaggtcagagtaaggagctgctctgagccatcagtgggagggttaagttaaagaatagaaagatgtaacctgacccaaaacttagctctcattttcaacaggcaagagctccttgcagggtgaccttgactcagacccacaatttcatcttttttttttgttttctttttggaatggcaataacaatgtctgcccagcatccaccactttaagttggtgtttacaatagaactgacacagccctttaagcaggctcttgcgtgcagagttaactctccccttgcacacagagcagatcgtcaggctccctccagccccaggacctttctctaaccataaaaaggcaattgtacctctaaaccccaaatccttacctatccctgctgcacccagctgtgcaaggtgagtcctaggaggtcacatcccacatgattccacgttttctcatcagtatcctttgctagttccagatattgcaacatcactactgttcaagattagaacttaagaacttgaaaaggtcaagaaagatgtggtgccttgtctccacatcaagtaaacagtccgtggcattggcctctgacaaatgacaacagactcacggggcagcagttgaggagctgtgcttacatgatacttaccatcctgagaagcatggatgtatggggatacccataccctggtaacccaaccccatgggctcagacagtgttgaacactagagaatcttcatcatttgctcagctgtcaccacttccacagatgcaagaaatggccgatggttctagaggatgaccccagcctctcaaatagaaaagggagtgtgttagatgtcatccagccagtcgtatagaaaggtggactttaagaaactgtggttaatgttggaaggaaacataaggcagcttttaaagctattttcatagtcttcaaagagaaataaatgaccagcgccgacggctgcagacagcaggacaggcagcctgacggagctctgtattcactttattctaatctgttgggggcaggggaattcatgggtccacactctatgaatccatgggtccacagactaattacatcatacattgtctgattaatcctcccgataattgatcctgctctggcatgagatagctgtgtgaccttgaaccaatcattaacctttgggcctgtcctcttctaatgccagggtaagaattatcaacatatatgttgaaatccccaaggattatgccaaggaatggaacagagaggaagacagtgagacatgttgagggggtagaggacttggatagagaagagtgaggcagagaagcagcgtaaataagtgggagaatatctagggagaaaaggaaagacaaattcaataagcagtttcaaagcatgagcctcaaaataaatgtctttcttccttgcaatattactgttttgtactggcttaagaagctagactatctcctgtctgcagaaaacagacaggataacaggaaacagttttggattccacagtgattatagctacttaagtttgacttaccaaatactgtctcaaacagatggtatgtaacatttgattaagggcttatcctgcaagcccgacagggaacatttctttccctcttaatatagaaaaaatgtagagaagaagggaaataaactgacgatcttgcccatgttccatgtataccaacgtttatgccttttctaaaatgaatctgtgcttattatgcaactcaagaccaaactgcatactggtgacaccatagaatttcagtaaaaaaggatattgaagatcatcctatataagccccttattttataggtaaggaaacagagacacagaaagataagtttgtttgcccatggtcacactgtggcacatctgggaccaggtctcctgattccaggtctggcattcacaccagtctttatatgtgcataatgttcaatatagggaaaacatacaaatctgtcagcaccattactactaaattagtgccaatctgtgatgagcaattatcagaacttgaagctgatgggtaatgccattctagtccagttaatgagccaaaagcttggttcttcaaaacacttaacattaatcagcatttggcttcagtttgtgacaagtgttttcaaaacatcacagacaattacaatattcctagctttgcctagtgtaaatacatgatgaaagaaagtcagaatttcataaatgacagtctccagaatggaaataatgagtcccttagagaaggtacaatgtgttcatctttcttgctagccaaaagtaatttgggaactaacgaggtcactgagaaattacaaagtgtgaacttctgctgggtgaggatgaaaaggcctcttttcacagtagcaaagcagagctagcacgtgagatcagccccatatgagtaatgaaggagtgacaccaggcttcatgcctcatcggccacccccacacacacccccttcccccttggttactggcaatgcctcaaaggcggggggctcccaagcatggagtactgaaatgctcatctagggaagaagaagcattccaagaggacttgggaactcattacacagtagcctgatgctgggaaagtagtagaagaaagaaaaccagaaaaaaaaaatggtggtttgtacgaagatgatgtcctcagctccaagctccacgtttcccaggacggttcttgcagaattttgtcccctaggatttctggagaagttgtctatgattgattgattgattgactttctgcaagccaagaacccaactgtggttaatattaggttttctgaaagacagagaattgcttaattaactgggcttaggatagtgttactcattagctagttttatattaataaaaatatgttaatcaattaaccagtcattgtcgatcacctggttaataactaatatttattgagaagtcattgtgtgacaggaacaatgtgaaatgttttcccttcattatctcattcactcctcaccatgagtctttgagatgatagtaatcataattacattcaggaatttattcgacgtatatattgagcacctgcttatcaatagacagttctaggcattggagatacagcagtgaacaggcaaaatttctcttgtctcttggatagattatatcaggtaactatcgctgcctaacaaacctccccaaaacctactggcacaaaacaattaacactaattattgttcataagtgtatgggttttccaagcggtttttctgatcttgatgggactcactcatgtatctgttgccacctggcagattagctggtctaagagggtctctactaggaaaactcatctctactccacaaggtctctcatctttcagcggctctcctaagcttattcttatagaaaaggcaggggtcccaacagaggggctggaaatgtacaaagcctcttgaggcctagattgggagctcatacagtatcacttctgccacactctgttagccaaagaatgtcatgagactagcccaggttcaagggtggggaaatggagttgacctcacaatggacagagttgcaaagtcacattgaaaacacagggtatgagaggtcattgatgcagaccatctactacatatataatgatgactaaaatgacactaaggaattcatggaaatatttcatttgagtctcacaataatccctggaggcaaattctattaccaatctctgctccccaaatgaggaaattgaggcctagggaggttacaaaacttgtctaagatctatgaatatttggtgatggcctcagggttcaaacttaagattccagtgtctgagcactgacccactatgtgattctctccagcctgcgcacttcatgagagaaagtacaggacatggtcactgcccgtaaggcacttatagtcctactggggatagataagtccctgaggaatcagtaaaaatacgtgtctctaacccaaacttggtaattgcccaacaagcagtaagaattaagggggccaggacaagagacagaagcttccataaagagattctccaatgaactgggctttgaagggtctaggcagtgaatagcaaaaggggagagttttctgataatggcatcctctcaccttcatgtaagggcttatagtataaacttccttttctttagaatggcattcagtgctgcaggcaatagaaaacctgattaacagtgacttctcatatagggatttttgtttgtcatgcacaacaagtgtgggaaaaagaagttcaggacttcacaatagccagatgatgtcatcaaggaaccaggttctttctgtctttctcctctgccattctacaaacataccccgattcctgggggtttcataatgccaggatggcagctgtattcatgagtattcttgtgcattctcaaataggaagaaggaggaggtgagcatgctagcacatcctgtccactgaactactttcccatgatttccacccattgtaccctccttactctctttggctagaactcagtcatgcgtagctgcagggaaagctggagaagctaatgtttcagttttctgaaactctgtaatatgggcaaacaagaaaaaaagggggctgtgaatgacttttacataatcaatccacagtgtcgatcccaacccgcccagcaccgtctcccagcactttccccagccactcctatgcaccagcaaacagaagtcctctgcattagtccattttcacactgctgataaaaacatacctgaaactggttaatttataaagaaaaagaggtttaatggactcacagttccatgtggctggggaggcctcacaatcatggcggaaggcaaatggcacatgttacatgatggcaggcaaaagagcgtgtgcaggggaactcccctttataaaaccatcagatctcataagacttattcattatcatgagaacagcatgggaaagacccacccctatgattaaattacctcccattgggtccctcccatgacacgtggaattatgggagctacaattcaaaataagatttgggtggggacacagccaaaccatatcatcctcattccaagtgcacttcaatcaattgttctcttggctcccttttttattttcataatgtcctcttgccttcatggactgttgaaattcttccatgactcttctctgatctcccgtagctggcatgacccctatcttgtgttaggccccttggtccttctgctgctgcccctgctgtagcacaaagcacattctgatttcatagttcctctactagaatgcaaactcttcaagtcaggggtcatgccctgtccagttttctacccacctttagaaccacatgcagctccaggatcatgcagacatgaaggaaattgagtgagcttcatgatttagcatgaggaggatgaggaaaagaaaggtggcacaaacaattgggggactgaaggagctgttgaggaggaaagaaaaagtctcctcttcccatttaggccctcttccaactgggcctaagaattaaactgatatatgacagattgaccggagaaaagcatacaagtttaattacaatttttacacataagcagggaccttcacaagagaatgaaggtctgaaaaattgaccagacagaaagattcttgctctgtttgcccagcctggagtgcagtggtgtgaacacagctcactgcagccccaatctcatggtctcaagcaaacctcccatctcagcttcccaaggtgctgggataacagctgtgagccaccgtgcctagtgtttttgtgccttttagacaaagaaactattaatttgtgaagaaataacaagacaaaagggtgttggccagggacagcaaattgtgaggaagtgactaagatacatagtagaaagaaccagaggaaaataagggttattttggtaactttgtttgtccagatccatttcagcattgattcccagtgcctggtgataagaatgttcctctctctctctgtctctttctctcttttcttctccacaccatgattctgtaaggaatgttcttctcttgctggttcagggtagacacctttctcatgggaaattttatggcctgtttaggttaaaaaaaaatgtggaggggaggggtggtcagaaagcccttcctgcatctgctgtttctcaagtgccttcagctcaaagtcatcaatctgccaaagtggcctattttggggtggcatgtcctgagctcctttagaacagatgacaggcacaatgctggtgccatcgtcagcaccagaacactgctgagttctgtttcagacttgttgagtgtgaggtgatcatggaattctcaaatagaaatttaaaacaggcatctactttcagaagaaaggtcaggatttctttttcttttttttcttttttttcttttttttttgtttgagatggagtctcgctctgtcacccaggttggagtgcagtggtgcaatctcagctcactgcaagctctgcctcccaggttcacgccattctcctgcctcagcctcccgagtagcgaagactacaggtgcccgctaccatgccaggttaatttttttttttttttgtatttttagtagagacagggtttcactgtgttagccaggatggtctcgatctcctgacctcatgatccgccccccttggcctcccaaattgctaggattacaggcgtgagccaccgcacctggctggtcaggacttcaattgtaagtttgatacaaagtggaaaaggctgaagatttcatccacagtctgaaaagaccatatgaaagaggaaggggtgagctccaaagaacaagcgtatgtcaaaagtagtggtgggcaaagactcaaatctaatatcactgaggcttctgccaggcagagagcagtggccgtctgctcaccgcagtggccagtgtgtctttgtgaagagcaatggaggccaggattgaggtgagtattgtcagtaccaactctaaatttcagattagctgtggatggaggcagtaaataagcaaatgcgtttgtccaatttccttacattgcaagttgcaaaacccacttgaagttgggtcgagaccagcttaagtaaagcagaatgtattggctcatgaaagagcaggatagctttggcttcagccatggctggattcggggtccaagtaatgtcctcaggactctgtctctttccatccatctctcatctctcttcatttttgattctctcttaatgttagattcattgtctctcactatggatggctttccccaggtatccaggaaaggtgacagaaagcaactctggtctatatcatctttacaatcttgtgatccaatactgaaaaaagagcctttctctctctctctccgcatttaaacatcaaatctcaaggaagaatctgattggcttttctagggttttctgcctcttcccattccaaaggaatagatttatctgattgactgaacttagatcacatgctaacttctctggaaagtgggggattccccataaaaaagtagttccattagcagaagaagagaagaaggcattctagacagaaaacaaaacaaaacaaaacaaaaaaaccagaagtcttctcttagaaggactgttgcaaacagggtttaatcatttgggtcctgcttccttgtcagtggatccagacgcatggagcttattgataagcacctgtggagacgtgtttgactcgcacccctgctgctgctgcgtgcttgcctgtttagctagaagccattctctacctttcagacgtatccccagcagaggaactgaatggagacttaggccagtcagtctcaaggctggttatttttagtaactggattctgccctagttgccttataattacatctgttttagattatatttggctcccccctccgtgccttcctgagctacatattggattccaactctgtatgctatttcttccaggcctagaatattattttcttctctcctgatataatccccttaccaagatcctatggctgggtctccactctttctttgaatggcagctgtctgtactagagctatctgcaactggatcctgagctctacccacttgccgagacttcttcctatctctactggttggaccacccctgcaccatctctgaaggctggttcagtctctgagtcccactccaccccgcactggccaatctccaattatgacagctgctaacgttcttataaaaacttccttagtctctaaatatagagggtaatcagaccacatggaacagaattcatggaagcacccaaactgtgtttattgcgttataaacatttgatcttctctgcagaaccatgaagaagtgggaagaatgcccagttcccctacttctttagcacactttgccacctgggccctgaaagagtttgtaccactggccaggtgcagtggctcactcctgtaatcccagcactttgggagggcaaggcaggtagatcacaagatcaggagattgagaccaccctggctaatatggtgaaaccccatctctactaaaaatacaaaaaattagccgggcatggtggtgggcgcccgtagtcccagctactcgggacgctaaggcaggagaatggcgtgaacccaggaggctgagcttgcagtgagccgagatcacaccactaaactccagcctgggtgacagagtgaaactccgtctcaaaaaaaaaaaacagtttgtactgctgaatggcagtgtgttagaaccttcataaaacagatcctactctttctgcctgagccttttcttccatagagttcagactttgtcatgggatagctgccctctggcccttccatttctcccatagctctttctaggcttttgtatataaaactcagttttcccttccttcaggaaaagagcaaagaactcatgcatatggatacacacaaatagattttctcaagtctgccccattaatttgccaaacatgcctgatgcctaaagagaaacaccagcagaagaataggttcaggttgaaatctctgcaataagaagagttgtgttactagaaaactgtttcccaatctgggtctatattactaaagcattcttggtatgtgtacgggatacctctcatgtaccacttcacatcctctcagccccacctccaagtgcagccactgctgcagtattgcgctccatgtagtctttgtccagcttcacatgagtgtaatctcatcttgtctgggtccccaccacatacctcttgcttcctgtaccaggtcttctctcatgccaaggtgcagtatatctaggggaacctgcttggcacccaaacgttataatccagaagtaagagcgtggctaaggctgttgggaccatcttgggccaatagatgacaggagttaatggctaggtagttcctccgttcctccttttgtcttccaggcatgctttttttttttttttttttttttttttttttgagatggagtctcgctctctctcccaggctggagtgcaatggcgtgatctcggctcactgtaaccttcgcctcctgggttcaagcaattctcctgcctcagcctcctgagtagctgggattacaggcgcccaccaccacgcccagctaatttttgtatttttagtatagacggagtttcaccatgttggtcaggctggtctccaacccctgacctcgtgatccacccacctcggtctcccaaagtgctgggattacaggcgtgagccaccacgccaggcccaggcatgcatttttgagacacaattcataaggctgctcagaaggttccagtgagatagaagaggagttgtctgtagctgtggccaaaccagtaactcatcctcttttgggcttttcctccttccctgtctcacatcccttgatccccactcctcttctctggaatcactgattttttttttttttttttttttttttttgagacagagtctcgctctgttgcctaggctggagtgcagtggcccgatctcagctcactgaaaccttcacctcctggattcaagcagttctcctgcctcagcctcctgagtagctgggattacaggtacccaccaccatgtccggcaaatgttttgtgtttttagtagagacaaggtttcaccatgttgatcaggctggtcccaaactcctgacctccagtgatctgcctgctttggcctcccaaagcactgggattacaggcgtgagccaccacccccagcctctgagatcacttttcaaataaaatatctcaggctctgctttcagagccacccaagacaagagagtatatcatggcttctttgtaattgtctaacagaaagaataaaattttggtaccaaagagacctcatgtcgaattctaacagtatgactgaaaacaaattatttagccatcttaaaacccaatttccttatctttagtacacagataacatgagtggcccccatgatgtttgtctaaatactaaatcagatagtctctctgagaagcataataggtatctgacacagagtagcactcagtcagtattcattctcttctccttattctcacccgttgttctgatagaaataagaactttttaaaaaagagttataaagtagaaatgaaaacagacataataaacagacggttgtatgttcaaagaaaacatactttaaatatgcatacttactagcatatagatggatgcatatgtaaaaattcattaagctaaacacttaaaatttgtgtgctttatgtaagctatgctgtaattgccaatttatttttttcaagagataaggtcttgctctgttacccaggcaggagtgcagtggcaccatcatagctccctgcagccttacacttctgtgctcaagtaatcctcctgcttcagcctcctgagttgctgggactacaggaatgcaccacgtggttattttttgtagagacagggtctcaaactcctgggcttaagcaaccctcttgtgtcagtctcccaaaatgttggtatcacaggcgtgagccactgcaccaggcttgtaattctttttaagttaaaaattgtatggatgtactaaatactccctaaaatgaaaggacacattattgttctaaaatgcatttaacatacatccacaatgggatgaacaaatgggttcttatttctatcagagtaggaactctttaataagttttaaatgaaaatgcccttattgaatatatatattcaaaacaaagtgtttacgtatactaaaccatccttgtttttcttttcttttgtttttagttgagacagagtctgtcaccttggttggagttcattggtgcaatgatcgctcactgcaacctcaaattcctggactcaagtgatcctcccatctcagcctcctgcataggtgggactacatgtacccaccaccacacccagctaattaaaaaaaaaatttttttttgtagatgcagagtctcaccctatcaaccaggctggagtgcagtgttgcaattataactcactgcagcctcaaacacctgagctcaagccatgagctcctctgcagcctcccaagtagctggaaatacagataccatgcccagctaatttttatcttttgtagagacaggagtcacactatgttgactatattggttttaaactacagctcaagctatccttccatctcagcctcccaaagtgctaggattacaggtgtgagccactatgccctgaaacttttatgaaactaaaagtttcatagtatgaatgacagattctttaagaatctgataaaaagggaacatcacatttttaatctcttgcatacttttaaaaatatgtcaacagagaaaataaaagattggatatttatatcagaaaaactaatcgtggccaggagtgaggcagaggtggtggggccggccagtcatcagagccaactcaggaggcgggacattgacacgaagggaggactttggcttgatctctatggaaatgggaaggaaagccttggtcttattagcggcagataaccaactgagataatcaaccaacagtggggtaagaaattcaacagtgaagtaaaacaaaaaagtgcatgccatagaagtcaccacacagccagagttggcggcgctgcttgaacacctcagagtaagaaggaaacccttgtcaaataaatgctaggatgctatcctctcaggtcttgacttttactgtactagcttctgttcttatcctctttccctcctaacatcagactggggaaagaggaatcatggaagacgggatcccttagtgcaagagcggaaggtgtcaccatctcccctcagttctctctgcccaccacatctaggggagtggcaatttcttgagtgccaccaccagtgccttgcacaggcagggaggcactcacagtctttgttgggtttgtggaatggatcctgtgacctacagacagtgatggggtgcaatgggtgctatcctgtatggaagtagagcggtagatggcccagtccttgtctggaggcattcatgatgcagttgagaagacaaaaaatgcactccagcaggggcccactgtggacaaggcttcatgccaagtgagggaacccagaaaagtatgtgaatgatgaccagtgtgagggtggcccagaaatggaaaaggaaggaaatatcatgggaatgatttgcttacattataagtatctaagggcaaacttgtacaatgattctaagatagtgacaattactgctcgaaagaaaagcacgtatcacttttgagatatatgccttcttgtaacacatctcaaaatgccaagaaaactacacacaagcctagagacaagtcagtagatactaaagagacagagccatattaaaacaggttgtgagggtagcagctatggcaggagctgagggggtaaaggaagcccatccagagagccgaatcttccaggttacggaagtgtagagccaggaagccccccggggccttccaaagacccacagcatgccgccagcctttgggtacctgctacatgggagcacccacaagccaacagagtaaggctgtggcacagcatcaacatcgtgaaaggactgcagatgtgagcaggcagctgagagacactgatcccttcttcttcccctcctccctacttgacacactgaaagagcgtaagaaagggtggagtggaagagagaagctgtgaaccagaatgagatttaaactatgcagacctacttttttaaaacggcaaatttctacaatctgccctagatgttgttggacagaaaaagggattagacatagcaccattgaaagtgctgattaggggccaggcacggcggctcacgtctgtaatcccagcactctgggaggccaaggagggtggatatcttgaggtcaggagtttgagatcagcctgaccaacatggcgaaaccccatctctactaaaaatacaaaatttagccaggcgtggtagtgggtgcctgtagtcccaactactcgggaggctgaggcaggagaatcgcttgaacccgggaggtggaggttgcagtgaaccaagatcacgccagtgcactccagcctgagcgacagagccagactccatctcacaaaaaaaaaaaaaagtgctgattttagggaccaagaagtgaacccattccatgtttatgcccccagtatgttgcaatttcccaattaactgcttcctgagaggtcagtgatgtaagagaggcgtatatacacgcagtatccattcatacaaacaaagaattgatttgaaaagattcaaatagtttcagggtaggataaaaacagcgacattcacagggggattcttattgtgccctggattgaaccaagttcattatcttaatctatttcaccctcccaacaagaattgcattatccccatttctcaaatgaagaaaccaagactttaagagactttgagagctaaggagtctgaagtcctactgtttgtaagtgtctagtaagtggctgtctgccctcaacctcctcttattgcttgtcctaagccaggattcattaaatcagtctagttttactttccattacctgattttataaatgtttaaacttagtcccagagaaattaaaagacttgactaaagtctttagtattcagtagcagaggagagatttctaacataaaaagatcttccaagttttactacagggcttgtaataaaaccattacaaagaaaaagaattattgcaaacttgcctaccaacatgtgataagcacttttgttctgagccgtgattgtccttaccttaagagaaacatagtacaaaaaaggtgactggctctggctgtcctcttatcgagagtgggcaatggaggggctttgtacaattcttgcattctcagcatctagcatagtgcctggcaaacagtcattactcaataaatgtttgctgaatgaatattatatataactcaatattccctggacacaaaaaaatagctcttttcccccttcacattgtggagagaacactaatgaacagattgactttgttttttctgccaactcacatcattccaagttttatttgcgtttgtaatacagatgcatacaagtggactcatcatccatcatctcgtctgagctaaccaccatgacatcattaccaatccccagataccaaggccagatcttctagatcagtctctctacatatgtgtattgctttttcctttgcattacttatttcctttttgtactatagctgatattccaggagctgactcctggaccctctttgcccccagtgactttcaaggtgcaagattctgttgcctctcttttgctgatagatgttgctgaaaggcctgtgtggaaacttacaaaatcaaatgagttttcttctcctccccttctgttaaattctaactcaccatccctcacccatacctgaagcccagctctctcccgcaggcagtctctgccagccaggccaggcctgagcttgttctctgcgtgtctgaagcagggagtcctaaaaggaaatattgctctcattccaaagttgcttcatcttcatgggcaaagaaaaaaaaaaaagcagaggaaggtaaatgcagcaactctgagaaattcttagttgattatttactgttgcttaaccttcaaaagattccactgtagaaagggagggccggtattcatacagttcctagcccaggtaacttctctttcctagacctgctagtccagttagcttgagctcatttgcaaggaggccaattctgtgacccctttcgtttcccagaatgcctcacagtggacactcaaagcagtcgacttgctaacaaggctaaaggagttaggttttacatcattcctgaattattgatgtgctttgcaaattagcttttcctgtgcacatgactctccttagctaatctttacaacatataagacagttgtcaaaactgttttgaaatatgattctggggtttcagagtaccgtttcacgggacttgagttttcagaacaaatctctgtgcagagataggaactattctgcttaataagtattattattattaattatctgaagcaattactcaaaatacctaaatgcaatttgcaaagtagtcaggtaataacaccatgtagaagttcatgttaagagctaccatttcaatgaatgtagggaacactatccacttttctcagagtccttagaaaaatatagtaagtgaaaataaaggccgggcatggtggttcatgcctgcaatccaggcactttgggaggccgaggcgggcggccttatttgaggtcaggagtttgagaccagcctggccaacatggtgaaaccccacctctattaaaaatacaaaaattagggctgggtgcagtggctcatgcctgtaatcccagcactttgggaggccgaggcgggcggatcacttgaggtcaggaattcgagaccagccaggctaacatggtgaaaccctgtctccaccaaaaatacaaaaaaattagccaggcatggtggtacacacctgtaatcccagctactcgggaggctgaggcagaattgcttgaagctgggaggtggaggttgcagtgagccaagatcacaccactgcactccagcctgggcaacagagcaagactccatctcaaaaaaaaataaataaaaaaaaaagtagaatggtttattacacataagaggcaaaggcaaaatgacacatggtatacagactgaaccaaaatatcaaaaataacaatgcactcttttctttttttcatccaacaagaagccataactttatttatgatagaagcagtacaaatttcaaaccaagctgcagtcactcatttgagacaccaataaaagttgctttcagatggttacactgttaattccataatagcatttacaatattattactttgttcttccaggctccaactgcctttgctctggacacattcccttgtgacatgaccaattctatgtccttaacttctacacctgtttcatcaacctcatcctcttcactctccttttgtacagttggagtctgtgtgttttcttgaacatttaagacagcttcaccctgaactttgaatttcgcagcagttgctacttgtgcttgctgagataaatcttcaatcttggcttctgccaaaacgatataggtatccgaagcagggctcttgtagacatctggtttcgcgatgacaaagaggatattcttagatttccagatagtgactctagtaacccctataacctgtcaaagacccagtttggacatagccttctgtgccttcttttcactccaactctgttgtgctttactgactggttcttcatcaatttcagctgctgccaccacaatgcaccctttattatggctataccagttaggaagagcaattggatgcaaatcacagagatacctcaagcagctaaagaaaatcaatggttactatcacacataagaaagtctgaaggtatgcagtcctctgtcttttgtatctgccatccttaacctcatgacccaagaaggaggctggagccctaggcatcacatccatatcccagaaaagaaaatgggaaaaaggacaaaaggggtaggccaggcaaggtggctcatgcctgtaatcccagcactttgggaggccaatgtgggtggatcatttgaggccaggagtttgagaccagcctggccaacaatggcaaaaccctgtctctactaaaaatacaaaaattagccaggtgtggtggtgcacacctgtaatccctgctactcaggaggtcaaggcaggagaattgcttgaacccaggaggcggagcttgcagtgagccaagatggcaccagtgcactccagtctgggtgacacaatgagactctatctcaacaacaacgacaacaacaataaaatgttcattattgactgaaattctaatttaactaagtgttccttatttgatctggcaaccctgaccacccaacatctcctgggatttcattagtcacccctactgtgaaggaagatggaaaatgtagccttttagccaggcactttcccacgctgcttattctaccaaggaagacatggagagtgaatactgggtaaggagccaacagtctttgcaggagtgagggtggttctgggaaaaagtgacagagctacatccatgccccatgccctctgtgaagaatttcttgactgcatcagcctcttgtggtcactgtgacctctgaaagcctatggccctttttgtcttagttctattaatagatacaaagtaaagattactgatttttaattaacatgtaagaactgatgtattcaggtggctactgtcttcttcaaagggttaaacacacaatattgccactcttaaaaacacttttagaacttagagctggtagaagcagaagtctccctttacaaggcatacgggaagctgcaggctgtaggcagggccagggatgcgttggaaatttgctaactctgagtgcttcaacaaattgcattctatgtcaaactcatgccattcctcgtagaaagaccaatttcaaatgtcctcactcatatggggaagccaaaaattataacaactgaactcatggagatagagagtagaatgatggttaccagaggctgggaagcgtagcagggagcaaggggaaaaatgggaatggttaatgagtgcaaaaatatagttaaataagatctagtatttgacagcacaacagggcaacaacagtcagcaataatttactgtatattttaaaattgctagactgtatatgtggctcacgcttgtaatcccagcacttcggaaggccgaggtaggaggatcacttgagcccaggagttcgagaccagtttgggcaccatagggagacctcttctcttggaaagactcaaaaattagccaggcatggtggtgcatcagcctcttgtggtcactgtggcctctgaaagcctatgaccctttttgtcttagttctattaatagaactgcatgggaggctgaggccagagaatcacttgagcccaggaagtcaaggctgcggtgagcagtgatcttgccactgccctccagcctgggcaacagagcgagaccctgcctctcaaaaacaaacaaaaatgaaactaaaagagtagaactggaatgttcctaacaaaaagacataataagtgcttgaggtgatggacaccccaattagcatgatgtgatcattatacaccacatgcctatatcagaacatcacatgtacccctgccatgaatacatacatgtattatgtacccataataatcaaaaattaaaaataaaaacttacactatttctccccagaaccttctcctacctttgtaggaatataggattatcttccaggatgtcaatagctctggccagtggggaccagactgatgagaagcagctggtttaggaaactgatgttggaaagctcatggcctctcataactcagtcatctgtggcctgatcaatgtcactaaagcatggtttgtactctgtggtatgtcctagaataaaggtagggaacaatggaggaaaacaggcctgaattaaaatgttctccatgtctctctcgaaaaattccaacttggaagtcccttttgcctgatagtgactgcttacagttcctacccaatgtaaactacagttccatgtttttccccctggctcttaactggctgaacttgggatgttttataagtgtctgtctgtacttcctatgacagccaatcacatccaacctatcctcaggtcccttccccaaattaactctgtggtccactgacttccaaaagtagggtcaaaattatttttctaagattaagccttaataacgtcacttatatgtttcatcttttcctggatggctactgggcaaaaatatcttcatgcaggtgctgataacagtaaacacatcatatatcttcagcctggggtttaaacacattcatttctgggtttgtcatatgttctctcgctatttatactgctttgggtcagctacttgatacttaataaaatttgcctccaagctgtcctgcagggaaaatgacctatctggggggaatgctgttccaactctataacctctgatgattgcccaatagtcctccaaaaaggttgcagggcaggagcaagggaaggtccatgccacttcctggcatttaatggcaacaagtgctttagtgtaagtataattatatcccctgctttcaggaggcctttccagccaacctctcggacacgggagcaactgtagatggcatgagcaatgtggaaattcggcttctgctcaaggtcagaacaagccgttcaccagcgttgattttaccaacctttcggttattttggaaagccgaaagagaacgcaacagaggcaagaatggatctatgggatggaaataaggagccatttataacccaaaatgagactgccaggaaaaacaaacacacagaaaagtacattttatcagaggcttgggctgcccagggctattggggtacaaagtactgcgtgttcagctccctgggccaagagctacagtaagtcaggcccccctgcaaagctcctctcctgtcagccccatcaagcagccttagccacctggcggagacaagctttagtgtttttaaagtgtgtgctgcgtgaatgtttcacatttttggtaaagatgtggggtcatgttgcaacacttaagtgcttctgcgtaaaccttgcgcaattccgacaggcactgggttcctagcatcagtggcatcctctgctcacatacggcttatgtaatgtgtgatcaggccccccaggtttctccttgtagcctttgaaaaaaatttcaggctctgaacttggccctggtttccggcagttctttgctccgaaggtgcgtggaatggctcagctgtcagcacctgctggtgagatacagaaaagtgccacgggttgatctttctctggcaccagtacacaggaggctggcgatgctccccagatgggcttggcccgccctgaggcaccctatagggaaggagagtgagggcggttcatctaaggaagagtaggtcggaggattgaacgggggctgctaccaataggtaacaaacatgaaaaggatttccccaaagcaaaactttctagccagagcagcagcacagtgaatggtttactcacagctcctttgtctgctgatgggagatttggcactgtgcttgcctcttgggcttacctgagcaaagttacacagtaggtcaagtgtttgatgccttctcacctccagtcactgtgctggcgcccgcctccgtgcctggcttctgtttccatccagacttccatccattcaacaaagctttcgagcacctgctctatgccaggtgctgtgccaagtgctgggcaccaggcagggctttctcaacacctggtggccccctgtggtgcgctggaccagtcctaacacaggcctcctctccagtgtcactctcggccccaccatttcccaaaattatccctccctgcattcacttcctatgactcttgtcctttcttcaaccttagggatgggactatttctttacagtttttatcatagaaatccaacaaattttatttttataaaagaattgttcttggtagtcacagatttctctctgtggaatctgagtttctgcagattaaaaagtgatgatgtgagctgggcgctgcaggtggtgcctgtaatcccagctacttgggaggctgaagcaggaggatcacttgagcccaggagttcgagaccagcctgggtaacagagagacccccccatctctaaaacattaattaattaatgctaattaattatttcaaaaatggtggcatgaagaaacaatgtcttccatggaatgaacaaggcattaattgaaaaatgtgaagcaggaaggaacaggggaggaatacattgtctgagcagaatctacaatttcaccaggtagacaagttgcccctttcacctctccatttattattggtgagctgtatgtgtaatggttaaggaggcaaattctggagctggactacctggggattcaaatcccagctctgaaggttataatctaagaaagctattgttatttgttccttaatttcttcatgcaaaaagagggatggtagaaatacctaagcacatctcacagagtggcttagggattaacataaattaatatgtatgacatttttataacaccgggatgcacagtaagcactctctatataaatattaactttgatttttcgtgaaggcaactctaggctttctactttgcagtcagattctcatggcagttactgcatgcgaaagacagaatttgttatttggcctgcagtttccacatctgcaaagtaggaagaaatgattgaataaagatgtgggggcggaggctgcgttctggtctgtgatctccacttgcttcgtgaccttggacaactcacttactctctctgcatcctggagattggacttgatctgaatttcccaaactcaggtcattcaaataacacttagagaatctttgccatattccagtccactttcctatactcagctactaacttgatgttttcctttagataatccttaaatcaattcactttcatatgtagcctcacaggaagcagtaatatccacgtatgcaagagtccgatatgctacagatttttgtttttcctttatttatttatttattgtgatagcgtcttgctatgttgtccaggctggccttgaatccctgcctgggctcaagcaattctcccgagtagttgggactacagttgtgtgccaccacagagggcatgatacactgtcgatttttctaatgcatgttaaaataaatgcctaatgaaagttttaaatgtttgtataatgcccaaatcatcttgcatcctatcaatgagatgaggacaacatttctggaaactctggatcaaatgttccctctggatccaggcaactgtaaaatctataatgttataccatgttcaggtggctatttaacttagggtatgtttctttataccatttgcctccttgagagctcagactgtggcttaaacctctttgggcacgtagcaaatagaagagtgcttgataaatctgtatttaatgttaaattaaaagcacaccatacatacatacaaatatatccatcgcctactcacccccagaccccatccactgccaaaatgctcatttctttctctccacctcagtgtcactgtgttcctcaagtggctgtctgtaaatgaactgaagcatgtggcgttccaggccttgtgtgggcactcaggaaatgttaccttccctgacccctttccctcttcctgtgcctctttgttcatgagttgccatttgtctgtgtgaaaagtgggccgacttcccaaggagtttatagcccaagctcttgggtcagaataattgttgtcttcaatttcagccctaaaagaggttccattgccaggtgcagaaacttctaatctaagaaaaaaagaaagtatacttctaaaagctattattaaagagatcttgaaaaactgtctggtgatttcctaaaattcatcagcaaaaattgaatacacacccacagtatcatgaccccattgtgggttcacggtctgagaatttcacaaccaaccagcatttactaagcatctgcttgagccctctctgtccataaccttgggagacacaaatctgaataaggctatctattagaccatgagactagaagagactaaaagactgaataccttgaaagcaaggaatatgtcttcatctttgcctccccaagggcttagcaaagcatcatgcatgtggtagttatgcattaaatatttgatccgtaaatgaacaaatggatgaatgacactgctccagcactgaaggagcttacagtctgtttgagaagaaagaagccatagataaacgatgggttaattaacaataaactccacattacaagagataacactggctaataaaaacgttaaatgaaaggggtgctgtcatttactttcccccaaaacaccaaatgttgattcagccgcaggtctcaaaaaagaatgtgtgttggccactcttctgtactttcatttttctgcacatgagtccaactttagaaggaagttgctaggttgttgtcatgtgactgatttttatttaattaattaatttatttatttatttttgggacggagtcttgctctgtcacccaggatggagcgcaatggcacaatcttggctcactgcaacctatgcctcctgagttcaagcaactctcctgcctcagcctcctcagtagctgggattacaagcattgccaccatgcccagctaatttttgtagtttcagtagagacagggtttcaccatgttgaccaggctggtctcgaactcctgacctcgtgatccacccgcctgggcctcccaaagtgctgggattacaggtgtgagccaccgcacccggtccatgtcagtgatttctaaaggccaccaaccttgctggctcctgggaatgagcagggtattatttaatgtaaataaatcagcgagtgtttatccttccatgcattcttctgccatccacaggcaaagagagaagtggcactggtgacttttttagagctatgaagttggaatatacaagagaagctgaaagctttcaattaatgatttcttaggctttaagtcagggtgacccttcaacataaaagggctttagccaccacttgctggggagaagcgctgggctttctacacagttctctgggactccaaattgttagcataaaaatagcagcccaaatcaatgttctctattattcattagttaccgaaatacttttcccaaatatacgcatagctgaaagatgccttctttcaaaatgttttaaaccactttcagcccatgaatcttagtccatctttaaagggcacccattttttttcaaaccatatatttcagtcgatttcattgggcactgataccatcaccagcaaaaccctaattaattgggaagaatgacatttccattaaaattctttttgaaaaatgatttatgcacctggctgataaaaatttcaaacagggcaaaacaatatggagtggaaagtaaacttccatcgacctctggaacccagtctcccaatctttttcatagaaacatccagtgttaaatttctggggtatcctcctagaaatactctgtgtatatataagtgcatacacacaaaagaggtctttaaaaagtttatggaaaatgcatattatgaaaaaactatgcatggattttcatttttcttgcaccaaaataaactcatactaacctgttataacatgtctgaacagaatctagttgaggcagtaagaaggataagacttcagtttgaaaagcgcctctgtcagagcaacatgaattctgctaaaattgaagcaagaacaaacttcaaatctagggtgaagtttgcatggaagaacagtgaaatcattgaaactgtacaaaaagtgtgtggggacactgccccaaagaaatcaacagtttacacatggctaattccttttaagaagagatgagacgatgtttaagatgaagcccacagcagcagaccattcgcatacattttggaggaaaaagttagtattgttggctcatgcgtataatcccaacactttgggaggccaaggtgcgaggatcacttgagcccaggagtttgaaaccaacctgggcaacatagtgagacccccatctctacaaaaaatttaaaaattagccgagtgtggtggcacaggcccgtagtcccagttacttgggaggctgaggtgggaggatcacctgagcctcagaggtcagcctgcagagaaccactattgtgctactgctctccaacctgggcaacagaacaagaccctgtctcaaaataataataataataatattgtttgtgccccaattaaagaggactgacagttaggaacataaacctaattataaacataataagcataagtctaattatagccaacaccatagacatctcaattggttcagcttacacaattctgaatgacaaattaaagttgaacaaacttttcactggataggtaacaaaaccactgcactcagatcagctgcagacaagagcagagctttcaatggaatttttaaagaagtgggatcgagatcctgaagcatttcatttaaggattgtaataggagatgaaacacggcattaccagtatgatcctgaagatgaagcccaatcagagcaatggctaccaggaggtggaaagggttcagtcaaagaaaaagcagactggtcaagagcaaaggtcatggtaacaatttttgaagattctcaaagcattttgctgttgactttctggaaggccaaagaatgataacatctgcttcttatgagggtgttttgagaaagccaaaactttagcagaaaaaatccaaggaaagcttcaccggagagtccttctccaccgtgacaatactcctgttcattcgtctcatcaaacgaggacgattttgtgagtttcagtgggaaatccttagacatccaacgtacaatcctgatttgactccttctgactttttgttttctaatcttaagaaatatttaaagaatacccatttttcttcagttaataaggtaaaaaagattacattgatatggttaaattcccaggaccctcagttctttagggatgcactaaatggccatcactgcttacaaaagtgtcttgaacttgatggagcttatgttgagaaataattttatatttttatttttatcttttaattttttccataaactttttgaagtcccctaatgcagcagtcaccaacgtttttgtcaccagggaccagtttcgtggaacaccatttttccacggaccagcatgggtggagggcagttttgggatgaaactgttccacctcagatcatcaggcattaattagattctcataaggagtgcacaacctggacccctcacatgggcagttcccaacagggttcacactcccataagaatctaatgcccgctaatctgacaggaggcagagctcattcgcttacctattaccttctgctgtacggcctggttcttaataggccatggaccagtaccagtctgctgcctggggattggggccccctgccctagtgtgtgtgtgtgtgtgtgtgtgtgcgcgtgtgtgtgtgtgtgtgtgtgtgtgtgtattgtgtgtgtgtattcccctccccttccttacatatactctaacattcttcagtgaaacttaacagatattgtgaagtttgctgcaaatctgtacagctgcactatatttcataatatgagtgtcccataatttacccagcctcttctgaatagacataatggtggttttcagttttttacttccacaaacatacttttgcacatatgtatgactaggactacagaatcaattccttaaagtggaattacagaatcagaggatatgtgagttttcattctgatagacattgccaaatggtgacacttaacttttgatgagaactgccaaaagtaaagtatttgttcgtgccagaaacagagtgaagatagcattttattttaaagtttaatacctcaggcaagcaagtagcacatttattcatgaaactcatttgcccctgtcttgcccacctaaagcacatacacattgttatgaacccattcaaaatatacttgtgacaacagcttactcaatgaggaacttgctagaaatttcgtatcaccaaattgtgtgagtatttgtcgcaatggggttagcttgcacgctctctactttgccctggctgtgtttactacctttcatggccctggtcagttagtaacactgtcttgtttttcttttgtaaccaaaggtcagtttgtgaccctgctccactccccacctcctctgccttagtttcttcttgccttagtttcctcataagagtaaccagtcttaaagtgtcagggcaggcacattactgatgtatcagtgaagagcccctgggcacaatggaacttgaatttgattttctattacctgtgagggtgagttagtaagcagacagccttgtactctgttcagcggcttcccttgctgcctttctataatgaaaaaagcagagacccagaacattctcccgtttctctagtgtttacccaacacacactctgtgctaccatccccatttgtggcttctttcctatttgctcttgtaacatgagaaacagtgtggaggttttatgcttgttttgtaaccagctataaccatttccttttctctgcctctgattataaacacatttccttcctggtaaccattgaaaatctatatctgaccaggttgaaaccaaatgaagtcattttggttccattggtgacaaccaattaaatataattctgtttacatttagaatgggttgtaaatttaagaaaatgatttaagccctacttaaaatattttttggctcataaaaccatgaaatcatttctgtaatatgagtaatcaagaagcttcatatttacatttacctttaaattgctctaaaagagccagagactggacattaaaaacaaacaaacaaaagattcagagtctgcaaggaagctatttcactatccccatgctgcgagctggttaagctctttagctcagatagccctattttctcagggagcaatggaaaaaacagatctcctacttaaaaataacagtaaaaacaagaaacacactgcactatattggtaaacctcaaactcacgtaagtcagttacctgccccgatgggagtttagaagttggtgctactactcttagtactgccataagatgtcaccagaaaacaggaccctgagttctaggaaaagggataagaatggacaacaggtgggagccaccaaactattccaggccggatgacagaaaccttaaaagaaaagttccaaatacaattaactgaccaaacccctccacacagtggagaggcttcataatcaataaagacaacttcccacctctgagcacttacaacaaagatgcagatgtatctttggcagtggacttttttttattgagttctatctccttttcttcacaagcatgtattaagcaagttttatgtgttatactttcactgggtgttgtgcaaagactaaaaagtcatcagctctgccccatagtgggtggttgttaaatgttgttaaatgaatggatctgtgaatatatgcatgtgtgaatgaatgaataaataaagcttataatatggttatgggagaaaacacagctttaattttctgttacttgtcagggtggtgtgtacagaacacagtggtatgcgtgaccagttctacccagggtagtgtggcaagatctcagacttgaggtgacaattgaatgggcgttggtcagatgaaaggagtttaacgtagacaagtaaaagaccacagaatgagcaaaagcctaaagcagagatcaacaaactacagcctgtggaccaaatcccatctgctgcctgtttttgtaaataaagttttatttgggcagagccatgctcatgcatttatattttttccatggctgctttcacactacaatagcagcattgagtagttgcaacagagaccacatgacccaggaaaccaaaaatattaactatctggccgtttacaagtaaatgtctgccgccctctggcctagagatatgaaagagctgaatattcaggaacctgtagggaagtcgtaatagctgaaacttgtagtccaaaaaggggctcagtgagagaagagacaaaacggtgatcagaggccaaccctgaaggttcttctgtgccatattaagaaattcagttttgccatcgcatgttctcactcataggtgggaaatgaacaatgagaacacttcgacacaggaagggggacatcacacaccggggcctgttctggggtgggggaagtggggagggatagcattaggagatatacctaatgtaaatgacgagttaatgggtgcagcacaccaacatggcacatatatgcatatgtaacaaacctgcatgttgtgcacgtgtaccctagaacttaaagtataataatacagaaaaaaaagaaattcagttttgctcctttaggaaatgggtaacaagagcaattttgcttttagaaatatctctcagggatcaggatagacgagagagatgcaagtttgcagcaggagatcagctctccaaacttcacatcttataaattccttgattcaacaaacattgaaaagcttaatgctgtcattatgcctcttgctctatccttgggaaacagaacctggcacacagacatgcccaatcaatatttattgaataaaggaattaaggaaagaaaaaagacaatattgtaatggcatcattattaaatggttttctgaataggctgcctctgctatgagacaaatagctgagattctcacagatttccagtttccatactagcaggcattgagatccaggcaaaaggaggttaatagtgaaacacaagccagagagaaattcctccccttcatctctggtgccaacatcatcaaataccagtcactggccaaacctgtgtttattccatgccctgtggcctaatgagaggggatgggacaagaagcagctctgctaataactgtcatgaaaataataatatcacttggctgtatgcggcaactttcattggaagctcttgaatcaattttttcctcttgcataactattatttccattttatttccactaaaggagaagccaaaccacagagtggttgtgacttgcccaaggtcatggagcaaatcagaagagcagtttttaaaagctgagaaggatatcaggggatgtaaaatccagttgccttcccagcctagaatgggctgggttcatgactcagtaagacacatggcgttacctaagctcagtgtctctgaaaatgagtcacactaagggagactcagggcctgaggggctgtgtcagacatacgttttcagtagtcactcattgtccctgcccatcagattttaacgtctgtcaccgaagcccatcacagacagggcctcttgggaggtttagcctatggaactgggaaggtctgccttgggggtgtctgtcttttctggatgtttacccagctgtcagttcctatgaagcccaggtctccccattccattatccatcaggagcccatggctggggtagctgtggcttccactcggtccatgatgattctggtgtttgcctgttgtcccagcataattactaataaatcttttttttactctaaaaaaatgccccagtttggaccataaattaattatatggtcactctaactgacaaatcaggaagcacctatgcagaaaccaaaagccctcttttcatcatgatgattctatctcagccacttttgtttcatggacctagaatcttgaacttacaataggcccaaactcccagtcagttaaggaatctcctctgagctatgtaaatgctcctggtcatagagttagctacacagcccatagaccagttaattactaattgtgaataatcacttccttaccttgtaccaaaatctgccttccatatcttttatacaatgatcttagcactattctcaagaagctgaaaagtcaattctccctcctgtcccataagagagcccccttaagtcctccgttgtacagcccaaacaccaccaaccatcaggaacaaattctaaacagcatttaggaatgtagctttggagtcagacatacctggattcggatctgggctccatcactccctagctagatagcctttggtaaatacttaacttctccaatttcactttctttgtctgtaaattttgaacaaacattaactacttaagctaggcatgactggttatggaaccaatagctagttctcctttctttcttactaacaaggggctcacttaaatgctcttggattacccaacttccttgcagctagatgtggtcatgcaacacagttctggacaaggagctgcaagtggaggtaccagctggagtttctgagaaagcctgttagagggcacacatccagcttgcattcaccttgtcagtttgtgctacttagcttctcccttctttcaaatacttcctgcctaaaaattagttgtgaagcacaaaatagaacagctatgctgcatacatgaggaagcaagcctccagcaaaagagactgggttcttgatggcaccatggggcctgcatactcactctgaagtgcttacagctggacttcctattacatgagaaaaataaatccctccattggttaaaccattgaaattgggtttctgccacttgcagtcaaatgaatcctaaatgacacatacttcagaaggttgttttgaacataaaatgaacttactacagtgcccagcacaaaacatatagtgaatggtttgctattatcactatcataattattatcattgctactcattgccatagaccttagagagaggggcaagaacatgtagctatagcaatccttccaacctctgatagcaccagtacaaaaatatctgtgatctcttaagcacacacaaaaaagtcagttgctgatgttttgacaagtgcatctctgttagtggctaatgaagccagttcttcaaagcaccagatcccgagagcacaaagaaatgaaattccacctggctggcaggtcagggagcaagttctttcctgtagtgaagggtgcgcctggtttcctctctggacaggggatccatccatattgtatagtgcatttcctggaagtgctgtcttctctgaacgacaagcaaagcacaacaccttaaggatgtcattatttcatggaaagagagtttctgctcagaaaccaaagccacacctaaaaccagctgagcataggagcacatgttcaaatggagcactgggaagtggaattagctttctataacctcactgaagcatctgccaagatcagacaaggatgggactagctatacattcttccctggagtccatcaagccacagatttgggttcacgggggcctatcatggtattcatcccacctccacctactccctactgcactctgcagatataaagagtggtgaagtgggaaaaaaaaaaaaaaaaacaacaagacaaaacaaaacatcataaatttcagagttcaacagacctagggttcaaattccagtgggtcacttctaaactgggtacctttggacagaccatttgccctttctgagctgcagtttttgtatctgtaaaacagataagagtttcacaagtttgcagaggattgaaggagaaagtctgtgtggcagtacctggtacagggttatcatgagtccttctttccctatcagcaggatggtcttggctgactttttgtattcatcacccaagcccaaggagtggacccagctcaggtcactgccaccaagggcagctcgtttgttgccttctaccccgtgcatcatcatccaagtttttgggccacacttggggagccaaagccttctccaaagctgaggtcataaagcagaaaaagacaaagctctgctttcagagagcaggtttggttggcagtgagcaaaccacctctctatagccaatctgcccttgggtatgggagtgagtccccagtaaatccagcaaaaagtggctggcccgctcagccctcccacctaccacagccacgcgcaacacctggacaaagatctaaggcctgggaagcagctttgcccagcctctccatctccgggcacagcccccttggggcacagcctcaggcaggatggaatatgacagtcacaagattcacacctcaagccacaaaacatattcttctcccaacgtcacctggcaggtgtcatcgtagttggttttatagctacagtggcaaacacagtgttttcttcacctctgtgtcacaggaatggccactgttactctcctcacttttaaccactggagtatctagggacatttgtcaacagggtttgtggatattgagactgaccggatattcatacatacatttctctgtaactccataagctggcaacataagaccatgcagaaaccagaaatttggggtccatacataatggctccacacaaaatgtgttttgtcacagagtataagaatagataaactagtaatagcaaacaatgtgctaactgtactgcaggctctgtgctgagcatgtcactttctacaattattattatctccattttacaaaaaaaaaaatcccttgagtcttcttggtgtgttctagatattaattctttataggtttagatattataaatcttttctcactctgtcacctttttgttaactttgcttgttgtatctaccctttacagaatttttaatttttaaaatatagtcaactctatcaaattttcaacttatggccaggcatggtggctcatgcctgtaatcccaacaatttgggaagccgaggtgggcagatcatttaaggttaggagtttgagactagtctggccaacaaggtgaaaccctgtctctactaaaaattcaaaattacctggccattgtggcacaagtctgtaatcccagctactggggaggctgaggcaagagaatggcttgaacccagaaggcaaaggctgcagtgagatgagatggcatcactgcactccagcctggtcaacagagtgagactccatctcaaaagataataataacaataatttcaacttatggtttgtgtaatgagtaccttctttaacacctctgatattttagctttgtaattttacttttgcactgaattcctctttggcatatgcttgagatagtgaacgaatgagctgtttctccactaccaagtagtaggttttaggcaatccatcccttccccactgattgatggtgccatgtttatcccaaagcaggttcctatgtagactcaggtctggctctcactctttgctctttccctagatgtattttactatgttcttgttccatactgattttatatggaagggtgagttccttctctttgctcttctttttcaaaatgacttaggcatcatgaacatttattccttcatatgaattttagagtaagtatgttgaagtcctaaaaaaaagacttgtaataattttgtctgaaattacattgaatgtataggttaattgtgagggaaattaacatatttatatttcgaagatgtggtgtatatttctatgtattcagatctcttcaaagcaacaactgagttttaaatttttcttggtaagttctttgataggttatttcctacatactttagagtttgggaatcatatcttattttttaaaaaatatttttgagatggttttgataaagaataataattcttaggccaggcacagtggctgatgcctgtaatcccagcactttggaagactgaggttggaggatcacttgaggccaggagtttgaggccagcctgggtaacatagtaagaccctgtttctacaaaaaaaattaaaaattatccaggcatggtagtgggtacctgtagtcccagctatccaggaggctgaagtgggaggattgctttagcccaaaagttcaaggttgcagtgtgctgtgatctcaccacttcattccagcctaggcaactctgtctcaaaaaaaaaaaaaaagcaaaacaaacaaacagaaaaacaataacaattgtttaaaagtgatcaggtattcatcatctctgctgaagtctcttattctatttagtctattgattaaatatgctgatacaaccttttatttcttttttctctccttttccttttttcttatcttcctgtcttgcccagaaactgggtaagcgttatatatatatataagaagcacaaaaatacgcttacttcaaaaaatatataaatgtgcttactcaaaaaaatatatatatatgctaactccaaaagctaataacttatcgaacttctacttgaactttattcccaaagagatgaacatattgaaataacatgattaacccacaaagctgataaagtgtccattgacttaaatgttcctccttagttatgtgccaagcattgtgcctctgtgtaacagcagcacagaaatggcaatatacaaaacaattaacagttaactgttgctaaacagtaacaatgaaagcaggttgtgtctaaattttcttttaaatcccattgtgtgaccctttacaactttcaaataacttccatacccattacaccatttgtgtttcataaacacatattagtagggagaacaggtattggctcattttataattaacattcaatatggttgggttttggaggatcaaaaactagaaaggatcaaaattcatattcaggtctttaaagcttcaagttctctcactataacaagctgatttatatataaacaaaatatataaaactacgtgattcaattcagtaacactgaattttcatttaaatctcattccatcctgaaaaagatgatctgatatcatcctatcatttttaaagaaaactgtatcagctgatattaaacgtctaaacattttcaaggtgtaagagccagatgaccatatcaattagggttgtaattctactaagaatttgggtctataccatggcaaaacagtcagttaatttggtcagtttaggtaaacaggtcagttttgtgggagggagggaaattgggtaagaaatattcatcacattaattttactaacattgcaatacaactaaaaatgttatttggttgggcatatttaaacatttaaaagctgctgtaaagataatattgttacctcatttttataagaagaaaaaactaagtaaatccatttcttgggtgtgcaaaaatagcccaaggggaagtgacagacctgtgaacagaactcatgaattaaacctgagcttggtctaccagttctctgtaatcaagccccatgattcactcatggaaatcaatgcctcttaaactcactgaatgacagacacctcaacagacacacatctgtggattcccatagctcctttaaaagtaaccatcaggaagcaattagggagtgcatctgtctctaacagtcaaggtatttttccttccatttcttgcatcttctcttagggaatgtgtaacggatcgtcctctcttaatggtgctgttacttggaatatacaaagtatgctgacttgtgaaagggtcccaggcttaaacagcaggaaaacacaaataaagctgtattcaaagaagatgaatcaaagtatctcagaagaggaaaccagaaaattgtaatctttcttaaatgcagctttgtgagctgagtaataaaatacaataatgtaactaagcaggaggcttacataactgaaaaaatgaggggcaaggaactgttccaaatccattgtacttattagaacctctgatttcctttgaaatggcacatgcaataaaatttactgtgagctagctaacaaaaaaatctcatttttatgggaaataagtattgtcagaaaaacgaatagattctattttaaatcctgaagattataaaattgaggttttaatagatgaagaaaaaaaaaggctccagaacagaggcatcatggaggcagtgatttctatttaatcttttatctgtaagagaaaaaaaaatcacctcaattgaaactaatatagttttctgtggcagaatataccacgatagctaataatgcactggctgtctgtattaagtgaattttctttttgttaaaaaaaatcagtgcttgttaagcacatgaactgtgcaagtttatatctggccaactcctgtccccgcacctgttcattcaggcattagccctaaggacttacaaagcaaatgaatgtatccgtagagcaatgggtaaaaataaactgaactattcttttaacactatcaaaaatgatctgaccaaatagaagatcacatttcacgaggtaaaatagccaaatgagatgtttcctcacgttttatgattggtttggcttattcactgcgtatgaaatagctgaccttcattccaggagaatgagcagcaaccaaatttaatgctgtttgctcaggggttcaaatctggtttagctggtttaattgcctctgaggcaaagtttctaaatgtgctactgttacacagagacccaatgcttggcacataactaaggaggaacatttaagtcaatggacactatatcagctttgtgggttaatcatgttatttcagtgtgttcatctctttgggaataaagttcaagtagaagttcgataagttattagcttttgcagttagcatatatatatattttttgagtaagcacatatatatatttttgaagtaagcatatttttgtgcttcttatatatgtataatgcttattttatatatatataaaatatatattatatatataaattatacatatataaaatattctctataataagaagttcccggctgggtgcagtggctcacgcctgtaatctcagcactttgggaggccgaggcgtgtggatcacgaggtcagaagttcaagaccagcctgaccaacatggtgaaaccccatctctattaaaaatacaaaaattagccgggtgtggtggtgcacgcctgtaatcccaactactcgggaggctgaggcaggagaatcgcttgaacctgggaggcagaggttgcagtgagccaagatggtaccactgcactccagcctgggtgacagagtgagactcagtctcaaaaaaaaaaaaaaaaagaagaagaagaagaaattctccaggacagacaattataaaatcaactagtactgtcactccctggctcactattctttagccatattggcaatggattccttgaaaaacctagatgtggttgactgaatcattgttcacaatttttcacatctttcctatattagataatgtatccacattcatctacattcttccaaaataccatccgctatgggtaaaatattttccccatcccactgattttgggctgggccatgtggcctcctttagccaatgaagtgttcctgaacatgttaagaggccttaaatgtgcttgtgtgattccatttgggctcttgtgctcctgtcatgtgctatgtaagaaacatgttcctggaagctattggtcaacacagaatgagtaacacacaagggagacctgaaccctggagtccagccaagccccaccagttgcagctggctcacagacccatgtggaaggaataaatgcttattgtttcaaactagagttgtggatagttggttgtagcacactgctatagcaaaatgtcatctcagtgcctcagcacattcccttccctctaccagaaatcatcttccacgaccactctttgcctagttaattcctactcatgcttcagaattcagtttaaatgtcttgaccacaggacagatgtcacaaaccagattacctgccccttcacatcctgggtttcctattttgtgagattcatcacttttgcaatgttttgcttcatgtcattcaactagaatataagcttctttaagcggtgggaccacagtatatttttcattggtattattcttagcacacgacacacaatgctaatacaaagtagatttaataaatatttgttacctgatttttaaaaaaggccatgtggttctactacttaagagttagaaaagaaacttaatttgtatgagttttggttttcagcaactataacatgaacacaataatacctatctcctaaaacagtgaggattaaataaaccaaccattaaatttaatgaatttgaggaaagacttgtaagtatctgacacatgggtgcataaaaggcatttgacaactgacagcttttattatggttggaaagataaatatatttgccctctgtctaagaacttgatttattttaaagagatatttttgcaactcaaaaaagaaaaaaatcagattaggttgcaacttatgattatttaatttggacatttcaaagtatcctgtttacttcccaggctctgagtcccttttagaagcactttcaggtagaattcagctaagaagaaacaggttggcgattgatacttggtttatttcaaacatttgtcattaaatgactctatccttttaaaaaagaatgaaattcatttttgctatttatgtttatttctatttgtattccttcccaccatttttgctatttaaaattttttccctgcttaattaattttttagagttggcacttacttattttcaaaatgtttttcttcattcctacaaatagcttttggaataggattttatacaacctaaatcagtttttttcttttgccaaaaacaatatgtatccactacaaaaaaattagaaaatacaggtaagtgtaaggaaggaagatttaaatgtttgtaatcctgccacccagagatatccactgaacattcctccagatagtttgattcaaatgcatatatttaataatggtggaattatgttgtacatttgcccttttgaagttaatatttcatttaattaccacaattatctttctatgccaataaatattcatctacatcttttattagtagccttccatcataacatcatttacctgagcaattccctattgttggaaatttagtacattttacttttttcttttactgttatcagcagtatcttcatgaataagtgaagagataaaaatgagttactcaaacctttagaaaacaccacttaatggggtcttgcagttcagagcagaacagatcattatcccaactgtaatccaaccctttccttgcatttcttattgtgagtctaggaccatcattggaaaataatcaagtttggtaggtgggctaaactagaatcagagaatttgaggcaacactttcatttctggtctcaataatgaatgtgtaaaccagaacctacaaatcgactcatgatcaaaaatatcataacagaaagcaggaattctgaaatgggaataaaggaaagagaaggagacctacagaccactgttgctctccctatctgcggctaccacgtccatatttgttttgacaaacactcctttaccacaatcgggtctctggtatcataagcactgactttcccattttacagataaaggcactgaggcacacacagaggggctgacaacagtgtccacagtgccacagttagtagcacagccagggtctgagcctgtgtgttctgcctcacagacaagtgctcttttcatgctcacagagttctcagtaatactgggaattattcagaagagggaacaggacgcaatgcagcagggagattagcagaaacataattctcctgagagtcagcatggaggtatttgttagctactcaacactggtctaacatcctcggtaagaggatcataaatacctctatccacctccctagggcaatatgagcattattgcttatttagaaatttgtccctgtaagagctttgatattctcaaaggaaaggtgctgccaaaaagtgaaaatattttctatgcttccactatgcacgtgagagaaaggagatttggatcaggtaaaagaagtattgtcaggcacataaattctttatctaatcatattaggataatactcctgagctccttgaatggaggcatcatgagtacctgctgcgcttagcacataccttacaaaacactgaaaatcttactcaacacaatcagaactgctcattaatgagctcatcagtaatgtcagtcaagaaaaaaaaaaggggatacatttatgttgtaaatgtaatcagtcgacaggttcttcccgcctgatgcacagaagaaatcaattcactgacaccatggtatcggaataaaggatgagtttagttaatgcagggctgcccagtggaaggactggcgttatcactcaagttggtctcccagaaggctcagaggctaaggttgttcaaggatagtttggtgggccagggactagagaatgggtgttcctgactggttggggatgcaatcagaggaatgtgaaaaaattatcttcatgtgctaagtctgcctctgcgtgagggccacaggacaggttgagtcatgagtcacaagtccaggtggggttagtagattgccagaatgcaaaaccctgaaagacatctcaaaagaccaatcttaggttctacaataatgatgttatctataggagcaattggggaagtcataaatcttgtgacctctggccacatgactccttagcagtaagagatgatagaaactctgcctataccttagcagaatccaggccccttccataatcctaatcatgtggcttttcattagtcttgcaaaggcagtttcagcccctgaacaaggagaggatcagttttaggtaggtactattatgatccttgtttcaaagttaaactatacactaaattcctcccatggacagcttggcctacacctgggaatgaatgaggacagccagcctgtgaggctagaagcaagatggagtcagccatactagacttttctcactgttgtaatctttgcaaaggtggtttcataaacattgtattttattttattttttaatctttttaagatggagtcttgctctgtttcccaggctggagtgcagtggtgtgatctcagctcactgcgacctccatctcctgggttcaagtgattctcctgcctcagcctcccaagtagctggtatcacaggcatgcgtcatcacacccggctaattttttttgtattttttagtagaggtggagtttcaccatgttggccgggatggtcttgaactcctgacctcaggtgatctacccacctcagcctagcaaagtgctgcaattacaggagtgagccaccgcacctggcccataaacattatattttaaattaaataaatataaatgtatttaccaaactggtggaaggccatggttctttccctcactatagattcactggcaagggtccaataccaccttttctggcctaaaccacacccataagatctcatttttcatttccaacttttctttctttgtagggggtcagaacttaaagacactcatgagcaaaatactgtagagtttattatttttcctaatctcttactgttaactaatttaacattagtctttccaaagcattccatttaaatgtcattttaataattctctctctcttcaccctcatgttattaaagtaatattaaagtaaatagcataattttaataacaagtaaaaccagcacaaatatgtcagggaacaaacaattctgattctcataaagcacaaaactcaactcctcaaagaagaaagggatcagtgaggacagatggacagctctgttcagtgtgttttgagcaccagcccaagccttacagagggaatggatgctggttccctctatgaatctcttaagtagaagttggtttaaagagtgcccaccatagttttttttttaaattagttaattattaatattaaacagtgtatttgtggacaatgacaggtgacagtcccaggtaggagtttaaatcatatgtatccattcatactcaaagttttaaaatcccatcctccctacccaaataaatttccagagtctgtcaacttgcctgtctacataatagatatgaattcacattatcctgctcgtaggaccataaaagacccagttactcaccagggaagcctcttaagatgagagggaagagctagaagagcaaattaaatctcaacttttattttcttcctactacttacaaacattgtaagctttcttattatttcttattttctgtctcccaactttggaaggtaagttctgcgagaggaaggatttcatctccctcacctacctctgtattcttggcacacttagaagagtgcctggcacagagaagttacataataaatgtttgttaagtgaatgattgatttaatccaggtaaacacaacatggatgtttgctacacaaatttgatcccacttaatggttaactttttgtttttccattttttaaataaatttctacactgttagaaatttttcaaatttcttggcaaaaatataccatgcaaaaggctagccagattttaatcttgtctaaatcaggtcagaaaaatcacttttattccagaaaacacaaagggcaaagtacaatggccagagctgtataacagctacactcaccaggtgtgcaaagcgatttaatattgtcattcagactcagccctaatgagcaatcttgtttatctacaaaactgtgaacaacccactgctaacaaccggacattgtccccaagcccagcacacttcatgtcaactctcgatgcacccacaatctaggaccgttattagaacttctaataaggaccatgatagaactgctgagaaataaagaaaaaaatggatttcatgcacgtgctttaaaactttatgtttagttattttaagcatatgttttgttctggtacacttagatttgcaactgaaaagagaaaggcatatcagaaagaagttttttgttaaagcagactgatgaagaaaccaatgctagatggaaagcacaactcattttaagttaccggagaaagcaacagaaagtttctccaaaagaaagaaaaaataaagaaagaagcagccaattggagagttacttatttttattatgccaattaaaaagatagtcaaggggccaggcacggtgggtcactcctgtaatcccagcacttttcaaggcagaggtgggtggatcatttgaagtcagaagttcaagaccagcctggccaacatggtgaaaccctgtgtctactaaagatacaaaaattagacgggcgtggtggtgggtgcctgtattcccagctacttgggaggctgaggcagttgaacctgggaggcggaggttgcagtgagccaagattgcaccactgcactccagcctgggcgacagagtgagacttcaactcaaaaaaaaaaaaaaaaaaaaagtcaagggcttcatgccacgtctttttttttttttttttttttgagacagagtctcactgtgttgcccaggttggagtacagtggctcagtcttggctcactgcaatctctgcctcccaggttcaagtgatcagcctcctgaatagctgggactacagacgtgtgccaccatgcccaacaaatttttgtatttttagtagagatgaggtttcaccatattggccaggctagtctcgaactcctgacctcaagtgatccgcccacctcggcctcccaaagtgttgtgattacaggtgtgagccaccatgcctggccccacatgtctccacagagtgaacatgaccacgatctttcttcaagcatcacctttgatagcctttcaatatagagttatgggctttacttcaaacattaactcgtcttccacattcagttatcaaagccattgaatacaacctttaaaacattttgcaagttcagcacttcttctccatcccattgatactgattcagactctgctcctcattgcaatgagctgttataacagctcctgaatgatatacttgccagtgctctatccttgtgctaatccatctccatgaagccaccaggcttccctctgacccagactccctggcataccatttaaggctttcaccccaactcaacttacctccgaaatccttttttttttttttttttttttttgctctatcgcccagactggagtgcagtggcgcgatctcggctcactgcaaccttcatctcccgagttcaagcaattctctgcctcagcctcccgagtagctgagattataggcgcccaccaccacgcctggctaatttctttgtatttttcaatagatatggggtttcaccatctaggccaggttggtctggaactcctgacctcatgatccaccagcctcggccttccaaagtgctgggattacaggtgtgagccaccatgcccggcctgaaatcctatttctagtcaatccccctgcagcatatattttatgctttaggcacaattagtagacagtgggctacatgagtctgaagcccagtgggacaatctggagcaactgaacatttgtaaatagagtagttcacgatttctgtggtggatactgtgatgcgccactcagatccttcaagagcatgatgctcattcttccagctgcaggggagtgctgactcacagctaactctctttccaaagaagctgccttactcaagctcacatcccctccaaactggcagcccatatccagtgactggttgaggcagagcacagaagcccagaccccttgccttgatggcagataactctgaagggtgatcccagcttgaggactcatcctgcgccatgggctctgtgttggctatattatagcttaccttctccttctgtccagtcctgcttcccttacttccaaggaattcttccctataaagcttctgcataggaatcttaggcacagggcctgattccaggaaaccccacctgaggtggttttatttacattttactcgaaatattattatcttataaaaatgacttgctttttaattaatgtttatgcttgaccatttcaacttttttaaggtttcattttaattcaaagtgtttaattgaaaggaaggaacatctgtatatatttttaaagtattaattcctatccagctccacaatcagatattgcttaaaatattggagtcagaactctgaaacctggctccatcatttcccggctgtgtaatcttcagtaggttacacagcccctctgtgtttccgtttcctcacctacaaattgaggataataacaacaaaatgatcctaaataaactactgggaagactaaatgagttatcatatataaagcattaagaatgatgcttagcaaaaatacatgtgctaaaattcattagggtaacactagctgctataacaaacagacctaaaattgttcaatgacttgactatataatagatatttcttcctcatttgtctacacggttttacaaggacttaggttgatagatgcacagttttcttcactacatagtttctccatcccaattggccagaaaagggaaagaacatgaaggagtatgtaccagagaattctacggaggtcattcttcctgctcaaatcccattggccggaacataatcacatggccacacctaactgcaaaggaggctgggaagtgcaggctagacaatggattgtaatgactagctgtctatacagcagactttgctgtactgataattattgttatcatctcattattaccaactttcgagcttgggctcttatctccacttacctagaatgttgcaaaagcctcctcactggtctctctaactccaggctatttgccatcccaaatccttcctccacaacaaacccagagttatttatgtaaaacaccaagtctgatcttttccctcaccgtcctccagcttcagtttaatatccttctgtgacctccccactgcctcaggttccagtcaagtccccttcattgccttcgtgactcagtccctccacatccctttagttcatctccaaaatccccgcccaccttgcagcgggtgtttgcgatttgacacccactttgtgcctgcaacagtgctggacataggctactccagtgaagaaagcgggcgggatccctgctacattttaatgaggtagcagaaaaaacaagtaaacaaataaatatgtaatattaagctataaggagtacagtgaagaaagatacagggtaaaaaaaaatgggggcggtgagctaaatgaacaggtagtaaataacagcttaaatttcacgtgcaagtgatagccattctgcagcaggatgcattgtggactttttatcttcactatcattacccacacccctgagactgcatattacaaaagagttcttatcattgacctatatttgcattccttttagcttcttttatggctgttattcagggaaataatatagagcactaaagattgcctaatgtgctatttgtgtgggatgctgagagaatatcatttgctattgccccacggggcagtgacggtacaaatgactcaatttttttccctgcaaccttctttgcaggaaaattcaactaaaaatatttaataaaaccaagttttactcaagtataaaaaactgttgttttttaaagttccctgggctatgttactgtcaccgtggtagcttaaaaagtattacatatgtgatgttcctgtcactttactggatttaggttttcaaattcagagcaggtgaaattgaaggttttctttacagaggctgttcttttaaccagggtgatttgctcccacccgacttagtcatttttaaaattcttatttttattttagagacagggtcttgctctgtcacccaggctgcagtgcaggggcaccatcatagttccccgcagcctccaactcctgggctcaagcaatcctcccacttcagcttcccaagcagctgggactacaggtgcacattacgatgcctggctaattttttatagagacagggtcttgttttgttgcctaggctgctctcaaactcctgggctcaagcgaccctcccacctcagcctcccaaactactaggattatatgcatgagacaccacgcccagcctgaattttttttaatataagaaatcaatataaagacaaaataaaaacgggtaaaatgtgtgcctttaacctaaggtatagacaaacccttattatcctcatctaacacacagaccttaattctactgctgatttccttcccacttctcttcaactcagaagcactttctgaggcaaaacatagcttcagctttctggtctcatggcaacttggcagcacaaggcttctaggctaaaatcccagcttccatggatccacgctgtttcagtcacaaatatttaccttgcctggctccgcaggctaattaaaggggtaggctctgttcctcttggctctcctctaaattgcttttagaggaagaagcagtggcgggaccagaatggcagccccatcactcatctccacagccacacggtgactaccttacaaatatcctgttcagatcagaaaaggggtttgcagccacgcccttgcctctctccagctagatctgaaattgcacatcccaacgatgatttcccctggaagctgacattagccctagcagcgtatgtgactgatggtgcctctgaaagagggactctcaggatcaaatactaagagcttattataccagttagaacacagtgtttcactgtgaatatatacttttattataaaaatgacatatgcttattataaacaattcaaggtgaagaaaagttgggaagttcacagggaatttttcttctgctctcactcagccccagcactgatccaaagactgccctccctctagaaacctcttttatcagtttctggcattttctatgcatccacaagcaaatggatatatacacacacacacacatatatatatatatatacacacacacaaacatacatatatatatatatatgcatttaaataaatcactctaaaggctttaaagtgatttcataataacaagcaagtccacatttgataaaccataaaatggagtcacatagttccagtcagcaaagggcttggcccttcctacaaagcagagtcactgggtgaatcctgcttacaactcacaatcgagtcaagaagccagaatcaaattgccaggcccaggaagcaatcagaacatgaggtgaggttacaactctgaaaacagatactcaaagtctgggcaggggagggaaatcaatggagaaggtagaaatacactctgaaaggcaaggggctcagagtgctgggtctagttggaaggggaggtgatatggtttggctgtgtccccatccaaatctcatcttgaattgtagttcccattatccccacctgtcttgggagggacccagggggaggtaattaaatcacgggagcagttttttcccatgctgttcttgtgatagtgaataagtttcatgagatctgatgattttataaaggacagttcccctgcacatgctctcttgcctgctgccatgtaagacatgcatttgctcctccttcaacttcaccatgattgtgaagcttccccagccatgtgaaactgtaagtccattaaatctcttttcctttataccagtcttgggtatttattatagcagtgtaagaacagactaatacaggagagaaagcaccccagggtttactgtcatcactggggtgatgggtagggagcagaagtggagaagtggcaatttgagtttgccttacaggaagaagcaaagataccactggaaaaacagaacacatccatccacaagttgagaggagacagagaagcccacaggggctgaagctggatggcgtctacctgggaggcagtctccctctgcctcctctttgagagatttctaataatattataagttgcctttcagcttgcttttgttgctttcttcttttaatatagtaaaatgtatatgtaatgtaaaattcatctttttagccaattttttagtgtacagttgagtggcattaagtatgttcacaatgttgtacaaccggcatgatcgttcatctccagaactttttcatctccacaaactgaaactctgtcctcattaataactccccattccctactatattagttcattttcatactgctatgaagaaatacctgagactggctaatttataaagaaaaagaggtttaatggattcgcagttacacatggctgaggaggcctcacaatcatggcagaaggcgaaggaggagcaaaggcatgtcttacatggcggcaggcaagagagtgtgtgtaggggaattgccctttataaaaccatcagatctcatgaagcttattcactatcataagaacagcatgggaaaaactcacccccatgattcagttacctcccactgggtcccttccacaatatgtggggattatgggagctacaattcaagatgagatttgggtagggacacagccaaactgtatcacctacttctcccagcccctggcaattatcattctagtttctgcttctatgaatttgactactctaggtacttcacataactggactcatacagtatttgtacttttgtgactggcttatttcactcagcataatgtcttcaagtttcatctatgttgtagcatttgtcagaatttccttcttttttacagctgaataatattcccttgtatggatataccacatttcatttattcatttattagttgatggacacttggattgcttcaatgctttagctattgtgaacaatggtgctatgaacatgggtgtactttcaggtgcttttctaaatgaagtattctaagccgtgaaaggtgaacagggtttttctaaacagaagacattcccaagtgagggaaagtgtggtgtgaggaagcacagcttgttcaatgaaaggtaggaggccccatgaggcagcgatatgaaagaggggaagaatgacaagtgagataaaaaatgtgggtcaggccattaaacttaaaaatacaaagaagaatagaatatattcaccacctagttgtgctgtgtcttaatatcttgccctatttactcatttttcaaagaaatatggtattacagatacaattgatccttcctgcaaaatccctcatctcattctttcattccccttcataatggcaaccattttcctgaattttaaatttattttttcatgttttataaatttacaacgtatatgaaccatgtcatgttttgcatacttttacattttatatgagtgacatcacactctgtatatatccatttccaacttgcttctttaaatcaacattatgttatagggttttacttagattatttcatattaatacttcatagtataaatattttacactgtatttttgtaccattacaaacagtgcagcaataaacattcttgtacattttccttgtttatatgggtatgactttaggctatggacctaacagcctcaatttgtaaaggcaaatttctctccaactaagtggttatatcaatttacaccccaacaaacagggttcacttgttcccattctgccacatccttaacaacagtgagtattgtcaaatgtttaaatttaacaagttgataaaatagaaggtagttaagaactcagattttagagccaaaccactagtattcaaatgctggctttactgtttactagttgtatgatttcagccctactttccctctctggaagaaaaaaaaggtcgtaatacctacctcacacactcattgccaggaatatgtgtgttaacatatgcaaagcagttggaataatatatatattgttaatactcagtaaagcctttagaataatacacggtgagtgctcaataagtgtgagccttgttttaacattttgaattggccattcaagtcttgtctcctgtgaattttctattcctttccttaccctaggacttatcattttaacttaactattctgaacataatcattcatttgtggttatatgctggaaatatcttcttttagtctgtggcttgtcttttttgtttttatgacattttttgttaagaagttttaaattggaatctagtcaatatatcgttctttgtactcttttttctcttgtttaatcaatccttctctttggtgcggtcatacaaatattctcctatattttatttgtaaaagtttttaaagtttgttcttcacatttaggattttatgatttaatccatgttgaatttaattttgtgactagtgtgaggtaaggagttttttcaatcacttctccatatgagaaaccaaatattgtgatatcattaatgaatttgtaatgtcatttttgtcatgttatttctatatatgaataggtctggttttaggctttctgttctattactctatttgggggggtttttgtcttttgttttttttttttttgcctacaacaaacatttctttttttcttttttttttttttttgtttgtttgttttgagacagggtctcattctattgcccagactggactgcagtggcttgatcatagctcagtgcaacctcaaactcttggcttcaggcaatccttctgcctcagcctcctgtgtagctgggactacaggtgcacttcaccatgtccagctaatttttttattttttgtagagatgggatctcactatgttgcccagggtggtctggaactcctgacctgaagtgatcctcctgcctctgcttcccgagtagatgggaccaccggtgcatgccaccgcacctgctaatttttttttttttttttttttttgtagagacagggtctccctgtgttgcccaggcttccactgtcttgattacaatagctttaacattcatcttgacatgctaggttatttcattaccactttggttgagctaggaattccctttcctgtctggttccaggtccaagttggccaagagaagaccttgtgtgagactttgggatgtggaagtgaagggcagttctttactctgtgaagctcttcaaagttagatggggtgacagacacagaagtacctaacagattccaacttgcccttgttctcctctgctttgcatcctgctgttcttcccaaattctggtcccgcagcccaagacctactaccagatacttggctaagagccacagagaaggtggcttcacaaaggcaacagcttcacacagacatctccatgagttcccttggcaggacaaattcagtagctggatgtgtacttggcttcttagatttttttctgtaaactcgatgttgtccacttatgccagtgctttcaaaagatagtttagactcttctctgagctcccagcttctccttccagatcttcatctccccagctcctcccacaattggataaagtctgctttctagaataaatcccatgtcataacactctttgtggctctagttccttgattgaaccctgactgacatatttgataggttaaagtgagccttcctatcttggtcttctacaaacttcttggtcctttgctcttccacatggctttttaaatcatcttgtcaagtatcaaaaaaaaaaaaaaactgttgggattttgagttgggattgttttgaattcattaattaattaaggaagaactaactttttatgatatttaatattttaaaaattatttattgatgttgatagagtgtaaattatctttatactaatgttgtgcttagtaacttgttgattttttatgttagttccaattgcttgcctgtattttctcttagactctatgagggcaatttctataaatagcgattgttttgttttgtttttacaattagtatgtcttccttttactgccttactgttcaactagaacccccaaataatgattggctacaaatagtaattgtaggcatcttgtcttgtccctcatattaaaggaaataattctaaagatttaccactaaatatgatgtttgctgcaagtttctgatagacatattttactctgtaaagaaaatctgcttctatttgtatttcttaatttttttaaatatgaaagtgttaaattttaacaaataatttttctgcctctattgaagtaatcatgtgctttttctcttgcaatttgttaatgtggtaaattatattaatagatttttctaacactaaaccatccttgctttcctgggaactcaacctggttatactgtattataatatagtatatagtatagcatatttttgtttttaaacaaaatatagttttgttttatacaaaatatagtgtgtttttgtttttaaagtaaccaattttgctaaatattattagaatttatagctttatatttagaagtgaggttggcttacaattttcatttatttatttatttatttttgagatggagtttcactcttgttgtccaggctggagtgcaatagtgcaatattggctcaccgcaacctccacctcctgggttcaagcaattctcctgcctaagcctcccaagtagctgggattacaggcatgtgccaccacgcccagctaattttgtatttttagtagagacggggtttctccatgttggtcaggctggtctcaaactcccgacctcagatgatccacccacctcagcctcccaaagtgctggaattacaggtgtgagccaccatgcctggcctacaattttctttactgtccatgtcttattttggagtcaatcaagcatacgtcagtctaataaaatgagctttggagtactccttctttttgtaatcttgttatagtctctggaatagtttatataagattgggattatacattccttgaaaatctggtaaaactcacctgtaaaaaattatttgtggccaggtgtggtggctcatgcctgtaatcccagcactttgggagactgaggctggagggtcacttgaggtcaggagttcgagaccagcctggccaacatggcaaaaccctgtctcacaaaaattaaccaggcatggtggtgggtgcctgtaataccagctacttgggaggctgaaccaggagaattgcttgaacccaggaggcagaaattgcagtgagccgagactctgtcttaagaaaaaattatttgtatgttatttcataatataggtagctataatcattgatgtcatatctttcaagatcatataatttaggctatttcttcttaagtttatattgattattgttttctggaagttaaccattttgtatgtcttccgaattaattgacataaagtcatacctgattgtctcttgttacctgttttaatttctggtatatttgtagttatgtccctttctaattcacaatttcaatattgctttgaatatcttttgtatgtaacatcatgctgaaactggctgtaagaaagccaagttttaaatagttttaatagctaattcttccgaaaacccagagttgtaaagaggaatagaaacagaaataccactaaaactacttctccataacttctacctactgtccctaattcttcccctgggagtcacataacctcaaatgtgtacttctacatactccttagaaattattactcttaagtaaatccaaagtggtggtgttttgttcagtccgttcaagaaacaagagacaatacatatctctcctgaaatacatcttttgcagtttaaggagcctcagtttttctgaaagttactcaaacaccctgcatcccaagctctttgctagcactcctttctgatgatccatccccaggcatcagcatctggaactgagtcctttagtccaagcgtagtctgaccaacatgaggagaatgagtctaaggctatcctctcactggaccattcccttcatacttcctaaaatacatttcttgcttgttcatcacactgttgactcatgttaattttgcagtcaaccaaatatttgagtctttttcacacgtgctgttgaggaatctttatccccaagtaataaaagaagactccattatataactccctagtctacagacttcaaaagagaattttaagcatgtttgggccttgagcaaagcactgagataaaaagttgagggtgaaggagtagcagacagtactatcctcagcaattagaggaggagttctttctttataaaggaaggcatctcagctgggttataccatagtccaatttccacaaacagggaaggaaagaattcccttttactgagtaccgactgggtgccaagtctaggttaggtgctttatgtgtgtttatctcggctttcgtgctgataacatcattgggtcaaggtgcagtgtaaataaagaaggatgtaaataaatgctaggtaaagttattcccattttatgtatgaggaaacagaaattcacagcatgactcgccccaaatgatacaactaaaaagtaatggggccttgttcaacttctgcactctcagccaggaatgaatgactacaagtagagaggaggcagcaggcaacaagagcaattggatgatgctttgtggtttaatgaaggacaggactttcacctacattaactcttttggatcacctgctccacctaccataagaggctgattctcacaacagcctcttatggtaggtggagcaggtgatacaatctttattttacataaagattacagggctcagagaactgagggacctacccaaggttgcccagctagccagtggtagagacactttgaccccggctttctgacagcaagcacctcttttggcagcaggtatggggcaaggagaacagcagggacctggggcaggtgttgacagatcaatgtggacatggggaaaaaagccccaaaacccctcaccaaggaaatgtaatgctctgttatttatttaaaaaaaaaaaaatttttctcaagcctttgagatgcacagaagaggcctggcgtggtggctcatgcctgtaatcccaacactttgggaggccaaggcaggtggatcacttgaggtcaggagtttgagaccagcctggccaacatggtgaaaccccatctctgctaaaatacaaaaatttagccaggcatggtggctggcacctgtaatcttagctacttgggaggctgaggcagagaattgcttgaacccaggaggcagaggttgcagtgagccaagatcacaccactgcactccagcctgggctacagagtgagactctgtctccaaaaacaaaacaaaacaaaaagaagatgcacagaagaaagcaagcccagtgtattagtctgttctcacgctgctaataaagacatacctgagactgggtaatttatatggaaagaggtttaatggactcacagttccacatggctggggaggcctcacaatcatggcagaaggcaaaggaggagcaaagtcacgtgttacatggcagaaggcaaaagagcatgtgtggaggatctctcctttataaaactgtcagatctcatgggacttattcactatcatgagaatagcacaggaaaggcctgcccccatgaatcaattacctcccaccgagtcccttccatgacacatgggatttgggtggggacacagccaaagcatatcacctaggtcgatgacagaagcagcagaggtgcctaggacagaacacatcactccttctgccacaagcatgtgctggaaatgcctccagtcaagtatccttagaacaatcgttttcccagctatttaaactccactgaagtcaagcaccagcttattccaggccaggctttgcctgctaattaacaattcacctgctggttactagttcccacagggcctcaagtgagaccaaatcccccagctggaaggtcctctttttttttccagcactgctaattcagctctgttgcccatctcaagcctggctgagaagttgttcccctgcagcccccttagttgccccagggattctagatgccctctatattcaagccaacattcatcgtctgtcaacaggtggtggacatgtacttttatgattgtactcaggttcctctgagttttgttttttcaacccagacattaagaaatccttatttcctatagaggatttaagaaatagaaaaatggcatgaacctgggaggcggagcttgcagtgagccaagatcacaccactgcactccagcctgagtgacagagcgagactccatctcaaaaaaaaaaaaaaaaagaaagaaatagaaaaatgaaattaaaaaaaaagataaaagacattaagaaatccagaagcagaaacacaacttctccagtattttccaagcctggctatggatcaaattcacccaagcaccttaaaagaatatacagatacagaaaggattctgcagcagagaaccacgttaaacattacttggatgccatcagcaaaatgcagactctggaaaaaaagaaaaaagagagagagagagatgaaggaagatgaagggagaacttgtacattaaaagagacttaagaaacgtaacaaccaatgggatgtttgaacttagttggttcccatttcaaaaaacacaaggtaaaaacagacaaatgaaaaaagaaaatttgggacatttgagagacagttaaaattttgaacactggctatatgatgatattaaagactttttattatttctgtttagatgtaataatggtattgtggttatattttgaaaagatttcatatcttgaagagaaatgtactgaaatatttttggctaaaatgatgtgtctaggaattgcttcaatatggaggagagcgagtggaaatccagacgaagcaggaatggccatcagtcgatgatttttacagctggatgttaggttcatggaggaaagtggggttcattatactttttgttctacttcagtatatgtttgaaattttctgtaataaaagtttaatctccccagttttgtgaactattctatttattttatcctcatcctttaacacacctatgtacacggaacttcctgtgtaaaatgtttattgagtgtttattccccagaggagaagcaaagaggaagtaagagtaggatatttttgaactatgtacaaatacaaccagtttcagacccttttatatgatctatactcattctagactgagccacatagaagagctgttcctgaagtcagatcagcctggttacctctaaaagaccaaaagactaaactaaaacagccttttttttcttctgtggaagcgtacatgtgtgtttgcatgtgtacgtgtaccgaacagctgtcatggacctttgtgcaggctgtgcactgcacaagtttgtcacatctaagggggcatgcttcacctcatcaacacattgcagatctatatatttattgtgacaacagtcttgtaagtggcagcaaaatgtcttcttctaacaaaattggtatttttgataactttccaaaagatggaagcaaaaatatcttaaagtagggacttcttttctaattatgtacttatggtatgggctagcagtggacctgaactgactgtcttgcctgagtttgaatctcttcccccaaactcactcactgagtttgttatttaatagccttgagttcaagtttcttcatctgtaaaatgggatgataatattatgtaccctgagagcactgttcagagcattaaatgcatatagacagtatctggcccataggaagccttcaaaaagtgttagagattagctattaccatatctgttcacccatatcaaattttataggtgtcggtatgttgcgttattcataaactcaactaataaattttgcagtggactgaaaaaagactgtctccactatttcatgaatccaaactattttaaaaagaggattttcccctaaccatcagttctgaaaaatgcaaggaagctcaagctccaggtaagcagccagggtttctaagcctctctgcgcacagaagctgtgtgcatatgctaatgaggaacctttgaagaaaagtgctggggtttttccaacgctctaactacttggccagtaagcctttaatgatgggaaaagacccagtgggagttgccagccacaaaaggggttttacctcacaggcagaatagtcaaaatgcttcaagacgttaaaagcctatttttaaaaggaaagaacacagagtatgtctttaacttgatgttaaaaataaactcagccgcctcctctgcgtttcccaccctctcccactgtccttccgtcccctgcactgccctaaaggaaagaaagagtgcttttgtttcatttttatttttctcatgagcttttctttcattattatttgtttactcttagccaaacttgtttttccgttcacaaaacaagttgcatttttctcttaaaaattcctcggggattcccaggaagcaagacggattatcaattagaactagcccgtgtcaggatgagtaaaagattcgcgcggagataagcaaagtggagcccttacggcgtcccttgtgcccagaaagtatctgcaggggacgttgttcaagcaagggggccttttatttattttttatttttttattttatgtatgtatgtatttatttatttttgagatggagtttcacttttgttgcccagactggagtgcaatggcgcgatctcggcttactgcaacctctgcctcccgggttcaagttcttctcctgcctcagcctcccaagtagctggaattacaggcatgcaccaccacgcccggctagttttgtatttttaatagagacggggtttctccatgttggtcaggctggtctcaaactcccgacccccacgatcctcctgcctcagcctcccaaagtgctgggatttgaatgctttttcatattggggtttaagtacagacacttcctgaggcatgactagacatagcaacactactttgctgagctgccttcaataaattccattaagcagccataaaattccaatagatcagatgtgccagtttttgttcatgaaaaagctaatctgtgtagcagaaaagctgccagctggagtggaaaagctggatttcttattgtatattgatggcggagggatttcaagaccccagtggaagccaaagttgttgaaagacaaggagacccaggcctgtgcatagtactatgatttcactggagggaaatataagagatgaaggggtggctgaaggcttgagaccctgtttacttaaaaatattaaaaaaaaaaaaaaaagaaagcccttaggcaatataagataaaggaaaaaacagcaaaaatcattttaagaaataaaattctgccagtgtggtggtaaacacctgtaatcccagcactttgggaggccaaggcggaaggatcacttgagcccaggagtatgagaccagcctgggcagcatggtgaaaccccgtctctacaaagatacaaaagctagctgaatgtggtggcatgcacctgtagtaccagatactctgagggagtgggggaggctgaggcgggggatggcttgagcagggtagagagagacctggaaggaaggaaggaaggaaggaaggaaggaaggaaggaaggagagaaagagagaaagaaaggaaggagggagggagagaggggaggaaggaaggagagagaaagagaggaaggaaggaaggagggagggagggaagaaaggaaggggagggagggagggaaaggaaggagggaaaaggaaagaaaagaagaaaagaaagaaaaagctctagctgggtgtggtggcttgtgtctgtagtccagatattgggcaggctgaagcaggaggattgctggagcccaggagtttgaggccaacctgggcaaagtagcaagaccccatctctttagaaaattagaaaacaaagttcctgtctagggttggcctctaacttgcagcatgacctcagtccagtgattttcttccctacaatttctttttcacaaaatcagatccctctcttcttgaatctgttctttaataggaatatataattgataaattacatataattgaaaacaagatattacatcagagcgcttaataagtgaaaatcacagtacaaacgcatgcttaaacactgttgaaatttaatgaagtaattttgacacatgtctagaaagtcagaagggaaattttgttactaaaggttgagtttgagccaattgttttccaattttcatgaaagcgaagcactgtaatacaaaagcatgcctaggaacactagcacctaactcaatatgccttaacaaatgagtaaaggaagaatgccaagatttccagcctgcaaagcttcacctctagggaatctatggccttcttgcaatggatcttctagtttataagctcaccaacataatttgacacccagtgaaaatgatattttcaccatatgtatatgccaccattttcaaatgtgtgtagattggttgtgactaataaaatacaataaaaaattataaatttatcatttgtatatgtattaataaaatacagactcatttaaaacattaccaaaattgagtcaattgtcaacatctatttctggatcaaccaactctaaaattacaatttcttccagctgggaactctggagtttaatatactatagctttttgtcataaattgatctctgctgtattagttcattctagaaagtgatggaacattgatactttgagtaacttgtgtgccagtaacaaagtgcttccctaaagcacagccaggaatcaagtctatgattaaaaacatctgagtcaataactatttatttacttatttgtgttgtcctgggaaggcttgaggatggcttaccaagatgcacaaaattcagcaagataccatcagttaaataaaagtaatgggggaaaaagataggatagaaaaatgagtagcagggctgtggttaggacataaaaggcgttctgtgaaatcccacattcttccaagtgctggcctatttggctctgccctttgtaagcagccaaagggaagaggaaaccattattagatacataactcatattagctgttaataaatatacatcaacttcttataagaagcccaactctttctgctggaaagatgagagaaacttcaagaaatggcagcgtccccaacaacataccagttgcaacagatcaaaaactcagttttagcccatgtcctcatgccagagccagattcagtaactaattttttacagactttctctaatgatgaaaaagtacttttccaacactccgtgaaaatgatctcttccctcttgtttaagtggggaaacagaggcagagaacagtgaattgcttccacttcatatactaggtcaattgctaagataaaagtagaaataatttgtcctagctggatataattacctccagatgtgcatttgcagattacatgatgattatgaagtgctcttgaggactccttaaggtgtaatggtgacctttgactccatttcattttctcttccatccccctgatgcaattttcctcaccctgactcttatcctcttgccttggtcaccactgagcactcaaggatgtagaaaatagatggcctctacaaggcggaggtccaggggaagccatcacagagatggatgaaatagcagagctggaacactcgggcatgcactatggagatggcctggaatgagtttctgaaaagagtctgggcctccagcacctcactgctgaccaagaagtccagaaacacgtctgtgcaacttccacttccacggcaccagcaaatcaccaggccatttaataattcaccaagcaaatacgtactgagtgccttccaagacaccaggtgctgagcctgtgctagggaatcaaaggcaaaaaaggcacaggtgtgtccccatagaaactgtagcttagctgtaagagagtccatcacacaggaattttaatatggcatacacacattgactctggaatcaaactcttgagtcctacttccacttttgctatgtgagtaagtcaaactcttggggcttcagttttatcgtctgtaaaatggagatagcaactaccttctagagaaagagcctagaacagtgctggacacagttcccatgcccagaccactgccttctcctgggatccttatctctgtaagaatgaccaaaatttactgtgcgtgtgatattccaggcactattcaaaatatttgaagtgtgtcaactcattttccctttatcatagccccatacagaggatatcactattattttcattttacacatctgagacatgtgattcagtgcctggccccaggttctcagagtggcagtgtacatcagtggttaaggggacacactctgggaccaaactacctagactttgcaacttagaagttgtcagagcttggaaaaagtaatgaacttctctgggcctatcttctacctatttctctcagtttgttccccatctttaccgcgacctctgcagactacattttcccaggctcctgcccatgagtgtctggttagctcagccgacaggaagcagtggtggagcttagcagtaggatgagggaatgtcagggtacttaagcccctctcagtttggggtggctgctctgacagtggctgcacctcctctagagctccagttcccgctgggcagtcccagtgcctcacctctggtgacatccccacttccttctgtccctccaacctggagcagcagcttcctactgtttctcatctttggattgtcttgcatcctccatttgttttttgtgttcttgcaacagacttatagtcagagccccatgtcagacttcctctggtgaactactagagtggcagatgcaccgtgctccaacagtctcatctgctaagtggaaataataattgtgtctacctcatatggtttttgcaaaattaaatgagttaatatatttaacgtgcttgggacaaaccatggcacacagagtgacagccatactgtaacacacagccaaggcaccaaagtccctttctagaccccagagaggagatccccaaagcctttgagaatgaataagactcaagcaggtgcagagaagatggaaggacattcgagctgtcttagtccctttgtgttgctatcaagaaagacctgaggctgggtgatttacaaagaaaagagatttctttggctcatgattctgcaggctgtacaagaagcatggcgccagcatctgtttctggtgaggtctttaggctgcttccactcatggtggaacatgaaggggagctggtgtgtgcagagatcacttggtgagagaggaagggagcaagcagaagagaaggaggagccagactctttttaacaaccaaatcttgtgggacctaagagtaagaactcactgattaccacaagaatggcaccgtgccattcatgagccatctgccctcatgacaaaacaccccccacgagaccccaccttcaacactggggatcaaatttcaacatgtgatttgaaggagacaagtatccaaactgtatcataggcaaagggatcagacaactaagtggccaagaggtaagagagagaagggggccttccgggagccaggaaagggaagaaacacaggaagacggggcatgctaacagagcaaggggaggggatggagtcagggagaaggatgaggctggagaaaacagagcccagagcatacctttttaggcatattggagtccagactttgccctgacaatggggaaccattggagcattttactgaagtgacacatttgaatttatgttttagagaggtttctttggctgcagtatggaaaatagatggggtggaaaggagagatgagagaacagcaggaagagctgttaggaagccatcgtgagtgcccaggcaagagataatagcttggactatagtagtgacccaggagcaaaaaaaaaaaagaaaaagaaagaaaggctcaagttattcaggaggtaaaaggaactggattggcattggattggatgtgggagccaggggagaagatgacatcaaaaatgatgctccagtttttgacttgggtaaatgtacaacagcaagcagcccagccgagtgattagaagcatgggctacagtttcaacagcctgcattcaaagtctggctctgtccacagctagctgttgaacctggggcaaggcaccgattcactgggtgcctcagagtataagagagggataataattgtatcttctgtacagggctctggaaaaggttaaatgaggtaaagtatgtcaaatgcttggaacggagcctggaatatcacaagcacagtaaatcttggccactattacatagacaagatctcaggagcaggcatagtttgtgggggtgggagcatcatgagctaggttcaaacacactgattctgagacatctagggaaccacagaacaagttctgggctggagatgtagatttcatttgagagctgccagtagtagagacggtaattgaagccatgggaatggaggtgattgtccagggagtgtaggtaaagtgagaatagataagtgccaaagggcacagtctgggtatgtcaacatttaagtgacaatttcagaaagagaagccaaggaagaaaccagagaaaagcagttggagaagcaagaaggcaaccagaagtggccttggtacagctgtgatggggagacaatgacgaaacagcaggaactggcactgagagttattggtgtagcttgggctctcccctcatcatcctctccagctgggagtcatgtgacagaagcaagaagcctgtcacagcgcacatgtaaaagagcaaactccagacacacacgtcttatctgtgctgacggcccaccttggtgactggaaatgacaccatccaattttttctggccgcaatgttgcacccctgattttttccttcatatgacagacttcacagcaaatactcctactgagtccaaacaaccgctacgattgagaacaagcatgaatccgccacccaccttctcctggaaataaggtgatgtgtaggttcctcatctcctttccagtgtccacaaacccatctgagtaattgcaacttcaaatttttcttttctttttttctgttacagacactgattccagaagagtgttccatatgctatgcttttttaaatttattatttattatttttatttttttgagacagagtctcgctctgtcacccgggctggagtgcagtagcacaatctcagctcgctgcaacctctgcctcctgggttcaagcgattctcctgcctcagcctcctgagtagctgggattacaggcacacaccaccacacccggctaatttttgtatttttagtagagatggggttttaccatgctgcccaggctggtctcgaactcctgacctcaagtgacctgtccaccttggcctcctaaagtgctgggattacaggtgtgagccaccgcgcctggcccatatgctaaatttattagaacccccaagcctggccaaaggcctcactcctaagattctggtggcaatgccagcatacactgggctcagaggaggtcttcagataccaggaggattactctaattcaacgcagaaatgttgtgaaactgctttatattctgtctagcacaagcaagtgggggttactatttttgtaatcattataagagccttcaactatataattttgggaagtggtgataaaaaacagagtacttctcccttgaattctaccagccccaaactttcattaacatccaattaattttcttaaaaaagttcagcatgaaactctctgcagcactttggcacagtagtatctatgcatttggaatgacacagtaatttcttatcctagggaaaaaaaattactctgtcaaaatgaatcttttagcctaagatgaactggttccatttctcatttctcttttctcaaggttattgggttgctgaactcccatgaaccaaaaagaaaacactgaatggtatccaaaccagcctggaaaggacagcgagaaaagccagaaccaaggctgaccagcctgaatgctggtaaatgttatcaaggtaacaacttctcatgtatcggtatgtgaccaataaaaagggaatgtgcttgattagcaaaaagaatctccatgaaaaataaggcatattagcatgatgactttattatacagcaataacataaatggcaatccactcttgtagaatatttgtgttgaaattaggaaatggcagcagattcaaacacaagagttaatggaagccctaaatatagatgatattccatctggctgccaagagcctgcctcagcacattaaccagaagaccaaaccagagaagggaaatagcttttaaaagtgcaaaagagaaaagagattcacttagaattttatctggtaaaaaaaaaacatctagtcataggatgaggagtcatctgtttcatggactatttatgactcagatgttaattcggatgctgtctttaaatacatggagagaagagagaaattttccccctttatttaggcttgaaagagttttgttgaagcaggtagctcacagctggtaagtggcattcagttgtttaaaataatttatatgatttggctttcatatttgctacatttgtgcaacaaacagagctgctgttttgattcctccaaaaccattttaaactctagcaccatggggaccatgtacccttagcattttgcaagagttatactttgcactaaatgaacagcaagcctgtgtttacaaaacaaaattatttttttccagtttcagttttgcttattaacaaagtagatatttctcaagtcaaaatttctcctttgtttatggttggagatcttggccctgatgaaaaaacaaaaatccactgatgagtacagaaaatcaccaccatgcagacatctctctttacaacaatcctgtggctcacagagccatcatgattgccagtgtcctcgtagaaagtcaacaatagctatttgcagttgattcggttcctctgtttaggagattttttgtagcataaatagattacagtgtttgcaaaaatgtgtgtttatggttgacccttatgcttctcagaatctgtttggagtactaaggcatgctatcctgggtgtgttgatttctctttgtgcaaactctgctgaaaaccaagggcaatcaacaggatgaagaaagtttaattcaggaccccggttgatagagattacctctgggtctaaggtcagggatgctttagtcctccttgttagaatctccagggaaaccctaactcccagatattaatcagatctgtagaaccctgcttaaaaccttccagtggctctgaattactcttaaataaaactccttaccctagctgataacacagtatataatctgacctctgttcagaccttaccagacctattatgcgctgtttatcctgaggcctctcaccttgacctgcagaaggctgtcttctccctttgtcttcacatgacctttcctctgtgtgtaactgtgtcctaatctctctcttcttagaaggacaccagtcttactgggtgagggcccacccagaggacctcttttttgccttaattacctccttaaaggccccatattcaaagacagtcacattctgaggtactaagtgttgggacgtcaacatatgaattttggggggctataatttgcctattctgcacatttcatataaatggaatcgaacaaaatgcggcccattgattctggcttctttcacgtagcacaacgttttcaaggttcatccaagtggtagcaggtatcagtgacagagcaggagcaccgtcatcttggacaaacatcgccatttcaagttccggctccttttctaatctcaggcatttcaaggaaatcacttctcttctaacaacaagcagccagaaagagcagacagtaaaacacagataagacagctcaggcacagaaggtggggggaaagtctcttgggtaactgccaaacttcacactcatacaatgggccccagtaaaacagtgggccctaataagcacattcctttccctttaggtacactaagatagggaagctaaaagcaggcttgggtatgcctgcagctgaaaaaaaaaaaaaaaaaaaaaaggatagaaacaaacacaaaaactccctctcaaataagcaagacaaagaaacacagaaatattctgagcctgtgataagctctcctgccctaaacccttaaatactcttagtctgtaacagagagtgcccctgacctaattcagccagaagcccctctcgggtttattctccaaaataaacctgtttttaactgtgaagccacttttcatgtttctttcttccttattcaactcttactatcagtactttcttcttttttatgactgaatagtatttcacggtatggctgtatcacattttatttatccattcctcagctgatggagatttggattgtatttgctttttgcctgttataaataatgttgctataaatgtttgtgtacaagtttttgtatgaacatacgtcttcagttattgtgagtatatacctaggagtggaacattctgggtcataaacacacataactttgtgtttccctttttgaggacccaccaaactgctttccccagcagctgccagctgcatcattttacattcccaccagcaatatatgagggcatgtttctagagattacataatcacaaacgaagggcattgtcctttatagcctgctgaagttcaaaagagagaggaagagatgttcaagtaaggaagagatgttttattaggaatatgaagggttcacaaagtcctgcttactcattttcagccaactttgccatggcattatttaattagcattttcacctcatcttcaatcttaacatgaatagcctgggtctcaaggccatcttttcccaaccagtataagcaccttcgagacagcattcaatatgtgtcaatttatttcctattcaataaggaaaattaggtcttgctttgcccactcagctttattcctggaaatacacttttcaaaaagtagaaagttcagtcttgctttaaaccaccaagctgcctgaatggatttcatccattatttgggctttattttaaactttgcttttaataggcacagaaccaatgcatattttaaacttttgacgcaggcaaattttatatgtccaaaagactcttggaagttaagcagacataaggggtaccgtgtgtgtgtgtgtgtgtgtgtgtgtgtgtgtgtgtgtatcacagaatgaggggcacatgctgccaatttagtaattaattatcaactaacagaaggccactacctatactgtctgtggcagccagagcctcaccacactgacaccaagttgctgtgcctccttgacagaaagtaacacagattgccatcaatggatagacaaaaaaactctgaatctatggttatacgtgtgcatcttacaaatggagtaacaacaaatagaagaaatatatttacaaatgaaaatgaacccgcatttatttacttcactaaaactgtttttttttcttctcatcaaagatttctctattcatgctactcaacatcccaaaaagaatcagcataaggccacaaactcaacaaaattccttctcctgttcattaaactcctgtcctgactccaagttcacacctaaataaacaggcaagcctgtgctctgcaccctgaggaacagtctcctaggctttgtccttgcagagagcccatttccaaggacaggccgtccatctacccagcttttctcaaggccacatagctcctctctaaagacagccatccccaggggttcagttgatcctgacagctgcgcctacagagaaagaagggaagagagatgggagaggaagatctcccaggagtcaggatgcaaggtgaagccagctgttgatcagcggtcactcagcagctagaccatgcgacactctccttctgaaggctgcaggctgtgagagtgttctgagtggcatttaaggatagctcccatgcagcgtgccagcttcggcagggcctcctatggtaagccctaaaacacagagggaaaagaataaccaagtggaagtggatcatcatgccatctatcagagacaatgcatgtgagaatgctgctactaaatgaatgaaaaacgctttgtaaactcaaagtctgtggttctcaaacttgagcatgtatctttttttttttttttaaattaaaacgctgatttacttggccttattctagaagttggattcattcggtctggggtaggacctagaaatttgcatttctaacattgcatttcccagaggatctgatactgcgggtcagcggccacacttggagaactagttgctaaaacacaggatccatgtcagctgaagctataatgggcaatcatgagccatgcccagactgagcagtaaaaggaaacaatgttactgtctaaaacaagcaagaaaataatagaatatttaaaaataacagaatatataatgcttgagttgccagtagcaaagtgttatgattaggtccttgaagtcggaaaaagcagagattaactagacatttctgaataagccctgtcctctaactcagcagaaaggaagagaccaagtccatcatcctctcagtaaaccattagccctggagcattggctttccctcttcacagatgaggagttccatcttctaactcacacagagcagggagaggataagagctgaggaaatgccatcagccctcagctggtgactgtctctactagtagtgcctcatatgggtataaggctttgtggttttgaaaagctttccagtgatcaaaacaatgtgacatgggtgaaagaatagacaaatggaccaactgaacagaatagagagcccagaaaaagacccgcccaaatttagtcaactgagctttgacaaaggagcgaaggcaatacagtggagaaaggacagtcttttcagtaaatggtgctggaacaactggacatccacatgcaggaaaaaataaactagaatctaaaccaagaccttacatctctttcacaaaaattacctcaaaacggatcaaagacctaaaggtaaaaatgcaaaactgtaactggtgacagccagaaagaaaaaataataattgagtgactactagtgccagctatcgagttaagtacttttaatagcttatcgcattgattctaaactctgtacacaatgtattattcccaaattgcaaatgatgaattttttgccagtgataaagtataatttctctatgttattccctatagaatctggagcaggagcctcagtctcctatcaaaaggagaagaacctgaagaaaacacttctcttccttctctctgcctaggggcagtgaccttggattcaaccaccatcatcccttccagacaccagaggggggagtcccacaaggcagaaggtgcccctgtgacccatccacttctcttccatgttctttacctccttgctcaggaagccataaagttgagctgagtggaaggtgaatttcattgcaaagtttacacaggctctgctgacaggttcatgaaaacactactgaatatgttacataccaccaaggctcacagcacatcctgtgttggaagtgatacttttccattaccagtaaacctccttttgtcctaggagctcactgaacagctaaaatcaggtgatatttttatgtggaacatgcaacgtattaagtccttttgctcagtgacccaaaaaggaactaaacggtacccagactagaaatcaatgtcaaattattcaaataaattccacttaaagaatggtggtttggaaagcgctcagtcagaaagaattctcccaagattagtttactgtgaagtagaagggaagaacgttttaactttggttggaaatctgatgacattacatagaaggtgatgaaacatcctctaagaaacggttctgatccattgtatggcacccccctctcacattcccccattttacccactaaagaagttcttttacaagaggctaaggaaaccaagcaatataagatctaatcaaaactgagtgctggaaatgtgtggggagaaatccataattaaactgagcaattaactccagaaagttaactggggccaactctgacactgctataaagttataaaatctccagcatctcatttctttgtccctctacccaatttcccctcaaaggtaagcctctctttctctctcctctcttcttcatatttaataaaactgtttgccagaaaggaaagaatcttaggttagtcatttacactttagtgcgaattaaagccagtgtgtcaactctcacaggaatgagaatttcaagccatacttctaattgtggaatggctgtcattgaattcttttaagggtatttcatggaacaactaaatataaggaagaggagagaaactgcccaagtctgcctatgcctaaagtcagccttaagttcaatcttgagggtgacagctttcatctgccactcccaattgaaagtgaattcagattaattcctagatgtttgtttgttgtttttttttttttttttttttttttttttttttttttgggacggagtctcgctctgtcgcccaggctggagtgcagtggcgggatctcggctcactgcaagctctgcctcccaggttcacgccattctcctgcctcagcctcccaagtagctgggactacaggcgcccgccactacgcccggctaatttttttgtatttttagtagagacggggtttcaccattttagccgggatggtctcgatctcctgacctcgtgatccgcccgcctcggcctcccaaagtgctgggattacaggcgtgagccaccgcgcccggccaattcctagatgttgaatgagagttataatttatcctttcaggatctactggttttcttttctttttttcttttttttttttttcagacagagtcttgctcttgttgcccaggctggcgtgcaatggcatgatcttggctcactgcaacctccacctcccgaattcaagctattctcctgcctcagcctcccgagtagctggcattactggcatgtgccaccatgcccggctaattttgtatttttagtagagatggggtttctccatgttggtcaggttggtctcgaactcccaacctcaggtaatacgcctgccttggcctcccaaagtgctgggattacaggcgtgagccaccatgcctggccggtttttctttcttttttacttttattttacgttgaggggtacatgggcaggttatgtaggtaaatgggggtttgtttacatatattttgtcactcaggtactaagcctagtacccaatagttattttttttctgatcctctccctcctcccaccctccagcttccaaaaggccccagtgtctgttctcctctttgtgttcatgtgttctcatcatttagctcccacttagaagtgaaaacaggtggtatttggttttctgttcctgcattagttttctaaggataacggcctgcagctccatccatgttcctgccaaagacatgatctcattcttttctatggttgcatagtattccatggtgtatatgtaccatgttttctttatccaatcagtcattgatgggcatttaggttggttccacatctttactgttgtgaatagtgctgcaacaaacattcgcatgcatgtgtctttatggtagaatgatttatattcctttgggtatatccgggatctactggtttcaatatccacctcttctcctctaggcccagaaaacaggttaatttctgatggcttttaagtgtcagccctataggacccattctcacttgacaccaggtatctccactccagatgcccttccccctaccaggttttacttgaaaagcacaacatgagtggcttgggccaaatgtggccataggtccttcaacaaatgttgagtgagtgtgacccttggagcagaaagttgacagggatctgacacatggctcgtcccccagaggctctcactgctctcttagctggaagaacttcaaactctcagacagtggaaaattcagtctgttccaagcaggagacacaaatgtgctcttaaaattcatactggcgtttggaactgcccagggtattataaatataatcgttctgaagtgtgagtgtgtgtcagggagagaaagagatggagagagagagagagacagacagagtgtgtgtgtgtgtgtgtgtgtgtgtgtttgtgtgtgtgtgtgtgtgtgtgtgtgacgacagaaaggaaagtgagagcagacccagggccagcaagtatccatgccaagaacacaaggccaagcccagagaagaatgtccaccagatgcccagtgactacattttggattttctactgcttcctcctcagagaaaaggggggaaataaattagagagaacgcaaagggagagagagagtgagcaagatgggtggggatggagagagaaaggaacaggaagtgggagccttactaaacatagagcaagaggcccagactgagagagagaggctgtcagaatgaggaactactgagagatcacaggcttctccaccagttacaagtgattaatatctacatttattgtgttttgaagccatcaagttctatgtccaaatgaccccacccctcccataatgcagcaccaagactaatccaccatccacagggcattctgtttcctgccaaacagatggggcttattgaggttggtcttacacagcctcttccaggtcttggacacacgctggccagcctctgtggctgaggaatagaataaagttaagtgaactgaccctacacgtgggcccctatgaccttcattgctcttgaactaactgagctgaccagccagcctgaagcaacatggccccagggcaggggctcttaaccttttatgcaccaggcttcctttggcaggctggtaaagccacagactcccttctcagaataatgttattaggcataaaatgaaatacataaagctacaaaggaaatcagttacaacatcaaatattttaaagattacaaatacagtaatatttttactcttttatcagtgctttaaataataggatctggtgagaggtcaaataacaaccatcatttcaaagagtgatgagagaaggagtgtttccattgtctacaacaactaccaggtgatatgaaaagatctgttatttctgtggcaagagtcataggcgctgctaataccagtgcagtttcttgcctacattcttaatagaaacaaaaagctagatttcagtgagaggttagataaaataaagatgcaatttttccccatccaaatttatgaaccagaacaaaggcaataaaaggaagggagctgcaacaacagtaatcgtagtgacaaagcaacatctgctacaagaacaacagcaaaaaatggctgccatctctgctctgtatcaggccctgggttaaatgctttctactcatctttctctttcattctgagggaggcatcattttgcccactttacagatgaggaaactgaggctttaggacattagggaacttgtctaggaccatagccaataagtagctgtggcaagaatggaagtcaaggctgtctgacactgaaggccacattcgctgtgcactgtgtcttcagaaagagatagggtgtgtgtgtgtgtgtgtgtgtgagagagagagagagagagagagagagagagaaagctgtttcctttttctcattcatgccagaagaattggactggtttaagcatctatactttcacccatcttgactatccatttccatctttttaatgtttgctcttttcagttcaaagacccttatgcttcatacattcatagccagtacatatatgttgggtactggctatgtttactgacaccaaaaattcaaagataaatatgttctctgactttcaggaagcttataacttattggagaaaacagatatgcaaacagataaattataatatgcagcaattagaattcaaggtaatttgcacaataaggagaatttattgactcatataactgaaaagtccagaagtagacaggcttcaggcactgtttgattaggtcttcatcagcagtgtgctaggaagtatgtcacaactaactgactttccagagaaaaaagagccatgagtttgtctatttccatggtgtaaatactcccaccacgacctatttcaagctaccaacatgaagtcactgaagatagaattaggaagagatgtgcgcagtcaccccttgcctgatgcaggctagctccagcatgctatgaccattctcatttcttcacagttctctcagtttttccatcctctgtatgctggttttgtcctgatgatgcaaccagcagctgggactgtacactttccttctagtgtctagcaagcttctcttctactaatcaccaaaaaaaaattcctgagctcttctgaaagaatcgctgtatccaaggaatatcacccagctggcttagccttgggtggcatattaaaataagcaatagctaccttctctcaaggctcttcatttcacctatcaagtactccttgttggacaaagctacggtctgaatgttcttgtcccttcaaaattcatatgttggaacctaatacttaaagtgatggtattaagaggtgggggtctttgaggaagtgattaagtcatgagggctccaccctcatgaatgagattactgccctcataaaagaggttgaagggagtgtccttgtcccttccaccatgtgaggtcatagcaagaaggtgccgtataaggaatgggcccttactaggtgccttaattttggacttcccagtctccagaactgtgagcaataaatttctattgtttatgaattacccagcctaaggtatttgggtatagctgcctgaatggactaagacaggcagaattagcaccaaaaacctatcctctagaaggtggaattatcagcaagacaagaaaatgatattcttgtttacccattttagtgcctgtgtcaaccagatgttcccttcagaactgagaccctcattttcccactctggaagtattgatggctgatggctcacagctgagttcctcccaaagcattgctctgaccaaaaggagctgccagactcgaggatattgtcccccttaagaggacactgcctctaatggctgatcaatgagtgagtataaaagcctgaggtcacctcaattcaggcatgtctgaaggatcatcctggctccagcgcttccaaaggggaatcagataaagcctctgttgaaatcatatactgggtcaatttctccctctgtgccatcatccttccctctcttgcctacatcattcctatgtgtcctccccactaaacctcctgcatgcaatctcagtgtcggtttccatgaaactgaatattcaatgcctatctctaaacaagtcaccagatgttctagacaaatcagggcccatcctggagctgggagtggaatcagtcccacccacatcccatggctgccccacggtgggagagggttgggatgtatcttgagaaataactgcactgtctgctacataataaggcatactgggtgatgtaaaagacgtatgaacaatatcacagtccaatggctgagccattataggcatagagaaagaaaaaagcaggccctgacatccagaaatagtcaccggtagacctcaatattattacaagctgatctgacactcacagccaggctatagttctcctgttggacatagacaatctcacagaacaccaacctcagacaagcttattctgaaccacgataaaatgaaacaaaacaaggtcactacctaattttgtccatgcacaaaaacaaggtcactctgccccctgtaatgcactcaatcatagaattgcctggatttctgatggtatctgacctagagcaaatctttaatttcttaagccctccacaaatcacccaaccaaagtccaaatcttctagtagtttctttctaacacagttgctaagatagtgtccttaaagtatgttctccctaaatcaatgagtagtaagcccagcttgtttaattatcagtgtgttcctggtggtctttggctggagggcattggtagccttcaatcagtgtttgtatggtgaataactgggtgtgtaaatggctatgttgcccctctttcaagaaaggcttaacagaagacctttgagctggttcttaaaggaagattgagcttttccaagcaaagcagggtcagagagaagtcattccaagcaaaggaagcaagatgtgcaaaggttggcatcactgaaatgaaggatgaagagtccatatgggtggggtgttgggtggaccggaagggtgctaggaccaaatgtggatatccttgtaagtcacaactaatcttttaggcaaagaggacagagaagcaggagagagacagagagctcgaaatttgaaatctgattgcagagagtattactggagtagccataactatttttcctccaaccctttctttcttttttggagagaaggagaagacatttgctttggttgaagcaaaattgcatattttgagttttctcagttttcccaacctgacatttaaggcgcacacctaacaacactgagcccttaattccctggatattgtgaatgcttcgaagacatcatggccttctctcaaaggtttgataacttgcacttcactatataattcctcttgcttgtcagaagtgcaattcagctggtcacttcctctgttatttataattaaatgacttaccatacattccttaaaagagacttccagatgccctgatagaaaatgccaatgtcttcccacttccttgtgtgtgtccacctttgactctccattcgtggcgcccccaagatgaccttcatcgtctaggggtcttatctctaggacctcccaggccgtacgattcctgcagtccctccgtctgtgtttaagtcttgcttgtgctccacaaaatccttctgccttaacagccctacagctgcacggcctcctcttctgttcccttctgtctgtcttgccctgccctgccactgagcactcagattttataacatcttgccttgccaactggttttgtgagtatcatataagtatctgttaattatagatcttttacaaataacatatacctgatacagctgaaggagactgaaatgtccccactcttacaaatccatgttagtgctgccctagactacccttaaaaagaattttgtgtatatttgtgaaatccacattttctacttttactctctctatatatatctcaataacctatgtattactttgtgcttttaaacataaagataatcatagtgttgtatcattttattctatgctttttatactcacaattatgttttaagattcagttttgttaatatatgcaaagcttttagaacagtgcctgtaaacaccatataagtattagctactattattttcagtattattattattgttattttgaggcagcatctcattctgtcacccaggctgagtgcagtggcatgatcacagctcactacgcctcaacctcccagggtcaagtgatcttccaacctcagcctcctgagtagctgggactaactacaggcatgcaccccatgtccagctaatttttgtatttttggtagagatgagatctcaccatgttgcacaggctggtctcaaactcctgggctcaagcaatctgcttgcttcagcctcccaaagtgctgggattacaggtgtgaaccaccacacccagcctattattttcaatattattaataaatgtatttacatcattccttgtaattatagtaagctaacattgatcatacaacattttatttatcccattcctctcttgatgtgttgggacttagaaaacgacaccccagagtgaaggcctctgaagcaaagtctctctctgaccttctcctactctcctgtctcttgcccctcattcttccctaaggcaagccatagaaaatgtgattcctcttccccaaggcagatcttagaaaccaaaacagattttacatgaagccagtcataaaacctaaaaatattactgtaatcttcccctgcctttctgtgtaagaactggctgcaaagaaattaagaccctcgtcccagagggttcctattccatacctgggagaaagaaatgctgcacagagaggccaagaagaagctgagctgacggggcttgataggtatcgcgactcggtctatttccattagattattcctgtttcccccaattgtagttctacatggctgtacattcttcattgaacctaagcataaaaaaagggatcaatttttcctggatctttggtctccattctgaagactctcatgtctcataaaactgtgatcaaataaatgtattatgcttttctcttgttagcttgtctttgttataggggtgttggccatgacccttatgacagggaggaaagggatcaccttctttctgcccctaaggtacatatttaggttgtttccaatttttcacaattaattatcagcagtatcccaaagaatatccttaaatatgccatgttcatatgttcaagagttggtatttgcttaaaagtggacttgctgggctgtaaggagaatgtattttaggttttgctagctattgtcaaattgtttcccaaaatgtctgtaccctcagcagtgtatgagaattcttatttttctatctttgccaaccaccactgattttttcaaaagtttgtgagtacaaagtaataatcttgttttaacttgcattcttcttttcattaatacgtgatatttgtacattttttttctctccatttattggccattatgcactgggccttaacctttgctggggtcttagacgcctttgagaatttacttcagaaaaatacacacatatatatatatacacacatacactttataaacacattgaggggcttcacagagtccctgaagacccatccacaaagccccttcagagcagagactctcgagcttttagtagatatgagaaccttctgggaagtttttaaaaatgcagattcctaggacccatctttgaggatcctgactcagagggccctagctaggaactgaagggctggtgcaggtgattaaaaaaagaaagaaagaaagaaagaaagacaaccaagactatactttcaggggccatttctgtagttcgttaagaaagacaatcttgagtttctggattcccagtaagaactcctatttctgctttccaaaacgttcccttctcctacagctatgaagcaaaggataaagtcaccaagtttaatgtactaaagctgtaacttgcctttaaattgatgctgtagctacttttaaatccatggttacttctgcagatataccttgtgcctctctcctccttagctggaaaggtcggtgagggaatgaataaatagggtgacatgtgagacaaagaaaaacacaaggaaaggaaaaaaaattaggaaattcgaagctattcagaaaatgctacataaaaagcatcatcctactaaatatgaacagcttgtgtttggaatggtttgtgtttctaattttatttcatgagcaagctcatttttttttctctgccagatacttcaaagattctcttgcaaaaagaaggaaataaatttattttcctcttggatccaaattcacataaatgattctgttgtaagatgaagaaaattgattgcttcaatggcaaataagatacttttttaatttaaaaatttagtactaaggaaatcatgtgccagggaattctcaaaacattttgagagaggttgagaatcccggtatgatgagatgatgatgttactcatgcacatattcccccgctttctttttcaagcctgcaagtgtcaagacagagttaatccttatttttgactcagtcacacgcaaatgcgttcttctctgagctggtcagtggccagtatcctcttgaacctttggtggaattcaggtccgtgaatgatgccaggaacaagaattaggatctgattctaggactttataatgactcactcggtacctttgtccagtaacaatagaaaaatgactcggttgctctatccatgaaactagggcagtgatgctggctgcctgcctcacacagggttgaggggaaaccaggcttacaaaatgacagaggtctccggagcacgggcatcacatgggaggaggtgggggtatcttcacagagccagaagacaacagagggggcaacctgacacagaaccaaaggaggtccttgaaccctgccacaccagcctgggtggagggtattctgtatacactgtatacactggagaacatggaatgaagtcaacttacatcttttgtctttctggagaccatctttttactttcacacattactcatggattaagaagaaaagtggtggccatgacattttctaacattttctggtatccattatcttgttcgcttggccatacagtgcttcttacactctagattttcagattctagacagtatgttcattaaaagcaggaattaaaattgacatatagatatacatagacgtgtgtgtggtgggtaaggtgcctggcactcaatataaacactggatataataaatgagtgaattcctacacacagaaaaacacaacacacacaaacacaaataagtcagcatttttccaggacccaagccacaaggaagaagatttggggagtgggagacttctgctgccaacctcattcctgcctgtattatttaggatataaataccattgcagtaaaggagactgagtgaccataacttaaacaaaatagaagtttgtttttctctcatataacatggctgctctgtggtatcacaaccccaagttccttccacccttcttagagtgttatctccatctgcatggtccatgtagctcaccgcagcatctgcatcccagctgatagaataaggaaaggaaggagagcatatcttccctttcaaaaaggctgtatttcttgggccagaacttagtcacatgaccacatctagctgcaagggaggctgggaaatgtagtctttattctgagtagctgtagatccagttgaaaaataagcattgtcttaaaaaaataaaaaataaataaatattgggggaagtaactgtccctgtcacactgaaaaaataaaagcacaaagatgtaggtttctcagaatcactagaaaaattcccagtaaacctaggactagtactaggctgggtgcagtggcttgcacctgtaatcccagctacttgggtggctgaggcagaaggatggcttgaggtcaggagtttgagactagcccagtcaatatagtgagactctcatctctaaaatataaattagccagtcatggtggcacacatagaacaagatcctatctctaaaaaggaagtagctaatacttagttggtctcacaagcatgtcaatctactaagcagatgttcactccagagaaagacagttctcaacttcttacatttgccttttaaacaatttacactttcctctattaatctctgataaatttaagcttcatttcccataccaaatttgggttttcatactgcaggtagaattttatattttctgacctctaggagaataaatgcccaacctgatcaccacacatacaaggctagaagatgaatacatttggtgtgaaatcagagatctgccagcattcagcttgggaaataagaataaaaagccaaggagcctgtccagaataggtaaggttacgaatgatcagacaacctaatagtgataattaacgtaaccataacatagttaaaatctatggaggacttactttgcatcaaatgctttgcccacatcattttatttagaattttcttttaatgttggagggtgtattagtctattttcatgctgctgataaagacatatccaagactgggcaatttacaaaagagagagatttattggatttacagtttcatgtggctggggaggcctcatagtcatggtggaaagtgaaaggcacatctcacaaggtggcagacaagagaagagagcttgtgccgagaaactcctgttttaaaaaccatcagctctcctgagacccattgactatcatgagaatagcaccagaaagaccgcccgatgattcaaccatctcccaccaggtccctcccacaacatatgggaattatgggagctactagatgagatttgggtggggacacagagccaaaccatatcagagggctatcctgttactaaccctatttatagtcaaggaaatgggcttagaaaaaagttgaggaacttgaccaagatcacacaaataccaattgacagagcctggaccttaactcaagaatctaactctactgttggtacctgaaatcactgatcactgtggagtctcaattaaagaaaaagacaggctggtgggagcagggaaaagcaacaaaaaaaggcaaatacactataagtctgcctttcttcatggtccaggacatacagacctcctgtgcaaataattcataatcttcctgtgtccagctatcaccagaccctcagctaatacaaaaaatgcaagttagctccctgcaaacttggtattagcagtactgcacgtagcattctgcagcccaaaaccgtcctataaaatctccagcaagcctttgtctcctggcagtcagcttctgttctgctgatttgcccgttgctttcttgcaatgtattttcatactttctctaataaatttacctttctttatctacaactgtcttggtaaattcttttacctccacgccactggcccagataatcatcactccccagcaataatctctaccactacgctgatggcaaggaggacagtgagcaatgtcccacgcatccttcccgcccaccatcacatggataggtatcaatcttgttgttcatcctatctgggagtattgagtttggtgacctaaaaaagaatataaaagttccaaccatcagtatttaagaagtgatctcagaaatttacttaaatctccacataacctttgtaaaacaaaaaaatccagaaaaaaattgaaatatattaaaagagacttcaaactttgatgaaaatgttttgtaattactaaagtttacaaaatctacactattgcagatggtcatatctacaaactactcttttatggcacttactgctattggaattcatcacgtaataatttgtgtaagtttaccttgccagtggagagaagactccaagaaggtgtttgttcctaaatcgggaacagaataggtgtccaataattatttactgagtgaatcaatgtttttctttcaacatatctttttagaattatttgccacttattagaaatagttaatataaataattatattattagatgttgctgtgcttcaaaatttgatactaagagcttgcactataaaaagttttgcttaatccgtgttaacttatcacaggaatttaatatcccactgacttgtgtgtgtctgtgttccctgtgggatttcatttctattaataagtttgtttactggactactttttgcccccaacatttcgtgtggtcggttttaaatttgacactgctggatatgaaggagtcaagtcattaagaactcaaactgctttagaacatggtaattatgctccaagtggaatgaaccgtggatccatctgactttaataaatccattcttgaaaagaaatctcttctccctgagatatataattaatgtaacatgaagtctaaaactaaatttctccccagaaattccaggtgaaaatttcaggacactttttaccctagaattttgattcttcgtcacataggcagacagattcttactaagtatgcacaaatgcttaacgggcccaagagactttgacttccttaaggttttctaaatggttgctctctcaaatgcatgttcatgttactgtttccttttgtgagcaagccctccctccacagctccctctcaatccagcctttcagctgcaggattgtaaagaactgaggattccccaatgtgagaattgaccaagagtttatataccccactaccttttataggttgtgggagccattcgtctcaaaaggagaacagcgccctggtgtctttgtgagtttgcatcaagggctcctcactgaacagaatgtttgctagaaaaagacatgcagattggttagctagtttttttccatgaagatttccccccaccccaactttttattttgaaaattttcaagcctacagaaaagttgaaagcacagttcaatgaacacccataaacctttcacaaagattaatcagttgttaacatttgtcatgtcccaaagaacattttctacctctttacatatctgtatgtgtgtgcttacaaatatagaaacagggtcttgctatattgcccaggctggagtgtagtggcaattcagagccccaagcatggctcactacagtcccaaactcctgagctcaaaagatccatgatcttcaccttcctgagtagctaagactacaggcatgtgccacacacccagcgtgtgtctgtgtgtgtatgtgtgtgtgttattgaaccatttgaaagtaagttgcaggaatcatgatgctatacccttaaatacttactcttatttgtcctaaaaaaaaggatactttcctacatagttataatatcattgtcatacccaagaaactttcctttgattcaataacattatctaatatacagtccacaatcacatttccccagttgttctataatgtattttacagttgggtttttttaggggagtgcctatctgtattcattcaagattcatgcattgcatttagttatcatgtacatttagtctcttttaatctaattctacctacctccagccctgcctttttggttttgctctgtcctttcaagttttttgaagagtttagggcagttgtctggcagaatgtgccctaatctggttttatgtgattgtttccttgtgattcaattctgcttaagcaattttggcaagaatgatacaatgagatgctgttcccatgaactttgaataaactcaaggacagggattttaccaagcctgagtgatcagattcaaagaggcttaaaaaaaaaggcatttttgaagatgagaatttagtaagtatatggctcttcatagcagggtgagatgtcccaagcaaaatgaaaaaatggagcttctaagattagtgtccaagattattcatgacttgaaagaggcccttgttatgtcaaatctagcaacctttgttgaatcatcaggactgagatttgggcagagtcaacctctgctgttgtaaagtggataattactaacttggtgcaatttcaggaatgcagaggccactcttccccactcagctacactgcctccattatgggagtggtgacgcctgtctgctattattaaagatcagagctgctctctaatgactatctactatatgtcaggccttgtgcttagtggtttattaatctgttccttacaaaaacctcatgaggtaaacattattattcccatttcctaggtgggaaagtgaggcttaacaatgtaacttccccaaggacccaagcagctaatttaagatgtgaaccaaaatctccctccataactaaagttccataattccatgttccatgtgatgctcctctattccccagtcccagtcttacctcattccctaaatggcttttccttctctctctagagcatacattacactggacatctgattaccccattttatgccaatagatccttctacaaatgctaaccattattgtgtgtgccaggtccagtttgtgccaggcaccttgctgaatgctctacacacccaaactcatttactcttcccaagaaccccagaaggaaggtgtgcatcagtaatgtcctgtgaccactctgatagtagatggcagaaagagaatctgaaccagatctgacttcaagcctgagttcctaacaaagataggaagaacaaggcaaccccggatgatacagtagccagacacttgctagtaaaggccagaacactgactcactaagctctgaactcctctgcccccatgctgccaggggcacaaccccaacagactgcccagcacactgccctaatggccattgactcatctgctccaacgagcaagtcactgcacaaaactcctcccccacagaaaggtgttggtcctccggcattcagaaagaaccaggagccaacataccactcacaggaagaaaacgcacacactgtctctatttgttattcctcctacacaaactctttaaaatgattgagtttaataaaggaagatgtttccctgcagctgtagagaggaaatgttctaaagtaaaaatcagaacacagtctgactaggatcactatgcctatagcaaggatgtcctcaagcggggaaaatgaactcggctaaatgcatccagtctgttcctctggcccttctaatgagcaggacctgcagaaggcgaggaaggttatggtcgcacccataaacacctcttggaggcacctgccttatccatgccccgttctttcacaagtgcaccccactcccgaccccacttccctgacaaagctgacagcaccaacagtagacgcctgttagggcatctttcctagattctctcctagagactggtatttagcaattcctgctcttgaaggttcttgaacttagagcagtagaaaggccaggaggaaaagccagtcttggctgagcagaataaagcagcctcagtgagagatgagatgagagacagacacgagcccaggtggacccgtcacagccccgtctcaacaccgcccagtgaatctatcacacatgcctagtacatttgtctccccatttccaaaatgaacattctcctctcttgaaaccccagcccacccatgcccgccctacccttcctttgagtcctgaattgtattccttattgccttctccgggactcctctgtcataattatgccccctcatggattattcccatgaacatagagtaatactgcccatcttttaaaaacaacctccagctgggcaccatggctcatgcctgtaatcccagcactttgggaggctgaggcaggtggatcacttgaggccaggagttagagaccagcctggccaacatggtgaaaccccatctctactaaaaatacaaaaattagccaagtgtggtagcacaagcctgtaaacccagctactcagtaggctgaggcaggagaatcgcttgaaccctagaggtggaggttgcagtgagccaaaatcgtgccactgcactccagcctgggtgacagagagagactccatcttaaaacaaacaaacaaacaaaaacacacacaaacaacctcccttttccacacattttcttctagcctccacttcattttctgctcctcttcaaagcaaagagttgtctctatttaccaccttcacattttaaaaaattttctattctgtcttcagtccactttagccaagcttctttcccaatcaccttgttgaagtcaaaattaaaatatagagacaaatctctacaagtaatgttttctttggcaagaaaggatcccaatgtggggtgtacacacagtctggttggtttttggtatgtccaaagaacaaatagaaggttggggattttataaaaaagagagaggattgttatgtgtggtcctgaaagaaagttcattgtgattagcaaagatttggggagctggcaagctccaattggtgggcgagggtggtgggcaaagttagtcctagaattgcagcaagttatcttagcagctgtagataaaactggtttcaggttacaaccagcagtttcagctgctgggcttgcagaaagtaacatttctagagcaagttgagcatgacaagaatgacccaattcatatgatcaactttcacgaccccatgaagactggtgtcattaaggttactaatggctttgatgtttgcctaatctaaggatcacacactagtcctttctcacttggatggcctgcagcatttgacaaaatgatgatcattttctcccatgcaagatttgcatgacactcccttctcctggccttccttctccttttctgcctccttttccatcgcctttactgtgtccatcttctcttgttctccaaatattgagggaagggagagtgaggcaggaaaggaaggaaaacaaacacaatgttgcatccctgagctggctttctctcaggatcatgcatggccagttactccatgtcccaggacttttcgtccaagagaccacaggaatgaccacatctgagcactggctgtccaaggagaggaagagggaggaatttatccaccagctcccattccccaatggtcaaaagtttactccacagggtgttaactcctcctcacttctcagtcacttctacagaggcattgagcacgtttctgtcatcaataagaaatccccgagatggaaagtgacacccacaaaaggtcagtgggagcaacacagagccagccacagaggcagaacaaatctgcaaggcccctgaggcacgtgagcctgagagcacctggagtagctcatgacaggtgtctatgacaccccagtcctctgtgcacaacgccagacttgccaacttcacatttcctcatgaatgtctaataggtatgtgaagctgaacgtggccaaaagagaacttttcttcctctattccccaacttgctcttcctatatcttccctatcttggtcagtaacatcttaatccagctagttgccaacctaaaaagtgaagggttactatagacccctcttgcatcctcaccccactcatctatcagtaggtcttgttggctccagctacaaaatgtatcccaaatccatccacttctcctgtctatactacaaccaacctaaccctgcccatcaccatatctcagatagattctgcttttcttaactggtctgcctgctctttgtccctctaaaacacagtctccacacagttgcaaccagagatactttcttttttttttttttttgcaacatctcattatttaaaaatttcaagcatatatagaagtaaaaagaacagtaaatcaaaacccccactacccaccattaacaagcatccaatcatggccaatgtcattcacctctatctctaattttgaggtaaatctcagatattacaccatttggtctataaatgatctgattttgcatatgtttgcgtctcttaaagataggaactttaaaaataaccacatctaaggaaaaaatcaataaaaattccaattaaaaaaacacaaagtgttttttttgtttttttttgtttgtttgtttgtttgttttttgacagggtctcattctattgtccaggctgagtgcagtggcacaatcatggctcaccccagcctcgacctcctgggctcaagcaatcctccctcttcagcctcccgagtacctgggactacaggcatgtgccaccacacccagctaatttttgtattttttgtagagacagggtttcaccatgttgccctgtctggtctcgaactcctggcctcaagctacccacctgcttcagcctccaaaagtgctgggattacagacatgagccactgcacctggcccagaatggtcttttcaaaaagtaaagcagaacatgtcatttctttgtgaaaaccttcccgtggcttcccatcatgctctgaacaaagccaaactccttcttaagactgctttcacatggctcctgcctatgcctctggtctcatttccagccaggctctccctgtccgtgcacaccagccaccttcgttcttccctgggagcccttattctagtcgttctctctacctaggaggctcattcctgtcatcttcctatgcttggctccttcttgtcactcaggtctcagcttatataaggacatctcttatcacctgtgtcaagtagccacccagccctcgccacatgactctactctaattctcgccatagtcttttgcccatgacatttccagtgtgtcctggacaggtttactcttattgtcaagcatgactattaatagcacctcattcactctcaaaagtaggcaacaaggctggacacggtggctcatgcctgtaatcccagcactttggagggccagggtaggaggattgcttgagcccaggagttcaagaccatcctgggcaacatggtgaaacctcgtctgtacaaaaaatacaaaaattagctgggtatggtggcacatgcttgtagtcccagctacttgggaggctgagtgggaggatcccttgagccagggagtttgaggctgcagtgagctgagatcacaccaatgaactccagcctggtgacagagcaagaccctgtcgcagaaaaagaagtaggaaacaaattttatgatcactctacttataagaaacttatttttatttgactttgactagcttatcacctatctccttctatgaggatataagctctttgacaggaggtctctctgattagttctttactgtatctacagtacttggctcataggagatgcttgataggtatctgtggaaggaaggaagaaggagggaaggaaggaagcaaggaaggtaggaaggaaggaaggaaggaagggaggaagggaggagggagggaggaaggaaggaaggaaggaaggaaggaaggaaggaagcagggaagggcatgaggaagggaggagggtgggtgggctcaggccctgacttttcagttcctggtttcagacatcttttgtagtacgtactgggcttccataatctcccgttaaaattcctgttttgcttaacatagatggaatggttttctgtgagttataaccaagcaattcttgacacctgctgatttcttttaataaattgtccactttcctcttcatgctatactttacttctagtgaattgctttatttaataaagaaaaagaaacttttatcagcaccatccttttaaaaagtgttttctttaatcgtaagctgttgagaagtctggaattgcaaacaaacaatcctaatacaaggtaattctttctgctccaaaatctacaataaatattagtgacactggcaataaagcttcagatcctgattatgcatgaacccgtttttacaaaaacgtttcagtggaagatataaatgcattgtcaaaacagcattaaacccttgaaataagagccagattttttttttataattcaagtatgtaaagcatgtgtattgccatggcctttgggtcattccatttcaggaaattcatgctttaaaatagtcattgtcaaataagagccattcttggaggaaacgaaaggttgggtattattcattcaaagagaacaatccaaatatcaaaactcattttgttttgtttttaataggggatgctgggggttgggggttttctctgaacttcagataacagataatgacaggaatgttgattcatagtgcacaatattgagaaaaaataaataagctcattccccaagtaacagtaacagtctttgaacaaagaatgaggaagccaagcatggaaggagataaagaagttttactaaagaaatgtgccccataccacttctccaacctcagctctgctctctttcccaaaagaaaagattatatttaacaaccaaagaaaattagaagatcatcgcacctccttccagtagcccacccccaaaagcaacaagtgccatttctgtaagaaaggcactataaattcatttatttcatgaaaatccattgtactgaaatgtgctaggatttggatgtacagtgtgagtaaaacagacaaaatctctgctttcttggggcttgcaatcttcttgaaccctcagaaatggcccaaatcccagcctatgtgatttttccatcaaggaggcagcattccattggccctatagtcagtcaaggggcctgggtgaaaatcctggctttacagtttacgagctgggtgatctcaggacagttacttaatctccctatgcctcagattcctcatctgtaaaactaagatggtaataacatctacctcatagggttgttgggaggattacatgaggtaagcaatgtaaagcagttagatcagtgcctgacatagattaagcaatatttaagagtttgccatttttatcattagtacagcaaagtgggattgaccaaaaaggtctgtatttagaacagttaatcaatgaatataatgcaccaaaacatccctgtacatagtttcctggtagccaggcccagacaggaattatgaggtttcttatttggagaaactgaatggctccagagaaaagaccttgatatggttaggctttgtgtccccacccaaatctcattttggattataatccttataatccccataatccccacatgtcaagggaaagaccaggtggaggtaactgaatcacaagagcagtttcccccatgctgttttcatgatagtgagtgagttctcaggaaatctgatggttttataaggggctcttcccattttgcttggcacttcttcctgccaccttgtgaagaaggtaccttgcttcccctttgccttccgccatgattgtaagtttcctgaggcctccccagccatgtggaactgtgagtcaattacacctccttcatttataaattacccagtctcgggcaattctttatagcagcatgagaatggactaatacagacctccataggatagcattcagaaatttctcagttcacaaagcattcagctccttaatttaaaaagaaggaaaaaaaaatttccaagtattgcggccaactccctgctgccaatcgtcctaaaacaactaccctcagaaagttagccccaatgaggtctgaagcatccccgctccactctccagcagctcacgcttcattatgcatgaagagctaagggtgaccagaactttgataatagagagacaccaagaaaagcaggcatctcatcagaaacaaagaaaacataagaaactgaagagaacctgaagcccctgaaagatcaggggaagatattgcaactataaaataacatcaaaattctatggggacaaaaaaaaaaaaaaaccaatagagaacaagaaagtttggggagcattaaaaataaaattgctcaaattgaaaattcattagaacagttggagaataaattaaaaagcacacacacatacacacacacacacacacacacacacacatatatatacatattagtcaaccctgttcccctcccttaacagtggcatcaagagtctatcttccctaacccacttttcttccctatcccgtgccctgggctatattagagtgctcttgacactagagacatctggcagatgaggctggaaaatgtccaatgagggatggaaagaaggagtgatggcagaagtggagcccaacttcatacctttgcagccgcctgggctcagtttctgctgcccctccctaggtgctcttcccctctgcatagaggcgacacctgatgaagttttcataagtacacaaacactggactggaattacacagactggttgtgtgtccaggctctgctatgaagtttccaaagaggcaagaagcatgtccatcagaacagctattggcttgcaatcttgttgtcaccattaaccaaaaagaaagtatcaattttatttgaatggcctttggcaatgttggtctgagaatatgtggcatgaaataataatgattactattaaattgattataagtacatacctatatcaactgatatataaaagaaatgattgagccaggcacagtggctcatgcctataatcccagcactttgggaggccaaggcaggaggatagcttgagcccaggagtttgaggtcagcctgggctaacatagtgagatcctgtctgtacaaaaatttaaaaattagttgggagtggtgatgtgcacctatagtcccagctactcaggaggcttaggtgaggggatcacttgagcccaggagatcaagtctgcagtgaactgttataatcataataataataataataataataataataaactgataatgtgaaagaaaagattaatatgtaaaggattgatccaagatctcaaacatttgataggagttcctgaaagagaaaaggaaggggataaaataatcaaataaagaactttttccaaggtttgaagaacataaatcttcagattgaaagaacttagcacagaagaaaaacctataccaaagaaacagcatcatgaaattctagagcatgagacacaaagagaagaaataacattcctacttcacacgatacaccaaagttgatgccaggtagattaaagacttaaacgtggaagtcaaacttgaaaactttaagaatagaatatagcatagtatcctcatgtccttaggatagagaatgatttttcaaataagacatcaaatgtacaacatataaagaaaaatctgtggctgagcaggttggctcatgctgataatctcagcactttgggaggccaagactggtggattgcttgagctcaggagttggagactagcctgggcaacatggcaaaactccatctctacaaaaaatacaaaaaaacggccgggcgtggtggctcatgcctgtaatcctagcactttgggaggctgaggcaggagtttgagaccagcctgaccaacatggtgaaacccactgtctaccaaaaatacaaaattagccgggcatggtggcacgtgcctgtagtcccagctcgggaggctgaggcagaagaatcacttgaacctgggaggtgtagattgcagcgagttgagatggcaccattgcactccagcctgggcaacaagaacaaaactctgtctcaaaaatacaaataaataaaaataaaaacaaactagccaggcttgctggcacacacctatagtcccagctactcgggaggctgacgcaggaggatcacttgagcctgggaggtcaaggctgcggtgagccatgatcgtgcaactgcactctagcctgggtgatagagtaagaccctatctcaaaaaaacaacaaaacaaaaaacacccaaagtgacacatttgactacattaactttaaaacttatatttaatcaaaggagtctgacatgatttggatatttttcctgcccaaatctcaaattgaaatgtaatccctgatgttggaggtggggcctagagggagatgattgggtcataggctcagatccctcatatcttggtgcagtcctcatgatactgagtgagttctcacgacacctggttgtttaaaagtgtgtggcaccttccctccctctctcttactcctgctctcaccatgcaacgtgcctgctcccactccactttgtgccatgattgaaagcaccctgaggcctccccagaagctgagcagaggctggcacaatgcttgtacagcctgcagaaccatgagcaaactaaacctcttttctttgtaaattatccagtctcaggtattcctttatagcaaaacaagaatggccaacacagagaacatatcaaagctgcgtgattgttcactcatccttttgtcctttcctcctgtactctgactgcagttctcagccttacttgcagcaagtgtagccatgtgatgacatagtggtcaatgaaatgcatccatctgggacaaggcaccctccatcacttaaagatacacagctaacagggcgtgtgttttgttttgtttttgtttttgtttttttattctcagtgttcaagacatatttgaagggaggaggaggtagaggttgccatgagctgtgatggtgccactgcattacagcatgggtgacagagagagaccctgtctcaaaaataaaaataatatggaactcagaatagcagcatttaactgttcctagaactttctagaaatggtcatcattcaacttcagcaacacgtatgcattactactacttcacaccaaaatccccatagttgcaaataaaatatgaaagtgctttgcaaatataaaaggtaacataaacagaagtgtgctaagaggaaagaagtgctaaaaagagagtgaaacccacaaaaaacattattttaatttcagtaagaagaaacaattgcaatgtccttagcaattcacttaccctcacttgttcttcagtgtctaagtctgtaacatggaggtaataataatacctcccttataggattggcgtgacaattaaatgggtcaataaactttggagcttagaacagtgtctggcatttcagcataataaatagtttgtttttttaataatattgccttaaaaatgtcaatgctcacagccctcagtaaaatgaaaaaaaaagagaatgaattgagagaagagggggctgaaacataaaaggagctgggcattttttacaggcaatctgacttgaagcctctctacaaaattatgaagcagataacactgtgcctgttttatagataaggacaaagagtctcgaaactatatggctattaagtgtacttcaggcacattttcatttcattttactttttttcctccttttattttatttttccataatttattggggtacaggaggtatttggttacatgagtgagttctttagtggtgatttgtgagattttggtgcacccatcacccaagcagtatacactgcaccatatttgtagtcttttatccctcgcccccctccagtccttccttcgaagtccccaaagtccattttatcattcttatgcctttgcatcctcatagcttagctcccacatatcagtaagaacatatgatgtttggttttccattcctgagttacatcgcttaaaataatagtctccaataatagtctccaatctcatccaggtcactgcaaatgcgttaatcattcctttttattttattgctgtgtagtattcgtatacacacacacacacacacacacacacacaccacagtttctttatccactcattgattgatgggcatttgggttggttccacgattttgcaattgtgaattgtgctgctataaacatgtgtgtgcaagcatcttttttgaacaatgacttcttttcctctgggtagatacccagtagtgggattgctggatcaaatggtagttctaattttagttctttaaggaatctccacactgttttccatagtggctgtagtagtttacattcccatcagtagagtagaagtgttccctgttcaccgcatccatgccaacatctgctgcttttttatttttttattatggcctttcttgaaggagtaaggtggtatcgcactgtggttttgatttgcatttccctgatcattagtgatgttgaccattttttcatatgtttgttggccatttatatatcttcttttgagaactgtctattcatgcccttagcccactttttggtaggattgtttgttttcctcttattgatttgtttgaattcattgtagattctggatattaatcctttgtcagatgtatagattgtgaagattttctcccactctgtaggttgtctatttactctgctggctgttccttttgccgtgcaaagctctttagtttaattaggtcccagctatttatctttgtttttattgcatttgcttttgggttcttggtcatgaaatccttgcctaagccaatctcttgaagagattttccaatgttatcttctagaatttttatagtttcaggtcttaggtttaagtccttagtccatcttgagttgatttttgtgtaaggtgagatatgagatccagttttattctcctacatgtggctagccaattatcccagcatcatttgttgaaaagggtgtccttccatggactactacacagccataaaaaaggatgggttcaggtcctttgtagggacatggatgaagctagaaaccatcattcttagcaaactatcacaaggacagaaaaccaaacaccgcatattctcactcataagtgggaattgaacaatgagaacacttggacacaggaaggggaacatcacaccagggtctgtcgtggggtggggggagggggagggatagcattaggagacatacctaatgtaaatgatgagttaatgggtgcagcacaccaacatggcacatgtatacatatgtaacaaacccacacgttgtgcacatgtaccctagaacttaaagtacaataataaaaaatgataataataaaaagaaaaggttgtcctttccccatgttacatttttgtttgctttgtcaaagagcagttgactgtaagtatttgggtttatttctgggttctctactctgttccactggtctatgtgcctatttttataccagtaccacgctgttctggtgaccacggccttagagtatagtttgaaatcaggaagtgtgatgcccccagatttgttctttttgcttagtcttgctttggctatgcatgctgttttttggttccatatgaattttagaattgtttttttctaattctgtgaacaatgatggtggtattctgatggggattgtgttgatggcttttggcagtatgtagattgcttttggcggtatggtcattttcacaatattgattctacccacccatgagcatgagatgtgtttccatttgtttgtgtcatctatggtttctttcaggagtgttttgtagttttccttgtagagttcttttgactcctttgttaggtatattcctaagaattttattttattattttttatttttttcagccattgtaaaaggggttgagttctggatttgattctctgcttggttgctgttggtgcatagaagagctacggatttgtgtacattaatcttgtatccagaaactttgctgaattcttttatcacttctaggagctttctagagaagtcctaaggattttcaaggtaaacgatcatatcgtcagcaaacagtgacagtttgacttcttctctactgatttggatgccttttatttctttctcttttctgattgctctggctaggacttccagtactatattgaagaagagtggtgacagtgggcatccttgtcttgttccagttttcagagggaatgctttcaacttttttccccattcagtgttatgttggctgtgggtttgtcatagatggcttttattgcattaaggtatgtcccttgtacgccgattttgctgagagtttttaatcatagaggatgctggattttgttgaatgctttttctgcatctactgagatgatcgtgtgatttttgtttttaattctgtttatgtagtgtatcacatttattgacttgggtatgttaaaccatccctgcatccccagtatgaaacccacttgatcatggtggattatctttttgatatgttgttggattcagttagctagtattttgataaggattttagcatctatgttcatcaaagacataggtctgtagttttcttttttggatatgtcctctcctggttttggtattagggtgatgctggcttcatagagtgaattagggagggttccttctttctctatcttgtggaatagtgtcaaaagaattggtaccaattcttctttgaatttctggtagaattctgctgtgaatccgtctggtcctggacttattttgaaatggtaatttttaaattaccatttcaatcttgttgcttgttattggtctgttcagggtagctaattcttcctgatttaagcttggaaggttgtatttttccagaaacttatccctctcttctagattttctagttaatgcatgtagaggtgttcatagcagccttgaatgatcttttgtatttcagtggtgtcagttgtaatatctcctgtttcatttattagtgaggttatttggattttctctcttcttttattggctaatcttgctaatgatctatccattttatttatcttttcaaagaaccagctcttgtttcatttttcttttctatttttgtttttgtttttttccatttcatttagttctgctctggtcttggttatttcctttcttctgctggatttgggtttggtttgttcttgtttccctcattccttgatgtgtgaccttagattgtctgcctgtgctttttcagacctttggatgtaggcgtttagggctatgaactttcctcttagcgccgcatttgctgtatcccagaggctttgatagattgtgtcattattgtcattcagttcaaagaatttttaaatttccatcttgattttgtttttgacccaatgctcattcaggagcaggttatttaatttccgtgtatttgcgtggttttgaaggttccttttggagtggattttcagttttattccactgtggtctgagacagtgcttgatataatttcaattttattacatttattgaggctcgttttatggcctatcatatggtctatcttggagaaaattccatgggctgtcgaatagaatgtgtattctgaggttggatgaaacgttctgtatatatctgttaagtccatttgctccaaggtatagattaaatccattgtttcttcgttgactttctgtcttgatggcctgtctagtgctttcagtggagtattgaagtcccccactattattgtgttgctgtctatctcatttcttttcttaggtctattagtaattgttttatgaacttgggacctccagtgttaggtgcatatatgtttaggactatgatattttcctgttggataaggccttttaccattatatactgtccctctttgtctcttttaaccactattgctttaaagtttgttttgtctgatataagaatagctatccctgctcgcttttggtgtccatttgcatgaaatgcctttttccacccctttattttaagtttttgtgagtccttatgtgttaggcaagtctcctgaaggcagcagatggttggtgagttcttatccattctgtggttctgtaccttttaagtggagcatttaggccatttacattcaatgttaatattgaaatgtgaagtactgttgctttcatcatgctctctgttgcctgtgtactttggttttttggtttttgattttgctttttaacttgtatttttgttttatagatcctgtgtgatttatgcttcaaagagattctgttttgttttgtttcaagatttagagtttcttttagcagttattttactagtggtttggtaacggtgaattcactcagcatttgtttgtctgaaaatgactgtatctatctttccttcttacatgatgcttagtttcactgaatacaaaattcttggctgataactgttttggctgaagataggtccccaatcccttctagcttgtagggtttctgctgaaagatctgctgttaatctgatagattctcctttataggttacctggtgcttctgtctcacagctcttaagattctttcctttatcttaactttgaatgagctgatgacaatgcctaggtgaagatctttttgtgatgaattttccaggtgttctttgtgcttcttgtatttgcatgtctagatctctagcaaggccggggaagttttcctcgattattgccccgaacatgttttccaggcttttagaattctcttcttcctcaggaacaccaatcattcttaggtttgatcatttaacataatcccagacttcttagaggctttgtccatattttcttattcttttttctttgtctttgttggattgagttaattcaaagaccttgtttttgagctctgaatttcgttcttctacttgttccattctattgctgagacattccagagcatttcacatttctaaaagtgtgtccaaagtttcctgaattttttattgttttttctttaagctgtctattcccatgaatatttctccgttcatttcctgaatcatttttttcccttgcactgggctttgcctttctccagtccttccctgattggcttaataactaacctcctgaattcttttttaggtaaatcaggaatttcttcttggttggacccattgctggtgaactagtatgattttgagggggtgttgaagagccttgttttgtcatattactagggttgtttttccggttccttctcatttgggtaggctgtctgaaggaaggcctaggactgaaggctgttgttcagattcttttgtcccacgggatgtacccttgatgtagtactctcccccttttcctatcgatgtggcttcctgtgagctgaactgcagtgattgttgtctctctgctgggtctagctgcccagcgagtctacctagctcagggctggtactgggggttttctgcacagagtcctgtgatgtgaactgtctatgggtcacttagctgtggataccagcacctgttccagtggaggtgatggagagtacaatggactccatgagggtccttagctttgtggtttaatgctctatttttgtgctggttggcctcctaccaggaggtggcactttccagaaagcatcagctgtagcagtatggagagggaccagcagtgggtggggcccttgaactcccaatattatatgccctttgtcttccactaccagggtggatagggaaggaccatcaggtgggggcagggctaggtgtgtctgaggccagactctccttgggcgggtcttgctgcggctgctgccggggatgggggtgagattcccaggtcactggagttgtgtacctaggaggattatggctgccttttctgagtcatgcaggttgtcaggaaagcaggagaaagccggcagtcacaggccttaccagctcccaggcaaaccaaagtaccagtctcactcccaccatgcctcccacaacagcccaagtctgtttccaggtggagggtgagaagggcttgaaaacttgcccaaggctatctgcctcccagctgcaagagaaaaaagctttagttctgcccttgcctgtgaagtctgaacacctgattcacgccctccccttagttctggccaggaggcttcttgccctgtttaaattgttacaaagttcaactagagaattccttctccctgtggagttttaccctctgctcctctggccaccctctggatggatccctgtggtgtcaggcaggaatgggctgtctggggacccagcaagctcccaaggcctttctgctgcttcctctacccctgtgttttgctcagctctctaacttgactcaggatcatgtaaagtcagaagcttctcccacaaacagtacttcagtttctccagtgggggtgtgtgttcgggaaaggaggatctccctttcccaattcaacagttggggcactcacagtatttggggtgtctcccaggtcctgcagaagcagtccacttctttcagagggtctgtggttcctctcaggattgctggtttgttcttgcagttgatctggagataaaattcacaatgcaagcctccgcatgctgcattttcattttaaaaggcactacaagtgctttacctttcagagaagccatataattccatagacacactccattatcatatgctaaagattatttaagctgttcattcttgctaaattgaaccataatcaaactgtcaagaaggcatagaaactcaaagactgctgttaaatcacccttttgccccctcattagcagggaaactgacctcagatgttttcatctcaccccacaagtgttatttctccagcctttactcactgccccttccctctacagtcctgagcctaggtttctagaagaagagaagctgctttggatgggtcccttctcccatatgtcccaccctctctctctatttaattttggcaaccttggctaatgtcaccagagatgtgtctgattttgtcagttttctcaaagaagcaacttgccattattgataacttttattttatctttgttttctattctatgtaatttacatgtattaagtttttagcctttgtagtgtatagttctgtgatttttgacaggtacaatcatgtaggcagaaccatgaagatataaagcattccgattatctctaaaaattccttacaaccctttgttgtcagctccttccctcgcctccaacccctgaaaattaccatgtgttttctattcctccagctttgccttttccagaatatcatataaatgaaaccatgtggcatatacctatttgagtctggattctttcagttagcataagatatttgagattcacccagttgttgcatgtatcagaagctagtttctttttattgctcagtggagttccattgtttggatggactacaggctgtttatccactcaccagttgaaggacattggggtttgggatgtgatatggtttggctatgtccccgcccatatcgcaccttgaattcccacatgttgtgggagggacccagtgggaggtaattgaatcatgggggcaagtctttcccatgcttttctccggatagcgaataagtctcacaagatctgttagttttaaaaaggtgagtttccctgcacaagctctatctctctttgtctgctgccatccatgtgagatgtgatttgcccctctttgccttccgccatgattgtgaggcttccccagccatgtggaactataagttgattaaacctctttcttctgtaaattgcccagtctcaggtatatctttatcagcagcgtgaaaacaaacaaatacagggtgcttatgaataaagcttctataaatacttgcacacaggtttttatgtgactatatatttgcaatttgcttggataaacatctaaagttggtattagtgggtcataaggtaatgatattttaactttataagaaactgccaaactttttctaaagtatccataccattttgcattcccaccagtaatatttaagagagagttccagtttgggtacagtggctcatgcttataatcccagcactttgggaggccaagggaggaggatcacttgagcccaggagttcaagaccagcaggctccatctctattatagttaaattaaaaagagagaggctgggcacagtggcttacacccatcatcgcagcactttgggtggccgaggtgggcagatcacttgaggtcaggagttcaagtccagcctggtcaacatagtgaagccccgtctctacgaaaaatgcaaaaattagctgggtgtggtggcacatgcctgtaatcccagctacttgggaagctgaggtgggagaattgcttgaacctgggaggcggatgttgcaatgagccgaaatcaggccactgcactccagcctgggcaataagagtgagactccatctcgggaaaaaagaaaaaaaaaaattaaagagagagttcctctgcatcttcatgagcacttggattttttatgtttctttttttgttattattatttttattttttatttttttctgagacagagtctcgctttgttgcccaggctggagtgcaatggtgcaatctcggtgcactgcaacctctgcctcctgggttcaagtgattctctcacctcagcctcccaagtagctgggattacaggcacctgccatcatgcctggctaatttttgtatttttagttgagacagggtttcaccatgttgaccaggctggtctcaaactcctgacctcatgtgatctgcctacctcagcctcccaaagtgctgggattacaggcgtgagcgactgtgcctggccagcacttgggttaaaaaagttttttttagctactttattttgggtttagtggtatctctttgtggttttaatttgcattttcctaatgatgctgaatatcttataaatgcttattgggcatttttatatttaagtttccttttgagttgtttgcccattttttaattgggctgtgtttttcttattttcgagctttaagagtccttcatctattttgtcctacagcacatattgatttcctgcttccttttttatcctcccaggggccacatctaacatttttgagatgagcatacagattgtgttttgcccagagccactagtcacaagggaaggaggggtccagatattgataaaagatgggaaaggccttgattgtacagtaatccaaagttttccactgtcttcatctaagttagaacaacacagtgggtctatgataagagaaaataaagaaacaacatggcacaaaagtcttaaggaatgggccaagctagtgaaagaagttagtttagtagctacttcactctgagacaggaccagaaggtacaattttcattctaccctttgctcaagattaaggatttattgtatgcccctcatcttcagtttcaacaggactgatctgattggctgagcactggagccaaaacagagaggaagaggtagcgtccaaagacgaggagacactggaaggagaggaagaggagtgcccttgcgcacaccagacagacagctcagtatgtactgagcaatgattttcttttctttgcttttttttggttgttgttgttattgttgatacaggatctcactctgtcgcccaggctagagtacggtggtgtaatctcagctcactgcctccctggttcaacctatcctcctgcttcagcctcctgagtcactgggactacaggcacatgccactacagactaatttttgtattttttgtagaaatagggtttccctatgttgcctaggctagtctcaaactcctatattcaagtaatccacccgcctcagcctcccaaagtgctgtgattacaggagtcagccaccatgtccagtaagccaccatgcccagcctgagttatgattttctatgttgcaacattatctggactccttgtgcacacttggtcaatagaaagatttttaggtaggaaaggcttagaaacggtaatctgtttaggagtaaaagaaagagcaggaggggcatgccgctatgtttgcaaatctcctcccaaaagattacaaatatcaatactccatatcaaagaagagagcagagatgaatctttatgctaatggactgtaatatcaatcttctagccattcaggacaaagtgaggataagaattagctcaactccccatcactgtttccactacatttttactttcacaaaggagaaaaattttaaatattctataaattataattatatactataaaatataattgttatatgataaatataatatataattataatatgcatatttgtatattttaatatatgtactcaatcactggcttttaactttagtcaaataatcgaaaccatcttcaaatttctgactccatattacttacttgacctgagaatatgttgtgattttgaagtactcacagcatccaggaaatgaaaaaagacaacctcaaattgcccaatctttctatgggaaacataagtagtatatttttatttcctttctctatgtcaaaagagacaattaaacctgcaatacagaagtctgaattccttcaaatcgacatcaaattactgtgccctagtaagtcaccaaatgtcttgacctctgcagattttttgttgacccctatactttggattatttccttaattatcagaatttacatagggctgttccacattgtggcactctatgcaagatgagtggttcagaaaacacatcatcatgggtcatcgtttataatgagaagtagattaacccaggggcatgccatcagatgatctgccaaaggtacagttgacaaagtcttcatcagtcagtactgatataaataccatcctcctcagcagatcatttgcaatgtgtctctcagagctaaatcagtactctaattgcaacatcagttaggggccctacttggtgatgagaggggcaaagataagaggatgttctcaactgaagctatttatacacaccacgtagtccttaattatctgtagggagaggagggaaataaagagaaggttgacatgactgaaattgaatccacccaccgccctttgtgccactccagcaagagaaaattcttactaagtaagaaaagtacttactttctaagagaaaaaggtaagaaacctccagttctatgagagtacagcctactcagttgccaactgatatttaaatgctaatactcctttttattgtgtgagtcttacaaccattcaagacttcaggagacttaaaaaaaagaaaacttaagttttatatccccaaaattaaacaagcagtctaggtagaatctccttttatcgttatagaaaaaagttgtggattagaaaattgattcagctatttcagaagtttggtcagtaaaaaatccagacttaaatacaagaaaacttcctggaactcaacatacaattattgataactgttggggctcaaaaaccaataccccagaatatgatgttttgccttcctgagctgaagaagcgtcagggtctctctgaccttccctgcccccgtccaagcgaagctgaagtttctttagctgcctaagatgcagacccaccaagaacaattgttttttcttaccaagatataaccacacctgagcagacccctttatcatttaaattccaaacagaactatttacaagttaatcctgcattgccccttaatagaattcctcttccccctcttctataacctgttttaccaggatccaagcccccattccttctgtaacctcaagatggtttataagcttctataccacactgagtagctgggccttcattctgaaggctcccgtgtatacatggcaaatagatttgtatgctttttctcctactaagcaatctgcctcatgttagtgattttcagtgaacctttagggggccaagagcctatggcccccacattacatattcataaattgatatatgccaggagattcaaaagatagtacaggatcaaacataaggtacacttgggaagaaataactgtaataataactgcctttatttagtgcttctatgtgtctgggactgtgctaaaaattttgcctatattttctcaataaattctttcagcatctcagtaacagatacagaattatccatgtattactgataaggaaactatggctcagaagattaatcaatccaagccacatagcattaaaggagaagtattaatattcaaatactcatctgactccaaagcctatatcctaaaatactactctttatggtacatatttgtatcaacctcatggcttatcttacccatacttcttgtgttcccataatgttgactgacctttttgttgatactggcccaattgtcccatagaactgatgtttatggttttttaaataaacagaaattgactctccttgatcttaaaacttgaaacttacattgttttatctgagttccttcctcaggaaactgactctcaggtaagaaactgaaactcatcagatcactgcatccagccagtgaagatgccagacccctcatccgtcatgattgcttcctgacccctccatgatttctgttttcccctacacagctaccttcataccctgctgtataaccactaaataaacccccaattttatttggttgggagagatggacttgaggctgatctctcctctctccagctaacaagatccaaataaaaagttttcttccctggcaatactggttgtctcagtgattggttttctgtgatgtgagaaaggtgacctagactgaacccctggcatttcagtgacattatgacctttgaaggcatctcttgccatttccccatgcatctttaagctgtgaatccactgtgaactgtttaactttctggttatttcccagctccaatctaacaatgaggtcattgtaggtctacatctttccagtctgcacagagactttgcactgggcaccctgacaatccagtgattgtgcatgtgtcctatacctagtctcattccaatcagccagtggctggcagagagggagcaggagaggaagggtaccctgcccttttagcaggggttctgtgtgggccagctttccttggcaaagctacagaaactgggattgacttgggtaacacaaatgcagactagtttgaaaccatcaaaaatgatactgtaaaataatatttaatgacatgaaaaagtccactaagttaaaaaataaatatatgcatttgtatatatgcactcaaagtctaaaagaatgttcattaaattattaacaattatcttgagaaccaggaacaattttaactttcttttttattcctttttgtgttatttgaacttacaataataaatgtatatatttgtaaatgttaaaaaatatgtaaatgttttctcttttggaaagaaataagaatctatgcataccatttgatgaagccatattattattattattattattattattattactattattattatagatggagtctcactatgttgctcggactggtccaaactcctggcttcaagcagtcgtttcacctcaacctcccaaagagacatattattttttaaatttatcataaaaaataaagatgaacttaaaaatatagccaggaaaacattcattgccatattggcaagataaaatttcaaataaaagagtccaacaacacaacattgaataaatatatccatcaatggatattttgtaattttaaatatattttattttaacagatatgacatggaaatatgtgcacaatatattaattgaggggaaagttacaaaacaatagagtatggatctgttttatagttaaaattcacgttaaatatatttacgcctagaaaataatctaaatttaacaaaaagtaggtgggattatagattattttaatcaccttaaatttatgtatctatatattttttattatcctacagtgaaccttcattacctatgtaattgttagaaataaaggtgggggtttgggggctttatctggttggggttttcttttcttttcttttctttttgtttttttttatacagatgaggtctcactaagttgcccatggtggtcttgaactcctggcctcaagctgtcctcctgcctcggccttgcaaaacattgggatcataaatgtaagctactgtgcccagccttgggtttctattttatttaaatatcaatggctctcattgggatttaggagttttcttttttgtcatctcacttgaccttgctgagagcacatgggaaaaccatcagcagttaaggttgtatagtcccaaaacaaaacagactagactaacgagtgtacattttaatagagaaggcagaggcaatttctcaatcaccatattaggttttcttaatgagtgttcatgtattcatcattgagtggcagattgtccccagagcctggttctactctataaagtcctgtgcgcctcatatccatggtaacaaaatatctgagagtttttatttgcaaacttggcaggctgctggaaagcaatggtgaggaaacatgaatattctaaggtagtacattatttcacagtagctgtaatatgaaaattatacctttatgaaaagtattatcttcctcaaaaaactgaaaataggattgttactggtagctaatccatatgggtctgcagcaacctcaattcttgccaccacagaagaaagaatttgaggggcataaggcagaaggagagactgaagcaagttttagagcaggagtgaaagtttattaaaaagctttaaagcagtaaagaaaggaaggaaaatacacttggaagaaggccaagcaggcagcgtgacctcctgatttggggttttataggttggcgtgcttccaggatcttgcattacttcttctcactcctgagatcttattgggaagctgctgatcagtttcaaatgttttctatctattaggagactgcctttccctggcaggagctgtaaccaattattactttacagaaacagttaacgatgttgcccaacactcctggtgtgtgtgtgttgcaggggctggggccctctcctgccctgctcatacctcactatcttcccactgtaacagggttaccattgatttggcagttccacttctaagtacctacccaaaagaattgaaggcagggacttgaatagatatttgtacacccatgttcataataatattatttacagtagccaaaatatgggagtaacccaaatgtccattagtggatgaatagataaacaaaatattatttagtcttagaaaagaaggaaattctgcacctgctacaacatggatgaaacttgaagacattatgctaagtgaaataagccagccacaaaaggggaaactgagtatgattccactcatcgtggaactagcccctcactcaacattgatgtaagatttgtccatgtgaatacctgtaaatccagttaatcattttaactagataagtcatattcatagagacaggaagtagaatggtggttgccaggggctggaggggaggaatgaagggttagggtttaatgtctacagaatttcagctttgcaagatgaaaaagttctgaagatgaatggtggtcatggttgtacaataacatgaatgtacttgctactgaactgtacacttaaaaaatagctaaaataatatattttatgccatgtaaattttataatttttaaagaaaaatctatataaactaaaaaatcattgtcaggcatgtaatttctcatgtagctcatttagctctaagatatatttcaaaattgtcttctttccacttccatggtccctggcccagttcagaccttcttcctcttatatgacctgaattactgtaatggcctccagaacttggccatgtctttctcccctccaactcattcctttacctatctccaactttatctttctttttccattttatttatttatttcaatagcttttggggtacaagtggtttttggttacatgggtgaaatgtacattggtgaagtctgagattttactacacttgtcgcccaaggagtgtactttgtactcaatatatagctttttatccctcatccacctcccacccttccctcttcttagtctccaaagtccattataccactctatatgactttgcatacccacagctttgctgccacttacgaatgagaacatatagtatttggttttccattcctgagttacttcacttagaatgatagccttcagctccacacaaatttctgcaaaaaacattatttcattcttttttatgactgagtggtattccatggtgtatatagatcacattttctttatccactcattggttggtgggcacttaggttgtttccatatctttgcagttgcgaattgtgcctcagcattatctttctattatcctttcatttacgaatttttttcagacccacagaagataatataagcacccacttacctgccactcagattcttaaagattattatcagtcacatctttttttgtattctgtggtgaccccatttctctccttccccagagtaaaaactattctaaagctggtaagtatcattctgtccatacttttacacttttataacatacatatatatgtgtgtatacatatttatgtgttgtctgtacatgcatatgtatatatgtatatactcatataatatgtatatatgtatatgtatatatgtatatactcatataatatgtatatatgtatatactcatataatatgtatatatgtatatactcatataatatgtatatatgtatatactcatataatatgtatatatgtatatactcatataatacataatatgttgtttcatgtgctttaaaaatctgacacaaatgctattatgcactatacagctttcctcaacttgctcctttcactcaacattgatgtgagatttgtctgtgttggaacatgtagacccagtttatttattttaactgctctagagtattccactgtagaaacagtaccatgatttatttatcccttcctctactaatggtcatctaggttagtttccattttttgttttacaaacaatgaataatccttccaaatatgtaagttcctctagggtgtacacctggaaaggcaattactagatcttaggatcaatgaggagcatttggatacagcaagggaaaacctggctcacaaaaggtctagagaagaatgttgctggaattgattcaatggctaagagatcagtgcctttattaatcttttgaccttcccttcattgtctcaacatgactatagcagttctaaacaccacttcctcagaccatactcaaaatcaggcagtgagggagagtacataaaaccatccagcagacatcctatttctcattggctagaaatgagtcacatagcaaccactagatgcaagagagaatgggaaagttagtatttgggttttccagcctctacagtgggagatgagaagggagaagttgttggaaatggcttttgggtacccaaccaatatatctaccacatcattaagttaactagatattgtgaaattgctcattcaatatagttgaacaaatttacacagcctcaagtaatatatgagttcccatctcccaaaattctgtcgatattgttagatgctttattttttgccaaaataatagatgtcaaattgtattatctcattgtggctttaatttgcattgctttaattattagtgaaatacagtgccttgtcaaatgttattgattatctagggttcctattctacaatttcctgattatatgctttatcccttttcccttgagtttttttgtcctttttttattttgttaaagaagttatgtttttttaaatatagtctagatactggtatttgtcagttttatgtgttgcaaatatcttctcccaattagtgaatttcttttagatttgtatataatgtccttgtctttatgatttacatttattatggtcttgttttaagaaatctttctctactgtgaagtcataaagacatttcctatattttcttccttcattttttaaagtttctgatctgacaaataggtcttaaatctctctaaattgatatgttcatatgaacggatattcatttttccatgtgaactatttcagcattgtctattgaataattcacaattcattgatttacaatgtctttccatcatatattatcatatatgcttgaatctgagtttatatgtcagcaataaattttttaaattgtgttatttaaatagtctatacctttactaatttttggtctatttgatctaccagtttctgagagagatatgacaaaatctcttccctttttatcataaatttgttgatttctactggtcaaatttttctgttacatattttgaggctaagttgttgaatgtatgtaagttcaaatgtagtaatattttcttggagacatgtaccttttattaatgtcttctttaatccccaagaatgattattgtctaaaatttttttgactgatggtgatattgttaatgcagcttttttttactcagtatttttgtataatttttttccattctttgattttcaaatttttgtgtcatgttctagaagtgtacattatattcctttttcctccctatttgaatgaaaactttatgttctgttttattattttcatagttaccctttaattttgagcaatactgaactaaaattctaaaattaatcaatttccctattgctctctggaaaaaactattagcttcttaaaatactttaattctaatccccccttccattttccatgctattattgtctagcattttcattcccccttgctttaaaaccctctaaacatgtctacgtttgagcagtcaatacccatgtagacttatcagcatgtttaccaatttgcttgtttaccattcttgcatcctactcttatgaggttattatatccaaagtatatccattagcaattctttcagcaatggtttgtgactctcaatgtttcatctttctttgaaaatctctttagtttgccctcatttataaatattttagctcagtatacaattctaggttaacaattattttccctcaacacttcgatggtatgagtccactgttttttgacatctattattgctgaaaaggtactgctgtaagtctatttacaactattgttcactagttggtagcatgtctaacattttatagctatgaagtttttcatttttgcctttggtacttcactatggtatgtctaggtgtgaatttgttcttagtttttattaatgctgctttaacctgagaagatatttttcttcaagctggaaaattcgtcattatcttttcacacactgcctctcctacactttttctattctctcctgaaactcttattagatatctattgtaccatctcattctattcttcgtgttttcatcttagttaagtaaattaagatattttcatacctttatttattttttttctttctctaagctgtattctggatgatttccttgaatctgttttccagttcattaattttctcttcaactctatgtaatcagatattaaatcagtcccaaatgggtttactttcaatgaacataattttcatttctagaaattctatttgtatccttttcaaatatatgaattttacattaatgttgccctattctttcctacactttgaatttcttattattaaattatatttatttaataatattaaattatattatatttattattattaaaatataaatattttaaaaatatttattatattctcactcagattattctttcatctcagtttgttgggatgttatttttcctattcattgcatctgttagttatcttacagtgttttgttttttatgtaacttgtaaatattcttagcattttgaattcattttcacctggaattgccttttctaagggaatggtctatatcctgagttatgggtgcttatgtgcagtacctaataagaggtgaaagtttcccaggtccaggaacaaagtacagtagtcccttgttatccatgggggatacattacaagacccccagtagatgcctgaaattgcagatagtacgaaatgttatatatactttgatttttttctatacatacatacccatacctatgataaagtttaatttataaattaagcacagtaagaaattaactttctttagcatatatttggcttttctttggcatatcaaaattgccagcatcactactattggccttcggggctgttatcaagaacaataaggtttacttcaacacaagcactgcagtaatgtgacagtcgatctgataagcaaaggctactaagtgactaacatgtgagtagtatatacaacatggatatgctggaaaagggatgattcatgtcctgggtgggacagagtgagatggcatgagatttcatcatgaagctcaggacagtacacaatttaaaacttatgaattatttatttctggaattttccatttaatatttttgaactacagtagactgtgggtaactgaaattacagagagtgaaactgtggataaatggggactaccgtattacagaggtagcaggagctggccacagagtgttgcagggggcggggggtcatcatatgtgcctccagccacaaggtatcctttttggaatttgacagtgtataaatatcattactattataccctagattttcctaatacagtcataatttcagacattgtcagtcctcatgttaagccagcgtttttcgctgcaggttgtgaagtatcagtgggttgtggaatcaatttagtgggttgacctgcagggcttttgtttttaaaatgaaatgcagattaaaatagaataggaaatgtcagagttgcattatgtaagaggaagtgttgggatttgaaatgttttgcagttacaaatgtatatgcatgtatgtgatgaaaaatgtatttcatgctgtgggtcatggtcaaaattgtttgaaagcctctaagttagataatatgtccagatatgagaattagaaaaaatggaataaattataaattagttgattttgttaaagtatttctatcagtaatcagagaagccagcaaaacatggtggaatgcaagtccttagtgttcctagtttatcactgcccttttcagaagcatatttctttctgaattcactccaacgtctccacaatctcgataggattttcagctctcttttgtgataatcacgtagaagtatgtctgtatgtgattatcataaaaggaaagcctaagtagtaaagaatatcaacaaatagcagattgctttaatattttagtctacttaagtaaacaaggatttttcctacccctctggctctttaaacttataagcttacatgttgatatgcctcagaaaattttatcttctcaacctcttgggttaagagaggcctagtgaggacaacatgggcggtcgacacgcttgcccaggatgaagcagtcagctagttgataccatgtgaaaccatgggaccccgtgttaacaaatctaattttcaaagagaaatgagaaatttttatttttatgtgaaatatcctgtttttaaatgttggggccaggtgcggtggctcacgcctgtaatcccagcactttgggaggctgaggtgggcagagcacttgaggtcaggggctcgagaccagcctggccaacatggtgaaaccccatctctactaaaaatacaaaaattagccggatggctgggcacggtggctcatgactgtaatcccagcactttgggaggccgaggcatgtggatcacctgaggtggggagttcaagaccagcctgatcaatatggtgaaaccccgtctctactaaaaatacaaaaattagctgggtgaggtggtgtgcgcctgtagtcccaggcactcaggaggctgagacaggagaattgcttgaacgcgggaggcagaggttgcactgagccgagatcactccactgcactccagcctgggtgacagagcaagactccatctcaaaaaaaaaaaaaaaaattagccaggcatggtggcacatgcctgtggtcccagctacttgggaagctgaggcagaagaaccacttgaacccgggaagcagaggttgcagtgagccaagatcatgccactgcactccagcctgggtgacagagcgagactccatctctaaataaataaataaataagtgttggaaatttattcaaaataatttcaaacactgtgaaagacaatgtgtccacaggcagccccatttgtgatctcttcccccagaagcatactagataaaacttcacaacgattactcctcagagcctccctaactttaccccattctcaccttccctccctcaccctcacgtcaactgctctccactttgagttactaacgcaattgatatgtgcctctgttacactgcttatgacattatatggtagttatgttgttgctgtttgctgttgttttcttttaacatatccatcagctctgctaaaaaataattaataattcaatgtggaatcctgaggttggggctgtcatagtttgaggaaatcagtttgaatcccagccctgatgagacaactttgggtgggttttcacatctaaaatgtgagtgaattataataatggataacatggttgttgcattgtcagccttgcaggagaagccatcacctcgaattcacatgtgcaggggacactgcaatagaactttctttgccttgatgtaaactgatgtcaattggacagatgtttcttggataccatctattcccttttgctgcagcctcttaatggccctctcaagcttctcaaactaggcatgttccatatgctgggaaaagtcatgctctgtttgacagtcaccttccgagggcctctgatagcagaactcggtgaggattatggagatagattgatggggagatcagccatcttgctgccacacacaccttgacagagagatttactgcctctccaatatcgcttccgaatcaactttttttttttttttttaatgggttctcactctgtcgcccaggctggagtgcagtggcacaaacatggcttactgcagcctcagcctcctgggctcaaggaatcctcccacttcagcctcccaagtagctgggactacaggcatatgccaccacacccagctaatttttgtattttttgtagagacagggtttcaccatgttgcccagggtggtctcaaactccttggctcaagtaatccaccagcctcagcctcccaaagtactgagattacaggcctgagccactgcacccagcccaaatcaatttttgctgttcattcccaagaggagaaaacattaaaaggttttccttttttccatttttcctttcttttcccctcaacctcccttcttcacccttataccatcctccttccttctggcactggttccccctcaagcaaaaagataacgtgtacctccaggattcttgataatcaaacaccatatgatttctatcagctgaatgcctggcaaagcaatacttccctcatcaaaaattaaaactggagtggcatttactttcctccaatatcacctaagaagttatagtaggacacgaagccagaaacttctcaatctcagcttttagttgagattattttgcccattggattatggagctctttcaatggtgaagttagtaaatttaaattatcgggaaattaacctttaaccccattgaaatggtcagagtaattctcaatctacagaaggaaaaaacaaaacatggcaactgagtgatttgttctattacaaatcctgtacaaggaataatttggaaactgggtggcttgttccaactgactataaaagttgagcaaatagtcaaaatgcctattatgctaatttttctttttttctggattctatgcataaggccagtgtgaacttaaagctctagttctttcatgcctgtaataaaccaaaagtttctgctcagagcagagtacagaattagaattgcccatttgtccttttttactattcttttaagacttttgcaggttcacaaatgatataacaggacactcatgaacgctgagctacagcaacagagacacatgtgtatctgtagtcagaccttcccacaaggcttcaggaagaaaccttgagtgcagactgatttttttaaattaagattatgggtagtaggccaggcgtggtggctcacgcctgtaatcccagcactttgggaggccaaggtgggtggatcacaaggtcaggagtttgagaccagcctgatcaatgtggtgaaatcccatctctactaaaaatacacacaaaaaaaattagttgggtagcgcgcacctgtaatcccagctactcaggaggctgaggcaggagaattgcttcaacccgggaggcagagggtgcagtgagccaagattgcgccactgcactccagcctggggcaacagagcaagactctgtctcaaaaaaaaaaaaaaaaaaaaaattatgggtagtgggtggaatattgagagtttatatgagccaggcactttctagatgctttataaggtcccatcatcttcacaacaactccaaaaggtaaatactagcattatttgcattttgccagtaaagaaaatgaggcatagggaggctgaaaggcccctctactatgtgtctgaattggaaccaggaaggcccatttcaaagcccacaatcttgaacactccgcaggctaaagcctcagaaccatgtctttctctcaatctggttggttagtgatgcaagaaaatggatagtcacatatacctttgtgtcatttatattccttttgtggagaaatatgcttgcatttatttatgacaaaaatctggctgggtgcggtggctcacgtctgtaatcccaacattttgggaggctgaggtgggcagatcacctgaggtcagaagatcaagatcagcctggtcaacatggtgaaaccccatcttactaaaaatacaaaaattagccaggcatgatggaacatgcctgtaatcccagctactcaggaggctgatacaggagaattgcttaaaccagggaggcagaggttgcagtgagccaagattgcaccactggctctccagcctgggcaatggagtgagactctgtctcaaaaaaataaataaataaacataaaataaagtaaaataaataaataaataaaaattaaaaaatctagagtggctaacctagatggaagtttgcctgtggacacacgaaagggggctggccactccatggttttaggcaggtttctctaaggggacaaggtttgagaaaagctctcaacaaagagaaggatgggggttggcagatgtggaaaaagagcttcctcttgcctgttcctggcacctcggccccaacccagatgtagagagcttgacttcagagactgctgccaaccaggcaggaatggggccaggggtgacagctggcttgggaaaggtggaggctgcccaaactttaggaaaactctttatcttggcaatggcaggtcttcccattcatcatggaaaggtaaatataggaagccatgagataaccatctgctaatgagggtttactttactaaggcagttcttacttacagatcaatccctggcaagtagttggtatttcccattgttagggaaaatagatttgtcctccaagatactctcaatacttcaaatctgacactaaataaaagaacaaacagtgttttctatgctcacactcagcacagaacacttctgtgaccagatgtgtggcctgttcccatgccagacaattctccaattcccacgccagacaattgtaggacaactgggtgtcctacaatttaattcaattcagacactatgtacctggaagtagcgtcagatcccacaggttcagggctcagtaccacaagacttctccccacctctcccccacacttcagacaccaatcatgagcccaagttgtcactggtgcctctgactgattggctgtaaatcagagcttcccagaacccatctcaggttccatcgtttcctagaatggctcacagaactcagaaaaacattttgcttactagactaccagtttattacaaagggtactgatagggacaggaggcagagaaattctaggcagaaaagggcagggtccctggtgaagccccaccttcaagcatggaaccataacctaaagtgaaaacgtgcattcctgctttcccgctcaaatgttgccttttccaaaaccacacacggccctctccaccccccatcctgtacccataaaaacccctaacccaactggtggagggcagagaaggggagaagagaagaagcagatggacgtcagagactgcggttgcacatcagagagaagcagcttgactttagagggacagcttgacggtgttgcttcagagaggagtccagctgggtatggctgtactccaggggaagatcaccttcctgctccatcccccttccagcttcccttcccactgagaaccactttcattggcaataaaatcctccacattcaccacccttcaattcgttcatgcaacctgagttttcctggacaccaaacaagagcttgggtgccacaagtgcagacactaaaggctgttatgctgatcctctgccctcatgaataggtagagggcccactgaactgtttaacacttaaggcatctgtggacagcaatgctaaaagaccactgtaacacacgccctctggggcttcatgggtcacagggaccacaccccctctccgcccagatgctgtcacagggcctcacagagttttgctcctgctggcgcccaaaaacgcttactccagctcctgcacccgctcacctgcatgctccccctccctcaaggggttaagagctgcaggctgagtaagggaagcaccccatcacaagggtcaagggaaatttcttgtctcagtacaactcagaaacagccagatggaacagatatgttgcccttgcatatgggaagatactggacacagggtgcagagcttccttgccctctccaggtatgccacccaccaggcacctccgcaaggtcagcaacccacaaactctctgagcccatccttctgagtttttaaggaagcttcattactgcataggcatgatcgattacatcacttgccatcagtgatcaaccccctcagccttcagcccctctccccttacctggaggtaagagttgagtggtggggctgaaagtcccaaccctctaatcacatgattgtttcccctggcaaccagccaccctacctccaccccaccctgcttgtccagaggccatccagaagcccccagccttcagtcatctcattaacatacaaaaagacacttatcactaaggaaattccaggatatttagttagttagttagttagtttttgagacagagtctcactatgttgcccaggctggagtgcagtggcataatctcggctcactgcaacctccatctcctgggttcaatcgattctcctgcctcagcctcccaagtagctgggattacaggtgtgcaccaccatgcccaactaatttttgtatttttagtagagacagggtttcaccatgttggccaggctggtctcaaactcctcaagtgatctgcccaccacggtctcccaaagtgctgggattacaggcatgagccaccacacccagccaattccaggggttttaagagctgtctgccaggaaatggaggcagtgaccaaatatatttttgttactatatcacaccatgtacatttttaaaggcctgagtgtcatttctaaagaaaggagggggtagtaggggctgtcagaagtgggtgcaacattctaaacacagttgccctcactggcattataaatcattgctgttcatttttaaataactgtgcacaagaaaaaaaaacagctttagaaacctttacaaatttaggtaaacttgtctggagtttttggttgtttcgtttgtgaaaagctgttttcacaatcccaagcattgataaatgaaagctacagcatgcctgcataacccaggaaggctctggacagatgacctagctgagaatgagccagcacttgtatccacagtttctaccttctaaagatagaaataactgggcacggggcagggaagggtgtcccacagggacattttgaccaatgctaaagaaataaagaggacaggagcccccaccacaagttcagccagattcagccagatgagaatggtaagtgggacttcaggggagccagagccaacaagagagaagtcctcggtcatgagggcatgaaatcagagggacaccttagggtggcctattggccagctttcagtgtcccattgaaaaagcatgggttgttccaagccactgagcagctgccctagggagcattcagatacttgcccaatagtccacagggtgacccacatttttgttgctgttgttgttctttcaagaggattgagcaaggcagtcgactgacaacttgaaacccagcccagctcactggcctcatgggggtagaccagcctgctttgtgtagtacatccaactctaaactagatttccttgcttcctactgggccagtccaatgtgatgcccatgtcttacagtcttccaatagttttaaaaaaaagaaaatggaaacaaaggaaggaaggagggaaggaaggagagaaagaaaggatggacagacaagctggatttctgcacctaagtattccagttaggagacaggccaaaggctgggcttactttaccctcaagacaatctgtaattgcccaaggggttcagcttacccactgcctggacagagttaatttctcaagacagggggattgcaatagagaaagagtaatccatgtagagccagctgtgtagactggagttttattattacccaaatcagtctccctgagcattcagggagcagagcttttaagggcaacttggtgggtggggggtaaggcagtgagccaggagtgctgattggtcagggatgaaatcatagagagcagaaactggcttcttggctgggcacggtgactcacgcctataatcccagcactttgggaggctgagacaggtggatcatttgaggttaggagttcgagaccagcctggccaacatggcaaaaccccatctctactaaaaatataaaaattagccaggcatggtggtgcgcacctgtaatcccagctactggggaggctgagacaggagaatcacttgaacccaggaggcagagattgcagtgagttgagattgcaccactgtactccagcgtaggtgacagggcgagattctgtgtcaaaaaaaaaaagaagaagccagcttcttgcactgagtcagttcctgggtgggggccacaagatcagatgagccagtttatcaatctggctggtgacagctgatccatcaagtgcagggcctacaaaatatctcaagcactgatcttaagagcagtttaggaagaatcagaatattgtatcctccagctgcataactcctaaaccataatttctaatcttgtcgctaatgttagtcctgcagagacaacctagtctccaggcaagaaggaggtatgctttggggaagggctgttgtcatctttgttttaaactataaattataaactaagtttctcccaaagttagttcagcctacgcccaggaatgaacaaggacagtttggaggttagaagcaagatggagtcagttaagttagatctctttcactgtctcagtcaaaattttgtaaaggcggtttcaaatcctatgaaggaaatactattccttttgtctacagataagaacatcaaggcacagagtgcttaagtaatctgcctcaacctgtcaatatttttttaaaagtctatgtggctctagaatccagatgtttaaacactatcctgtcctccctctcaattagatgattaaagtggtttgacagtacctgctttatagaaagagttcaataaatattggctacaattattattctccttttatacatggaccttcatattttagttaaaattatcagctaagattatcagttaattaaaacatttaaaataataatataataatttgtcaagtcatatttcctaggaatttctactaggtttaggaagtatctctggtagccagcctccaagatggccgccaacaatccctgcctcctggtattcacacccttgtatggtcctctcccatatggtatcagggttgatctgtacaatcaatggaatgccacttctgagactaagttataagaaattgtgacttttgcctttctcactttcacaataagatccctaactcaggtgggataagttagctgccatgttgtgagtagctctatggaaaggcccctatagtgaagaactgaggccacctaccaacagccatgtgaacgggccatcttgaaagtggatccttccccagtcaagccttcagatgggcacaacccaggagagaccctgagctagaactactcatgtattagtccattttcatactgctatgaagaaatacctgagactgggtaatttataaggcaaaaaaagtttaacgaactcacagttccacatggctgggaaggcctcacaatcatggtggaaggcaaaggaggagcaaaggcacatcttacatggtggcaggcaagagagcgtgtgtaggggaattgccatttataaaaccatcagatctagtgagacttattctctatcataagaacagcatgggaaaacctgcctccatgatttaattacctcccaccaggtccttcctacaacatgtggggattatgggagctacagttcaagatgagatttggatggggacacagacaaatcatatcaacctagctaagccacctccagactttcgagcccttaaaaacaatatgagataacaaatgtgtattgttcaaatccactaagtttggggtcactgttatgcagtgatacataactaatacatcatctcttctagaagccttcaactgacccccagcattctgtgccatatcatagcacctactatattctgacttacatcttttcccttcattctcccattctagataatgagatcaaggacagggactagctcatactgatttttgaattcccaggatctagcataatgctgcaattggtgtggacttcaataaatgtatattattgagctgaactatcttcacttactgtacatcctttgtccttaaaatatagtttgcatttcagatttctcatgaattcaggtagttcctgccatctaaacaattaggcctggtttcactcaactagtatttgattattaaagtcaatattaaaattgtactatccaagatcttagacacatcttttttatttttgcaatagaatcatatcaacttgtaacagaagaggtttgatagtacgtaaggtagcaacattcctctgttttcaaagtaattgtgccattagcccagaatttttcttttttccaaataggattaaataacctggagataaaagtagttctccaaaggaaaaggtaaaataatttcacagaaaatatttcctgagttggtcatatgacatcagagattgggattaaagattttatttttttaactcatttaattcatggaatataaatttattgttatcaaagatatcagttcaattttattattgaacctgtaattcattctatactttgatcctgtgaagaccaaattcatcattttcttcaaaaatgtcatataaaacttgagtgatcagtgacattctttattttgtttttgtaaaataaggaagacattaaagccatatgaacttcctcagtaaatggaaagcagtccacatcaatgcattcctcatcatggtcattaccaagggattcactacttctaggaggctctatcctcagcaaacaaacaatggcccacttcatcatttccaagttgaagttccttgccccaaaatatactacaatccaacaaaggaatggacatcattcttgctgatatgtccccagatgacagcattcttaagagaagtttcacagctctggataatgtgagtttatctgcaagcattgacacaatacacattcaagggaagtggtggtggtcttggcattgacacacagtggaaactcaacagtgacgtagactacagtcaacacacatgtaacatcctcaggttatatcccacttcagtctagcctggcagaaacaactaaaataaaatacataagcatgcaacatccatataataagttcaggaattaaggatgagaatgaaaaccatctatcccatatacacagcttgggaactaaggacttgacctgtctctctaactctctccctctcaacacacacacacactcacacactcactcacacacatacatacactttctttcctacattaacgtaagtttactactccactgtcttcattagcataactttactattccaggagattctagcctaagcaaataatttgattattcattacagaaacttcccaaaaagatccttcactcttcaacaggaagtaccagcagacggttaacaccctaaggatcttcaaatccctcaactcaaaatcctttccttgctgtttccaattctacactgttgtgttattatccttattcaatcttcatcaagctcccttaccgaaagatcaccttaaaccaaactcccaataaaacatattttttaattcaccactgatcggaaggcataaaataattttttaaataataaaatacaaccttgcttttttcccctcagagatattaccaaagctctgcctaggaggtgatcttccctaccacaataaacaatacagatagctttgacttatcagcaggttgtgttggtgatatttggagagccagcatttgacaagtacttagtatggatcgagcaataagctaaaacatttggaaactgatatatggcttaatctaagctaaaactaaagcatctggaaacttaatctatttccccctagaggtcagaggccctcactgtttaaacaattccacatctggacatttaaatttctgcctggtccagcatttgctaccgtatgttaagaggaattatttgtctaaatgaaaaaacgtttccatggtcaaacaatttgaagactgatgagttaagaataaaaagcatcatttcttcactgtgggacttctcagggcctttagggtatactactgggtatcaaaaatatccaagagggagttattaatatatagcctacgcaaaatgtatatagatgctttgtcctacagtaactccctagattctcactggatacaacagggatgatggacagttttatctaaccttccatcctgccgtttattcacaggccatttccagagaacatggtcagaaaggaagataaatgaccacagctgtcttagccctcagcaatcagctccgtggtaattttagggctgccttgatctgtgggcaggggaaaatgaaggaaatgaattagcctgagtcctgccagcctttaaatgaggatgcctgtgtgccctgagctatgcttagctaattccagcccttctccccaaagggaatgctggtctttcaatatactgccaggagttccttaaacctttcccacatctgtgaacaccaggcagaagttgtccaaatggtccaagttgctgatctttgctcaaaggaaggccctgctggcatggacccctcagtttacaaagaggtggcatctgacatactctgccccactaacagctaaaatcctcatgctgttatctttcttgactgtacccttctgctaagatctccacttaaaggacattgttttggtcagcactctgacttgcttgttttgggtaaaggagaggaaattgacatttactagacactttctatgcgtctgatgtcacataagacactttacatgctttattccatgtaattctaacaagtgcaaaaaaatcataatagcaaatgtttatctagtgtttcccatgtaccatgcactgttgtaaatgctttacatagtctcactctctcaaggctcaaggcaactctacgtggtagatgctgctattacccccactctataaatgagcaaatagaaggataaagaggtgaaaataatttgtgtaaggtcacatagacagtagcagagccagatcggaacacagtcacagtccatgcatctaaccacactaccattgtctgccattatctgtcctgtcagatgagaaaaccaaagctcaaagaagcagctctctcaaaggcacaccggaagtggaagaactggtaccagaacccatgtctgtctactcccaagtccgtgtttctcctctagaccacaggctctcagagcatagttcccagaccagcaacatctgtaacaactgggaaacttgttagaaatgcaaattcttggccccactccagatctactaaatctgaaagtctggcatggggcccagtcatctctattttaacaggactccaggtgattcccatgcagactaaagtttgggaggcactcctctacaccatgctgccttctgtagagcactgaattttgattttaccggcaaggactagagatagtgctgtctagtggttagaagctctgggaagctaagaaacaacttggtcatgacccagcatatttcactgtccttgacagtagacaggccaggggttgctttttccccccttagcaaattcatggagcagaaaaagaacagctgcactgtggtcaagaggaagactggattctgtccttggccatcctttaccctgctgatcacttttcagatccagagattctcagtgcctttctgttcaatgttctgctgcttttgcctgccagctttgtcagctcctacctgtgacccttcttgtctttcaacccctcccacttcaggaggaagcacttctgtggcaatatgttcagctgatgagctgccctcctggttcagatattgtgcaatgcaaaacatttcttaacaattccggaagcaaactttttttttctcctttattgctgtcaggatcagttcagtagctacactaaagctttcaccactcactgcttcactgaaaagtttaagaccagagcgttctgctgaatcaagctgttgttgagaggttcagtgtacgtatataaaacagaacaataattgatttttatagaggctgaaagaaagttaaggaatcttggatggctcagggtgggagcttgaaaggcttttgactcaggatgaaggatcacatggtcctcaatttgtgcttaatagctacaacatggggaaagagagagagagagacacggtatataggggaagaagctaagttagcgccaagctgagtattttgcagtcagggatcaaaaggatactacttttaaaaaccatatttcttctttaacaaacattaattcaagctcattgagtttctgtaggtcatacgtttcaatccaggatcagcaacacagagtgtgttatttcactttcaatgctgagggtggggacctccccctgcgagaacatgctgtatgttgattaaagttgcaaggagagctatgaaggatctgcccaaatctccttaatctctttttcttccttcttgataggtttctagggatctgttggttgaattgttctgtgcttgatatggaatcttggtttttattggcccacagtaaaactaattactactggaaagggcaccaaattaagattagcaagcctgacttgatttatcaaaatggaatgtatgtatgtaatgggtgagtgtgtagatgttagaatcaggcagaacactcctcagtttatgacctctccaaaacctggtagcggccgggcgtggtgctcacgcctgtaatcccagcactttgggaggctaaggtgggcaggtcatttgaggtcaggagttcaaggccagcctggccaacatggcgaaaacccatctctactaaaaatacaaaaattagctgggtgtggtggcacatgcctgcagttccatctactcaggaggctgaggcaggagaatcacttgaacccgggaggcagaggttgcagtgagccgagatcgtgccactgcactcctgcctgggcaacagagcaagactctgtctcaaaaacaaaacaaacaaacgaaaaaaacctggtggattatcttaaggattaagtgggaaaatacaggtaattcccaacctgcacagctggggcattcaatactgttaactgttatcagtgaattcgcactcatcggagtctagttggtgcccgcccctgtgctggcgaggccctgcaggatcacagagggactctctgttgggggcaggcctagttgcagctgcactattgtcagcacacctgcccccaacctagccctgtgactttcgagaagctctgtaaacccctaatcctccataccttctcatctgaaaaaacccacatcctcctggggcttacagagagcaagtgaatgaaattgtctgaaaatttcaaattgctcttccaggctaataagagagtatcataatttgttatataaatagaatatacacttttaaatttctcaatctgattttagttgaacttttagtgctgtggcataatagaaagaattccttaaattgggattagaaaacctgaatgtaggtcctggttctgagatactgccatttattagctgtgcaactctgggctagtcacctaaccaccccggacctcagttttcttatctaaaaacctggctaagattatctaccccttaggcggattttttttcttttctctccacactctgcctaccccacaggtttttgtttgtttgtttgttttttgagacagagtcttactctgtcactcatgctggagtccaattgcgcagtttcagttcactgcaacttctgccttccagattcaagcgattctcatgcctcagcctcctgagtaactgggattataggcacgcaccaccatgcccagctaatttttgtatttttagtagagatgaggtttcaccatgttggccaggctggtctcgaactcctggcctcaagtgatccacccacctcggccttccaaagtgctgggattacaggcatgggcctccgtgcccagccccctataggtttttatatcaaaaacatcactccagcctggtcgagagagtgagatcctgtaaaaaataaacaaacaaacaaacaacaacaacaacaaaaaacacctcacaactctacaggcaggaattactcttcctggcttgcaaatgggctcagggacttaattatccagaagtcacacagtgaataacctgagatttcaaaccaatacctgagcccacacatgtaatcactattattatcactgttcttttattgtgcgtgccatttttggaagaacaatgaagtctatttgggttgacgatcccaaatcctccatcttaaatcttcttattaaactgtgtgaaaaagttaccatgtaatctaaattatgatctgttttcctaccttcactcctccaaaataattgcaattataaaacacttgatgtaaattaatctctgttcctcaaacttgagagttacattaaaaagtctcaattataaatgacagatagatgctgttcctagagcgaaatctatcttggtttgttctaggattttaaaaaatatttgatgtaggccaggcacggtggctcacacctgtaatcccaacactttgggatgccaaggtgggtggatcacctgaggtcaggagttcaagaccagcctgaccaacatgagaaaccctgtctctactaaaaatacaaaaattagccgggcatggtggtgcatgcctgtaatcccagcaactcgggaggctgaggcaggagaatcacttggacccgggaggcagaggttgcggtgagccaacatcgcgccattgcactccagcctggtcaacaagagcgaaactacgtctcaaaaaaaaaaaaagaaagaaaaagatgtaaaatatgccacagagagagagagagagacagagagagagagtctttaaagcttccctcaccccattcctgacaaaagcaacagaaaaaaattttcccaggacccaagctcgagatattcctgataccagccacctccacaagcaaggctgctgtcagtggaactgagaagctgccaagaagctaggccatttctactccacatttggtctgaggccagagtgttgtctttcagtttttagacaaatctcccagggtgatgtagacccagcaataaccatatgtgaccatcacagcctgcaggaaagagaagaaaggtaaagacggctttcataaatggccctgatcttatctgcaaaagctggacagctctttttccaatacagaagcagaaacagtcgagattaagctttgcttagggaggtagggagttctagttcaatggtccaaatcatgctaatcaacttctgcaaaggacagtgtcctggagctgtgggccttgaacagcaagctcgggtccacaggtttggccacagtatgactatgcctgtgttatttaaagtttgtcccaaggagtgttatgatgtgcttggtatgggcttcacccccagcaggcacaagcatgtgcatgcctcattggcactgtgtccgtatggagcattgtgaagggactatgtggaaggaacaggaaaaaagagactacttaacatcctttgctttgctctgccacgttttatatttacaagcttctgtgtagaaggatactgatgtatgttcttggcttccataagacagtgggggtgacaggagtaaaaaggaagacgcctaaagacactgaagtttcctggtctatttggtcaacaactatttaataggggcccaccatgaatcagataaggtacacatgctgcagatacaaatgaccaagagcaagcctgactgctgcccttatggaacttggtatctagtaggggagtcagccaacaatcgaatagtcacataaatgtatggaaaatggaagctgtggcaagtgctaagaagacatggtcatggtgccgtgagcaccattaatggaatctgacccagtccaagaggtcagcaagggcttccctgagaaagtgatgcttcaactgagaccttcaagatgagtaggtgctaagtagtgaaaggaatgaggatgggaggcaaaatcctggccaagtgaatagcacatgcaaaggccctgttttgggagagaaacagcttggtggaaggtaggagatctgacctaagtgttaccaggaaggccccccaacccctaaacacctctgcctcctaaaattccaccattattaaggaatgctttgggttaagattgtttttctcttgaaatattcccttttttttttttttttttttgggcaggagaccagagcttattattactcaaatcagtcttgctgaacatttgtggatcagagtttttaaggataatttggtgggtgggggaaggccagtgagttgagagtgctgattggttgggtcagacatgaaatcgtagggaattgaagctgtcttcttgggctgagtcagtccctgggtggggggccacaagatcagggggccacaagatcagatgagccagtttattgatctgggtggtgccagctgatccatcaggttccgggtctgcaaaatatctcaagcactgatcttaggaacagtttagggagggtcagaatcttgtagcctccaactgcataactcctaaaccataatgtctaatcttgtggctaatttgttagtcctacaaaggcagtctagtccccaggcaataaggtttgttttgggaaaggattgttactgtctttgttttaaaccataaactataaaataatttcctcccaaagtcaattcagcctacacccaggaatgaacaagaacagcctgaaggttagaagcgagatgtagtcagttaggtcagatctcttccactgtctcagttacaattttgcaatggcagtttcaatccctccctttgggttttataacaccttaacctcaagatgttggcaattgaagatggaaaaagagcaaagactgctctaacttcttcctgctgatcaagggcatagtgagggtaggtgtcgaccccaaggtaaggggagtagaactgctttgcaactgtctgaaagtactcatgcaggcctggctggggtcccaaggcttgcatggcaaaggcgttagtattattatttgcagttttagtaccacgtttgagggaatagtatgctataacgtaaataatgagtactagtgtaaggaatgcaattcccagttttaaaagcaaaaattttaaagcattactttgggaacttgtagcccacaaagaatttaggatttagccaaactgaagaaaaaactcaagaacagctaatagcagatgtactatagacttttgttttgttttggttttggttttggttttggttttttttgagacagagtttcactcttgttgcccaggctacagtgcaacgacatgatctcagctcaccacaacctctgcctcctgggttcaagtgattctcctgcctcagcctcccgagtagctgggattgcaggcatgagccaccatgcccggctaattttttctatttttagtagagatggggtttctccatgttggtcaggctgatctcgaactcctgacctcaggtgatctgcccatcttggcctcccgaagtgctgggattatagcatgagccaccgtgcccggcccagatgtactatagttttttgaagcataatttttttctttctagtttccatttttattaaaaacaaattatgatagaactgatttgtttgcaaaagtaaattttagtcttattagatttggtctgattatttgcataaagtgtagcaagaatgattatttcccacagaggctttttaaattggctttgatggaactctattccataaggaatcttagataagactttttaaagctgagcccagccatgggtttgtaagcttaaatacctataagttgggtaaatttctcttgacatcccaagataacttggggctcctgagcctgttagaaagtgacatttttttacttactacaggtcgggaaccctgtacagggattgtgtagacaaggtatgaggtcagttttcccaaggggcttttattggctttgtaagtcaactttgatttttttttgtttgctttttttttgttttgctgagacagagtcttgttctgttgtccaggctggagtgcagtggcaccatctcgctcactgcaacctctgcctcctaggttcaagcaattctcctgcctcagcctcccaagtagctgggattacaggtgtgcgccaccacatctggctaattttttgtatttttagtagagagagcgtttccctatgttggccagctggtctcaaacttctgacctcaggtgatccacccgcctcagcctcccaaagtgctgggatgacaggcatgagccactgtgcccagccacattagtgcatctctaatgctaaaggtagttttcaaatacaattttataaatctattcagttttaattaatttgaccagaaggtaagatttccataaactttttagaaccctttacaattttccattaaacagcagattaattttttaagaaaaccgtattatttggacacatgggcccataaaatcagtatgattttaatgttttaacctatagaaacaagctaaataatctcctttaaattttagccaacttgcttatacccacagaatgttttacaaggttaaccctttacaaacccttttttaatttgcttaaaccttcgattttgtcccattactcttctaggttaagacaatcttttaaaaccctctgaactagacaaaattacattctctttaacaaaaagcatattcccatatcttcttataatctcccaccaagattatattctgcttttcttctatacctgacaacttatatgtaaaactgtttctccagtagtctcaattgtatgttacaatgttaactcttagcaacttttatttttggtgaaaaacctaataagtaggcgatttatttaggtacgaggtgtggagcctaggacatcaggagtactgacccttttcagcatagctaggggacatggctttccatatgtccccaggccttatctataatatcatactccaaagtaggtaaattgaacaattttcaaaagtcaaagaagcagtttatgacttaaagcatttagcaaatctaatatctgaccttaattgagaccaaatgtctaaattttgaagacatttttattttactaataatctttaaaactgaagggttacttcttgttgttacttcttgttgtgaacaagaaggcattaaagtttctatttttctgataaaatatgatttaagtgctttttttctaagccaattaatcagctcttttatatataaacatcacacacacacatataaatacacagacagacagaagatccagtagttgtaagacttttcatttgccagttttttaattggattactggcttcagggtggatcccttggatgagcagggccaggaaagcatgcagtttttaggacctaataagtaggcacagctggaaggcaaagacaaatcctcaaaattaaaggtgccattttatactggatcctggatccccaaaaaggagggaaatactacaagagaagatagtgcagtgcttctaccatgcatttcattgcaaggcaattcaaagccaatcagcccattttttaattagcccatccccaacgggagtctcatctttcagtgggggttggggatgtttccatatcccacttccaagtggccaagagcatgcttctttgacccaagcaagtaaagagataagtatctcttcataactgacattagccatttcttaaagtatatatatattttttacctagttattacacaccaaggctaaaagctttcccataaaataatttgattattatttcccataaagtaatttgataccctcaaaagtcaaaaccattagctaaagcaaggcaaaacaaaacagagccttagattttgagagggatttattgttttcaattcctggggttccatgaggaaaagaagtttttcccagaatggggtctgtggtgccatctctgtttttccccaggagtcccaggttgttagtaattatcttgagttttttcctgtggacattaacagtggcaagaagacaaaatggagaaaaacaattcagtctactgagaagaaaaaaactttttcagaaaaacacaactcaagaagaggaaaaaagataaaggccttttaagtatgtataccttgggtatccatttttaattaagttgaatttaaccataaagttcttttctcaaaaaaaaattgcttattacccaggacagccaatatttttggcttttgaattgtaccacaggtaaccttccatgagaaattagtaagttttaactaaggttatgacttaaccatggatgcacaaggtgtttcaaagacatgataagcagtttttttccttatttatttcttttcttcttttttttttaacaagatttagaatctccacaagggtcgttcagagaaaggaaaatccaatcaggaaatcagaagctatccatggggcagggggaaaaatacacctcaatattagtggcaaagttacacaaatgacaaaccagaaaggaatcattctggaagccaagaattgaacccgagccaccattgtcaaaaggcaaagccttacctactgagctacacgccattgagcagtttctattgctgtgccctgaagaagtctaaagcagccaattccaagcttgcaaagcctcttaactgttcaaaataatttttagggctaactatgacatgaacccccaaattcctgtcctctggttggaggaaaccaaaagaaagtatctccacatggtcacaaagttaagctcttgaggacacaaaacaagacagagaaatttcatctggtattcgtttcagggaccctcagcaaagtttgtaacagaccagcctgccaggctggcttgaaaagcgggaatataggagttctaaacctacgttttatcttgtgatgcccatctctccattatagaacaacatagaaagacaaattcttagcacaaagtacaccagatttgctacaacctaagactagtctcacaaatcctttcttctattaatcaaacccttgtagaggagacaaatagtggtgtttaccatttacacacatacacacacacacacacagagagagagagagagagagagagagagaaagccgaaacttggctggtaagattttcttatcctttttgctggcatactaggtttccaggttctctttcttcgcagcttccacagaaacagagtggcttttgatgatcctgaccactgtgccataactgtgagggtcaagccacccaacaaaagaaaatcacccctttctgttttatggaaccataggcaaaagattctcaattttgcaagatgttgcccaacaggctgcttggggaaccaaattaacattctccatcccaacaaaatacacacaacaaaacagacactagtcacctcgttcagtacccaatattgatatggcaaggctcaaactttctcctcttggtttctgttgcctttggtctactccaggtggttgagggatgacttcagaacagtaattcaatgggtggtctctgggaaagacaaagagcagacagtcaccccaagtcagtcctgttgagcttacttcagggttcactgaatgtaaccacacaaataaggagggttctccgagttaggcctgttggacttctgtcagcaattccttcggagatcccctccacatatacaaacacacataaacacaagacagacagaaggccttccaaatcaagatccctaaccaagaattccaggagtacttcttctaaactatcttactattctccatttgagaaatctccccaacatcttctgatggaggagaagtctcccaaaccaagactcttcctactagttagggagagccaactgagaacccccaggagctgaactgagacagacaccccatggtggagctccaggcagacaccccacaatgcggctacagctagacaccccaccatggggttacagaaccagtcaggagaaggaaggagacattggcagtgcctaggatactcaccaacccagatactccataatggggctatagctacagacactccatgacctggctacagcaccccgccatggagctatggacagacaccctgtgacagggcttcagttatgagatgtctcctgaggactatttctccattgcaattaaatccatgcacattgggttggcagtgcccaactggaagagacggtgccagagtcacccactgtccaagaaaattaggtggccacttgagctgacctccagatccattgccagaggcaggctaccaaaccatgggcagctagccacaagggctatcctggacaagcccccaaatttgtaactgcccaatgggttcaccttgcccactgcctagacagagccaatttattaacacaggggaattgcaatagagaaaaagtagtttacacagagccagctgtgcaggagactggagttttattattactcaaatcagtctcttgaagtgttcctttatgctcagaagaatgactcattaagtcaagtgaatggttttatctgataaattctctccctaatagcagaagtcatggccacaagtccctgagattagtatgggaatttgggtaggtgggtttattttaaagagaaaaagagttacaaaaatgagagatgtgtgcctcaaagatcaaacctcatatttttctaaatttatcccaagaccagccctaccagaatttattaaaagtctgatctccaggaaatcacgtaagcttttgcattcagcaagactaatcaagatggtctcagcctttgagagaaatctatgaaaaggagcaattcaaagaaaagaggtaaacatcatattatgagaatgccggcatttttttccataagctgagtcctccatcctaaaccagcttcatcagcttgagcatccttaaaagtttcacagctgacaaaatatagtcatgcactacataacaacctttcagtcaatgacagactgcacacaccacagaggtaccataagattataatactgtatttttattgtactttttctatgtttaaatatgtttgactacacaaacactttccactatgttacagttgcctacagtattcagtacagcaacatgctgtacaggtttatagtctgagaacaataggctataccatgtggtctgggtgtgtagtgggctgcagcatctaggtttatgtaagtatattctatgatgttcacacaattatgcacttctcagaacatatccccattgttaagcaacacatgactgtatattaattcagtattttgttcctagagtctcataacagatgtttctcccccatggcacataaacaagcagtaaaccataccagcttttcagtcacttaggcctggattcaaatcctgactcttcagcttagccatgtgaccatggggaggtcatttaactgccctaaaccttgttttctcaactgcgaactgggaatcattgtccctatcccatagaattgcttggaagatgacataaaaataatgcattaaagagcttaccgaagtgcaggtcatacaatcagcacttaatgggagaaagttaaaaagaagggccaggtgaggggaactggcaaagacagagaaagagtgtggagctcctgagagacacaagtgcatgggttccaggtgatgcattgcttgggcaaaaccacacacaccaagtctcaaaagaagttgaaaagcctgagagaaagcaggcctggaatttacaaatggaaagagtcctatctctcttgtattttctcttggaacatgtgagatgagttcacccagagacaggaaagaaaacagcaaggaccgcccaggcattacagcatgggttctgcctgaagaggcccatgacaaaagagaatttagggtaggacatccacctggaaaacttccaggcagagtggtgcctgggaagctgctaaaagcttaaataagggggagtaaaccagagagctggacgaaaaaataaaaagccaaaaggaccctcctggtctccctgcagattgccagcctcatcccatgaaactggcctcagttattacagacagaagaatttcctgctggaaagctctttgaccttactgagcttggcctaggatattcaacattctcaggcttggcatggcattccccagtaagattttctctttctggaaaaaagtaatacagaaaaagaaaaggcaactatatagtgaaaataccaaagaatgtcaggaatctgaatcatggggaagagaattcctaaatttatctttcccaaagttatttttatcaaggagaaagacatttccttactgaggctctgaatctataagtccctaaaactctttcttatgaaattcatgcttgtgctttattttttattttattttattttattttatttttgagacagagtctcactctatcacccaggctagagtgcagtggcgtgatcttggctgactgcaacctccacctcccgggttcaagcaattctcctgcctcagcctcccaagtaactgggattataggtgcccaccaccacacccagctatttttgtatttttagtagagacaggctttcaccatgttggtcaggctgatctccaactcctgacctcaagtgatccacccgcctcggcctcccaaagtgtgttttattttttaaagatataggcactttgcatacctctttctgtatcaacccttttccctcctgcccacatagctgtgagaagaatttcaacaggcccagcaaatgacataaaatgatataccatgtgcattttggaggctgaggtatgaggactgagagttgtaaataaagtgctgacccaagtgagatccaaagagcacctgggaagctctgggtgcagggtagcagcccagagccgctggccccttcctggccatctgggtgctgggcatagatttctcaacaagaagactctgctacctcccctcaccaggcctctattcttctgagaaacacaaagcaataataaaagaaagtgttaaccaaataaataaataaatagtgctgaaaagggctcactgcatcctggagttgcagctcctgtagctgtaataatgaatctggtagcccttagtgattctcctttatttgttttgagttggggtctcactctgtcacccaggctggagtgcaatggtaccatcttggttcactgcagcctctacctcccaggttcaagtgattctcccacctcagcctcttgagtagctgggattacaggcacctgccatcaggcccagctaatttttgtatttttagtagagacagtgtttcaccattttggcctgtctggtcttgaactcctaacctcaggagatccacctgcctcagcctcccaaagtgttgggattacaggcctgagtcaccacacctggccttctcctttatttctctaagcctagtttcctacctgtctgaggagaccaagcagggaataaacagagagcatctgcaacgccttgttagagggaactgctgtcctcaagcatccaacaaccccagtgaggaaaatacggccaaacctccctcccagtgttacaggaagcaaggctagaaattggaccagcgataagttttccaagaaagtgaatcacacacgtgagacttcaggaccacttaatgcagagcagattttcggaccacttaatccatggaaaaaaaataaacggattaatagttgcatagaaaaaaatatgctttaataaaaaacaatgcatcacttatgcatacccttctgggttatgagattgtagccatgtttattgtctttgagctactttgtaaatcttcgtaagttgtaggtaactgatagatatataacttctgtcctatctggtagtgatttaattgactccccctggccctatccttcactcatggataaaacagttttgcctccatttgcaattcatctcagcattcctttacttgtaaaaaaaaaaaaaaaacctgtgctgttttgacttttcctttgagccagttgctatgggttgaattgtgtccccttcccccaaaaatattgaagatatgtcccaacccccagtacctgggaatgtgagcttatttggaaatagggtctttgcagacgatcaagatgaggccatgagagtgggccctgatataatatgactgtgtccttaagaaaaataaaaggtgatttagacacagagacaaattaccttcctcttcatgcatacacaaaagaatgccaagtgaagaggaagtgagagataggatgatatgtctcccagctaaggaacacagaggattgccaccaaaaccaccagaaactgggagagatacacagaatagattcccctcaaagcccccagaaggaaccaaccctaccaacaccttgatttggaacttccagcctcgacaactgtgagagaacaaatttccgttgtttaagccacccagtttgtcataccttgctgtggcatcccaagcagacaaataaaccagttataacatgtttcttattccctagtatcatataagcaaaataaattttttagcacatgttcatttttgtatctatagaagagtcatgatttcattaggttggggaaaaagctattgtgatttttgccattaaaagtagtgatccaaaccgcaattactttgcaccaacctaatacctttttctgaacgttatcttttaacagtttcagaggattcaccaagatgtcctgtggatttgctgaccagagccaggtagacttcatccacagaaaagtgcaccacatgggcagttgaagcacagaaatatattttcctgattcatgaggtcaagtaacatgaagtgaacaatagaactttgctgactctgtttttctaattttattttgcccttactaattttggttttggtttgtttatagccagtaaattattccccattgagaattagttttagggtctgaccatttatgatctttgtaaatgtcgcatagagatctagtctctgttgggtgaaaggctccagggaatttagtttgtttgcctttttggttgagaatttggttgctttttttttttttttttttttttttgagtcaaagtctcacgctgttgcctgggcggagctcaatagcttgatctgggctcactgcaacctctgcctcctgggttcaagtgattctcctgcctttgcctcctgagtaactgggattacaggcacgcatcaccacactcagctaactttttgtatttttagtagagacggggtttcactatgttggccaggctgtctcaaactcctgaccttgtgatctgcccgtcttggcctcgcaaaatgctgggattacaggtgtgagccacagtgcccagctggaatttggttttatgatgagatcatcggaggatctctgcaaatgaattaatagtttacatagaacttgtttctgctgggtgagagataacagagaatctggtttgttagtcttttctgcgtgttcacctttatattttgaatgcaaattattaagagtttaaactgcaagggaggaaaaaaatttcctcctctcctctaagttcaatggctgggaccctgcaaattaaacaatctgacaaaagacagattaacaagagaaaaacaaatttaattaagtatatttgcacacataggagttcacaaacaaatggagcttgaggacatggttagaatttgcttttttttcttttccttttttttttttttttgagacagagtcttgctgtgttgcccaggctggagtgtagtggtgcaatctcggcttactgcaacctccacctcccaggttcaagtgattctcctgcctcagcctcccgagtagctgggatttcaggcgcccgccaccatgcccggctaattttttttgtatttttagtagagatggggtttcaccatgttggccagtctggtcttgaactcctgacctcaggtgatctgcccaccttggcctcccaaagtgctgggattacaggcatagaccaccaccccgccagaatttggagcttatctaccatcttaacaagaaagataaggtgtggagaagagattagaccaaggaaagagggtgctttttggtttcttggagggtgggggctgtaaaatgatcatgggaaggtgagtaagaaattaggaaatgtatggtaagtaaggttgtttagtatggtttgttatacagatgagtctccagtgataagaattgtccctagtagttctcttcctcatatagaagagggagacaactttacaaaaaagggatgtgtatgccctgcttttaaacagaagggagttttttcctgcatctgctatttttcaattatcttcagctcaaaataatccttatgctaaagtagcatattttggggtgacatattctggtccccttcgatacctactaggaaaaaagctctttgactggtgagttttataaatgtatgtttactttgactcatgactgaaaatctagaattaaaactataagctccctctgtctgtttccacgcttatgtttctgcaattcagaaaggcatttaaatctcacataacaattttcttttttatttatttatttatttatttatttattattttattattattatactttaagttttagggtacatgtgcacaatgtgcaggttagttacatatgtatacatgtgccacgctggtgtgctgcacccattaacttgtcatttagcattaggtatatctcctaatgctatccctcccccctccccccatcacataataattttcacctcttgttggtattaataaattgggttagaaaatccctgaaattaaaggagctctattctgattagcttatagagataaataagtgtttgtattgattgtttctagaattgctagaaaataaggaaatcgaacttctaatattttcaatgtaatttttatagaaagtaacatggaaatgttttaagattgcaagttcacataatttaggtaagtcttcagcaaccaagactagttaaataattttggtttaataaaaacagctacagattagctgataatcagattagttagataaattctgatttatcagcattaaatataatacctgctagtattttaattctacttgggcatgtacttcttaacacaggtttcttgattgaacaagctaccattacttctacttaatacttaagattacagaaaatataaatttgtgtttcattgactcattctcacaattttgtttgcctcgggttatggcttgtgcaaacaatgagtctgaaaggctacgaaagctgtcaaattttgctcaattttgacagacttgttcccttggttactgtttattgccttcatctacaagatgaagggctttttgtttttcttatgtaatcggcgtagacagcaaagattctgtgttttactggaatagccttcaatggtttatgctgaatttattattatgtccttgactatttaagaaaacaaaagtttctcagttaggaaagatctaagcctccttacagtcatgttaccttctatgtttactttttaaatactttattgtcacttagaaatgaggagccaaagagttttgtttcagtttttgttttgttttgggtttgttttttgtttgtttgtttgttttgagacgaagtctcgctttgttgcccaggctggagtgcagtggcacaatctcggcttactgcaacctccacctccccagttcaagcaatttttctgcctcagcctccccagtagctagaatcacaggcatatgccaccatgcctggctaatttttgtatttttagtagagacggggtttcacccccatgttggccaggctggtctcgaactcctgacctcaggtgatccaccagcctcagcctcccaaagtgcgaaattacaggtgtgagccactgtacccagctcccaaatagttttttagacacctagatccgattcctgtcatagtgttcaaattgcctgacagtgtctggtttttgcctccctaaaatggaattctaaatataaaataaaatgaagctttcaggattttttttgctactaaagctattttgagatttcctagggggcccctggaaaatcacaaagacttattttttagccttttgaaaagagaggtgttagaaataattaggtttacttgctggattactattgatgaaccacatgaaaggcttgtgaaatcagaagagatgctcagcctttcctaggttaaattggtatatgttgcatgttgttagtatatttcagaaactgtacgctatatgggcattttccagagctttgcagtgtcctcgccgtccatgacacatttcttcttattagggccctagtgctgctttgccatattagacaatgacactacagtgttatcactcatgatttcagttttgttttgtttttttttttaatagaaatggggtctcactctgtcatccatgctggtctcaaactcctgggttcaagtgatcatcctgcctcagcctcccaaagtgctggaattacagatgagagccactgtgcctggcccaatttcagttgctttctaagtgttaacttgatcacagctttacttatttaatttgaatctagtatcttctagggcagtggttttcaactggggattgacatcacttacataattttactaacaaacagatgtctaagaattactgaggaccacgaactctctttacttgatattcttgatatatttttgttatattcttacttagcaaattcatgttatattatgtttcagcattattacgttatatctcaagatttttttctctggaaagattatgttcatccatttttataaattagatataacgttcactgtcttcttttgttgttgttgttgttttgagacagaatctccatctgtcgcccaggctggaatgcagttgcaatcttggctcattcgaacctccgccttccaggttcaagcaattctcctgccttagcctcctgagtagctgggattacaggcgtgtgccactacgcctggctaatttttttgtatttttagtagagacaggatttcaccatgttggccagactggtctcaaactactgacctcaggtgatctgccagcctcggcctcccaaagtgctgggattacaagtatgagccacccagcctggcctgtcttctttaaaaatagagctaatcattgtaagtttttttggtttttttgtttgtttgtttgttttttagagggagttttgctcttgtcgcccaggctagtgtccaatggcgcgatcttggctcactgcaacctccgcctcctgggttcaagaggttctcctgcctcagcctcccgagtagctgggattacaggctcccgccaccacgcccagctaattttttgtgtttttagtggagacaggatttcaccatgttggccaggctggtctcgaactcctgacctcaggtgatccacccgcctcagcctctcaaagtgctggaattacaagcgtgagccactgcacctggcctgtcttctttgaaaaagggctaatcattatgtttttaactattttatctaaaatttttttgaatcgactttattttctttttggcatgccacagaagcaaccaaattttcttatcggttgcatttttattggaataaattcttatcagaacttttgcttttgaaaattatcagtaatacattaagcacagtattttaagccttttgtcatctagaggtagtttttttgttttactctgacgcttccttgaaaatgtttcctcttcaacaaaggactgtctcagagacccgtggaaaaggactatgttgggtattttggggtatgtgctgctgatggcatcacttaaacaattttgagaccataccagcaaactgagtaaggatttccagaactctaggcaagaaacaaatggagtcatgaaaatgctaacccaagatccagtgaaacaagaattaattacatagggctaaatgaactgatgaggaatgattgtagtttatggtgggcggggggagtattactgattttttttctttttctttttacaaaattatttttattcttcttcacagcatctgcagctgtgagattattgatgttttaatatacagaagccctttcttttttcttttatctataacccataacaatttagtagactctgtttttgtaaatggaaatgaaacatttataaatgatatcatattcttccagcctaacccctccagaatctggaaactcttaatgaacattcttcttttcataccaatatagttatttccgtagatgcaataaggacatatctgggacttaattttactgggatttcattgaaaacattggttatacaaccaagaacttgcctggaatgtcatatttgaaaactatgtttatttactcgtatatcaccaagtccttttaagtaactaaagttgttttatggagtcaaggcttacaaaaccattgggtgcagtggtgcacacctgttgtcccagctacttgggagactgaggcaagagaattgcttcagcccaggagttcaagaccaacctaggcaacatagtgagaccccatagtgagaccctgtctttaaaaaataaacaaataaaaaataaaacgcttatacaaccctcttgaaaaaactggcctgggacctggtttacagggtttccagacttactcttttttcattgagtttttgagtttcacgaaggcatcacaatatatctttttaaaaacaacccataattggaaacttaactaatcaaaatgggccacctctcctcattcatacaaatgaatggaagagattggagcccacacagctgccaggctctatgcagggcacttggcacataatctacaggatgtttaaatttttattttactttattcttattttattttactcttatttatttattttattttattcttttttttttcttttttagagtttttttgaaagtccttgtcagacaggtaatgtgtcaacatcataacgaggtttaagggaggtacagctcacacatgagcatgaaaacccaattatcatgcttatgaactacaaaaggatcacaggatatttttgtaagtgcctacccaacagatctcccctccttctgtggtacaatgtgtccagtgttgaactagtagcattcacatttccccacaagtgtcacgaaagggggactgtctcccaagtttccccagcagtaaaacccgattggtttaaggtctgcagggcggatctagtcctcttgccagtgattaattagacatgactgtataacatggctgggaggtgggagcagaagatgagattccaaaaggaaagggtttatgctcttgaaaagagctatgtgatgcctctgatgaagcctatgttagtagagacatctgagagtgtagatgaatgccaatggccctcatggaaagagagagagatgagaaaaagcacactctttttttgcatctacatgtgatgtctggaattacagcagccattttgtgatcatgagagcagctggcttggctaaggacaaaattcgtcacaccaaacatggcagagaagaaagaagattctggattcctgataatatttttgagccactggactaaccaagactggaattggtcttccttgggacttcttaatatgtgggatagtgaattttcacattgaagtaaattttgaatggagttttctgtttcttatagccaaaaccatcttacctgctacaaatattttatttaatttcatctttacaacagtcctatatctgtggacattctcattttatagataaaaatctgagattcagaaagttttagtaacatggccaggcacagtggctcacaactgtaattccagcactctgggaggccaaggtggggggactgcttaagcccaggagtttgagaccagcctaggaaacatattgacactctgtctctaccaaaaaaaaaaaaaaaaaaattacctgggcatgatggtacatgcctatagtccagctactcaggaggctgaggtgggaggattgcttgagcccaggaggtcaaggtagtagtgagctgtgatcgtgccactgcactccagcctatgaaacagagcaagaccctgtctcaataataataataatgacagatagaacaaccacacagaagataagtaaggagagagaggacttaaacaacataataaaccaactagagctaacggacatatacagaacactctacacaacagcatatacattcttctgaagcacatgagacattttccagaatagactatacgttaggccacaaattaagtctcaatacattttaaaagatagatattataggcctggcacagtggctcatgcctgtaatcccagcaccttgggatgccaaggtgggtggatcacctgaggttgggagttcaagaccagcctgaccaacatggagaaaccccatctccactaaaaatacaaaattagccaggcgtggtggtgaatgcctgtaatccaagctactcaggaggctgaggcaggagaatcgcttgaacccaggagatagaggttgcagtcagccgagatcatgccattgcactccagcctgggcaacaagagcgaaacttcatctcaaaaaaaaaaaaaaaagatagatattatataaagcatcttctctaagcacaataggatgaagttagaaatcaataacagaagtaaaactggaaaattcccaagtttgtggaaattaaacaatgcatcaataatcaaaagaccaggtgcagtggctcaagcctataatcccagcactttgggaggccaaggtaagtgaatcgcttgaccccaggagttcaagaccagcctggacaacatagttagactccacctctatttttaaaatatatatataaaataaaaataaatacagtaaaaacaatgaaaaaccaaatagatgaaagaaaaaattgcaacaaaaatttgaaactacagaagaacaaaaacaaaaacacaaccaactaaaacttacaggacatagcaaaagcagtgctaaaaggaaaaactatagctataaatgtttaaatttaggaataagaaagttctcaaatcaacaacctaactttacaaataagaaactagaaaaaaaaaaacaaacaaaacctaatgctagcagaaggaagagaataacaaagattagaacagagattaatgaaatagaaaataggaaaacaaaagggaaaattaataaaaccaaaagttgtctctttgaaaagatggacaaaattgacaaacctttaactaaatggactaaaaaaagagaaaagactcaaattactaaaatcaaaaatgaaaatgggaaaattactaccaactctatggaaataaaaacgattgcaagagagtactgtgaacaattgtatgtcaacaaatagggtaacctggataaaatggaaagattatgagaaacacaaaacccactaaaactaaatcatgaggagacagaaaatatgaatagactgataactagtaaggagactgaatcagtaatcaaacatctcccaacaaagaaaggtcctggacctgttggcttcactagtaaattctaccaaacatttaaacaactaataccaatccttctcaaacttttctttaaaaattaaagaggaggaaacacttcctaaatcattctatgagactagcattaccctaataccaaagccaaaaacactagaagactacaaatcgatatcctttatgaacatgtgtgcaaaaaccctcagcaaaatattagcaaactgaatttagcagcatagtagaaggattatacactatgagcaagtaggatttattcctggaatgcagggacagttcaacatatgaaaatgaattggccgagcacagtggttcatgcctgtaatcccaaaactttgggacactaaggcaggagaatcacttgagctctggcgttcagcctgggcaacataacaagaccctatctctacataagttaaaaaattagccgggcatggccgggcttggtggctcatgcctgtaatcccagcactttgggaggccaagggaggcagatcacttgaagtcaggagtttgaaatcagcctggccaacatggtgaaacccacctctactaaaaatactgaaaaaaaattagccaggtgtggacgggcacagtggctcacacctgtaatcccagcactttgggaggctgaggtaggtggatcacctgagatcgggagtttgagaccagcctggccaatgtggcgaaaccccatccctactaaaaacacaaaaaattagccacccatggtggcgggcacttgtaatccctgctatttcggaggctgaggcaggagaatcgcttaaatctgggagatggaggttgcagtgagccaagatagtgccatgcactctagcctgggcaacaagagtgaaactccatctaaaaaaaaaaaaaaattagccaggtgtggtcatgggtgcctgtaatcccagactcaggaggctgaggcagaacaattgcttgaacccgggaggcagaggttgcagtgagccaagatcatggcactgcacttccagcctgggcaacaaagcaagattctgtctcaaaaaaataaataaataaataaacaacaacaaaaaaagctgggcatggtagcacacagctgtagtcccagctggtcggtagactgaggtggaaagatcacttaagcctgggatgttgagcctgtagtgagctatgactgtgccacttcactccaatctgggcaacagagtgagaccctgtctctcaaaaaaagagagaaaatcaatcaatgtaatacatcccattaacagaatgaaagggttaaagaactacatgatcatctcaatggatgcagaaaaagcatttgacaaaattcaccaccttttcatgataaaaacctcaacaaaccaaaaacagaaaaaagctacctccgcataataaaagccacatatgaaaaatctacagcagacatcatactcaatgctgaaagtcaaaaagcttttccctaagatgaggaaaaaaacaaaaatgcccattctcggcctggtgcggtggctcacgcctgtaatcccagaactttgggaggccaagtcaggtggatcacctgaggtcagaagttcaagaccagcctggccaaaatggtgaaacccccatctctactaaaaatacaaaaattagccaggtgtgatagcatgcacctgtaatcccagctactctggaggctgaggcagaagaatcacttgaatctgggaggcagaggttgcagtgagccaagatcacactactacactctagcctgggtaacagagtgagactaaatctcaaaaacaaaaacaaaaacaaaatgcccattctctccacttctattcaacctagtactaggggttctaaccagagcaattaggcaagaaaaagaaataaaagacttccaagttggaaaggaagaggtataaattatttctgtttgcagataatatgatcttacgtgtaaaaaacttaaaaagattccacaccaaaaaaaaaaaaaaaaaccctgttggagctgataaattaattcagcaaagtggcaggttaaaaagtcaacacacacacacacaaaaaagtcaacacatagaaaccagttgcatttctgtacactaacaattaatctgaaaagaaaattacaaaacaatttcatttacaatagcataaaaaaaaaaagtaaacctgggaatgaacttaaccaagaaggtgaaagacatgtacaatgaaaactacaaaacattaatgaaaaaaagtaaagaagacataagtaaggccaggtgcggtggctcatgcctgtaatccctgcactttgggaggctgagacaggcgggtcgcctgaggtcaggagaccgagaccagcctgaccaacatggtgaaaccctgtctctactaaaaatacaaaaattagccgggtgtggtggcgggggccagtaatcccagctacttgagaggctgacgcaggaggatcacttgaacccaggagacggaggttgcagtgagccaagatggtgccactgcactccagcctgggcaacagagtgagactccgtctcaaaaaaaaagacataagtaaatgaaagcatatattatattcttatattcgtggactggaagacttaatattgttaatatgtcaatgctacccaaagtgatctacaaattcactgcaatccatatcaaaatccttgtgaggtttttgcagaaatagaaagttccattctaaaattcatatggaatctgaagggactctgaatagccaaaataattttgagaaaaaaaaaaagctgaaggactcatacttcctgatttcaaaacatactacaaagctacagtaaccaaaatagcataatactggcataaagacagacatatacaccaaaggaatagaatggagagcccaaaaataaaccctctcatatacagccaaattatttttgacatagatgccaatattattgaatgggaaaagcccagtcttttcaacaaattgtgctgggaaaactgcatatccagatgtaaaagaatgaagttggaccgttatctaataccatatacaaaaattaactcaaatttcatcaaacacctaaatgtaagacctaacgctataaatctcttagaagaaagccaaaagctacatgacattggatttggcaacaacttttttggatatgactccaaaggcacaggcaacaaaagaaaaaaatagacatattggacttcacgaaaattttaaatatgtgtgcatcagaagacaatattaacagagcaaaaaggcaacccacagaatgggagaaaatatttgcaaatcatatatctgataagggattaatatctaaaatatatacagaacttccaaaacttaataacaacaacaaacaacctgattttaaaaatgggcaaaaaggctgggcgcagtggcttatgcctgtaatcccaccactttgggagagatcacttgaagccaatggatcacttcagcccaggagttcaagaccagcctgggcaacatggcaaaaccccgtctctacaaaaaataggaaaatgagcaaggtgtgttggtgcatccctatagtcccagctacctgggaggctgaggtaggaggatcgatttagcccaggaggtggaggctacaatgagcagagatcaaaccactgcactccagcctgaggaacagagtgagactctgtctcaaaaaaaaaaaaagaaaaaagagaaaatgatttgaatagacatttctccaaagaacatatacaaatggccaataagcataggaaaaaatgctcaacaacactaatcattagggaaatgaaaatcaaaactacaagataccatcacctcacacccattacaatgactactatcaaaaaaatggaaaataacaagtgttggtgatgatgtggagaaactggaagccatgtacactggtagcaggaatgtattaggttggggcaaaagtaattgcagttttgccactgaatgtaatggcaaaaactgcaattacttttaatgaaatggtgcagcgactatgtaaaacaatatggtggttcccctaaaaatagaatcactatgtgatccagcaattccacttctgggtatatacccaaaagaattgaatgtaggatctcaaagagatgtttatacaaccatgtcgatagcagcaatattcgcaataactaaaacgtggcagtaacctgggtgtctatcaatggattaacagataaactatgttatagccataaaatggaatattattcagccttaaaaaagaatgaaattctgacatatactacaccatagatgaactttgaggacattatgctaagtaaagtaatcctgtcacaaatgacaaatactgtataattccacttatatcagatacttagagtagtcaaaatcatagagacaaagtgaaatggtgattgccagggactggggagagggaggaatggtgagctatttctttttctttttttttttttagacagtgtctcactctgtcacccaagctggactgcaatggcccaatcacggctcactgctgcctcaacctcctggctcaagcaatcctcccaccttggcctcccaaagtgctggaattacaagcatgagccaccatgcccagcctactttataatgagtatagagtttcagttttacaagatgaaaagagttctgaagatggatgttggtgatggatatacaatattgtgaatgtatttaataccactgaactgtacaatttaaaatggttacaatggtaaattttgtgttatgtgtatttcaattgaaaaagttgaaaaaaagaaaactttcttttttatgtgtgagacagacagggtctcactctgccgcccaggctggagcacaatggcatgatctcagctgaatacaacctccgcctcccaggctcaagagaaaagaaacatttcttagaccatagagcttagtggttaagagaaaactttggtgtcagcagacctgggtttaaatcctgcttctgcatgacctcagggcctctttagggctccttttctctatgcagaatgaagatagcattactgtaacataaggttgtgatgtagactcagtgaaactatgtatgtaaagtacttctgcatgcccagaaaaagaatgatggctatggcaattattaatattatcatgcctctcattgttaccctaatcagtaggcagccagcattttgtttttgtttttgtttttgtttgtttttcgtttttttggtttttttttttttttagatggagtctggatctgtcgcccaggctggagtgcaatggcacaatctaggctcactgcaacctccgcctcccaggttcaagcaattctcctgcctcagcctccctagtagctagaattacaggcacccgccatcatgcccagctaatttttgtatttttgtagacagggtttcaccatgttggtcaggctggtcttgaactcctgacctcaggtgatccgcccacctcggcctcccaaagagctggaattacaggcatagccaccatgcccagctagcagccagcattttgaatggaaagagagcatcttgttcccaataccacagagaggtgtcatcaatttcacttcaggcctcttagagcctccctgtccatgctaaaacttggagctcctgctcttcctgcccagccaccatcaaaagcagcccaactccctgggagcacctttgtctctgctcacattacctccctcccaccattcccagggcgctgagagctttgatgttcacgtggctgcatggcaggggcaggaagataaaatcccacttgttctctctctctacaataccacctttccgcaatttagagggggacagagataaaagagcaggttttttctctttttcttttcttttttttttttttcaacaacaaatggtggtttctctttaccagccgctacttcagagccatgccaacatcaaagagcatgaaatcagtggaaactcaagccagaggacttctgtcccaccctggggtggtgtgtcggggtggggggagcttggctgtttacaaaagaaacagaaagtggagaggagaggagggaactgtgtgcagaggaacatcccactgaggatggcaaaagtttgttttcttagcatttcccctatgccacattaagcttgccaaacagatgggactgagacaaggagggatgcgggaaaaagaaagctcaacttgtctcacgaataaatcttgagttgacttgacatcttctagtccagagggattaaggtggtgacagtgggttggcctgtgtatgtgagtattcaggtgggactcacaagtccgatgacattctctgctctaaatccatgtgactgtgtgcaagggcagaaggaaaagaagaaaagggtctacttgcataactaggaggcctgttgttttccagagtgtgccccatgtgccaggtcctgtgctaaatacctcacatgtagcaaccatggggtaggtaggcttgcttttcccacttaacatatgtgagaactgaagtttaaagagctgaagtccaaaaggagaagcaggatctccactcagatctgcatcaaaatgtgtgttcttggccagatattataaagctgcttcccacggggattgagtgtaactttgaaaagtgacaaacaagataccattgtagggcatcagttattggtgggaatgtgattccaaaaaaagatatgttaaagtctgaacccgcagtccagtacctgtaaatgtgaacgtatttggaaacagggtctttacagatgtaatcaagttaaaatgatttattggggtcaggagaacactaatccaatgactggtgtttttatttgaagagggagattttgccacagatcctcacagagggaagatggccgtgcgaaggcggaggagggagctggagttgtgttgccttaagtgaaggaagaccaagtatggcgcagcccccagaagctgggaagaggcccggaagggtcctcccctagagcctgcgagagcgtctcatgccaaccccttgattttggacttctagccttcagaattgtgagggaataagtgtctgttgttttaagccacccagtgtgtggtactttgttacagcagccctagcaaactaatatcacatctgcctttctgagtttggagagagaccaagacagagagacagagagtcagagagtgttgtggggtgggaataaggcaagacttcaattttcagacaaatatcgtaaagattatctctagcatactggtctggggaatgaggcaaagatgccagccaccagagagagagacagagagagaaatcgaggggggcggtggggtgaaagcagtgaaacaaggggtttcactgaagtaaggggaccaggaagaaagagaagggagctggaacccaagtgagacaggtcagctccttgaacatgaggagagtcaaagaaggttccaaggttccctgccaggaggggaggggttgagaaagagcaggatgctgccaccgtccacgcctgaggacgaccttgcccgcgccagcgcccctgccttctcacacctcaacagggctcttgcatcagactcttcttcagttactgcactcagggaacatgtatttagcactcacaaagtgacaggcactgatggggagaggtggggaggactgccagggtcagagagccgcactaaggacccagggaatggagagccctatgacatcctcagcctggactgctcttcacttcccaatcagcctagaaaatgtccgctcagatttctaggcccactcaacttgactagggcctttaccaccttgctgggcccatgataccttccgtacacctttaatgcttggtagctgtattgtttctttctacctgtatctagatctagatttcaaagaaagcagatccagaagctcacagtctaatggagaattcatatatctcaatctctatctagacctacatatagacctagatctagatagagacatacacgtttttctctttttttagggaaaaaaaaaaaaaggccaggtgcagtggctcatgcctgtaatcccagcactttgggaggctgaggcgggtggatcacttgagctcaggagttagagaccagcctggccaacatggtgaaacctcgtctctactgaaaatacaaaaattagctgggcatggtggtgggcacctgcaatcccagctacttgagaggctgaggcaggagaatcacttgaacccatgggggcggaggtgcagtgagcagagattgtaccattggattccagtctcggagacaaagcgagacttcctcattagactgtgagcttctggaaggtggggccagcatcctattcatctccatctagtctgtgcttttgtggagcctggtgcaacttagttgatcagcaaatagttgacaaatgaatgttctgagtattttagaactcaaacaacaaaaaatgtaaataattttaaaaaataagcaagtgacataaatgcacaactcatgaaataaaatacaaatggctcctaatcgcacgtactagtcacgtcgattccagtcataataagaacgcaagttaaagctatgctgagaaaatattttacctcttagcctggcaacatgtcgtatcaggaggctggggagggagccgggcacaggcaggctcatacctggagtgtgaaatggtgtgtccctaaggagggtaatttggcatcgtcaatcaaaattacagatatgtttatctttagtccaaaaatctcacttctgcaggatacctgctgaatatcttacagatctgcaaacataaaatagctatatgtatagggttacattgctacattgcttgtaacaacaagatatttaaaccaaatcaaaggcccttctctagagaactgggaagataacctgggtaggagcggggaccagcgtggatagctggcgagagaggaagatctctcaaggcgtaactttcatatcaggttgattttttttttttttgagactgagtctctctctgttgcccaggccgtagtgcagtggcgctatctcggcttaatgcaacctccatcccctgggttcctgtgattctcctggctcagcctcctgagtagctgggattacaggcacgcaccaccacacccagctaatttttatatttttagtagagatggggtttcgccatgttggccaggctggttttgaacttctgacctcaagtgatccacccatctcggcctcccaaagtgctggtattacaggcatgagccatcacacccggccgggttgattcttgcattatgtgaatgtattatatagtcaaaaatgatgaattagaaatgaaaaacaggtacgtagtgttaagtagtagatctaaagatagagttggaaaagtcttatgcctgtcttgtccactgcaggaaggttcatggaaagaaataaaaatgactctcaaactcagaataacttaaaattttaaaatggcattaaaatgtacctatcagttaactaattttctgaaagacttaagatggcgtctgttttccttaagaacaacaaaaaagcatcataccaaccaaaaacccctaagtcatctgaaggaaatgccccattgctcactgtggggcattttatatgctcaggacatgggctgcctaaccactatgttccctcattttcccctgccaatcccatcagaattttatttatttcctactttcaactttttctagccagtttcgacctctttttcagaacgcaatatcctcacatatcttggacttttcttttttaattttttccctctctgccccaccaatctgtcttggacttttttttttttttttttttttttttttttttttttttttttgaggcaaagtttcgctgttgttgcccaggctggagtatgatgacgcagtctcagctcactgcaacctctgtctcctgggttcaaacaattttcctgccccagcctcctgagtagctgggattacaggtgcttcccaccacgcccggctaatattttgtatttttagtagaggtggggtttcaccctgctggccaagctggtcttgaactcctgacctcaggtgatccacctgcctcaacctcccaaaatgctgggattacaggcatgaggctctgcgcccagcctgtcttggacttttctagcctccatgccatctatcaaagtcttctaagatctctgactccattcaacttacacatttatactcaaaaatctagattgccttctatgcatatgatgccctacccaagccaggacacaataaatacctcatgtaacccaataaatatctcataacagtcctgtaagatgaagaccatcacaatccatcttctcagcattttacaggcttttttttttttttttttttttgagactgagtctcactctgttgccaggctggactgcagtgactcaatctccactcaccgcaacctctgcctcccgggttcaaacgattctcctgcctcaacctcccgagtagctgggactacaggtgcgcaccaccatgcccagctaatttttgtatttttagtagagatggtgtttcaccatgttagccaggatggtctcgatctcttgacctcatgatctgcccaccttggcctcccaaagtgctgggattacaggagtgagccaccacacctggcctttacaggcattttttaaatggagcctggagaggtctagtactttgtccaaggttatgcagtaaggggaggtggggccaggaagtcatcttgagcagtctgactccatggcccactattcactagcactgcctccctagatgcccccaaaatgcttctggccatagacctttccttctgcttctcatccctctatgcttctttaccttccatgcatgcattcatttgtccataatatccctggccacctgctgtatgccaggcactgtgctaggcgaggaggatgcaaagattaagaagacagtagtccctgacagcagtccctgactttgagaagcttacattccatagagaatgcacagaggtaaaggacaaccccatgcacaggaggttctacaatgtgagcctaggatagggccacccacacacacttgtatgcctttcttgtttttcctcctctgctcaaaaagtcttcatttaaggccctgtgttcatcatgatgggaaaatcagctcaagaaaacttcaggaggattcctccaggtaaattaagttacccaaacagactaacatgctaacaactttcagatttggaatctgctcctctagagcctacagtttgatgactgtcatttcatgttgaaacaagaacaagaggattgcttatgtttgcttctctctgcaagaatctaggttgaaaacaaaatgaaaaggaaatctaatctgaggacacttctcaagtagaagtcagaggaaagagcaataaagaagaactcagaggtcttacctgttacccttaaatgtcttcttcctgatcacagtccaaaggactcatgttactaataccattgttctgacaaagctagcaaggacagtctgctgagcaagtatgcagtcttctctgtgatctattctgtcttcacaggcaagagtgattgcccatgttccatcccccaacaaagcatcaaaaccaaccacacagacctgggttcaaaggcagactctaccacttactgagagatcatcagtgtccttatctggagaatgggaatcatccctaacaggtgcaaagactctagccttgggcatgatcaaattcaaagccttcttgggacactctcataatcagtcactgcaggctttcacctgcacaaccatctagctcagctcttgtgctaatatatcagagccctggccccaactgcccaagggacttgtaattatttttgcagccgtaagtctggcatctagtcctgcagatgggtagggagaacaggtcctatgacctgggaagagagggagttgaaagcaacagagtatcccagctgcagtcacacaggctggggctcagattacactccagacaggatgcagagcaagagtacaaggaaatccaggcgaaaagaaatgctgcaagttggagggagggaagtgtccaggatgcccccagagacagactgagtccatagttagatatcaacaaagcagcacccaaaaaatgactacagaaagaattccctacttcccaaaaaacactcagaaaatcacattgagggaaaaaaatctgaactatgttggactggcctgaacttttgtatagtttaatattgtttttagttttaatacacagaagccaggtgaaggtagggattggaagacatcatattcttctccacgctaggtccactatggttcctaatccagcctggcctattaaataccaatgagatttaatgtatgtctctctagattgagggtcagaaacccaaatgcctacagaagtcaggcagattagataaacgagaaactgtgctaggtgggggtgtaggagctggaacacaaatgctctatggatgcaggcagttgttaatcagtcaattgctgccacagagaagcatggcctgagttgctggatcaatttacttttacattcccacatattaattctaaaaatgatttttccaactgtcttagtctatttgaacttctataataaaattccataagaggagtggttaataaacaacagaaatttatttcccccagttcttgaggctgtcaagtccaagatcaaggtactggcagatttggtgtctagtgagggcctgcttcctagttcataaactgcttcctttttgctataaccctacagggaagaaggggtgagggagctttctggggcctctttcataagggcgctaatcccattcgctacggctctgtcctcaaaacctaatcacctccccaaaccccaccttcttatacttcacattggtgattaggttttaacatatgaatttgggagaacataaacattcaaatcataacaccaacctattttgggggttttttgggggttttttttttttttttttgagacagagtctcactctgtcacccaggttggagtgcagtggtgcgatctcagctcactgtagcctccacctcctgggctcaagaaattctcctgtgtcagcctcccaagtagctgggattgcagctgcctaccaccaggccctgctaatttttgtatttttttaactagagatggggtttcaccatgttggccaggctggtctccaactcctgacctcaagtgatctgcttgcctcagcctcccaaagatagcaccaacctttgttcaatttataaaagatgtttgaaattaaagtctgattaatttctattttcattatggattactaataatatcagctaacacttccataaaacttacatggcaggcagcattctaagtgctttattcacgttgacccatttaatcctcacaacagccatttgaggcaaatctatcatcatcctcctgttgtaaattaagaaattgggagtctctgagcctactctggctcaagaggctgcccaataagaaataagaaattgttttttaatatttaaaagaaagttaaagaaaaagaacaaacaaattaagaaatagaagcataaagtatcaagcaaattctcccaactcactcagataatttgtggcacagctggagctacatggacaactaaccctgggttcaagatgagtttaactttgaggcttccagaaaagacatgagagagccctcctgtaaatggtgaatggttttcttttaccaaagtctttataatagctcattcccccaaaaccctataaatcagagaagtcaactctgaccccttgtctgtgttagtcaaaaagtttcattggagcagaaccatacctactcgtttatgtgtcctctgaggctggctttggtgtatggtctctaccatgagtagtcataacagagaccatgtggctcccaaagcccaatatgtttattatctggccctttacagaaatagtttgcaaactgctactctgaatttaaaaagattttttaaagttcttatactttatacttaattgtactagactcagattaagaaaaatatgtccttgaggccgggcgtggtggctcattcctgtaatcccagcactttggaagggcgagacaggcggatcacctgaggtcaggagtttgagatcagcctcaccaacatggcaaaaccccatctctactaaaaatacaaaattagccgtgtgtggtggcacacgcctgtaatcacagccacttgggaggctgaggcaggagaatcgcttgaaccagggaggtggaggttgcagtgagctgagatcatgccattgcagtccaacctgggcaaaagagcgagattccatctcaaaaaagtaaagaaaagaaaaagatgtccttgaggccaggtgtggtggctcccacctgtaatctcagcactttaggagtctgagacaggcggatcacttgaggtcaggagtttgagaccggcctggtgaacatggcaaaaccccatctctactaaaaatacaaaaattagctgggtgtggtggcgggcacctgtagtctcagctacttggcaggctaaggtggaagaatcacttgaacctggaaggcagaggttgcagtgggccgagattgaaccattgcactccagcctgggcagcagagcgagactccatctcaaaaataagaaaaatatgtctttgaaacttcaattaaaagtatctcctcctaaagttgaattcatagaaggaagaaagctcttaactagaaagttccttaaaaacacacagatatggccaggcgcggtggctcacacctgtaatcccaacattttgggaggctgaggtgggtggatcacctgaggtcaagagttcgaaccagcctggccaacatgaagaaacactgtatctactgaaaatacaaaaattagctggacgtggtggtgcgtgcctgtaatctcagctactcgagaggctgaggcaggagaatcgcttgaacccaggaggcggaggttgcagtgagctgagatcataccatagcactccagcctgggcaacagagtgagactctgtctcaaaaaaaaaaaaaaaaaaaaacacagatacataaacttttatggaaattttcagtttcttctataaaagcagaaaaagaaacaattcaaaccacaattccatttctccaattatcaaaaatctgccaatcctttttttatccaaaaagacaacttttagtggtaaaagctgcttttttgtggcaactgttcttgtttctattttatttaaggttttttgaataactagaacatactagaattgtgtttaagaagactgagaatacatcttacatttgtgactaatgaccctcttagactgaaaatcaatgtttaggcaataagtgtaaattttacagattacaataaaataaaaacaagttagtacacagctataatttgatgaagttaagatggtatttttaaactgaaaggtcaagtttcttgtggaaacaaatatgtgtttccaaggattgtctcattagtaactggtggaatcatttataaacaaataagacaaacaacctttccaggcctcaattcttaagataagatatagaaaaaggtcattttaagaccctaggaagtgtcacaccatcaggacctttctacaaatgagtgtttaaatatactgatgataaatacctgaagaaattaagttgaccttaaagaaattaaattaagttgaatcattggattttgtcctaaactttgcagaatcagagatcatttcgactttgcagacttcaagcagggtatttttctgctcaactgcagttgacatttcttgcatggtaggggaaaaaatatctaaacaaatggagggatacactgtgttcatggattggaagtcacaatatgttaaaatatcagttctccctaaattgatctatagattcaatgcaatcacactcaaaattccaccagacatttttgcagaaattgacaagctgattctaaagtatataagaaaaagcaaaggaagtaggatagccaaaacaattttggaaaagaatgttagctgcctcacactacctgatttcaaggttttgtttgttttttttttttttttttttttgagacggagtcttgctctgtcgctcaggctggagtgcagtggcgccatctaggctcactgcaagctccgccgctcccgggttcacgccattctcctgcctcagcctcctgagtagctgggactacaggcgcccgccaccacgcccggctaattttttgtgtgtttttagtacagacggggtttcaccgtgttagccaggatggtctcgatctcctgacctcttgatctgcccgcctcggcctgccaaagtgctgggattacaagcatgagccactgcgcccggccttttttttctttttaattttttttagagacaggatctcgttctatcgcccaggctggagtgagtggcatgatcgtagctcactgcacctgggctcctgagctcaggcgatcttcctgcctcagcctcctgtgtagctaggactacaggcacacacaaccacacctggctctgatttcaagtcttactgtaaagttaacaataatcaagatattaaagaaggccaggtgcggtggctcacgcctgtaatcccagaactttgggaggctgaggcaggtagattacctgaggtcaggagtacaagaccagcctagccagcatggtgaaaccccgtctctactaaaaaaaatacaaaaattattcgggcatggtggtgtatgcctgtaatcccagctactcaggaggctgaggcaggagaattgcttgaacccgggaggtggaggttgcagtgagccaagatcgtgccattgcactccagcctgggtggaaagagcgaaactccgtcttaaaaaaaaaaaaaaaaaaaaaagatagtaaagaataactgctgcaaatcacttgggcttaatcaggtggtaaagatttttgtttccagagtaactaaaattttaaaaactaacaatatcagccaggcgtggtggcttacgcctataatcccagcaccttgggaggccgaggcggcgggcaaatcacctggggtcaggagttcgagaccagcctggccaacatggtaaaaccctgtgcatactaaaaatacaaaaagtagccgggcatggtggcacatgcctataatcccagctactcaggaggctgaggcacttaaacccaggaggttgcagtgagccaagattgtgccattgcactccagcctgggcgacagagcaagactccgtctcaaaaaataaataaataaataaataaataaataaataaataaatataagaatacaaaaattagccaggcatggtggcacacacctgtaatcccagctactcaggaggctgaaccaggagaatcccttgaacctggggggcggaggctgcagtgagccaagatcgcaccactgcactccagcctgggggacaaagagagactccgtctcaaaaaaaaactaacaatatcaagtgttggtgaagatgtggagcagccagagcaaagtggtgtgtagttagaaaaatgaaattaagtcaaagaaaagacttggacaagagtgtttatagcagatctattcgtaatagatccaagtgtccagcaacgagagagtggattaaaaagtgtgatatgttcatacgatgagataacaaacactcagcaataaaaaggaacaaactactgatacgcagaacattatggatacatctcaaaatcatcagcttggttgaaagaacccagaaacaaaagagtatattctatattatcccatgtgtataaagtttagcaacaggcataactagtgacagaaatcagaacaatggttgcctctgcaaaaggcaggtattgaccaccaagggacacgaaggaactgtcaaggtgagggaaatgttctatacatatcttgacttgggtgacaatcacatgagtgtaatcatttgtccaaattcgttgacaaattcacttaaaattggtgcattttcctgtatgtaaaatatatctcatttttaaaacttgtgtttccacattgaccagaaagatcaacacatgatctatctcttattcattgtgctttcatttttaggactagttggcagaaatctaaggctttaaacaggttgtctatgattctagtcagagctaccaacctcttaacacaagacgctccttctttcattcattctacaaacagaccacaaaacaatcaaacactgtttcaatatataatttatacaatacataatttatgcacgaacatggcactcttctggctttttatattcattagttaatctaaattctactttttaaaaatatgcagtacgggccgggcgctttggctcacacttgtcatcccagtactttgggaggccgaggcagacggatcacgaggtcaggagatggagaccatcctggctaacgtggtgaaaccctgtctctactaaaaatacaaaaaattagccgggtgtggtggcgggcgcctgtagtcccagctactccggaggctgaggcaggagaatggcgtgaacccgggaggcggagcttgcagtgagcagagatcgcgccactgcactccagcctgggagacaaagtgagactccgtctcaaaaaaaaaaaaaaaaaaaaaaaatgcagtacggccaggcatggtggctcatgcctgtaaggcaggaggatcacctgagaccaggaattcaaggccagccttatgaacagagcaagaccccatctctacaaaaattttaaaaataaaaataaaaaaattgccgggcatggtggtgtgcacctgtagtcccagctactcacaaggctgaggcaggaggattgctcgtacccaggagtttgaggctgcaatgagccgtgatggcaccattgtaccccagcctaggtgacagagcaagaccttgccttaagaaaaaaaaaaaaattggggtaggaatatttaacacatgagaatcaaggttcagaaagatcaaggaacttccccaagataacataactaaggagtgatgtcatgaagactcaaacccagatcctaagcacacaccctttcctctccccagtaaatactcttacaacgcacacttgtgtgtgtgtgtgtgtgtgtatgaaatattcaaattgctaattgtagattttccattcttttatcatgaatctgtgataacagtttttttgtgatatttaaaaataaataatcaaagcctttataaaggtctggagcacatggaaagtttgaaaccatagcctgattcaccatacctggctctcattctcaaacccctgtttgctttgaattctaggggctggaatactgacagtaaaagaaggaaacatttgtagtgcttgccaaagggtaaagggggagtttctcttgctttgtttaggtgtaaaacataatcctctattatcctgcacaccgaagtattgccagcgtctttagaagggaggtagacatactgtttgcattttcaaattttaaaattgaggtagtggctcatgcctgtaatcccagcactttgggaggctaaggtgggtggatcacctgagatcaggagttcgagaccagcctgaccaacatggtgaaaccccatctctactaaaaatacaaaaatgagctgggcgtgatggcaggtgcctgtaatcccagctacttgggaggctgaggcaggaaaatcacttgaacccaggaattggaggttgcagtgagccgagaccacaccattacactccagcctgaacaacaagagcaaaacttcatctcaaaaaatgaaataaaataaaataaaattgaaagcaattagcaggaaaagagaaatgagcttcctcatctgcaaccactggctgctcttccaagccatggtccttagaatatggttccttactgaattttttgttctcattagtggtttttaacagtgaatttctaactacccaagtctataccaaagccataattatttaattctgatctgttagaaactttctaagaatccacccaaaaatgccagaaaaattcaaatgactctcgtgtatatagtgagattagtattccacagaaatgcctcattaatgtcaaaataattcacttaaatcttatcctagcaaagcataaaacagctatgaaaaagaataatatcgtgtagataccaagacagaaacaagctgaatagctggtaatgtttatagacgagcaatcaattaactgatgaagaaaaagaaaaaaaatcactattgaaaaagcaggcttctagtctacttccataatactaatgctctaaaagtcattttgcatcatccacagaaagctcccacatatctggccaacaaaattggaagttggtttccaatctgttttcaagtcctaatcctagtttccctaaaaaatagtttgcactttaaagagcccaggacaataattcccctggagacaatttacttttgtggctggcttgtcattctacatataaaccatcttaggcatcagctataagctaaaaaatctcattcctctccttggctcttggagcatggaaataataaaagtgtttccccagatcttacacccttctgagttccaagcagcagtgaatatgattcccaggattgtaaatagtcttataaatcttgccttccctgacaggtttaacttttcatttttcttaaatattagcaataaaagtactgtgtgtaaatatccttaagatttgggcaaagctatcacaggattcaaaatacccagtgcctataaacacacggcttttcatacagctaacagtggagaaacaattccaggagtgtgccaggaatagagaggaaagattctaaataatacaggtgaggtagaatcataaaggaaaaaaagttaactttaaaacacataatttttgttctgcaggcagtttcaaattgggtcgttcaagccagggtgttttttgactttggttctccctagggaaaagcacacagtagcaaaggataatgaaaaggcctggagaacttggatacagacggtctgggatttcaatcccactttaactctcccaagacaagaaacttgaacaataataaattgataataacagtgaacagttattgaaacttaaggtgtggtgggctgtcctaagtgttttgtttttgtttttgtttttgagatggagtctcttgtcgctcaggctggagtacagtggtgcgatctcagctcaccgaaacctctgcctcctgggttcaagtgattctcctgcctcagcctcccgagtagctggaattacaggcgtgcaccaacaagcccagttaatttttgtatttttagtagagactgggtttcaccatgttcgccaggctattctcaaaatcctgacctcaagtgatccgcctgcctcagcctcccaaagtactgggattactttgggattactgagattacaagcccggccttgtcctaagtgttttatgtacattaactcatttaattctatgaggtagtgaagtgtttaggaggataagttccggagctacactgtgtgagttcaaaaactttcccatttgctaactatatcatcttgggcaaattccttttctgtataatgatccttcaatggtatctacctcctaggttacttataagaattaatgagctaatactaaccataagcacttagaatagtgtttggcacaatgtaggtgcttaattgtttgccattcttattttcattttacattaggaaactgaggcatagaaagtctgtttactagagatgcagtaattaatatctaatgaacctgtaatatctggtactttgtaaatattttacacgatagttattttttattccataacaaacaaagaggttgaaaggttcttgtattggttcaaaccccgagagcacaccaacagataacacaaggcggtgtggagcaacatgctgttttaatgagcgcctgggtgcaggcaggctgaggcctaaaatggcgtcagcaccaagtgaggatggggcaggggttttatagtcctctgtaaacaagaagtgtcccagtctgacgtgactgctacgtagtacccagacggcctctttctcaatcttcaggggtacatgtctccctgccagagtaggtgtcttccggccagggtaggtgtcttcctggcagctctcttcctgcttctgctgtcttgctgatgcacgcaagtggccttgagccttgggactgggcctgagaagggaggagttatccctccaagctttcagaccccgggagaatctttcagaggtcactgtgaaaacaactccccctttgtaattcaaaattgcgcttcgcctatgtaaaccaaaaataaaattataagcctcccaactgactgaatggatccctcctcttggccaaggggattccagaataagcctgaaaaactacttcaggccatgatgggaaggaggggttgagtatgcctcattatactctcctccctttggaattcaggtacaactgaccaacagtaacattaaaatagagatcccaagactgacaaaacagattctttgtagcaataagataccaaattccaacctgactctagtataacatcacatgacagatagcaggccctgaaagaaattgaggcattttaccccaaaatatatttctttgacagattttgaaatggccctgcaaagctatctcctgtggggaaaaatctacattctgtagagaatcctcttcccttttcaggtcttttcctgatctgggggaaattaaaagtctagcacctaaaaaataaattaaaaataattttaaagaaataaaaataatttttaaaaaatagtctgacactttttaaggtctgataagagacatttactatctatcctctctgaagcctgctacctggagacttcctctacataataagaaccttggtctccacaaccccttatcttaacctacacattccttttgattgattccagctctttagataatgacttaattcttttttttttttttttgagacgaagtctcactctgtcacccaggctggagtgcagtggcatgatctcggctcactgcaagctctgcttcctgggttcacgccattctcctgcctcagcctcccgagtagctgggactacaggtggctgccaccactcctggctaattttttgtatttttagtagggacggggtttcactgtgttagccaggatggtctcaatctcctgaccttgtgatccgcctgcctcggcctcccaaagtgctgggactacagatgcctgccaccacgcccagcaatgacttaattctttcaaccaattgccagtcagaaaatctttgaatccacctatgacctagaaccaccccactctgtttcaagttgtcccacctttctgtacactttacatgtattgattgatgtctgcgtgtaattcctgtccccctaaagtgcataaaatcaagctgtaacccaaccaccatgagcacatgttctcgggatctcttgagactgtgtctccagccttggtcatttatatttgactcagaataaaacaaaacctctttacatattttacagagtttgacactttttgtcaacacctaaactgatcataaaaagttccaactgtagatttctaatacaaaactttttttttctttttctgagatagagttttgctcttattgcccaggctggagtgcaatggtgtgatctcagctcactgcaacctcctcctcccaggttcaagcgattctcctgcctcagcctcctgagtagctgggattacaggcctgcgccaccaagcccagctaatttttgtatttttagtagagatggggtttcaccatgttggccaggctggtcttgaaatccttacctcaagtgatccgcccgccttggcctcccaaagcgctagggttacaggcgtgagccaccgcatccagccataaaaaacatttaaatagctgtccattactatcatgcccttcttgcattcctggtaataaatccagagcacattaaaactctacacattgaatggagacattctgcaataactcttgtgttaaatcatctttccaatagtagtcagtttactgatctgtaaaatgggaaaccaacactagtccccacagcagggcaccttagggtgaattctctgctgtctacattgtggcccacacactggacagccttggaagcttgagtagagaacacagccatctctcagcgacaaactcccctaaaccaggctcatcatcaaggcccatatataaaactaaaacgtcaaattatttttctttttattttttatagaaatgggatctcactttgttgccctagctggtctcaaactcctggcttcaagcaatgctcttgctttggcctcctaaacagaatgatgaattattaatttataaggagatatagcccgccaagcaggcctgagaatagattagttgatggctatatttgctccctggaggccagagtataattaggttgcttgatgaatgcagaaccagaaagcaggcagagtcatccacctccagaggaactggaattgaagagtttgtactggggcctgatgaggcggggcctttgctctgtagccaaccccccttaggcacagtttagtttgccctcctctcgggcgaattaatttcctttctgaagggcacattctttctttgtctctgtaaataacttcaagcctattagtcaagtcttgggacctagaagccattccatcctttaaggtaatttgcctacataatctgattccttttatgtttgttttgcaatttagctctctctgaaggcaatctcctttctgaagttcaaagcccatagggaagtatatccctgtttcttccatacaccaacagtaagataatcacctagtctagcacaaaacaaatgctccagaaaagtaatcccctttcgtaatgcccttcttccaaaaggtcaacaatagttttacctaccggtggaactttagaaatgctcatggggggacactggcagatctaagggtgagttcattcattcattcattcattcatcttctactttctggctattaggtgccaagggctgagaaatgtgctatgagtcaacaggatgtgaaaaagacatggaccatgccagcctgaatctctaaggtctttgaaacaaatattaacaaattaagctacactgtaatcctaccagagaaggcaaaattataacctgagaaaagtactctgaagaagaaaagaaatacaattcttttagaaaacaaatgatcaggccaggcacagtggtttacacctgcaatcccagcactttgggaggccaaggctggtagatcacgaggttaggagttcgagaccagcctggccaacatggtgaaaccccgtctttactaaaaatataaaaattagccaggtgtggtagtgcacgcctgtaatcccagctacttggtaggctgaggcaggagaatcacttgaacccaggaggcggaggttgcagtgagccgagatcacaccagtgcactccagcctgggtgatagagcaagactctgtctcagggaaaaaaaaaagaaaacaaatgatcagacccaactcaggcagttgaaaaggctttcctgaagaaatgagatgtttgttgaggttaagaggagagaagtagatgttagctggtgggggcagagagtgggtgaacgggcttaggaagaggagagcctttcatccgaaggaaactgcacttgcaaaaatcttaaggcttgcaacagtgagcagcaaatgcataagaagaacctaagaaaggccagccaagcaggggagcaaagaaccattgagcaaagcagtgataacacaggtggcataggccaggcatggtggcttatgcctgtaatcccagccctttgggaggccgaggcaggcagaacacttgaggtcaggagttaaaagaccagcctggccaatatggtgaaaattcgtctctactaaaaccacaaaaattagccaggtgtggtggtggagtgcgtctgtaatcccagctactagggaggctcaggcaggagaattgcttgaagctgggaggcggaggttgtggtgagccaagatcgtgccactgcactccagcctgggcaacagagtgagactttgtttcaaaaaaaaaaaaaaaagacaggtgccataggtaggaaggggctgacccatgcagggtctggctggccaaaacatcaattttgatctttataccaggaagaagagttttagggcaagttgaagatccttgagcagatgtgtacttctaaagatcactcttcctgcatagtggagagtaagttgaaaggggctaaagaggaggcttggggaccaacttaacaggatctgcggttgtccaggtgagggatgctggttcccttagtgcagatgaggagaaatggacagggctgagatacagagaaaataaatgcctattaataagcaaaggttaagaaaaattgtccataccatgatgtcaacctaaaggaaaaaactgaggcaaaatttgtataagtatagcgtttatttgggccagatttgaggactgcaacccagaagcatagattcaagttgctccgaatatacactccaaatagactcaatgaaataatgggacagaaacttaggggattggccaacgagaatggccaggaaagagcactaaggaaacttgggaggtgaaatcttgtgttggtggttacatgaatataaattttttttttttgacatggagtcttgctccgtcacccaggctggagtgcagtgtgcgatctacaacctctgcctcctgggttcaagcaattctctcgcctcagcctcccacgtagctgggattacaggcacctgccatcatgcccggctaatttttgtatttttgtagagatggggtttcaccatgttggccaggctggtctcgaactcccgacctcaggtgatccacccacctcagcctcccaaagggctgggattacaggcatgagccaccacgccaggccataaacattttttttaattcatccaaatatatgtttaaatgattaagtttcattgtatgtaaagtacacctcaataaggttaatattttttaaaaatcagtttagcttaattattaagagcaagtacatggattttggaagtgtacagatatggctttgaatcctagctttaccattagtaattgtgcactctaagaaagtcagttagccaatgtaagctttaagtcttatcactggtaaaatggggagggaggatggctgttttgaagaccaaattgcctagcttagcagactgccaaatacaaaggcaagagggcttttcattcaaattttattccttgccacagtggaagtattaggtgaaaaattaatgtttcttgagtgtttccttgttttctttttctttttcttttttttttgagacagggtcttattctgtcacccaggctggagtgcagtggcatgatcacagctcacagcaggctcaacctcctgagctcaagcaatcttcccacctcagcctcccaagcagctaggactacaggtgcatagtcccacatctggctaatttttttaagtttttttattaaaaataactatattgcccagggtggtctcaaactcctgggcttaagtgatcctcccaaagttctgggagaacaggcatgagccagcagacccggcccatttcttgagggcttcctattattaggcctatggtaggccctttacaggtgttgtctcatttgatcctaatggaaactctaagagatggtctttgttcctatagcttagaaacttcccaggaaccagtaagttggtcaaggtcattcacagacagaacatggagccaaagttccttgccacagtgagagaatgctgccttcgccccaccctcagtgactggggaggaaacatgagggtcctcacaggggattttccaaaagagagtttaaccccaagtggtctgaaagatgattctaaatggcacacagtaggtcatttattattttgcttttattgtattcagttaacttctgtttcatagtagtcttccatttatgataattaatttaatctccttttaaaataagcttaagtttttaaagtgagtcaaattaaagaaaattatgaaagaattgatagtatgggcattacttgtgtatttttcaaaattgggaagaagatttggaaagcttgagaaaggatgggccagcccaagcagagacatgttaaggccctgagatgccagaaagacagtccaaggaggcggggaggattctggctggcttatgaccctagaacacctgagaagaggctagagggtcagaaagggggtgatccctttcctcaccatcacaggggttacagctgacacctataacaaaagacaggtcaacaagagaaaagcctaacacatttatttgatcacagttttatgtgacacaagagccttcagaataaagacccacagatacaaggaaaactgtccatttttatggcttaggttcaatgaagaatggacagccatgtagaactgtggttggacagaaaaggaataatctaaaggaaatagactgagtggggaaacctattaagccctgtggactcagattcttcttggcctctctgcagcatttctttcttcccagtatggggccagaccctttctgcaatgggagtcttatgacctattaccaaacaaggtaggttagagaattttttatggcccctcttacacagaaaggcctgggaagtttagagtaatatttttagcttttctggctggctttggggaagagcagttctatgacccgccttgcggaaggattctagtttctacagctagcctcaagggagaacaaagggtgagagacaggaaggcaggggaaagtcagagagaaactttgcttcagtggctgcttctgataccttcactttggggtattgttttcggagccccactgagggcttatgctcacattactattgcctcctatttgagcagcttcaagacatctagggaaaatacctggaccccagagaaggaataaagatggggaaggaagacatgggaggaggagagtaggaggaggatggaaggaagctggagaaagtgatccagatcgagtagctgtcagctccaggctgggattccaagtaccatcatctgtccgccccagctagggcagcagtctggggaaagccaaaacagctcaaagctttcaaaagccctattttcccctatgaactagggagaacctggctgtaaaagtgatcattttcaaaaacaaagaattaaaataatgaatcctcttgcagtttcagctttgcccagtcactgtcacaggtggcctttgaagatgaggcaagagataatagggtaactattcctagaaaaagacagtgatggtctgcagatttaaatccagagcttcttacaccaggtattgtgttttccaagcaagagctttgcagagcagctgaatggcccacaagatacattcttctcagaagccacaactgcttgcgtttttcctaatctttaggggatttttttaaatgcttatagaatttattctataccttgtttctgctcctgtttttctggtaccagcagggtgtagcattggatttggtcaaattaacttttaaataaagcccctaaattctactcctaatacccttaccaggatcatcccccaaaacacacactgtctatgcccaggctctcaagagagatgttccggaagcttattcatctacaaagggagcaagagcaagagaaattaagaagcttctttaaaactgcaaatcagtttgcacaaagaaagagcaggaaaataggaatgagtggccaggcttcagtgttagacaaagtctagacccaggagaaagaacatcaaacctacacactatgggtggaactttgtgggggttgaagaaaaggattataagccaggggctggctaatgcaggaggatcacttgagcccaagcattcaaaaccagcctggtcaacatagcgagacctgtcttgaaataaacaaacagccagcacagaaagacaaacttcacatgttctcacttagttgtgggagctgaaaattaaaataattgaactcgtggagacagagagtagaaggatggttaccagaggctgggacgggtaggtgggggtaagggggtagcaaggatggttacaaaaaaatacaaagaatgaaaaagatctagcatttgctagcacaacaggaggactatagtcaaatataatttaattgtacatttttaaataactaaaagagcataattggattgtttgtaacacaaacgataaatacttgaggtgacggatacccctgatgtgattattacacattgcacacttgtatcaaaatatttcatgtaacccataagtatatacacctactatgtacccacaacaattaaaaattaaaaaaaattaataaaggaaacaaaaatcggggggcttgcgggttcacaagagattatttgggagaaggcctagttcaaaatgaacactgaatgtttgcagattgaatcaataaatgcatgagtggctggctaagctagtgggcccatggcaagcccaggagagagaagacagggagcagaccaccagaagcttattcttatgcttctctagtctcagtcaaatttgggtcaaaaaaatagaggacacatctaggtaccttagggcccctttgtccagacctgtgcattggaacaatatgagaatcagcacctccccacctacatttcataataaagatcgtaggagttttctcaattgctaacagtcagttacagttggaactgcttgttctcctctttctccccttcttacaactgcacttgactagtcttatttattttttttctttaaaaagatcatataagctcctaggcctttctaagcttaaaaaagctgaaactcactaaggggaagagaactgtgaacatgctgcatgataacttccatatgaactagtaaaacttccctaaacatatggttgttatcatagatagcatcattgtttcagggagcacttactgaaaggctactacgtacctacagacctcatgttgatgcagaacaggtgcttgatcctaaacggtggtgacagttcacatagacagagagcactgggtgaagagtcaggaaatatgaattccagtcctggctcagacactaagtggctttaggaaataggcattccaagcagagaataacttgtgagccatcacagactgacaagaaaaagcatgtgtgagatcaagaaactataagcagcatggtgctcagtagaatcgctgggcaggagtggctaatacttattgagggctcagtaaatagttgttgaatgaacgaatgagggggaggaagatacagatcacagaggatcttatattcattctatgctaagaaacatgaatgtctcggccaggcatggtggctcatacctgtaatcccagcactttgggaggccaaggcaggtggatcacatgaggtcaggagtttgagagcagcctggacaacatggtgaaagccctctctactaaaaatacaaaaattagccaggcgtggtggcgggtgcctgtaatcccagctactcaggaggctgaggctgaagagtcgcttgaacccgggaggcagaggttgtagtgagcggagatcgcaccattgcactccagcctgggcaacaagagcggaactctgtctcaaaaaaagaaaagaaaagaaacatgaatgtctcttggaggcaatggagaaccactgaggacagaggactttattcagacttaggttgtagctaggggctgtgctacataaggagttaatttaggagaacaaggaattacacagaaagacccattaaggccggtcgtggtggctcaagcctgtaatcctagcactttgggaggtggacgcaggaggatcacttgaggccaggagttccagaccagcttggccaacatagcgaaatcccatctctactaaaaatacaacaaaaaattagccaggcgtggtggcacacgcctgtagtcccagctattcaggaggctgaggcaggaggatcgcttgaacccaggaggcagaggttgcagtgagctgagatagtgccactgcactccagcctgagtgacagagtgagactccatctcaaaaaaaaaaaaaaaaagaaaagaaaagaaagaaagaccggtgaagaagcaatgatcaaagagagggagaagagcaaatggcttggagaaaccagacctgaaacagacagcacttgctgggtgattagatgagggagataagtggaagaaaaattgaatcatgggcttttagggtaataaagttcttgatagtaacactagtttacatagaaagtgcataaagtgcaagtaactgataacttcggtttggaatgttaagtggaatatccatgtggaaataaaccagagctaacatttactgagcctttcccatacgccaaaagctgttttaagtcccctacagatgtgaacttgtgtaatcctgcaacagccccatgagataggtactattattagagtcccttttttagacaaggaaaacaaggtacagagagtttaagtaacttctcaaggtcacacagctggtcagtggcagagtcagattcaaactcggacaatcaactccaaatcccactttcttaacctctgtgtaaatgggtatttgccatatagtgagggcacaaagccatcactctacctcttcttggagaagtaaaaaacaaaaaataatcaaatcaaagtgatgatttacattttttaagcacacgaaatgcaagaattccaaccatcagattgtgaatgccattatttttggtgctgtaaaacatattaatagttaaatctaagtctacattttaatatacatctagtctccaaagcaaacaagatgtaatgtgatttgtaatatgcacttgtcaagtcctgctttatttatttatatatttatttatttatttatttattgagacagagtcttgctctgcacccaggctggagtgcagtggcaggagcttggctcactgcaacctctgcctcctgggctcaaacgatcctcccacctcagcctgccaaatagctgggatcacagatgcatgccaccacatcagctatttttttgtatttttagtagagacggggtctcgccatgttgcccaggctgatctcaaactcctgagctcaagtaatccgccagccttggcctcccaaagtgctgggattacaggcatgagccactgcgcccgaccctaaatcatgcttttttatataatctatttagagtaaattaagtagcatacgtcatttgtttaaggaaaagttaaagctggtgtttatatgcattataagtattattacagaacatattaagacatacttcaatataatctttaaaaacataattctcttaagttgattttttctttttttttgagacaaagtttcactcttgcccagtgaagcagcatgatcatagctcactacagcctcaacttcctgggcttaagcaatcctcctgcctcaggcacctgagtagctgggactataggtgcccatcatcatgtcaggctaattttgaaaaattttttttttttgagacggagtcttgctctgttgccccaggctggagtacagtggcgagatctcagctcactgcaacctctgcctcccagattcaagtgattctcctgcctcagcctcttgagtagcttggactacaggcgcctaccaccatacttggctaatttttttgtatttttagcagagatgaggtttcactatgttggccaggctagtctcaaactcctgacctcagttgatctgcccacctcggcctcccaaagtgttgggattacaggcgtgagccactgcaccaggccctaatttttttttttttcttttgtagagatgaggtctcgctatgttgcccaggctggtcttgaactcctgacctcaagcaatctctcaccttggcctcccaaagtgctacagttataggcatgagccactgcacctggcattaagttgatttttaaaaacctaaaataatttctttatttcctaactactttgcagaaataacataatgactttagttccttagaggggatcataacattatttattactgtaaaatagatttgaattttaaaagatcaggaactactgcttggcaccgaggtgtaatttctgccattttgagacatattccataacccagggatccccacaaacaactacgacaagaataaatatgagatcctttccattccagggtttgtggtagagggtttagctttgacttggaccccttactgagtgactaaccattacacagacagagcttgtgacctcatggacatgctcagctggtgagctattctgccaggagctcagtgctattttcatttggctttaatctttcctagatcaagacatagccttctttgaaaagccaggtttagtaagatatacacatgacgtattctcagaaatgaaagaaaacacttttagcttccttccctagttaccaaaactctagaacttactgtaaccctaatagcagccaaaaagaaggtcttttctcttgacccttggctgacccttcttccacttccacgaattttctccctctttctggctatggcataagttttgttccccttgagattcagcccttaacagaaataattcaggcagggtaacagaatgttctagagcactcagccatgactactgagcactcaaaatatagctacagtgacagagaaaggagattgtaattaatttaaactttaatttgaaaacttggaccagatttagttattgaagaacttctacataatttagttattggagaatttctgcatatgtttggaataactttgatatgtaaatctactttttcaactgtaaattttgtgaaacctaaattttataaaatctaattttatgaaattttatgaaatctaaatacagaccaagtatttccaatgaaaatttagtctccaaaccgagatgtgctatgtgttacatccacaccagatttcaaagacttagcacaaaaaaagtaactgtctcattaatagtttttatattgattacatgttgaaatgataatattttggctatattgggttaaaggaaatatattattaaaattaatctcacatggttctttttactttttaatgtggctattagaacactttaaataatatatggggctcacattatttctatcagatggtgatggtctacagcatgggtgatagtgtcacagagactaagctcccccgacttgctggctgtgtgactttaagccatcttcttaacctctttattattttattttattttatttttgagacagagtctcactctgtcgccctggctagagtgcagtggcacaatcttggctcactgcaacctctgcctcccgggttcaagcgattctcatgcctcagccacctgaatagttgggattacaagcatctgccaccatgcctggctaatttttgtatttttagtagagacggggtttcaccatgttgcccaggctggtctcgaactcctggcctcaggtgatccacccacctaggcctcccaaagtgctgggagtacaggtgtcagccaccgtgcctggtctacttagcctctttaaacttctgtttactcatctgcaaactgaagaaaatattggccgggcgtggtggctcactcctttaatcccaacactttgggagaccaaggcaggcggatcgcctgaggttaggagttcgagaccagcctgaccaacatggagaaaccccatctctattaaaaatacaaaattagctggtccagatggcgcatgcctgcaatcctagctactcgggaggctgaggcaggagaattgcttgaacctgggaggtggaggttgctgtgagccaagatcacgccattgcactccagccttggtaacaagagagagactccatctcaaaaaaaaaagaaagaaagaaaagaaaatattacaattttctgaataggcatacagtgaattttacatgagacagtgagcataaactgtgcctgacttatagtaaaatattctgcaaatattcacttttattatcattgttattattctctagcaatcatccagatgtttagcaaaagaatgcctcaaaataaatattagttccctatgggttgcctcttgtatctcatgactagataaattgtaacctcattttccaaaatgaaaaaaaagggacttgaggtcagatacaggtttttctcatatttgtcagttttttagtatttaaaaaatcactttttttagttgatgaaatgcttttggggggggggggattaaaataatgaaattacttaaaacccagacttccctgaaaaatctagggcatgagttttactcctaataaatagtgattctcaatatctcaaataatccaaacttagcaatccttcgtttagattcaattttggccaggtgtggaggctcatgcttgtgattccagcatttggggaggctgagacaggaggattgtttgaacccaggagttcgagaccagcctgggcaacatagtaagaccccatctctactaaaaataaaacattagctgggtgtggtgatgtatgcctgtggtcccagctattcagggggctgaggtgggaaaacagcttcagcctgggggtcatgccactgcactccagcctgagtgacagagggagaccctgtctcaataataataattagattcagttttgaagactaaagtttcattaatgtccacagtttttgcagcggaggggcagaattaaagagacttccaaataaatgggctgaatatacattagggacatctgctttgagaaaaatggagaagtacatttccctattccttctgcaaagtacaactgaaaatcatggaccttatatataaaggtggaaagaagaatgcagactactaggaatctcaggacccaaagaatgacatagcagtgaattccctgggtttctttattgcctcttatatcccaaactgtgctggagctggagaaggtagatgcacagaatgccaatggatacagacaaagaaagtccaaaacaagcctgatgtctctagccaaaggaccaggaaaagagaaggttagccaaacagcaagacagaaaacttttcgataataaccactctactccagctaaacatcatagaaaaactctgactccacctccacccatgccagcaaaggtaaaggagggagtctggacttccacttctgttaatggggcacccttccccttctccactgggatggtgtcagagtagctctagtggagataataagactttttccagtgctcaaaagtaacaaggctactccaatgcttgtggtatcagtggaggcaacatggggagccagaattcccacctacacccggcactaatgaggagccctttctgtcctgaggatgttaatggatgctgagtggggaacctggatttctaccacacctggcattaataaagaggtggctccctcaccaccagccagagtggtattagaagaagccagctaaaacagaaggcttaaataagatccagagtcccataacacaatacccaaatgtccaggttttgataaaaaaacattcatcatagtaagaacaagaaaaatcttaacttatctaaaaatataaccaataggtgccaacactgacatgacagagatactagaattatctaacaaatatttgtaaacagctattataaatatgcttcaattagccataataaacatatttaaacaaatgaaaaaaatagaaagtctcagcaaagaaatagaagatttaaagaagcaccaaatggaaatttggaactgaaaactacaacgatagaaattaaaaactcagcggacgagctcaacagcagaatggaggagacaatagaagtaaacagtgaacttgaagatagataactagaaattacccagtctgaacaacagaaagaaaatagataccccaccccccataaattaacagagcaataaggatctatagattattttaaacagtctaacattaatatcactggagtcccagaagaagagaagaaagaagatggagctgaaaaaagtatttgaagaaataatggctaaatatctcaagtttggcaaaagatgtaaacctagagatttaagaagctcaatgcacctcaacaagaaaaaccaaatgaaatccatgccaagacacatcatagtcaaacttgggaaaactaaagacagagaaaaaattattaaattaagtctcttccatgcttcatgaccaaaaagaaaaaaaaaagtaatgaaagcagtgaaagagaaataacaccttactcacaggagaaaacaattctaatgacaacagatttctcatcagaaatcatggaagccagaaggaagtggcacagtgtttttcaagtgctggaaggaaagaactatcaatccagaattctatatccagagaaaatatcttcaggaatgaagggaaaacttagacattctcacatgtaagaaaactaagataatttgtcatcatcagacataaactaaaagataggctaggctgggcacagtggctcacgcttttaatcccagtactttgggaggccaaggcgggcagatcatgaggtcaggagttcgagaccagcctggccaacatagtgaaaccccgtttctactaaaaatacaaaaaaattagccgggtgtggtggcacacgcctgtagtcccagctactcgggaggctgaggtgggagaactgcttgaacccgggaggcagaggttgcagtgacctgagaccatgccattgcactccagcctgggtgacagagtgagactccgtcacaaaaaaagagaaaaaaaaaaagtgctaaaggaagtttcctaaacagaaaaacaacaacaaaaaaatgataaaagcagtaatcttggaacatcaggaagaaacagtaaaattatgagtaaatataatggattcttcttctccacttaagtttcccagattcttttaaatagctaaagcaaacataacagtgatgtggttctaaatgcatatagatgggctatttaagatttatgggctgggcgcagtgtaataccagcactttgggataccagggtggatggatcgcttgagcccaggaatttaagaccagcctgggcaacatggcaaaaccccatctttactaaaaatacaaaaattagccaggcaccaggaatcatgcctgtaatcccagctactcaggggctgaggcaggaggatcacctgagccttgggaggttgaggctgcagtaagccatgattgcaccactgccctccaccctgggtgacagagtgagaccctgtctcaaaaaaaaaaaaaaaagaattataaatatggagagtaaaaagacataaggagaagtaaggtttctatgcttcacttaaactgctaaaatgtcaattccagtagacagtgataagttatgtatatataaccactaaaaatactatgcaaagatacacttaaacgcactaagttgtttttgttttttgttttttttttttttgagacagagtcacaccgtcgcccaggctggagtctagtggtgcgatctcagctcactgcaagctccgcctccctggttcacgccattctcctgcctcagcctcccgagtagctgggactacaggcacctgccaccatgcccggctaatttttttttgtatttttagtacagacggggttttactgtgttagccaggatggtctcaatctcctgacctcgtgatccgccggccttggcctcccaaagtgctgggattacaggtgtgagccaccacgctcggcctaaatgcactaagttttaataacccataggaagttagaaaaaaaacagaaacataaaactgagagaaaacaaaagatacaaaatacaaaaaataaaatgtcaggcacaagtcctatcacatcaataattatatccagtgtaaacgacctaacacaccaatgaaaagacagagatttgcagagtagacgaaaaaacatgacccaactatacatgtgtctacaagaaattccaattataattagataggtagattcaaagtaaacaaatagaaaaaatatatctcatctaaacattaatcaaaagaaagcaggagttgctatattaatatcaaatagagtagactactgagtaaagaaaattaccagagatggggcaaaacattccataatgataaaagggttagtccatccagaagacgtagcttcctaaatgtgtgtgcaacaaacaacagaactgcaaaatgtgaaacacaaactgatagaactgaaagaataaatagacaaatccacactaatagtcataaacttcaatgccttctctcaacaactgatagaacaagcagacagaaaattggcagggatgtagaagaagtcaggaatactttgtttgtttccttgagacagggtctcactctgtcacccaggctggagtgcagtggcatgatcacagctctctccagcctcgacctctcaggttcaagtgctcctcccacctcaacctcccttgtagctggaactacaggcacctgccaccacacctggctaatttatgttatcttattttttgtagagataggggcctcactatgttgtccaggctggtctcaaactgctgggctcaagcaatcctcctgccttggcctcccccagtgctgggattaaaggtgtgagccgccgctcccagcctgataatactattaaccaataggacctaatctacatttatagactattccacccaacaatagcagaaaacacattattttcaagcgcccatggaacacatcccaaaatagactatatcttgggccataaaaccaacatcaacaaatttagaggactaaaggctgggcgcagttgctcatgcctgtaatcccagcactttgggaggccaaggggagtgcagatcacttgagctcaggagttcaagaccagcctggccaacatggtgaaaccctgtctccactaaaaaaaattaaccaggcgtggtggcgggtccctgtaaccacagctactcaggaggctgagacagaagaatcgcttgaacctgggaggcagaggttgcagtgaaccgagatcgagccactgcactccagcctgggtgacaaagagagactctgtctcaaaaaaaaaaaaaaagtataaataaaactgccatatttaagaaaaatattgttgcaggttgggtttcctgggaaacagacttagagatggaggcttacacacaggaggtttattgggaagtgatcttgggattaacacctgtggagatatcaaagctgctgattcaggcagagggagaagttgggctgcaacgcagtcacagcaagggcttccgcccatctcctggggagcccttgagctaggatggtcttacagaaatatcccaaaataaagcaagggggctggacatttagacctcacatcatgatatgaagggaaatgaccttggacagctggcttctcatcactagggttgtcggggagagcaggaggagacaggtgtgagctgtcagccaatcagactgccggtttcagtcatgaagtgggagatctgggcagcccacccagtgcttattctaagtttgaatcacctactcattcactctcaccagggaaacctttatgtagacccaatagacagtaaaggctacctcctgaagaaagagcaggctgttagaaaaaaataatcatagctacaaaactttttcttaccagaggtaagatgacttgtcaccaccaaggtaaggcagcatcttatgctcagcacaggactgattccagcttccctgtcccacgtaaaggcagcccagcagtgaacctcatgccattgacccactcttctctctgccccttgccagcactgacgatatcttaccaaacactagtgactgacacatgaaatgcattccatcccagagagcctcctgaatgttaattttttcacgaacggacagggagaaaacttttatgtggaaatcgttgtgacagaaaaatggtctatggctgggtgtatactttcagcagagctcaaaggtcaaaccttcagtctgatcatacagttttcatgctttctgcctgctggagattcccagaaaaattttccaatagaaaaaagaaagacaaaaaaatcattagaaccagaaagaacatccgcccgtcatactcaatgttaaaaaaccatgtgactctgccgggcatggtggctcatgcctgtaatcccagcactttgggaggccaaggtgggtggatcgcctgaggtcaggagttcaagaccagcctggccaacatagtaaaaccctgcctctactaaaaatgcaaaaattagctggatgtggaggcaggtgtctgtaatcccagctactcaggaggctgaggcaggagaattgcttgaacctgggagacggaggtttcagtgagccgagactgtgccattgcactcactccagcctgggtgacaagaccgaaactcagtctcaaaaaaaaaaaagtgactatttaaacaaggaaactcattcttttgcccacttatggtatgatcatttaaaataacatttttaaaaatgtatagtataaacttgggggagggcgtggggagaaagaaggaaggctttcttctcagcactttccaaaagcagacagatgaaatatagacctagcactagaataatgacttcagatgaagtcctgtgaaagcaagttctatctgactgtctctccgtctgtctgatgtgacatcagtggtcaaaccctggaaatgatggctagagggcaaaatctattttaggtgttctctcaatccccttagcctcaccaacccacttgtcccaggtttatcaaatccatgctagaacctggccacactgctaagtctaaatctccaggaaaaataacgtttaaaaaagaaaagactgggccaggcccggtggctcacgcctgtaatcccaacactctgggaggccgaggcagacagatcacctaaggtcaggagtttgagaccagcctggccaacatggtgaaaccctgtctctactaaagatacgaaattagccaggtgtggtggcgggcacctgtaatcccagctactcaggaggctgaagcaggagaatcacttgaacctgggagacggaggttgcagtgacctgagatcgcacctttgcactctagcctgggcaaaaatagtgaaactccatctcaaaaataaataaaagacttaaatacagatgaaattcaaaggtaggggcagtaaacctacttagcgaataatcaagtttctgcatttccttttctctttggtatgagtgcaataatcttgtccccagtctacgggctcttctggtacttccaataaattccttccagggaccccacctaatcctttgtacatggtcccagttgtctgccttcctgaggtaaacgcattcctaaaacattctgtgtgaaggagatgttcatagtacaaataatacttttccactgactttaattctgattccctagtatttttatcatggcttctaatctatcttctggctacaagaagtgagtcatttgtaaagtgaagaatttattttaaagtgagcaatcataccacccattttctgttttcctccagagaggcatctaaaaatgactttccccttgtagtcccaaagttctcaaacctacactcacctctttgcccaaaacttccagcctcaactatgttaaggtctctctctgccttgcttagagccccaccgtcgctgtgatagttttctagagatgcccaacgaagtatcgcagagttgttaaagaacaggaatttatttttccacaggtctggaagctagaagtccaagatcaagctaacagcagggttggtgtcttctagggcctctctcctcagcttgcagatggttttctctctgtacctgtctatatccacatttcttcttgtaaggtcactggtcatattggattagggcctacccataattttattttaaccacttctttaaagaccctatttctaaatacagtcacattctggggccccctgccttaagggacaacatccaccacattggccggtatgctaaatggaagcattacatttctttgtgccaattgccataagaagtaaggccgaaagcaggagaagcatgtcttcattttctcaactcactactccaccgtctaggtccttgatttaaatgatttcatgacacaagtaggaacagaccctttgggcaactcagcagctaagccaacatcaccttaagcaaaatgttagacatgaaaatgtcacattacatggaaaacagcgttaagggaccacaactacaataaggaaaagactgtggttttttttctctcttatattgtttgtgtaactaggatgattcctgtacataatttattcgtatgcatatgtatccatatattatatataacatttattgagatccagccatgtgccaggcactgctctaaaagcattatgtgtactagctcacttaatcctcatgatagctccatgagatagatacttttatgatccccaaattatggacaaggtgctgcagcacagaagttaagccgctgcccaaggacacacagctggtaagtgttgcaggtgggatttggccctggaagtctggcttttgtatcttatgcatcagttagcagactattgcttattttgatcaagtcttttctatttctaatatgcaattaacatataaacaccattagttccattgaaaaacccactgcagagatttcagaaggggctgcaaacccctttgagcaggctcccatcaggctacctttcctgggtggtcagcagctgctttgctcctctgtgaactttttccttaatagcaaagtggcctcaagaagacctctggcctcaagaagctccccactcttgtactggcaattggcaatacagtgtacaaatgtacactgcttcaactggtcctagaaaacctgggaaccgatgcatccccacaaggaaatattagagttggggaccaggtgaaatcacagtcataccttcaggaccttccatatatacttgccttattcagcacgtactcagtactaagaacttaagttatttacacatattagctcactttagcctagaagaagcctacaagaagatattaatgttcatcattaagaacaatgtatataaaaatgtaaactgcaaaatgtgttaaaaatcttaagctttaataaactggagttaaaagagaaattgaattaaaccacactatccttactcaagttcaaaaccatatatattttcaaaaattattttctgtagagatgtggcctcactatgttgtccaggctagtttggaactcctgggctcaagcaattttcccatcccagcctcccaaagtgctgggattacaggcacaagccacctcagccagtccaaaaatatttttcttaaatcatactctcacaaaaacgttttgtctcactccacttccaaagtgactcatggaagccgtgaaaaccagaaccaataatagtaatgggattaaaaataaatagaatttattaaatatctactgtgtcccaaagtggcatgtgtttcttttcttcttttttttttttttttttttttttttgtagaaatggggtctcactatctttgcccaggctggtctggaactcttagtctcaagcaagcctcccgcctcagtctcccaatgcactgggattacaggcatgtgctgcccaacggtgtttcctggactcaaacttgctttgatgtctcaggtctgcatctacaaactactggatgttgagaaagtcctgtaactttcccatgcctcagtttcctcatctgtaagtgggatgacaaagatacctatcttgtaggcttgttgtgaggatgaattgagttagcttatgtaaaacgctcagaaaaacacatagcatgttgtaagaagacagaagtgcctgcggctatcatcaaaatctcacaaccttggtaatacacatttttacatctgaggaaaacatctgaggcttagacctaaacttgccgcaggtaactcattagaatgtggctggggcgggggacagtggtgaaggttccaacccaggtgtggcagattccagagcctgcggtctgaaccagcccctggtgacctttaccccgagagcggaagaaaggcaaacaggcggaagcccacagccgaggccatcgcgctgcgcatgatccgtggcaaccgtccttccttgacctttgcccactggaaaagccaatcccaagtcagcctggggtaaaggggcggggccttgtggttggcatagcaacagacatgggtcaaactcacctgggggttagggcggggttgtttgtcactaaggaatcattgctgaatgacactacagtggagaaccagagccccgggcttttctaaacaaacagccctggtcactgctgaattcaaagtgtactgccggggccgggcgcggtggctcacgcctgtaatcccaacactttgggaggctgaggcaggcggatcacgaggtcaggagatagagaccatcctggccaacatggtgaaaccgaaaccccgtctctactaaaaatacaaaaattagctgggcatgatggcgggcgcctgtaatcccagctactcaggaggctgaggcaggagaatcacttgaacccaggaagcggaggttacagtgagccgagatggtgccactgcactgcagcctgtcaacagagcaagacttgtctggaaaaaaaaaaaaatgcgcaccgccgggcccgcctccctcagcacccaatgctggtcggagccctcgggcaaacaaactacctcctgcatccgggaacttaccctccaggcggaaggaaagaatgcggggacagagacctgtcctgggagaagctccttaggagatgaaggagcaccgaaagatgcctgacgtttttacgactcctctttcatgtttgtgtcccatctcttctcagaagaattagccatgttttgtgaattccaggtgccatcttcaaaaacacccttggattctagccaatcaccaaaatggcagagacggccacctgagaccaattagaatatccacaccagtggaagagagctccagtggtaaatttcctagatgtacaactattgatttcatgatgtattgttccataaggtgactttaaaacaggacaaaagtcatgattcgtatctttgtttcatcttgtcgttaatattatatctggtaattttcttgaaaacataaggacttattttacaaatttgtatgctttcataagtacttcattgtaactttaatagtaaataaactttggctttattaaggtgtaggagagaaaaccctacgaacagaaataaaacaattgtgatgaatcattcattaatccctgggagaagcagagtgggcgtactgtgggcttaggctcactaagaaggacctggattcacatcctagctttgtccattgtatgtggccttgggcaggtctcataagccacactcctttgcaaaatgaagataacaatatctacttctgagagctgttttcagaggatgaaagtgcataataagtgccttatcttacacatggcccagtcttggctcaaaaatgttacttttctttcttgaatatccccacttcctcttgaacagcctcccccaaggcagttagttgctcatctttctccctaatccccagataatttgttctgagcagaataatttttatcccggtagcttagaacagtggccagcccacaacaagtacttggtgtctgtttatctggacttggttgtgctgtaatttatgtgctgactgagagctcccagggataggaaccacatcagctagcatctagcatagtacctagtacatagtgcctactacataggctatgctcagtaacatagttgtgttactatgcattgcactcctcatttttgcaaggtacacaaacatatctgtcttcagcagccaggcaggtgaattaagataagagcgataaagtccgtgacaaactggaggcattcccattcaactaaacaaaaaacacttttctggccaaacacaacaatctgtccacaggatttacccctctaccataaaactgccaccataaacaaagctttgtaattaacaagttcttttttttttttttttttttttttgggcagggtatcaatctgtctcccaggctggaaggcaggagtgaagtgaagtggcatgtggttcacagtagcttcaacctcctgggctcaagtgatactctcatctcagcctcccaagtagctgggaccacaatcacatgccaccatgctgggctaggttttttattttttgtagagatgaggttttgccatgttacccaggctggtcttgaactcctggcctcaagcgatcctcccactccagcctcccaaagtattgggattataggtgtgagccaccatgcccagcccacaattactttcttatatgttatctcatttgatacttgagcaattttctgaagaaagcgtttttgagttcattttacaggcatctgatagagaaactgaggctcaaatacagagatttatccaaatcaaactaagttaatagccagccagggatttgcattcatgtcttctaacatcgacccaggactcccgcttctctttacaccatatactgttctttatgtgccgctgtttttctctttatagtttttctaggacaaaaaccaagctccatcagaaggttaaacctgtgtcaggtttacagtccaatgaccgccgtgggtcataatccatctagagctctgagacaggtgcctttagaaacaatgccttctttgcaaccagaggagcgtgttttcctcgagtcatcagcatagagaggcctggcagcaaggtatgatgagcatgatgagtgggctgacaggaagaactctgcacccaaatggcaatgaggaagcaggctccttatatcaacgtgaagaatctttaaaggaacttgagtttgtaaagagagcaagaaaaacaagatagagtcttagcaactagaggaaacaagcatctcatttctgtaggccagtgttgtccaacagaaacaaaatgtgagctacatataactttaaattttctaaagagtaaaatttaaaaagtaaaaagaaacaaaagaaattaatttgaataatacattatatttaatctaatatatacaatatatttttaacatgtgaccaatataaaaattattaatgagctattttatttatttatttttgagacagagtctcactctgtcgcctaggctgtagtgcagtggctcaatcttggctcagtgcaaccttgcctcccgggttcaagtgattctcctgcctcagccacctgagtagctgggattaattagcatgtgccaccatgtccggctaatttttgtatttagtagagacagggtttcaccatgttggccaggctggttttgaactcctgacctcaaatgatctgccttcctcgacctaccaaagtgttgggattacaggcgtgagccactgcgcatgtaattctttttttaatttatatttcttttttttttttttttggacaaagcctttgacatccagtgtgcattttatatttacactcagtggcactggccatatttcaagtattcagtagcagctgggcacagtggctcacacctataatcccagcactttgggagactgaggtgggcggatcacctgaggtcaggagttcgagaccagcctggccaacgtcgtgaaaccttgtctctactacaaaaaaaacccaaaaaaattagccaggcatggtggcgggcacctgtaatcccagctactcgggaggctgaggcaggagaatcgcttgaacctggggcagagattgcattgagccaagatcgcgccactgcactccagcctgggcgacagagcgagactctgtcaaaaaaaaaaaaaaaaaaagaagtactcagtagccacatgtggctagtggctgccatcttggacagcacagatctaggccaaagaaattcctaaaggtctatatttctggcatagtaaaaatgagtgacatggctctcttcaaggccactgagaggtctcatttccaatcctgctagtccagtttgaagactgatcttttagggtcaacttcaaactttgccgccatttagagagcagccgtgtcaatttccagccagttgctctgcaaagccaatcagagcccattatgtttggctccctgtttttgccttgcaagagtgcagtcctcagcatgtcccctttcaaatacctattattctggtgctgtcttcagtggtgccatgactggcagtgattagggtgacattttttatgtgcctgagttcacagagcaaattacatagcgtgagtggcatggtgattaagtggctgtgtgtaaagactagaatcgctacatttgcatgtctctgaataatgagattcttatctccattatgtggcaatgaggtcgaaattgatagcgctattaactgtttacacagtaagcacaattttctattctctctttctctctcactggtttcaaagcagccaaaagctttgagccccccagcaaccctcccaaataagttttccataaaaagagatttccacaacccctcaataaattttctggctgccttccagagcccacagataatccaatccaccctcttggtttcacagggaagaagctgcagtgtagagaggtgagatttgtccaaggtcacacagaaagaaagagggctggaaaacagaggactccaacaatactcattccttctctgatttgtgtcctctggtgcccggctgcagctttggaataatgaagtcccaccttccagcctacatacatattgtgcattctggtcacacacccattttgctgctgaagagatgatgaaactggctgaaattataatttgattctccaaacacagagaccttttcagttgaccctagagatgagccctaactatactttgaatcaacaaatatcaattttcgcagcaatgaaataaatatatggagagatagttatagttacagtgggttataaaacagggcaagggaaagctgtgactatttatttggctctgctcctagcaatgaagtatttatccatcagctatgtggcagtgacattttttatatgaagggcaagtttgaattaataactaaagagaccgtttttaaaaatagatcatcagtgtagcaacccaaaaatgtatccaataaagtgcttcactagcaatattgcaaaacatgaggaggaaaaaaactctctccaattaaattctcactcaccagtgctttcgtggtggaacaaccacaacagcatgaaggttaactgccttggcataaaagaggagacggagtaacaggatttgtcaagtagatcgtggcatcagcttaacatttgtgggagttaaatgtatgcatgaacagttgtaatgctgagttccattaaaaaatatgatggtgaaatggcctggagtgaagcattattatttattatgaactaaaacggactatttgtttgtgatatatcttaaaagtactgagtgccttgaaatcactagaagggttcattacctctgtatcccatcaataaccaaaaatcttgtcctaggagtcaaaactgaaggagattccagatggcataaagcacaagaaaactggttcctatttagcagtgggtaaagaagttgtgaaatccttcaggactccacttaaactttgcggggttgaaagaggccctccctggaacccatagtctaaattacacttctttggtataagtcaccatatttctttttttttgagatggtgtttcactcttgttgcccaggctggagtgcaatggtgcaatcttggctcactgcaacctccgcctcccaggttcaagtgattctcctgccccagcctcctaagtagatgagattacaggcaagtgccaccatgcctggctaatgttgtatttttagtagcgacagagtttcaccatgttggtcaggctggtctccaactccagacctcaagtgatctgccctcctcggcctcccaaagtgctgggattacaggtgtgagccaccatgcccagcgaagtcacaatatttccacatgcgctgtttgatttattatatttgttacacgaaggtacttactacctgtcttctccacaaagtctgtgaactctagcaaggcaggtgcctatgcacctaacagcatattcatccattcaaaatgtacctacagagcacctactaagagttagccaacacaattctgccctcatatgtttacatccagatagggggacatagaccataaacaattaaacaagcgagttgatttgcttttttttttttttttaggcaaggtctcactctattggccaggctgaagtacagtggcatgaacatagttcagtgcaacctcaaatgcctgggctcaagcaattctcctgcctcagctttgcaaatacttgagactacagactcaccatcacacccagctgatttttttttttttagatggagtctcactctgtcgccaggctggagttcaatggcacgatctcggctcactgcaacctccacctcccggattcaagtgattctcctgcctcagcctcccaagcatctgggactacaagtgcttgccaccacacccagctaatttttgtgtttttagcagagacagggtttcaccatgttggccaggatggtcttgatctattgacctcgtgatctgcccgcctcggcctcccaaagtactggaattacaggtgtgagccaccatgcccagccacacccagctaatttttatatttttttgtagagacagggtctcactatgttgcccagactggtctcaaacttctggcttcaaacaatcctcctgccttggcctcccaaagcattagattacatttgtgggccaccacacctggcttgattttagataataatatgggagactgatcagagaaggtttccctgaggaaatgagattaaggaaacctgatactgaaagttctgggctggacatagcagctcacgcctgtaagcccagcattttgggagaccgaggtgggcagatcgcttgagctcaggagttcaagaccagcccaggcaacatggcgaaaccctgtctctactaaaaatacaaaaattagccaggtgtggtgttgcatgtctgtagtcccagctactcgggaggctgaggtgggaggatggcttgagcctggtaggcggaggttgtattgagctaagatcacaccgctgcactccagccttgacaacagagtgagaccccgtctcaaaaaataaaaataaaaataagttctggatagatatgagctgagaggagtgaaaaataaaaataaaagaaaaacaattttttaaaaagaagaaagttctgggtaaggggcattccaggcaaccagaagagcaggtggaaggaccccaaggtggaaataagtggctatggctggaacctagtgggtgaggagaagatgaagtcaaggaggcagattggggctggattatgtgcttggcacagagtaaacactcagtaaacatatgtttcatgaacaagtgagcccatatcagctataattgcaggcggaatgtaattcttgctaccctgggcaagactgcaggtgaccaaaatacaaaagtaaagcgtagatattaagtgttgtctccacaaaaataactacatgatgtatattgcgtttgttaattagctagatttaaccattccatagtgtatatacacttcaaaacatcatgctgtacacaaaaaatacatacaattttatctgtcaatttaaagaaatagtggttgttctagggtttacaatgttcatattttatgtatcatagtctcccttcaaagaatattacactactccacatgtagtttaagaaccttatgatagtatagttacaattcctccaccctttggtcttttaatcctcacaatacacttattgtatatttgtttacactgctaaatatcattgattggttctttaaaaatcctctgttaaaaaaaaaaaggctgggaacagtgtttctcatgtctgtaatccctgtaatcccagagttttgagaggctggggcaaaaggattgcttgagcccaggagttcgaggctgcagtgagctatgatcgcgccattgcactccagcctgggcaacagagataggctctgtctctgaaaaaaaaaaaaaaaaaaaaaaatagagagagagagagagaaaggtagaggctagaaacttgaaatttcaagagaaccacaacaggtaaataagataagtcctggggactcagagaaaatgaaaatgagatatttaaggcagcctataataaaccccaaattgctgcagaggaagtcagggcaagggagctaaatgcaggctgacatcatatggggcaggttcctgaaggcaggatgtgaactaggccttgaatcacacacaggaatttattgggcagaacaaataaggaaggtagggcactccaggaaaatcggtcttatcacattatcccaatggaactaccacatttatttctaggacgttatgtaaatccatactatgctcattacacagagggacaattgattatatgcatggagtatagaagttggatcaaatttattggccaggcaccgtggctcacgcctgtaatcccagcactttgggagactgaggcaggcgaatcaccatgtcaggagatcgagaccatcctggccaacatggtgaaaccccatctctactaaaaatacaaaaattagccgggcatggtggtgtgtgcctgtagtcccagctacttgggaggctgaggcaggagaattgcttggcccgggaggtggaggttgcagtgagcagagatcgtgcctctgctttccagcctggcgacagagcgagactctgtcaaaaaaaaaaagaagttggatcaaatttgttttaagttttaggcttaaattgtctcccttgaaattcatagactcctcatctagtggagaattgcctatcttcagctcatgcatagtgaaattgatgagttatggatctataagggatgttctaattctctcatttgctggaaactcagtagcctgctattcttgttgtaatggtttagttctttttagcactttgttaatcaaactgtgttggagattgtgccagggtgatccaacctcctattataaggtctgtgagacatgagtcacagcacaaccaagaggcctcaccagaaactagggtagcatccttgacaccaccgtttctctcatgacccccagtcaatctaaccagtgaagtgctatcaattctacctctcaagtaactctcaaatctgtcgtttttgctccttgcttaccacactgccttattcagccccttaacatttcttactaaatcccaccctttaatttccacctcacctccagctatttttaaacattcctttccaatccccataacctccctgtgactgcttgaacactcaccataatatacatacacacccttcacgatttgcctactctttcatccttgtcttacttcatgcctcccaaacagcccgagttcaagaaaacagccatttatggtttccccaaagccacatgctgctggtagtctccactcctttgtgcttgcaatttcctctgcctagaatttctttgcccagccctgtgtggtctcttttattcgtcctttaagactcagcttgggccaggcatggtggctcacgcctgtaatcccagcattttgggaggctgaggcaggtggatcacctgaggtcgagagtttgagagcagcctggccaatattgtgaaaccccaactctactaaaaatacaaaattagccaggcgtggtggtgcatgcctgcagtcacagctactctagaggctgatgcaggagaatcacttgaacctgggaggtggaggttgcagtgagtcgagatcatgccactgctctccagcctggacaacagagcaagattccatctgatttctataagcaagattaggggtttttcttaatttttttttttattttccgagacagtcttgctctactgcccaggctggagtgcagtggcatgatcttagctcactgcaacctccgcctcctgggttcacactgttctcctgcctcagcctcctgaatagctgggattacaggcgcccgccaccacgcccggctaatttttgtatttttagtacagacggggtttcaccatgttggccagactggtctcaaactcctgacctcatgatccacccacctcagcctcccaaagtgctgggattacaggcgtgagccactgtgcctggccaagattaggggtttttcttctgtaggttctgcagcatcctattttagcattcctacattgctgtaattaatactaggcatatccgtcccacctgacatgggtaggaaccatgtgccagccatatttttatccctttttttctctctctctcttttaagaggcaagaccttgctctgtcacccaggctggagtacagtggcataatcataactcactgcaggcttgaactcccatgctcaagggatcttcctgccttagccacctaagtagctagaactacaggtacgtaccaccacactcggctaatttttttatttttgtgtagagacaaagtctcactatgttcctcagacaggtctcaaactcctggtctcaagtggtcctcctgccttggcctcaaagaactctgggattacaggtgtgggtcaccctgcccagcctattcccattcacagtacaccatcagtaaatacttatcaaagtaatgaccaagtaaatgcatttttatatttttaggacactattatacatgcctagtccttacaactactactagaccagggaattattgttaacatcccaggaaagaaataaagttagagtacaggctgggtgcagtgacccacacctgtaatcccagcaatttgggaagctgaggcaggaggatcacttgaggctaggaattcgagaccagcctgggcaacatagggagacccctctctacaaaaaaatttaaaaattagctggacatcatggcgtgtgcctctggtcccagctattcggaaggctgaggtaggaggatcacttgatgctgggggtttgaggctgcagtgagccgtgatcatgccactacactacagtctggatgacagagcaagactccatctcaaaaaaaaaaaaaaattagagtacaaagaagccatcaaccccacttcccgctaagagactacaaacgctgagtttcatttggaacttttgccccttggtttatggggcacaaaagatggcctggctcccttaagccttctttggcagtgaatgaatggtcctgctcatgactatcccagctcctacagccactgaccaagaggcagttcctgacagccatctggacttacacctcactccgtgactcacctattcataagtgtctcgggaactttcctccgagtgtgtgtggtatagtaacactcaagagaacataattccgagcatgtgtcataaactaactagaacaaattcctccctttaattaattactttatttatttatttatttatttatttttgagacagagtctcactctgtcacccgggctggagtgcagtggcacaatctcggctcactgcaacctccacctcccaggttcaagcgattctcctgcctcagcctcccgagtagttgggattacaggggcccaccaccacgcctggctaatttttgtatttttagtagagataggattttaccatgttggtcaggctggtctcaaatacctaacttcgtgatccacctgcctcagcctcccaaagtgctgggattacaggcatgagccaccgcacccagacaatgggacacttttttttttttttgagacggagtttcactctcgttgcccaggctggagtgcaatggcacgatctcggctcactgcaacctctacctcccaggttcaagcgattctcctgcctcagcctccctagtagctgggattataggcatgtgccaccatgcccagctaattttgtatttttagtagaggcggggtttctgcatgttggtcaggtcggtcttgaactcctgacctcaggtgatccgcccaccttggccccccaaagtgctgagattacaggcatgagccaccacgtccggccaatgggacacttttaagacagtctcaaaagaatctctaagattttggccagactcagtggctcacgcctgtaatccctacactttgggaggccaaggcgggtggatgacctgaggtcaggagttcaagaccagcctagcctacatgacgaaaccctgtctctactaaaaatacaaaaaattaactgggtgcagtggcgtgcgcctgtaatcccagctacctgggaggctgaggcaggagaatcacctcaactcgggaggcggaggttgcagtgagctgagatcgtgccactgcactccagcctgggcaacaagagcaaaactccgtctcaaaaaaaaaaaagaatctataggatttcatcaaaaattgatgtccctgtgacatcttctctcccaacaaattaagaaggcccctagacttctctagctaaactaagaggctctaaggaccaagcacgaatgacctctgaagttttcctttctcactttcctagctctcagcccaaatactagttatcaaatggtacctgggtaactttcggagatattttttgtttgtttgtttgtttgtttgtttttgagatggagtctcgctctgtcgcccaggctggagtgcagtggcgctatctcggctcactgcaagctccgcctcccgggttcacgccattctcctgcctcagcctcccgagtagctgggactacaacaggtgcctgccaccacacccggctaattttttgtattttagtagagacggggtttcaccgtgttagcccaggatggtctcaatctcctgaccttgtgatccacctgcctcggcctcccaaagtactgggattacaggcatgagccaccgcgcccggcttttttttttttttttttttaactttcagagatatttaaagcttctaaagcaagactcttgacactgctctaagatgaacttaatcatgatgcactattaaaaacaatgtctgggtgtggtccagctttgggtttataaacatgctatctatttttcttcatatttttataagtaattctgcatcattgctaaaccatgcaaacgagcttttcatgattcttaatgagcagcctctcaatcacagcacaagacatccttcatgataacaaatgtggaaggaacttgtttccatcttgaatacagatctttcttctgtcctaaggatagaaagtggaaaatcagagaaacataccttgtgtaatgtcccatttattcttctttctgaaagagagaaggtaggaactacattagatgcattctgaggtttccaattcggcaataccaaacaaatgttacaggctaaattgtgtcacccaaaatccatatgttgaagtcctaaccccagtacttcagagtgtgacattatttggagatacggcctttaaacagttgatcaagttaaaatgacatccttcagggtgggtcataatccaaccttactgctgtccttataagaagagatcaggacccaaactggacacaaagggaagaccatgtgaggacacagccagatggtggcaagccaaggagaggggcctcagcggaaaccaggcctacggacaccttgaccttccattccagcctccacaaccatcagaaaataaatttctgttgttcaagctgacgagcctctggtatattgttatagcagcctgtggtatcttgttatggcagcctggcaaactaatacaaaaaatgatttttaaatgttagagcaattttacaatcctagtgcatgatgcattttgtttgtttgtttgggtttttgttttttgttttgttttgttttgttttattgaaatagggtctcattctgttgcccaggctggagtgcagtggcatgatttcagctcactgcaacctctgcctccccagctcaggcgatcctcttgcctcaagcctcttgaggagctgggactacaggtatgtgccaccatgctcagctactttttaaattttttgtagcgatgaggtctcactatattgcccaggccaatctcaaactcctaaactcaagcgatcctcctgcctctgcctcccaaaatgctgggattacagaagtgagcccagccatgatgtgttttatctgccattttggctaacaatgttttgactcaacatctataatacaaatattttaagtaaaataacaccattactaattaatttgggttaagaaataatttttggtgtgaatgccattaagccaatttaaatttttagtccattttctatggagaacaatgaaaccattttcagctttttccattttaggttttattcagccgcagtaactgtcactgaatcaatttttatgaacatacatttcattacaaagatatgattcatcaatgaatgttttgcccaactataattatatcaattgtggccttttataatctttctgctgcagttagtatttatattatatggaaaaatttatcaaatttttcaggtcaaatttaacaggcaaaattttactctttggtcatttttttaaaataatagttgtattgagacataattccctaaccataaagtttatccttttaaagtgtacagctaactggttttaagtatatacaaaggtttatgcacccatcaccactatcaatttccaggatattttcttttttctttttttatttttttttgagacagagtcttgctctgttgcccaggttggaatgcaatggcgtgatctcggctcactgcaaccttcacccgctgggttcaagcgattctcctgcctcagcctccggagtagctgggattacaggcacgcaccagcactcctggctaatttttgtatttttagtagagatggggtttcaccatattggccaggctggtcttgaactcctgacctcaagtgatccaccctccttggactcccaaagtgctgggattacaggcgtgagccactgcacctggccaaattccagaacattttcatcattcttaaaacatacttcccatttctccttccatgtctcctggcctctggcaactaccaatctactctctatggactcacctattctgggcattgcacattcagtcatgtgttacttaacaacagggataccttcagagaaatgtgtcgccgggtggtttttgttgttgtgtgaacctcataggtgcatttatacaaacctagaaggaatagtctactgcatacctaggctattgtaacacaatggtaagtatttgtgtatctaaacatatctaaacatagaaaagatatagtgaaaatggccggacatggtggcttacgcctgtaatcccagcagcttgggaggccaaggcaggtggatcgcttgaggccaggagttcaagaccagcctggccaacatggcaaaaccccgtctctactaaaaatacaaaaattagctgggcatggtggcacacacctgtaatcccagctactcagggggctgaggcaggaaaattgcttgaacctgggggtcggaggttgcagtgagccaagattgcgtcactgcactccagcctgggtgacagagcaagaccgtcacaaaaaaaaaaaaaaagaatttttaaaatattgatagatggttgaaaaactcaaaagaggcataatatttttgtaattcatgaaaattatgtaaaattcaaattcactaactataaataaggttatattggaacatcaccacactcagccacacctactcatctaggtaccatctattactgctttctcactgcagtgacagagttaagtagttgtgacagaaatcatttgagccacagagcctaaaatatttactagctggttctttacagaaaaaggtctatcatacggctgaaccaattcatctttatctttcagatcatatggtatgatgggcactaactgtccaaatagttggcagaaagagcaaatggaagctacccaaagtatgggtctcaggctgttgccagttgaactgttaggatcataatgagataaatacaaaaattgagagtaagccttagaaagttatagaaaattgacaaagtaattttatgtctatttgaatataatacttgaaaaatgaggtttaggccaggcatggtggctcacgcttataattccagcactttgggaggctgagacgggaggatctcttgagctcaggatttcgagaccagcctggataacatagtctctaccaaaaatacaaaaaatgaaccaggtatgatggcatgtacctgtagtcccagctactcaggaggctgaagtgagagaatggcttgagcctgggaggcagaggttgcaatgagctgagatcacgccattgcactccagcctgggtgacagagcaatatcctgtagaaaaagaaagacagaaagaaagaaagaaagaaagaaagaaagaaagaaagaaagaaagaaagaaagaaagagagagagagagagagagagagagagagagagagagagaaagaaagaaagaaaggaaggaagggagagagaaagaaaaagaaaaagaaagaaagaaagaaaaagaaagaaaaagaaagggaaaagtgaagtttctattttgtatgtctttgggagtttttaaatttcatctttctagccattgatttttagactaattgaatttttaagactgaccctttaatacagtttgagacacactgaaatagaagatcagtatctttagaatcaaagaagtggatctactaggacatgagcatgctgagggcaggtgcttcatctgccttgtgcacctgtttccccagcacctggtacactataataggtgctcaataaacactggaagaatgtacagatccaaaacaactcacttcttaactctagtatcattgtcaaggattatcattttctaggtttgtttttgtttctaatttattttcagacgcaatagatagcatagaagctagcagcaagcctgtgttcatatcccagcttatttaattaattaattcatttattttcaagatggagtttcgctcttcctgcccaggctggagtgcaagggcacaatctcggctcactgcaacctctgcctcccaggttcaagcaattctcctcctcaacttcccaagtagctgggattacaggcgcctgccaccacacctggctaatttttgtatttttagtagagacagggttttaccatgttggccaagctcatctcgaactcctgacctcaggtgagccgcctgcctgggcctcccaaagtgctgggattacaggcatgaaccaccgtgcccggcctgagtcctagccttttaaaacagtccctccaggttaagatcaccagatattttagcaaattgtaagatatctatttgcatatgatttttcatgaattcataaagtagttcttgtaatttttttttttaaacggagcctagcacgcccaggctggagtacagtggtgccatcacagctcattgcaacctcgacctcctctgctcaagcgattctaccatctcagcctcccgagtagctgggactacagtgtgagccaccacacctgactaatttttgtattttttggagagatagggtttcaccttgttgcccagactggttttcaactcctgggctcaagtgatccacctgccttggcctcccaaattgctgggattacaggcatgagccaccatactcagcccataaatttgatcaatacagtccaaagacctaacttcaggtatataaagtacagctcatgagttgatgcaagtaatgtgcagaagtttccattctgacatcctgcacacagttccaccccaatcccaaacaacctttacaaaatacaaaattttttcagagtgaatctccctaagtctgtggtagccctttcttaggaaggtccccaggcattgtgagggtggcagaaatactgagtggctgtccgaggaatgaccctctttattcttacatactagcacaatattcagggttactgcaagacatagcagaaccagaaaatgtctgtgtctccatgaatcttgctgccttgttgcctggctgtgttcttccttgagcctggaataaatcttttttttttttttttttgagatgggagtctcgctctgtctcccaggctggagtgcaatggcactatttcggctcactgcaacctccgcctcccaggttcaagcgattctcctgcctcagcctcccaaatagctgggaccacaggtgcacaccaccatgtctggctaatttttgtgtttttagtagagatggggtttcgccatgttggccaggctagtctccaactcctggcctcaagggatccgcccacctcagcctcccaaagtgctgggattacaggcttgagccactgcaagcctggaataaaccttcccccagtctctgcctactgagaactagacatccttcaagaacatctatgtcttcacctcacttatttatttatagtgtcacagtcactaaagttccaggaagtcacagaatcatagctatgaatgctagaaggaaccatagagagtcgaatccagggactgcaaactcaaaggcctatagtagctgcacaggttatttgatagaaagaagactggcaggtgggggctggggagaagagcaaagaatagagccatttagagagggcagatactcagctcaagtgggctgttgccaactggtacatgtggcccaatatgccagatttgttttaatatattttttaagtcgactattcaggttttcatgagttaccactctttattttaattgtggtaaaatatacataacataaaaacttaccatctaaggatttttatgtgtccagctgagaagtgttaaatacactcacattgctgtgcaacaataattccccctcttccccgccatccctggcatccaccattccattttctgtttctgattttaactattctaggtacctcataaaaaataaatcaggtcaggcacaatggctcatgcctgtaatcctagcagtttgagaggccggggtgggaggaccacttgagccgaggggtttgagaccagcttgggcaacacagcagaccgcatctctacaaaaaaatatattaataataaattaaaattgggtgtggtgtcatgtgcctatagtcctaactgctttggaggctaaggcaggaggatgacttgaggccaggatatcaaaggacatcaaagctgctgcagtgagccataatcttatcacagcactccagaagaaaggaagtggaatcatacagaatttgtctttttatgactggcttatttcactctatgtaatgtcctcaagactcattcatgttgtagcatgtgtctgaatttccttttttttttttttttttgagacagggtctcactctgtcacccaggctggagtgcgctggcacaatctcaactcactgcagcctcgacttctggggttttgacaatcctcccacctcagcctcccaagtagctgggaccataggtatgctccatcactcctggctaattttcatatttttggtagagacggtgttttgccatgttgcctaggttggtctccaactcctgacctcaattgatccacctgcctcagcctcccaaagtgctggagttacaggcatgagccaccatgcccagcctccatctttttaaggctgaataatattttattgtatatatagtccacatttttttccattcatccatcaatagactcttggttgcttctacctttggctatgtgaatgatgctgctaccagcatgagtatacaaataatgtatcttttttttttattttgagacagagtttcactcttattgcccaagatggagtgcaatggcacgatcttggctcacagcaacctccgcctcccaggttcaagcgattctcctgcctcagtctcccaagtagctgggattataggcatgcgccaccacacctagctaattttgtatttttagtagagacggggtttctccatgttggtcaggctggtctcaaactcccaacctcaggtgatccactcacctcagcctcccaaagtgctaggattgcagaagtgagccaccatgcctggcgaagtatacaaataatatatcttttgagttcctgctttcaattcttttgggcgtatatccagaagtggaattgttggatcatgtggtgattctatttttacttttttttaggaaccaccatactgttttccatagcagctgcaccatttcacattaatactaacagtacacagcattccaatttttccacatcctcaccagcatttgttgttttttgttcttttgataatacccatcctagtgggtatgaggcagtagtatctcactgtggttttgatttgtatttctctaatgattagtgatgtcaagcatattttgatgtgcttgttggccattttttaaattagattgttttactattgttgagtccttttttaaatgacgaacactagtttaaattttataaaaacaaaaacaaacaaaaaatggccaggtgcagtggctcacacctgtaatcctagcacttcgggaggctgaagtgggcagattgtttgagttcaggagtttgagaccagcctgagtgacatgggaaaacctcatctctacaaaaaaatacaaaaattagccaatttagtggcatgcgcctgtagtcccagctactcaggaggctgaggtgggaggatcacttgagcccaggaggcagaggttgcagtgagcagagatcgtgctactgcactccagcctgggttacagagcaagaccctgtctcaaacaacaacaaaaaacaaactaacaaaaaaaccgccgtaacaccatatggataaaatacatgatttcaggcagtatacggccggagacctccatttggtgacctcatctaggcccaacaaactcatcttccaaacagggaaaccaaagcctagatcataaagccaacagttgcacatggctatctgatatctgagccagcattagatctgaggtcctctagtgcacaaggcattgacacatttcttagaacactcaccagagccaacgcgtctgatttgtaaggagttgcaatttgctaaaaattcgtaactgggcttaatgacttgtgggtgaaagtgcaaaagtcaggcaaggcgcagtggctcgtgcctgtagtcccagcactttgggaagttgagtgggtggatcacttgagctcaggagtttgagaccagcctaggcaacatgatgaaaccccatctctaccaaaaatacaaaaaattagctggacatgatggcacatgcccataatcacagctactcaggatactgaggcaagaggatcacttgagctcaggaggtcgaggcttcagtgagccaagctggcgccactgccctccagcctgggagacagagagagaccctgtctaaagaaaaaaaaaaaaagaaagaaagaaagaaggaaagaaagtgcaaaaggcagcagcacaagacagagtcaggaactttttgaaaggaactctctctggcagctgcttcaatcttctttctctagaggtagtaagagggggctggagatctattcattatcttttaacaatggacaaagagaagcctgtctgctgcgttagtcattgcttggaggtccccgacttctgcttccactactgctctctacccccaaagtgacttctctttgatgctatttataaaatggaatgtgaccctccagctaggcagggctgggggcatggggcgggggggacatgagtgagatattaaagccgtatttctgcttgggtctggtatgtggcttctcaagagtacatgaggcaatgagaaactggaatgattgttatttagggtatagctctctagggaggaaaactgagcaactttcttgagaaggaatagtgaacatgtgaaggtgtccaatttagaaaaggggatgggcttcctctttctgggaaagactcacccctgacttgtggattactaaggaatggagtatttctgcctccaacttgctgtgcatcctaaagtgagatcctgtacttccttctacctcaatttctctcttcataatattgaggaaaagttacataaatgcagggtttcctgccttgctgactgtggcacttaattacactaaatagacataagtcgcatatccgtgccacctgccttgactggtgtcttctgctcaactggccccttgaccaacttcagctgcctttggtagttcaagaattgagagtttgaggagacataagagcaactgtaataaactgagggacctcattcaaactcatttgttgctaaagaccatcttaaaatttctggtcacctggagcaaaccatcagccagcaactcccagatctgatcatatttgatgtcgctgtgagaagtgccactccccacttccatcatggctggaggctaggaatgtgcaggggaatgtctaaaggggtagttgatatttgaaactgcatttgggggatctgggccgggcgcggtagctcacgcctgtaatcccagcactttgggaggccgaggtgggtggatcacgaggtcaggagttcgagaccagcctggccaacatggtgaaaccccgtctctactaaaaatacaaaaattagctgggcgtagaggcgcgcgcctgtaatcccagatactcgggaggctgaggcaggagaatcgcttgaacccaggaggcggaggttgcagtgagccgagattgcgccattgcactccagcctagcgatggggcgagactgtgtctcaaaaaaaaaaaaaaaagaaaaagagaaagaaaatgcatttgggggatcctcagaaaaagctactaattacacctaacggctggcaaccagctgtgttatccacattctagggttgagtatcatgacacaccatagtttaagaccatctgggctgggcacagtgcctcacgcctgttctcccagcactttgggaggccaaggcagaaggatcacttgagtctaggagctggagaccagcctgggcaatgtagggagattccagctctataaaaaaataaaaacaaattagctgggcatagtggcttatgcctgtagtcccagctactcgagaggtcgagatgagtttgaagaccagcctgagcaacagagtgagatcaagatgggatcataggctgtacctgtcatcgcaccacagcactccagcctaggcaacagagcaagaccctgtttcaagaaaaaaacaagaccatttgaatgatgccttttataccagggctggaacttgggatgctcagttgtctacttctttaacctccaaattccatagtataaactcaggagagtaggtttaacaaatgtttgacataggcagtaaatggcccagggtggagcaccacttattgaagaagtgtgcccaggtttgtgagtgcattaatatacattgcctgataacattatacactatctggatttagccaaaaatgaggctttattataatctcctataatccccttttcagggcaaaggccatgtcttactcattttggtattcccagcacgtataatagtataaggcctggcccagagtagagcctctcaacccctgattaactcctaatcatcctgcagttcattcactcaagtttgaatgctgattgagtacatatgtgtgcaaggcagtgtcgtgggaactgggggacagcagcacaggacagcgaggtccctccctaaggtcacttgcagcctacaggaacttcacctcatgcaggaaggttccctttccccccatccctcctggatgcgccctgaagaccctgcacctatcccaaaaccacacttactatacagcactataattacctgtatggatttcattagtacagggctgtgaattattaatccttggaacctcagagtctagaacgaagcacagttctctgtagatgctactcaaatgctcattaatcactgaatccacacctcccttctggcttccaagacaggaaaaggaggctcagagcggaatatgcaatgctgctctcttggcttattccttgtgctaaccagctgcttcgtaactgcccgcttactaacctggttgccccactagagtgtaagttccccaagattgagggcggtaccttatttaccattgtatcccaacatgcagcacaagcaggcgctccataaatgtttgttagatcactgaataaacaagtgaattatgaataaaatgaaagaggcttagatataaaaatgatgcccagttatacttataatgatagagccctaaagagtaaaataagactattctgtttttgtttttgtttttgagacagggtcttgctctgcagccaggctggagtgcagtggcacaatcatgactcatttcagcctcaatctcctgggctcaggtgatcctctcgtctcagcctcctgagtagctgggactacagacgcgcactaccacgcccagcaaattaatttttttggtagagatgggatctcactgtgtagcccaggctggtcttgaactgccgggcttgatcctcctgcctgtgcctcccaaatgctgggattacagacatgagccaccaaacccagtctattctgatatttctaacctgttattggagacccattaggtttgcttcttacttagaacaaaacctaaccaaccaggcacgatggctcacacctgtaatcccagcactttgggaggccaaggcgggcagatcacctgaggtcgggagttcgagaccagcctgaccaacatggagaaaccccatctctactaaaaatgcaaaattagcctggcgtggtgatacatacctgtaatcccagctactccggaggctgaggcaggagaatcgcttgaacccgggaggcagaggttgcagtgagctgagatggcgccattgcactccagcctgggcaacaggagcaaaattccatctcagaaaaaacagacacacaaaacagcctaacccaagatagatagaaatctgtcaacagttgaactattatggtttctattatcggatcatgcaatgaaaacactttaacccttcttcacttaaccaactcactcaattaatataggtctctgtttcctctctaaaacacactgacctgtcaccagacacccactgaagggatgccgcgggaagggtcttgatttgcatgtctgagtgcttctgttcctatctgctgaactgtatgctttccagttccagtggagattgtgcccactcccattgatgtccattgttattatcattttacaatttaattaaatattacataagtgctgaaataggaatgcaaaacaagagttgttatttttgtaaaaattaagttgaatgttttggggaaagttgatagaataaatcattaaaaatattgtcatacaggtgcaagctaatcaactctaaaagtttagggcagaaaagcctactaagattctgccctcaaaaccagaaaatgtaactcggacacggtggctcatgcctgtaatcccagcactttgggaggtcaaggtgggcagatcacttgaggtcaggagttcaagaccggcctggccaacatggcaaaacaccatctctactaaaaatacaaaaattagctgggcatggtggtgggcacctttaatcctacctactcgggaggctgaagtgggagagtcacgtgaacctgagaggcagaggttgcagtgagctccagcctaggtgataaagtgagactcagtctcaaaaaaaaaaaaataaacaaataaaataaattttttaaaattaggaaatgtggataatattttatgaaaatagtttgtgcaaaaaaagacagagtagaacctgaatcagcaggtccgtcttgaaaggaaaagccttgaggtctaaaccaaaaatagacaaatgaatctatagtatatgctgtgaactgtataaaaatatttaaggcttataggtatcatatcatatcttttttttttttttttttttggtctcactctgtcacccaggctggagtgcagtggcacaatatcagctcactgcaacctccacatcctgtgcccaagtgatcctcccaccacagcctcccaagtagctgggactacaggcatgcaccaccatgcccagctaattgtatgtgtgtgtgtgtagagatgggggtttcaccatgttgttcaggctggtcttgaacttctggactaaaacaatcctccagcctggcctcccaaagtgctgcaattacaggcatgagccactgtgcccggcctgtcatatcattctttatgattataaacacttccagagtttttttcagtttactaatttactggttcctggtctatggatctggcagattttctactgtacattggattattcaaaagctctatctgaaaatggtatctctccaggaaggtccctgtaattccatcctcctggcccgctaccctactaattagagtgatatgggatggccatagctacgtttccatcttgccgttttctctaacgtcacgtcctgaataaggtaggagagtctaaccaactgtaaggcatttagatatccatcatcataatctttctaaaaggaaattttactttaacattatagtgaaaagaagaaactcttttctgaaacagaagccctctctggagagcttattttcagaatggtaaaatggggaactaactttagttaagtatcttctgagagcagatgctttcatatctaattttctgtaatctttgcaaacattctgtgagttcaaaatcactggccccattttatagatgaggaaactgagctccagggaggttaagcaaggtcacacacaggcagtaccagagaggtggcatgtgacccattgtgagccaatatacttcccaagtcaccaaattacatctgatgatttgccccaaatgtgacatcccagtttttttcagaagtaaagtagtatggtggctacgtattatgtttcttaagttccagctacttcaaagggattgcccttgtttcattattggaatgtgtccaaactgagcagctcccctgccctccttcgacactggctgaggatggatgcagaggctctataaaaagcccgaggatggatgcagaggctctataaaaagccctttgctacatgctatgctatgctatgctatgctatgctatgctatgctatgctatgctatgctatgctatgctatgctatgctatgctatgctatgctatgctccagttattctagaaattctccaggctatcccctacccctctactttcaactctgtctctttctctgtccctctttgtcctttctctctctgttatgggttagtttctccccaaaagatattgaaatcctgtgactatgaccttatttggaaataggtccttgcaaatgatcatgttaaaatgttaaaatgggtcctggccaggtatggtggctcatgcctataatcccagcaccttgggaggccgaggttgatggatcacttgaggtcaagagtttgagaccagcctggccaacatgatgaaacgccatctctactaaaaatacacaaattagccaggcacggtggcacacgcctgtaatcctagctactcgggaggctgaggtaagaggacagcttgagcctgggaagcagaggttgcagtgagccaagatcgcgccattgcactccagcctgggtgacagagtgagaccctgtttcaaagagatagacaagagggaagatgatgtcaggacacagggaaggaggatgccacctacaagccaaagataccagaagccaggatggaagcaaggaagggattctccctcacagcccttagaaggaaccaacctctgcagacacctcaattttgtactttttttttttttttggtgacggggtctcgctctattgcccaggctggagtgcactggtgcgatcttggctcactgcaacctccacctcctgggttcaagcgattctcctgcctcagcctcccgagtagctgggattacaggcatgcaccgccaggccctgctaattttttgtatttttaatagagacagggtttcaccatgttggccaggctggttttgaactcctgaactcaagtgatccgcccgcctcggcatcccaaagtgttaggattacaggcgtgagctaccgcgcccagccagggaagagcactttaatgaatttaatttccttgggaatccccaaatttaattgtgcccttatcagtaatgttcattttgttaatgtaaaagaaatatatacaccctgcagaaaatatagaaattagaggaactatgaagagtaaaaggccaggcgaggtggctcacacgtgcaatcccagaactttgggaggccaaggcaggcagatcatctgaggtcaggagttcaagaccagcctggccaacatggcaaaaccctgtctctactaaaaatacaaaaattagctaggtgtggtggcacacgcctataagcgcagttactcgggaagctgaagtaggagaatcgcttgaacccagggctcataggttgtagtgagctgggatcacaccactgtactccagcctgggctacagagtgagacttcatctcaaaaagaaataaaataaaataaaataaaataagagagtaaaatttaatgacagtaaatcaatcatgtagcgagaactattgtgaatattctggagtatttccttcttgtcttttcttctatgagcacacacacacacacacatacacacacataaattcatatactcagcaccctctgcagtgtctgaaacatctgtgtgctcaataaagttcaaagaataaatgaatgaagaaaattttatttttacacatagtcaaacttacgtacagtaggaaattcatttttaaaaatcttactcaacacattatgtgtatttttctatgtattatatagatttttaaggcattttttatgaaagcataagtgctatagaataatgctgacctaaacgaacatctagtacataaccctacatttgtatctctgaagattcccttagcctaaattctttttttttttttttttttttttttggtgagatggagatttactcttgttgcctaggctggagtgcaatggcacgatctcggctcacagcaacctcctcctcccaggttcaagtgattctcctgtctcagcctcccgagtagctgggattacaggcatatgctaccatgcccggctaattttgtatttttagtagagatgggatttcaccgtgttgcccaggctgatctcgaactcctgacctcaggtgatccgcccgcctctgcctcccaaagtgctgggattacaggcatgagccactgcgcccggccaacccttaggctaaattcttagccatgaaattaataggcgaaaaagaataaactatttaaggtccttggtgtcattcagcgttcacaaacgtcccgaattgaagtgatacttcacatgaaaacccaagcaagcctttgcaagctccctggcagcccataggcacagattctccatctgtggggtgatcctcttatatagactgtagctccattatcccctcagaccagggataaccctccttctccagcatctttaggtcatccctggaatgacctgagctggattaagctccagctcagctgccctggtcctccacaaaggctcaaaggagagatcgaacttttggtgttacattccatttatttatttatttatttatttatcaatcaatttatttttctttttgagatgaagtcttgctctgttgcccaggctggagtacaatagcgtgatctcagctcactgcaacctccgcctcccgggttcaaccgattgtcctgcctcagcctcccgagtagctaggactacaggcgctcaccaccacgcccaactaatctttgtatttttagtagaaatgaggtttcatcatgttggccaggctggtcttgaactcctgaccagtgatccacctgatcaggtgatccacctgcctcagcctcccaaagtgttaggattataggcataagccactgtgcccggccttgcattccatttaattctcacttcagcatgtctttaatatctttctactttctctagccctatctattccaaagaaattctgtgtcacgagctatttctttttttattagtttttttttcatattgtgtgcagtgtgagatggaatgtaagtgggtggctttgtccttccttgaaacataacttgtgccaaaaataacatcatttgaattgtgtgtctttggtaacaacatgacatatgccaccgcaagtacattcatccaatatgtgcatgttacagggctatgcactgcgaagtcttgtttgcttgttttttgagatgggagtttcactctgtcgcccaggctggagtacagtgtcgcgatctcggctcactgcaacctccacctcccgggttcacgccattctcctgcctcagcctccttagtagctgggactacaggcatccgccaccatgcctggctaatttttgtgtttttagtagagacagggtttcaccatattaaccaggctggtctcaaactcctgaccttgtggtctgcctgcctcggcctcccaaagtgctgggattacaggcatgagccaccgtgcccagcttgtttgttttttaataactaaaactctgcctttcagaattcagattcaccatataacatcttcacccaaatgttactcccctggaagcctttcctgaccatcttttttccatttgcaacgccctttcctcctatgcttaattcttttcatagcagttatcaccacctcatctactatatattttactcatttgtcttgctaactatttttctcacccactagaagcataaccatgacagagccattcattcattcattcactgtgtatgtagtgaacacctacaggtgcccaggaatgtgttaagcatgagagtacggctgctttccagcagcttacaattagaaataccaaacagctaaacaaagatcagagtgtaatcttttttttttttttttttttttttgacacagggtcttgttctgttgcccaggctggaatgcagtggcacaatctcggctcactgcagcttcaacctttcaagctcaagtgatcctcccacctcagcctcccaaatagatgggaccacagggatgcgtcactacacccggctaattgtttatttttagtagagaggaagtctcactatgttgcccaggatggtcttgaactcctgggctcaagggatccgcccaccttggcctcccaaagtgctgggattacaggtgtgagccactgcgcctggcctcagagtgtaatctttcaacactaaaataagtggggcaggacaagttaggtttccagaggaagagaagagctcagactgtctcaaatgagggtcaagctataggaagtaggtgagagttaaaggcaggtcagaacttgatggaggaatttgaggtagaaacatttggctcatcccataagcagggcagatttgtgagcaggagaatggcatgataaaaatgatttatttagattaagccacagtggctcacacctgtaatcccagcgctttggaaggccgaggcaagcagatcaatggaggccaggagtttgagaccagcctggccaacatgatgaaaacccatctctactaaaaatacacaaattagccgggtgtggtggcacgctcctgcaatcccagctacttagtaggttgaggcaggagaatcgcttgaacccgggaggtggaggttgcagtgagctgaaattgcaccactgcactctagcctgggcaacagagcaaaactctgtctcaaaaaaaaaacaaacaaacaaacaaaaaagagaatgggtgaaactctagttcgagagtcaatttggccctgggatggggagacactaaaggaaggtgataaataagaatggacaaagagggtggaagctagcactcagtcaaaacacattcacctcaaagcaggcaattctcaaaataagatgtttaagatcatcaaccattaaagagggcctcgttagtgggttacaggagactgagttttgctgcctgaattgggagagagggagtgagagatacaaaaaagcagagggtaaagtcagctcggttattctatgctaagttaaacccatttaaagagcccagatgaagaggaaaaaaaaaaaatgagaggaggggaaaaaatgagaatcgctattttagacaaatcccatatgggttatactcttaatttacttaagccagatggctaggctggggaccgactaatttattaccatcctgccattcagagccagagccttccttaggttcctaagcaactctgagggggaaatgtcagattgcatgaaatttcctgattaggtcacatgacccaagcacagcccactgaaatgattcgaatcctccaaatcgcatattccagatcacagctgtcagctcggccctctcctgcttatggcagatgcacgggccttcccctctttgcaggcagtatggtggcagttctaggaataagaaacaccaaaataaaggctgggggaggactgacaaaaaaaaactttagaatttggcatttcagattctccctttgtaccatgtacatcccaaaattttctataaaagaaggaaagtagcaaagtatttttaaaaggagcatttaaactactgtggcaattaagcagcaatctctgagtcagcaaatcccatccagcaaactgagtaacatttgagataacatgagaggattaaaaaagtagggacactagccgggtgcagcggctgaggctggtaatctcaccactttgagaggctgaggaaggaggattgcttgagcccaggagtttgagaccagcctgggcaatatggcaaaaccctatctctacaaaaaatacaaaaaattagctaggcattgtggtgtgcacctgtagtcctagctactcaggaggctgaggtagaaggatcatttgagcccaggacgttgaggctgcagtgagccaagatcacaccactgcactccagcctggccaacatagtgatacaccatctctactaaaactacaaaaattagctgggtgtggtggcagccgcctgtaatcccagctactcaggaggctgaggcaggaaaaccggttgaacccgggaggcagacgttgcagtgagccaagatcgtgccattgctctccagcctgggcagcaagagcaaaacatcttctcaacaaaaaattaaattaaaaaattgggaaaaaataagcagctaggctggtttatgatctgaagaggaaagcataatgatataacaaaagcaacaatgaacatgttttaagatggagtcattatgtaacaagccatgtagaaactattgttacccgcattttgtattatggatgagaaaactgaggatttctaaaagacttaagttaggtctcaccgctagtaagtaccactgttaggggccaattctattcattcgtcagagaataagaaaatgattggccagaaaggtgaagggcaggccgggcatggtggctcacacctgtaatcctagcactttgggaggctgaggttggtagatcacctgaggtcaggagttcaagaccagcctgatcaacatgatgaaaccccgtctctactaaaaatacaaaaattagccggacgtggtggtgggcacctgtaatcccagctactcaggaggctgaagcagaagaatcgcttgggcccgggaggcgaaggttgcagtgagtcaagatcacgccactgcactccagcctgggcaactctgtctcaaaaaaaaaaaaaaaaaaaaaaaaagcgaagggcagcaggctgcaaatgccaaaatgagagcataactagtggttcctggggcctgtctatgagcagaggtggctagaaagctaacagaacagtgactgccaaatgcggaatggagcatgtgccaaattcaacggggattgaatcctggaacagaaaaaggatattagtgaaatctgaataaagtctggggtttagttaatagtagtgtaccaatgttggcttcttggttgtgacaaatgtaccattgtcatgtgagatgtgggtaagggacacaggggaactctctgtactctcctgcaacttttctgtaaatctaaaattattctaaaattaaaagttttaaataaatttaaatgaaattaaaagtttatttttaaattatttaagagaagagagtattggtgacatgtttacaaatattcttcagaagagtaacattttaaatggcaatggcgagggtaacgctgcatttttgtagccagtcatatttcttggcagacaagatgactaatgacaatcacaaggactaacattactgaatgcctataatatttcagcttccgccctaaggatgttacatgcatgcccatagcatcttcaagattattttcccaatttacagatgagaaaagttcttagaatagtgcctggaatctggcaggtgctcaaaaattagatcttttttgtttttttaacagaggctaagaaatgtacccagcttttgaacaagagtcacaattcaagtccaaactctaaaaggtttttttttttccttgtgatggagtctcacctgtcacacaggctggagtgcaatgacatgatctcagctccctgcaacctctgcctcctgggttcaagcgattctccagcctcagcctcctgagtagctggaactacaggcgcccaccaccacgcccagctagcttttacatttatattttttagtagagatggggtttcaccaggttggccaggctggtctcaatctcctgacctcaagtgatccgcccacctcgtcctcccaaagtcctgggattacaagtgtgagccaccgcgcccagtcccttcaaggcttttaaatctcagccttgccacttactaactctatgaccttgggcaagtttcaaagccaaaacaaagctaactgatatcacagaatggattttaaaagtatgttgaaagttgcatagtatcaacctaaatttctaaacagacaaattatttatagaatatttcaaaattgtcaaattgaataactggaaaataatcaggctgtatcgttctgcattgaaatcaataaaaatagggctcaaaataacagttctgaagaatccttgggcacacctctggatgtaagaaccaaacaagagacaactaaggaaattgttaactcctggtaactaccagagcctcaaggaaaaacgtgttttcagctctcctctggggtcaaatgactatagctcactgggccagacaggatccatgatgagattttctcaagaggggaaggtggtaagggcaaattataaagatacaccttctggctgggtgcagtggctcacacctgtaatcccaacactttgggaggccaagggaggcagatcacttgaggtcaggagttcaaaaccagcctggccaacatggtgaaaccccatctctactaaacaatatataaatataaaaattagccaggcatggtggcatacgcctgtgatcccagctactcaggaggctgaggcgggagaatctcttgaacccgggaggcagaggttgcagtgagccgagatcatgccactgcactccagcctgcgcaacagaacatgactttgcctcaaaaagtaaaataaaataaagataggccttctgatgactgacgctcagtcatctcactgacgctcagtcatctctactaaaaaataaaaaataaaaaatctctcgtagttcatgagcatgatgattgtgttcacacgcatgtgtgaaacgtaccaccacaaatcttattacaacgttggtacattacctgcctggcatgaaaaaaaaaaaaaaagagtgagagagaaatccctgagtcacacctctgttcacacatctgttcattttaaactagatcttggcctcaactgttacagcaaaagggaggtcacagcagaaaaactaaagttttttttggcttccaggtaggcagaaatccagattcaaccaatataaagactattgagggagggtttcaagaactaacttcagaggcctaccacatcattaaccgtacccatccctgccaacctaggtacaaagatgggggtgctgaaatccaattcataccttgctgatacaaagctgcttagagcctgagaaggctgaagccctcttccaatacatctgcccagacctccagccattctaattaacataaaagcaagaaacatgcctcacccttccccatccccataccccactaaaatgtgacacccttgcacatcttgatccaaaatagattgcccaaacaataacaaaaccctaagcctagagtcacatatttattttttttaacaaatacttgttcagcccctgccaagaccagcttggtcggggagaccctaacccagcagcactagaggaattaaagacacatacacagaaatatagaggtgtaaagtgggaaatcaggggtctcacagccttcagagctgagagccccgaacagagatttacccacatatttattaacagcaaaccagtcattagcattgtttctatagatattcgattaactaaaagtatcccttatgggaaatgggattaactataagtatcccttatgggaaacgaagggacaggcctaattaaaggaataggttgggctagttaactgcagcaggagcatgtccttaaggcacagatcgcttgtgctattgtctgtggcttaagaatgcctttaagcagttttccgccctgggcgggccaggtattccttgccctcattctggtaaacccacaaccttccagcgcgggcattatggccatcatgaacatgtcacagtgctgcagagattttgtttatggccagttttggggccagtttatggccagattttggggggcttgtccccaacaagcccctactctgtgccctggcccattttcttctccctggatccctgggctgcctttaatctccctattccacccttgcttgccctgcaggtctccagttcataatctatttactgttccttctccagggccccaccttctggtgtgcagatccgccatcccttttctccagcatggattattgttctatactcctctctgccctaggctttacctctttcctcctggcttaatttcatcacccttaatctcttcactgttcagcccttcttgcagctctttcccagtctcctgccactaatgtctgatctcaaccaaccacacaacagcccctgaatacagcaaatggggctgaaagaacgtaattcatttgcctgtgctaatcccacaagcaagtggtcccattcaacaaattctgtaaatcagtaatggtaacaataatagctggcacttgaaattgagctgatggacaggttgcagttattagtaatgaagtctaaggattgactttgggtgtgagtggcatgaggcatggaagggtgcaaggccatttgaagaggggaagcctaagaacactaagactagataccatattgaaaaaaatcatctgtagggataaaacaatcatcaaggatgacagaaaccacgtgggtgagaggaagcttgaaggaatgagggcgtgtgtgggaaggaggaggcgttagaggacagcaacacggtggggtagagtttgatgatgtgacagtcggaggtggtagtgggagctacagagtgggagggaaaatggcctggacgcaggaacgagaacactcaccccatttgcaggcctgtggtctgaggagtgtgggagagaaaacggccatccacagcaaggggagcaatgtgctcaagagaaccaggtctagcaagcaggcaaagagagcattcagataagtgaggaagtgaggtttttgaaagaatacagctgaggtccctgtggaagagttgcagaagttggggagtgggccggtgcagtggctgacgcctgtaatgccagcactttgggaggccgaggaaggtggatcaaatgaggtcaggagttcgagaccagcctggccaacatagtgaaaccacgcctctactaaaaatgcaaaaattggacaggtgtggtggtgcgcacctgtagtcccagctactcgggagactgaagcaggagaatcatttgaacgtgggaggtggaggttgcagtgagctgagatcatgccactgcactctagcatgggtgagagagcaagactttgtctcaaaaaaataaaaattaaaaaagttttttttaaaaagaagttggagaagggtaagacatgggatcagaaaaggggatatccaaggccatgtggatatcagagtctaaaggatgagcgatgacctgggagactgggctgacataaacagggaggaacaggaatgacatgaggggattagtcccaggatcccagagcagattgcagtggcacagctgtgagtgcggggggcaggatagtaagggttgtcaggaacatgaggagttcttgcccactgcaaattaataatctgttgggggagccccatatacatgacagaaccatacatcccagatgcctttgaaaattgcagatatggaaacctacaggagagcgacccaaatccaacagggagggtcataaaaaacttcgagggagagagagagaataacggaattccataaaatgattgcaaccactagaaaaaaaaattttttttttttgagatggagtctcactctgtctcccaggctggagtgcagtggcatgatcttggctcactgcaacctccacctcccggtttcaagcgattctcctgcttcagcctcccaagtagctgggactgcaggcatgtgccactaaacctggctaattttttttgtatttgtagtagagacagggtttcaccatattggccaggctgctcttggactcctgacctcgtgatccaccggcctcggcctcccaaagtgctgagatttcaggcgtgagccaccacgcccagctggaaaataattgagatgcttctcctatggcaatgagtctttgtataaatgaaccataagttgaaaaaagttgtataatattttatattcacattatttgaatagtctttggtcttgccagagtgaaatgtattgcatttggctagagaactttgcaagatttacacagcacaaggtgagtatattacctttaatgtaagttgtaaaattctaaatagatgtaggttagagattttctaagattctaattctttccctatccctttattacctgaaatctctgaaattacctccagtatttggggtgatggctagagatagaaaattaaattgatggaaccttccctgactcccttatctaaattagctaaactacctttatgtcaaaatgtgttgattgcctgaatgtatctcatataatcctcataacaaccagcaaggtaataatttctattttataaacaagaaatctaatgttcagagagccaagataagttgctcccacagctaatgaacagctgaagagggactcatgattgtctgctaactgccctttcctgtagaccataatgcaatcacattttcagcgttgttaaaatgcaaaaaaaaaaaaaaaaaaaaaaaaagctattgtgttgtccacgctagatggtaattcgcttacctcttctagtagtttcaagggcgaatactagttgattagaccttgaagccttttatacggtcattgataacataaaacaaattaaaatagaatatggaagaatccccctagggaattcttaagattacaagctagttttccaagaagaaattggcttgtgtttagtagaagcaatagattagagacagactgatagacttggacagccagacagtccaaatgggaccactcattatatcataaccagacaggtagtgttgaaagcgggctcaatctacagagcatcctcatttcatttcattttattttgaggcagagtctcactctgtcacccagactggaatgcagtggtgcagtcatggctcactgcagcctcaacctcctgggctcaagcgatcctcccaccacagcctcccaagtagctggccctcatttttaaaaacagacaaaaaaggcatctgtcaacccacatagatggactactattcaaatgtagagcatttactcatcttaaatctgtggctggttgcagtggctcacacctgtaatcccagcacatagggaggctgtggcaggaagatcgcccaggagttcaagaccaacctgagcaacaaagtgagacaccaactctatagaacataaaaaaatcagccaggcatggtagtacactcctgcagtcccagctactcaggaggctgaggtgggaggattgctttggcccatgaagtcgaggctgcagtgagtggtgattataccactgcacttctagggcaacactttctcaaaaagtgagaccctggccaggcgcggtggctcacgcctgtaatcccagcactttgggagaccgaggtgggcggatcacgaggtcgggagattgagaccatcctggctaacatggtgaaaccccgtctctactaaaaatacagaaaaattagccgggcatggtggcgggcatctgtagtcccagctactggggaggctgaggcaggagaatggcgtgaaccgggaggcagagcttgcagtgagccgaatcgtgccactgcactccagcctgggcgacagagtaagactccatctcaaaaaaaaaaaaaaaaaaaaaagtgagaccctttctcaaaaaaaagagaaaaaaggaaaagaaaagaaaaagaaatggatttagattcaggatcagaatcctgggtttaccattattagctgtgcaaccttgggttacttaaccttgggttcctcattaccttacctataaattgggtataatattggcactcacctcacaggggtgctgtaagaattaaatggattaatgtttgtaaagttcttagcataggcctggctcatagtaaacctttcataaatgttcactattataattatccctggttcttagacttttttttttcttttttcttgagacaggctcttgctatgttgcccaggctggtcttaaatgcctgggctcaagcaatactcctgcctctcggcctcccaatgtgctgggattacaggtttgagccacctcacctagctggttcttagactttcaaacttccaaaatcagtgtttaaaagaagaattaggagatcaatatgggtttgtcttctttgcttttttgttttttttagcttttcccaaatcaaaacagtttttaaaagccagtattttctataataaccaatatttcatagaaaaaaataatattttaataacacaaaatttaggcagaagataatgtcaaaataaatgacttctattattacatttagctttgagagaaacttaaaattttttgttttagagacggggtctcattctgtcatccagggtggagtgcagtggtacaatcctagctcactgcagccttgaactccagggctcaagcgatcccctagcgtcagcctcccacgtcgcagggactagaggccgtgccactacacgtggtaatgagagacattttttatgttatacatatttttctcagttctccttggaatagtaagcatattttttgttcactgtatttgaggacgacttagtcatattttccaacacccttacatgtatagtttttactaattagtagttaaatgtttttaacttttaaaaaactaatcatagactatagacagtagtgtttgtaaactgtgaatgaaagaccaggatcataaggtcagttactggctttgcacattgcaaatagacaaaaaaagaaatatttttctgtaagacactggaaaaaaataaaagtggagttaaaacctattctttggacaagaaacttggcattcctacttttactgtgatagaggagtccctaaaaacagttgaagtgaagatgaaattcccaagcacccatgtgccaactcatttgtggaagagcaaagaatctaattaactcgaagcaagacctgaaaggggacagaatgctcaggaaaaccacatgaactgtccaaactattgattgagcaatttgcaatcatttctagtttaaaaacaaatagtttgggtaaatgaatgaatattcctattgcattattgctattgcattacttcttgcaaagttttccaaggaatttcctagttgtcaggcatatatatatacacatgcccagccttttttttttgttgggggagggggttcctagccactagaccatcagggaggaatcttaagaattattattttagaagactagcagtcacttttctttcttttactagttatacatctagcaaggccatattagttacaagcacacataaagttatataccaggatcttggaatattcattttaccaaaaaaagtcagtaaagtcagttgtgctgctacagttttcgtattttccacagattccaatgagccaacacaagttctactaataaaatccacacaaaataaaatgcagtcagtggaaacactatatgtacattgtagtcatttatactaagactgttgaatacaatactccagagtaaaatgatctcaataacagctatgaggcttctttttttttttaagagatggagtttccctacgtttcctaagttggacttgaactcctggactcaagagatctgcctgacatggcctcccaaaatgctgggattacaggcatgagccattgtgctgggcctgtgaggctatttttaaagtctgaatcttaatgtctaggttggatgatattaaatccccatttactcattcattagctcttctgagagagatttttctctcttagaaccagttttcttttttctttttttgagacggagtctcactctgtcgcccaggctggagtgcagtggcgcgatcttggctcactgcaacctctacctcctgggttcaagcaattctctgcctcagcctcatgagtagctgagattactggcacccaccaccatgcctggctaatttttgtatttttagtaaagacagggtttcatcatattggccaggctggtctcaaactcctgacctcaagtgatctgcctgcctcggcctcccaaagtgctgggattacaggtgtaaaccaccgtgcccggactgattctatatattcctgattgtgttgttgataacaacaataatagcagctactacatattgggtatttcctatgtttcaggcaattatttcagtgctttatgttaattttttacaataaccctacaaaatagacagtgtttgcaaatctccactttacaaatgagcaaacagaaactgaaaggttaaataactagctaaaggccacacagtaagtagtgaagctgggtttcagaccctgaactgtctataactcctgaacctgaattctaccctacggcctacatgcttatggaatctctaaatggctctatggacattcgaaagaagaactcatcaaagtgctctctcctttttactaacttctattataataaacatattactaacatttactagaacaattataaatttttaaatcttaagagttttaggtctcaaagggacctttgaggtatttaatcaatgcccacaattctacaaataaggaactgagctatctcaagttcaactgagctacaactaaaacaccaacgattctcttaaaaatgttagacaatggctgggtgcggtggctcatgcttgtaatcccagcactttgggaggccgaggcaggcggatcatgaggtcaggagatcgagactatcctggctaacacggtgaaaccccatctctactaaaaatacaaaaaattagccaggcgtggtggcgggtgcctgtagtcccagctagttgggaggctgaggcaggagaatggggtgaacccgggaggcagagcttgcagtgagccgagatggtgccactgcactccagcctgggcgacagagattccatcttaaaaaaaaaaaaaaaaagttacacaatatagacctcattgtatgtatacatgttgttgatgataactacagtttgaaattaaatgaccatgtactaggaagatggtatcagcctagccaaggatttgacacaaaagactggaatgttttcaaaccttacttagtaactttgttgctggactacaaggccaaaagcaagtggctgcttggacactggctattcagctctcctttaatctttcttaaaatatcaaagatatgtttattttaaagatgtcttcagtggatgcatttttatttaaaaacctggtcatccaaaactgaatttacttttcccctaaagcaaaagcaaaacctttctagaagtaattgaaaataaaagcattgcctaaaaaacaaacactattcaaaaatcaagattatacaataaggccattggctaaaaataacagagacagaaagttcagcttgtggttttttacattgtttattttttatcctcctatccttaataggatcagtttttttccatgaacagtttattgatcatttggtaagtttgttttttttaaataaaagaccattttttccactgtaaaatgagaaaataaaattttcctcagaagaaaaaatgtacaacttcattaataacctgagtgataacagattaaaatgagataccatgttataaacaatgaaattgactgagatcaaagactccccccaccccaccccaattcgcaatgttggtcatggtgtgagaaaacaagcttatatggtgttttgataatattaagaaataaactaaggcagtctttctagaggtcatttagcaaaatcccttaaaaagtgcatttttggctgggtgcagtggctcacacctgtaatcccagcactttgggaggctgaggtggatagatcacctgaggtcaggagttcgagaccagcctggccaacaaggtgaaaccctgtctctactgaaaatacaaaaattagccttagccaggtgtggtggcacgtgcctctaatctcagctactccggaggccgaggcaggagaatcgcttgaacccaggaaatggaggttgcaatgagccgagatcactgcactccagcctgggtgacagagtgaaattccatctcaaaggaaaaaaaaaagtgcattttttggacatagcaatttcacttctacgaatgtaaactacaaaaacaattaagctttatgtgcaaaggcttacctataatgatattaataacagggttatttgtaataagatggaaggaaggaaggttagagggggagggagagaataaaggaaatcagaatttccatcaataggaattggttaaataaacaaatgtggtacagtgcatgcatcaaaagcagtattatttttccattgaaagtgatgctgtggataaatattattgaaatgggaactgttcacataggttactagatttaaaaaacagattacaaaactctatgtaactgtatgtttctatttatatgaaggtcaagatcaggcaaagccaatctgcagtgatagaaatctaaacaatggtgcagggaaactgggtagagcagaggctgatttggaaagaagtaaaggaactttctggagtgatggaaatgctctaagatgatattcttgccatatggcttgtgggggggtgggaagcacagagtaggtggacatttgtcagaattcatcaaaatggtcagttagcatctatatatttcatttcatgtgagtgatacctcaattttaataagaaacaaaatcctcaaatgtacaacatgatcttaagtttataataaaaacaacggtttctatttgtacagacagaaaaggatttggagactgtcttagtccattctgtgctactataacagaatatcacagactgggtaatttacaataaacagaaatgtattggctcacagttctgccagtatctggcaaagacctttttgctgcatcataacacagcaaaaggcatcacatggcagaaaagtgatagagaacgggtgtggggagagagagggagaatgagcaagacagcaagaggagaccaaactcatccttttataagggacccactcatgcaataatgtaataatggctttaatctgtttgtgatggatccacccccatgactaaattcctccattaggccccatcaccatcaagtttctaacccgtggactttggggaacacatttaaactatagcagaaaggatttagaggtagtgggattatgggcatttttaaactcttttttttccccacttgtctcaacaaatgttgtaataatttaatcataacaattaaacacaaaatgcaaatgtatccaaatgtgtttcagtgagcctctcttgctcttaatctgaatatttcctaacaccgcattaaagggtactgtgaagattacccagtgcatcaccgacttgcttgaaattccttggaaggataccaatggcgtcccaccccttgtggaggtctttcaccataggcacttccggccatttgttttactctttcaaacagctcaaaatgccaaaattaaatcaagaattttatcatttggaggcatgcttgaagtagattttatttctggtgcccaaacccctctcaggtccagagtaaaaagcttcaaattcctgaaggtaatgcaaatactttatgggctgagaagtagctgtttctttgcatgtgtcctgccaagcttctaagaatggttttgccattagttccaaacccacaagcagcctggtctgagctccaccacctccagcaggcttattacagataagtcagctggtcttcatgtgacagagaagccttctgtgccaggtgtgctcacagccaagactgggtgtctgccacctcatgctgatggcagctcatgttcacatgcagcccacagatctcagcacaggctgctgggtggttaacgatgcaggcacaattacctcctgacaataatagtgcaaacaactatgggcagttggttgaaggatgggagagaggaggaatagtaaaaagcagatgaaacgtcattacacttctctaaactcctgcaggatgcagcccagcatcgtggctcacatctgttataccagcactttggggggccaaggtgggcggatcacttgaggtcagaagtttgagaccagcctgggcaacatggcaaaaccccatctctactaaaaatacaaaaattagccagtcatggtggcgtgggcctgtaatcccagctactcgggaggctgaggtggaagaatagtttgaacccgggaggcagaggttgcagtgagccaagatcgtgccactgcactccagcctaggtgacagagcgagacttcatctcaaaataataataataataataataataataataataataataataaactcctgcaggatggatacaaattgagaactgaagtaggtgggaataagtgagaactgaaatctagttttcccttgggatatagccaaagaaactaatggatgaacagtgccaaaagaaactcacctccaacaacctggcctggatctggtgcagagaggaagacatatgtccacggatctgtatctctagtctactggatagctagacaaaaacgtcccacagggccatcacaattacctggtctaacatccctgaactgaactcaacatcccttccttgcctccaacctgctatgtcttttgcaaagacgtataacaaccagtgtataacacaggctgctgggtgtataataaccagtgacccctttacaagagcgagaacttagaagccctttagacctcctccttcttcatcttccacatatgattagttccagttcctagttaggacactatcatcctaatatctttctgactagcccttccttcttgttgtgctgccaactgtcacaaaatctaatttccacctcactgcctgaatgatctgtctacactgcaaatctgatcatgcctctggcctatgccagtctttccacagttctccattatctacctagcatattcttgagaagatctcaaatgccttcactaccaggcactcaaatgtgtgaagccatggggtttaatatggccaagaaggaagttgtatggacctggagaagatctgtcctacctgaagttattcaaatcaaaaattattttaaaacagctgcactggcctgggaaaactttctgaggtcactttgatactcttggtctacaatagagtcaaattccttagcctgtgatgtagctgaagcctgcttctctagcttgtcttcacctattttcaattaagcagcctgcattttcctgaaggttctctttcacacagtgatgcctttgaacatgatcttttctgcttgggtccgtctccttctttccccatcttgcctagaaacttatgtcaagacctcatctgccagcctttgtggagccccgggaagagttataccctggacatgcatctgttattgttgttctttccaagcttgcaaatatttattttccttctctgcaagtagtacttagggggcctgtcttataatggcacaaattgtatgttacaaaataaacggcaaaggctagagacagttttcctccccaacattttaaataagattgagaaattattgtttacatcacaaaatgtcatttaaaaaaaattcagagtgtcctttaggagctaatagagattttatgaggacctccaaatgtgccctgtgtccctagctagccttcatcaataaacctgtattgaatgtgatagtacaacaatcctaggccagaaaaactgcttcaggccttgatcaggttcccaaaatattagaggtgatattaatcattatcataaaattttagttgttcagaaaaaaaaaagaaaaaagaaatggtcacatgctccagtgcatttttaaaaatcacttaaagaaataaaagagaactcaactccactcccacaactgggtcacaagctccattggctaaggtagttgagttcccagccacatgaaatagttctatttctcagaacttgtccaaaagacctctcctgcctgcagagatagaagtaaggaaaagagaatctttcctacgcctttaagtttgacctgcctcatttttttttcccctccctttctgtccattgatttaggccatcaaggaactgtagaagtagaataggaagtgggaaagggaagagatagtgaaggatgaaggggtgggccaatcgtggggggctttcaagggatctatgtctatagtggctgaggttaaatgaagttaaccacaaagctagagtcacctcaccacttcctactttgtagactaataggctgagctctggtttaacttaaacttgagtggtctggagtgaactcattcgttctacaccagttcctcacagaatattatatattttttatcattattattgagattttacgtgtttttattctttccttttttttttttttttttctgagacagggtcttgctcaggtgccgggactagagtgtagtggcgtgatcatggcacactgtagccctgacctcccagggtcaagcagtcctccagcctcagcctcccaagcagttgggactataagtgcacaccacaacacccagctaattttttttttttgaagagatggggttttgccatgttacccaggctggtttcgaactcctgagttcaaataatctgcctgccttggcctcccaaagtgctgggattactggcgcaagccaccacgcctgactgtttttattcttattaaccaatctgaaagcaatttacttaatgtctggctgaacacacacacacacagacgatattctaatacaaatgaacatgcacatgacatgattttgagaaatacaggaaagcataaggaaaaaaatctatagttaacccaaaaataaaaattattaactattttgtcaattctgctattaagatctttatatagttgggactgtattgtattcacaacttttttttttttttttttttttgagacagaatctcactcactctgtcactcaggctggagtgcagtggcacaaccaggctcactgcctcctgggttcaagggatcctcccacgtcagcctccagagtagctgggactacaggcatatgccaccatgcccacataatttttgtatgtttttttagagatgggttttgggtttggccacgttgctccaggtgatacaacctttaatacttagaaatctaactttgtaacaagctcttgccttgcttttagaaactatgtaagcattgttatttatagctacatagaactccttgaagtgtatatattgtaatttatataaccatttttcttttttcttttctttttttttttttttttgagacagagtcttgctctgtcgcccaggctggagtgcagtggcatgatcttggctcactgcaaggtccgcctcctgggttcatgccattctcctgcctcagcctcctgagtagctgggaccacaggcgcccgccaccatgcccggctaattttttatatttttagtagagacggggtttcaccatgttagccaggatggtctcaatctcctgaccttgtgatccgcctgcctcggcctcccaaagtgctgggattacaggcgtaagccaccatgcccggcctacttatatgaccatttttctactactaggcatttagtttttaactaaacatattttggaataataatatggatttcgaccttttaaaagctctcactaccagcaatgagaaaataagacctctttaaagaaggtataggcagcagtagtttaaaagtattttagtcattggtttccttcagccaagaaaaacaggtacaatatcactgaattatggacaaaagcaggaaataccctgaaattttcccaagaataatatatttcttaaacacatgctgatgtgaaggttggacttgttctaggaaggctttaggaaagaaaggagtcttgaataggagaataaatatacaagaggtggtataaagacatgatgttgggggtaagagaaaaaacatggcaaatgtcgtgaggtgaagaactcaggctcttaacgtggtgcctggcagagttcctctgccatcattgcctttgatggtgactggattctggtaagcttaccacaaatccttaaattctaggcagaacacttgcttaaacaaagaatttaaacaaccatttgctaacggtaatctcctgcctactctaagtgtcttttcaccaaatcgttcctctttttctatgctatttagactttgccagcattagagtgggcagccagatgttatttcacagaattcacacggctggaatcgctgctgtgagaattcttttaaagggatgtagaacttatagtcttcctaaagccccatgtccctgaacttttgtagcaatctggggaagatagaatgctgcattattatattacatttgattttcatttaaatcaattcttttcttagaaagttatctaaaaattttgattcattctacgttttgcccaatatgtttcccattatttatcacagtgtgtcttcacaacaccctgagagatgggtaggccagatgttgctacttccattttcttcaaagagaagaaaaccgatgaagagactgaaggcattgccaccagaacccaggtgtctcatctttttggcccagggtgtgttcctctgacacattaaactgtcaccgtggctttgacagatggcattggcagagagtccgtagagacatgggttgtgtctctgctattggatatctcagggaagttttatacttcagtttttcaaacctgccataaaccctgagtatttctttaagcacatatcaaagtagtctatcttaaagtacctccaagtttttaccagatttggattttttaatttttaatttatttcattttatctgacacagagtctcactctgtcacccaggctggagtgcagtggcaccatctcggctcactgcaaacttcgcctcctgggttcaagcaattcttctgcctcagcctcccaagtagctgggactacaggcgcgtgcctccacacccacgtaatttttgtatttttttttagtagatacggggtttcgccacgtcggccaggctggtctcaaaatcctgacctcaggtgatccacccgcctcagcctcccaaagtgctgggattagaggcgtcacccactgcgcttggcctttttttttttttttgagacagaatcttgctctgtcacccagtggcatgatgttggctcactgcagcctcctgggttcaagaaattctcctgcctcagtgccccaaatagctgggactacaggcatgcgccaccacgcccgactaattttttgtatttttagtagagacggtgtttcaccgtgttagccaggatggtctcaatctcctgacctcgtgatccaccctcctcggcctcccaaagtgctgggattacagacgtgagccaccgcacccaaccagaacaatgcttctttaaaaatgactaaaaatacaaagggctggatgtggtggctcatacctgtaatcccagcactttgggaggccaagacaggaggactgcttgagcccaggagtttgataccagcctgggcaacatgacaaaaccctgtttctacaaaaaatacaaaaattagccaggcatgatggtgtgggtctgtaatcccagttacttgggaggcttaggtgggaggatggatagagcccacgaggttgagactgcagtgagctgtgatcacactactgtactccagcctgggcaacagagtgagaccctatctcaaaaaatataaataaatgaataaataaataaaaatttaaaaaaattatatagataattttttcaagctgagccttatataaaatgcatttctgtatgtaggtctccctttgtaaataatatgacttttctataaacctataatataaaagactcttggagaacatacaacagaaaaaggacatgtccactctatatcatacttgaaagtattattgattttctttttaagatagaaaggaaaagtcatattaaaagctacttttggctgggcactgtggctcacgcctataatcccaacactttgggaggccgaggcgggcggatcatgaggtcaagagattgagaccatcctggccaatatggtgaaacgtcatctctactaaaaacacaaaaattagctgggcgtggtggcgcacacctgctactcgggaggctgaggcgggagaatcgcttgaacccaggagacagaggttgcagtgagccaagattgcgccattgcactccagcctggtgacaaagcgagacccggtttcaaaaaaaaaaaaaaaagctactttcacttgggatgtgtgtgtgcacacatgtgttattgttgtcgaagagcagtttccaagaaccctcaactagcctatgaacgtggctgcaagttgacacttgacaatactcagttcaagactatacctgatactgccgcactcccttatattatttcctgttttcccaaaagatagcaagtgtcttgaggttaataactgtctttatttctgttatgtccctcatagtgtttcccatcatatctgtgttgaaatgaacattcatgtgatgttccaggagacccagtcccactaacttatccagtctttgaaataaattgctcttattctctgaactgtaaaattgaatgttaatattactattttttggaatatcttgactctacaataatctacatttgtatgatatggttgcaagcattactatcatgtgaaaaagaatagtttttttgtgcttattccctaaaaattttgaagctttggatataattttatcaatatagtaagtctgtgtgcgcgcgctctctctctctctctctggctcactcccaccttctcttgccttccctcaccctccctccctttccttacctctctccctcacctctccctctctcctacctctcttcctttctccctctctccttcacctctccctctctcctacctctcttcctttctccctctctccttctctccctgtctttccctctccctctccttcctctctccctctcttcttctgtccccttctccttctccttctgccataaaatgaaaaataaaaaaagtagtgaataagagtaagtaaataatagaaaagcaagagcccatcaccccctgaatctcttgtagattgtttttaaggtatgaggaaacctcttaggtttctaggtttctcttaatttctcccattagaattcaactgaccagcattaacattaaaacagagatcttgagactgacaaaacagactcttctagtagaagataccaaatctcaacctgactgtatatactgactgtagtatagcatcacatgacaaatagcaaggccttaaagaaatccaagtattttaccccaaaatacatttctttgacatattttggaatggccctgcaaagctgtctcttgtggggaaaatctacattctgtagaaaatctcctttcctttccaaatcttttcttcatccaggagagattatctgtccccctaaaatgtataaaatcaagctgcaaccaaccaccttgggtacctgttctcaggacctcttgaggctgtcttaagccttagtcactcatatttggctcagaataaacctcttcaaatatgttacagtgtttgaatcttttcattgacaatttcaaaaggttcatgatctttcagaggccccttatttatttatttatttatttatttatttatttatttaatttttactgaaaaagcatctggccatgttgcccaggctggtctcaaacttctgggttcaagtgatcctcccccatcagcttcccaaagtgctggcattacaggtgtgagccactgtgcccagactaaaactattttttaacatcatttattaatgaatttatttttgagacagggtcacactctgtcacccaggctggagtgcagtggcacaattacagctcactgcagcctcgacttcccaggctcaagagatcctcctgcctcagcctcccaattagctgagactataggcacatgacaccatgtcaagctaattttttgtatttttttgtagagatggggtttcaccatgttgtcccacctggtcttgaattcctgggctcaaacaatacactccacctgcctggcctcccaagtgttggagttacaggggtgagccactgtgcccagccctcagagaccccttttgagggatttctgctggtagtaacctacagcattttttatttttattttattttattttattttttgagaccaagtcttgctctgtcacccaggctggggtgcagtggtatgatcttggatcttggcttactgcaacctccacttctcgagttcaagcaattctcattcctcagcctcccgagcagctgggactacagttgtctgccaccacacctgactaatttttgtatttttagtagagaaggtgtttcaccatgttggtcagactggtctcgaattcctgacctcaagtgatccgcccacctcggcttcccaaagtgctggaattacaggcgtgagccactgtgcctggtgatagtattttttaaaactacaaaaaaacaatgtacatatgtttcagaaaatcctcaaattgtgtttttcttctgctctgacacaacagtcataaatacagaagacttctgtgaccaaatattggggcttctcctcaccaccaattctgcagtagataccagctgggtgtcctcgaattcaattctggggttatctacccagagatactgtgagatcccacagttgagggctcagcccctaaggctggaccccatcccccaccagtcacaaggtcaggcctctggaacttctgactgaccagcttcaagttggggtttccatgaccctctctttgggttcgattaatttgctgggggcagatcacagaattcagggaaacacttacgtttactggtttattatgaaggatattagaaaggatacagacaaagagatgccgggagcagtgcccagggaaggagcacagagcttccgcgccctctctgggtacaccaccctctaagaacctccctgtgttcagctatctggaagctctctgaacccagtgtgtttacggaatcttcatagtgttagcattccttcccccagggtatggggcggaaccctctctggaatgagggtcttaggaatcacaatcggaaaggtggagaaagattacagtcctaccttggagcaggtgaaaggagggagaagttcaaagagtttctgtttcctgaggttggccaggcccaacatagcaacaaaatgactgtaacataatctaggatttttttttatacctgccagtgaagatgttcctttcagttttggggggtttttgttgttgttgttcttgttgttgttgtttgtttgtttttttgagacggagtctccctctgtcacccaggctggagtgcagtggcacgatctcggctcactgcaacctccacctcctgggttcaggcaattctcctgcctcagcctcccgagtagctgggattacaggcgcccgccaccaggcccagctaatttttgtatttttagtagagatgggtttcaccgtgttggccaggttgatctggaactcctgacctcaggtgatccacccgcctctgcctcccagagtgctgggattacaggcgtgaaccactgcgcgtggctgtcctttcagcttttagatagaagggagaaagaggtcaactcagatatccagaaccaaactaatgaagttatattgttcttttctatttctgatcaaatacgtttctaaacagccattccaggctctaatataacaagtataacacaacttgtattctagcagtgtggggattcatgtccatgtctacaaaacattcttcctctccccaattttcctaatggcttacaacttaatattttaaacacttatagaaaatttcaaaaaatgcaaaaaaataaaaaataaaaataatgcaaccatatctcaactatgacaataatcaactaatggccaatctagcttccttcacactcctactcattttccttgcccccaacaacctagatttttctccatcatagtactgcagctgcaaatatttttgtacatatgcttaaaagataaggactccttttttgaacatcatcacactgccccaaaagcaacaatagatgcttaatatcatcacatattcagtgttcacattccctaattgtccttataaatgtcctcttaaaaatctttgcttgcctattgggaaaaattagtcatattaaaaaattgtttgaaagtttgttgtttggggctgggtgtggtggctcacacctgtaatcccagcactttgggaggctgaggcaggagaatcacttgaacctgggaggcagaggttgcggtgagccgagatcatgccattgcactccagcctgggtaacacagtgagactctgtctcaaaaaaaaaaaggtgtgtttgaatctgcatcaaaacaaggtcccaggtgggcatagtggctcacacctgtaatcccagaactttgggaggctgaggcaggaggaccactagagcccaggagtttgagaccagcttgggcaacatggcgaaaccccatctctaccaaaaatacaaaaattagccaggcatgctggtgcatgcctgtagtcccagctacctggaggctgagatggaaggatcgcttgagcctgggaggcaaaggttgcagtgaggcatgatcaagactattgctccatccagcctgggcaacagagtgagaccctgtctcaaaaacaaacacacaagggcagggtgtagtggctcacgcttgtaatctcaacactttgggaggccgaggtgggtggatcacctgaggtcaggagttcgagaccagcctggccaacatggtgaaacccccatctctactaaaaaaaataaaaaataaattagccaggcatggtggtgggcacctgtaatcccagctactcaggaggctgaggcaggagaatcgcttgaacccaggagctggaggttgcagagagctgagatcgcaccattgcactccagcctgggcaacaagagtgaaactccgtctcagacaaacaaacaaacaaacaaacctccaaaaaaccaatgtcaatttattgtgataattaacatgtctcttatgggcaacattgtccttttttagcctttgccctcaaataaaaaaattgttatgtagcaaaaacaaccatttccagatgatgcaagagttcaaaatgctggcctgaagaagtctatgaaaatgtcaagtcatgcctttgcgaggagataactacttggcatatacctttccctgaatgataaagaaggaaagaaaaaatgtacttccagtaaacatattcattagccacagagagctgcatataaacatgatgcttggaaaacaaatgctctgcagtaaatgggaattgagaaaataggtaataagttgcaaatctgaaaatcatttctttatttcaatgtaaggtaagtttataaacagtcagaccaaaaggtctgcttttaaagttttgcaaatgctggtcagattgattagtccttttttgaatttttttttttttttttgagacggagtctcgctctgtcgcccaggctggagtgcagttttttaatcctaaagctttttaatttaaggctttttaattttcagtttgcttactccattcttttgtaaaagaaaaaaatcactttagattaaatgaaattgtaattaaggcttctacttccatttctcaccttacgagcttatcttctggatcccccacttaaaaaacaaagttcccttttcatttaaaaattaaagaaactcctgggttagtacttaacacaaacaaactaataattaccatgtaatagaagcaacaggacaagctcacagtaatattacaatgcaggaggtaaaaacttgggcaacatagaaagaaggctccgtttcttagtctgtaaatggggacaataaatagctgcctcataaggctgatgctgggatcagtcaaatgagatcatgcaaagcacccagcactggctaacactcaataaaaaaatagccattatgatcattaggaagatataggaagagacttttgtcattgtcacagtttaatcttgaaaaggaacttactgtatggtagcattctgagtcagttacaagagaaagtaacaagtgacctgcattgctgaggatcctgcctcctccaagctaccctgctacattgttaaaacaccctgggggagaaaagtatcctattcagccaatgttaaactgtttccttttctgaaagttagaaatagatgaaaatagcataagaaataactctgtatatagtaagttctgggtaagacaatattgtggtaagtgaactaaacaaagattaatctgaaattggactctgatccccaagtgaaccagccagtgtagcccagtccttactggacctgaggaggaaaaacaagcctgtgtctatctcaagcgtgatctggctagatatgatctaaactttgaaaagtgcctaagcatgtttcagatgcatattatgtgttaaatactaagcagggagctctgagctggggcagtgcaccctgatgctgaggaactgacataggaaaatgaacacctagcattgtaatttggccttttgctatttatttatttatttatttatttattttgagacggagtctctctctgtggcccaggttagagtgcagtggtgcaatctcggctcactgcaacctccggctcctggttcgagcgattctcctgcttcagcctcctcagtacctgggattccaggcacacgcccccacgcccagctgatttttgtatttttagtagagatggggtttcaccatgttggccaggctggtctcgaactcctgacctgaggtgatccacctgcctcggcctcccaaattgctgagattacaggcatgagccaccacgcccagcctattctctcattttagtcagacaagttttcttttctgttagatctctccccaataattgcaaaaaccaaccaaataaataagtatgggagagaggtggttatttatattatgaaagcattcttcagtttaattcattgcagaatctaagatcctttcctccacagtgttaaaatccatagccctctcaattactcttccacgctttgaggaaaaggaagacagggaggagagatctccaatggaaatttccttgttaataacatcttatgtttctctaaatgttttacagtttcaaagcactttcagactcactctggtatgttagttaagccttgtgcaagataccataaatcatattatactcaattaagaggtgagaaaagacaaggctcagaggtgaagcaaatataaatagtagtaattagttttatatatatatataactaatatatataacattcatatatatatatatatatatatagagagagagagagagagagagagagagagagagagagagagggcgcaattggtacatgtgagacctgaagccaagatttttaaactaagtccagtggccaagaagctgaagcaagtagctcacactcactgccttggtgttgctgtttttcctcccttccgtgatttggttctaagcatcttcccttttttttctcagttaattctgattcatgacttccctcatgtaattaataaatgggaaagacttgagtgaacaaatattcagccaactagtatttattgagcaacaactagaaaccagaactttgaagggttttaaacaaaggaaatggaatctctttgtcatttaaaaggccacaataaaacaaataaaagtaaaaaataaaaaagaccatagtgaggagggtgcagtggctcacgcctgtaatcccagcacgttgggaggctgaggtgggcagatcgcctgagctcaggagttcgagaccagcctgggcaacatggtgaaactccacctctactaaaaaaatccacaaattaaccaggcatggtggcatgcaactgtggtggttacaggtactcaggaggctgaggccggagaatcccttgagcctgggaaatggaggctgcagtgagctgaaacagcaccattgcactctagcctgtgcaaccaagccaggattaataactttattgatgtgaaccaattatccaaaaataataatcacatattagccatagcggactccccagctagatgttttctgcctgtgtttgtaaatcctggacatagttaaatttcaagtgccttcaataagaaatcaatggcttggaaaacatctctgcgcagtcttgataagatttctaattgtggtgaagcctcattccttaaattatttattcaacactaacccattctacaaacttacatctgctgggctctgggagtaacaagatgagttagatgcagcagtcccaaatctaaaggaggttggagactagaaagaccagtgcctgctctgagctctccagtggtccccagcctctcagtcaggcctcacaggcccctctgccagaggcggaaccagcttgcctccgctctgcagccacactggccttttctttcatttctgagaactctcctcactccctcccactttgggctctgcagaaatcccagttccctttgccttgaaagctcttggtcaatttagctcctcctccttcagccctcagctcctgccttgctgccccaataatctttttctgactgcagatctggtcaaatctttgtctgaaaccttagagcccattacatttgtagttttacgtgtacacgtgtgatcatttaatatttgacggtgtgctctcaggtgcctacgctcctggagaggcaggggctgactggttttgttagatgccagtgcctgacacacaataggccctcaaggggtgaaaaaccaaccaaccaagtcaggacccaagcaacctgggcctctgtggaagggcagaatggcctgagtttgggtttctcgagctaccttaagatcaggcctcctggctcctatcttagcccttctaacactctgaagtgtagaggttgtttgttccaagtccccaaggtactgtaagctcccagatagcagaaatcccattatattttagtgctgtggccccagcatccagctgcgctgttacttagcatgagatccacatgaaaaccatttcgcaactattagccattgccagtattaatactttccggaaggtggcacaaagtgggggatgttatagacagcttcaaagaaacgtttaagctagagttgactctttaaataatacaagccatccccaaccaaagattaaaaatttaaatacaaaaaaaaaaaaaggaaatttgcctaccccccatttgtgaaaacaaagaaaaaaaaaacagttaacgtcttaacttttctaggccttcactctcgcctctccccgcgctacaagggcgaattctggacgtatctacacagtcaccgcggagtctgcaatcgccgcgacgtcccctggcatttcttggccaggctgcaactttggtgacggtgtatgtagttacatcccctgtagtgcagctggtatttagggtcctcattggcaaagttgagggtataagcagggagggaggggaccttggcttctttccattcactggcatgttttcggggcacggtcatcccacgctgggctccagcgccagtcccaaggcctcgccgaactccagcccgggagtgcgcgcggccccgcccaccgggcggccgaggtcccgcccctacctcccccgccacacctacccacccaccccattgcaatggtctctgcacgcaggcgcagtggcgcgcgggggaggcggggcgcatgtgggcttcatttaaacagagcagagggggcggcgcgcggtcgccgcggtgctgctgctcagtgggagcgggtcttcgcaactgtctccgcgtggcgcgcgcctctagccgcccttcccctggcggctacggccggagggagcggaggcgagcgggagtcgggctccatggagagcggcggacaactgggcagaggcggagctttcatctcggcaccctggttccagtgacccgcgctagcgtcccgtcccgcccgcgtcggagcggccgccggccccgggactgaccggcctcgccgcacctcccgcaccgactagcgctcccgggcgctcctgcgcccgactcgccctcgcccccactccccggcggggtggcggcggccgggcccccacggcggcggccggagcagcagcagcagcagcaggagcccgcctctatgatgaagttcaagcccaaccagacgcggacctacgaccgcgagggcttcaagaagcgggcggcgtgcctgtgcttccggagcgagcaggaggacgaggtagggcgcccggcgccgcacgctgccctccggggcgccggggtctagggcccgggtgcttcccctcgctccccgcccctgcgcaggctgcggggctgggagggattagcccccttcctccctccctcctttcctccctcactcctttcctccctcacttcttccttcctttctctgggctgatagatgagacaaagggggctcgcccagccccagtttctccatctgggcactcgagaaggcgcctggtccccgggaaggtcccgggccgcgtaagtctcgcctagcgggagtcaccatcttaacgtgcgaattgagttgaaagccggataaacctcgagtgctcagcgagaggagggtggaaatggcgtgagtgttgcagcagagcccttgtgcctcttttacatattttccttccatgttacagccgtttgcggtctcggattcgatctaagcatgtttgtggagtaacagacagtcctcgtgcttggaattgagtctagtcttggcaattcttgtgggtccatgaacccgcaagctgttggcataattatgcctcatttttaaaacggccttcccttcttaaagttttctgactgcagaaaaatggttagtgaaaaatgtggaataatgccaaaagggagacgatggactagagatgggcaaagctgccattttcagacagtaatctccagctctcagcttatgtataaagggttctttgctgtctggcttgacatctggaaaggagtagcctttctcgttctcagagcagtcgttcttggataatttacccatctgcattgggctgagaatgagacccttggggtttccctggagagcgatttttacttaattcagtagtatttatttaaaatggctaactgttgaagtttgcttagggcaatagtagccttttggtattgccactcttaagataaattacataggtgaaaaaaattaacattctgagttctgctttcataaccaaccgtgtataaaatactaggctaaggctggagatgggaatttaatggcttccttactgctagtccctgtagttgtgatgaatatgacacagaatacactcagtggcttagttcttgttatgttaacgaaaagttctcgaaatttgcccttcaaacccttgttttgcctttatttttttttgaaaagaaaccaagccctttaaatgggttgctctgtgctcactcataacctttacgtattagacttgaatcccaaacgagtgtgcagagaaatacggccccagcctttgagatgggtctgcttaggagagctagaaactgcaaagggaaaggttattaacttttacaaaatgaacaagtcaacaagcattaagtgtgttctgtaaaaaagataaagccttagcggaaaggggccatgttgaggcaaagtagtaaactttaaatataaaagaaatgatagccaaaagggatcaagatagatcaaggatcttgtctggtttcctcaatattgtgtaatgatattcttaattgagtgcttacaatgtgccaggcgctgccagaagaaaacttgttatacatttaatccttttaacactgggaggtagtgaagttactcccattttataggtgaggagacagttgcagagcataagtaccttcccaaatgacacaattaggaagtggtagagtcaggattcagggtccagtccttactcctgatgttgggctctgtttgttgagtgagtgagatttttgtgaggctaagtttggaagcctatctgaaagtggtgactgaagtgttgccataatgtgaacttggaattcaggctttgtaaaaatactagactctaggggaaaatatgagtgatggaaattgaaatgatgatctctattgtgcttatggtaaagcaaagactgatagaagctttaggaattactttagcaataaaaataaatgattatttttatgcttggatattatttctactgaaataaatactaaattcatagcctctagttgagtcaagagacccgtgtcattaggtaaggtgaagtagggagcaagttttggagaatgtattagaaaaatccattgtataaaactttgtaaatctgataacctgtaggttgagaattgaagagagtgagtcatcttgttagaggatatgatctgagggaagactctagaattctccttaagtgaaatgcacagccaattttaacatctggtttagctcttcagaattttcatttctgtgattgtgtgtagttgaggctttatctattacatgattattacagaataaactctgttagctttcctggagattctattgtttctctatgaatttgccttcactctgttgaaattgcattgccagacttcccaggacagtctagaaaaccagcttgagcccacctctctagttaataggtgagaaatgtttccctctactggatgaaaaacacctagatcctggttagaagatttaaatgtatgttttgtttgaggatgaaatgtttatatagagtacaaatggaagtaaaagagtaattgcaatttgaccccaaaaaagctacgtggcgctcccatctggctgttcctgtactgaagttctcagtaagtttctactttaaaacagattgttctaggaaagaaggttgttctaagagcagagttattcttttaaggtggctttatatattaaatattttccattttatctttttctgttctgtagggtaaataagtattagtatttgtttaggaagaaattaggtagcagaagtaacctatcccaaggtcacagaagctggcagatccttttgagctctggtcctttgtttctaaatgttttgtttatttgacctacctccccagctagttatttctgtggggaagcaccctcagttttggccgctgggcttctagacaggcccacagctaattgccctgtagagtagctgggtactgtgcttgtacagtgaaagatgacaatgcttttacaaataggtaatcagaaatggattctgttgaatgtatttgcatatatgatagtttaaaaggggatgaagagatgaggtcttagctcctaagaatcattctgtagggaaaggttggacaagggatcaatggaaagggaaataaagtaagggaaaagtgcggtcgggtattctggggttcagatccaatgtgagtcatttggagttggatgtgggtgactgggagaggagggaccaggcgtcccaaatagagcaagacttggggctgtgatagatttggctgcagcttagggatagcatagaatcagtaatagttgaaaaatttgcaacacttcaaatgtaaggttgagaagttgctacgcaagaacaaagttttgttttgaacttagttttgaacaaagaacattgagatagtagatgtgttcaagcttgagagtgatctggcagcaaaataggtttagactgctaaggggagaagtagaatgacttgatcctgtgtgaaatccagacatagttgcaagagaggcattaacaaatcagtctgaaggactaaccactacaggccaggcaggtggctcatgcctgtcatcccagcactttgggaggcggaggtgggcagatcacctgaagtcaagtgtttgagaccagcctggccaacatggcgaaaccctgtctctaccaaaaatacaaaatacaaaaagcagccgggcgtggtggcatgtgcctgtaatcccagctactcaggaggctgaggcatgagaatcccttgaacctgggaggtggaggctgcagtgagccgagatcatgccattgcactccagcctgggcaacagagcaagaccctgcctgcaaaaaaaaaaaaaaaaacaacaaaaaaaaccactactcttccataggacttgctgccctaattagcttttaagctctatgagccaggggctgtcttctacagatggtctgctataatgctgaatatatattcctgaaaaatcttgagctgtacaaaatcatgcagtaaagctttggtgggaaaggtcaagtctgaaaacctaaaaccagagctccgatgagcaacaatactaattcaaaatattactagagttaaatctcaactagcatttttatacttagaatcaacagtcagtccacccttttcacacatactctggggctcatagttcttcagagttaagtccttgaaggtatttctttcaaatggagaccactttcatcaaaaataagtactatccaaaggtagccttttttttttttttttttttgagacagagtctcgctctgtcctccaggctggagtgcagtggcgcgatgtcagcttactgcaagctccgccttccaggttcacgccattctcaagtagctgggactacaggcagccgccaccatacctggctaattttttgtatttttagtagagaaggggtttcactgtgttagccaggatggtcttgatctcctgaccttgtgatttacccacctcagcctcccaaagtgctgggattacaggcatgagccactgcacccggcttggaagccttttttaaacacagggaagtgtcaccaacttcttcatctgtgcctccagctctcccagaaggtttcccgtcattaaaccaggcattaacgtagaatttgcattggattttttttttttttcttagggtcttggtatagctcaagcttttctctaattgaaaaaaagcttataccccgtcactttaaaacattgacctgctaggtaaaaaatccatggtcaacctgatttacaacattattgataatacttatctaccaatcccatataagttggagctaaacatagtttagaagaaagaactgttatttctggtctactctgcctctggtccaaaaagaagtactaattttcttaatagtaggtagctgtttagcatgtatcaaaccattttcataacctatgttcttttaaaatgtctatgtgcatagtgggtgtttctaataacacggctggcctaattttggctaaattttggttaagtgtagtagaattaggttaacgtagtttcaaccattcatgataccctgatttatgataatttggaaagaaagaatagcaacctcgaaacagtttctgagtaggccaggtgcagtggctcacgcctgtaatcccagccctttgggaggccaaggtgggtggatcacctgaggtcaggggttcaagaccagcctgggcaacatggcaaaacctcgtctctactaaaaatacaataattagccaggcgtggtggtgtgtgcctgtagtgctggctactccggaggctgaggtaggagaatcccttgaacccaggaggcggggctttcagtgagctgagattgcgccactgcactccagcctgggcgacagagcgagacagcgtctcagaaacagcaacaacaacaaacagtttctgaatagctacaattttcataataaacctcttcattcttaggggtcacttgaggttctctggatggctcctccgctccccttcccgggaacagaagtggtatctatagtggttggagttcctagagccaagccatgacaattgcatctttaagggtaaaagctgaaacacaaatgggaattcgaggcccaaggacctacagcctctgaaggcataaatgcattacatagcccttgaacagcacccttttatacatcaccagcgaggaggacccgtcaggtgataaagggtatagattctataaaatagatcaggggtgcccaagcttttttttttttctcgctctgtcaccaggctggagtgcagtggtgcaatctcagctcactgcaaactctgcctcctggattcaagcgattctcctgcctcagcctcccgagtagctgagactacaggcgtgtgctaccacgcccagctaattttttgtatttttagtagagacggcgtttcactatgttggccaggatggtcttgatctcctgacctcgtgatctgcccacctcagcctctcaaagtgctgggattacaggcgtgagccaccgtgcctggcctggggtgtccgatcttttagcttcactgggcctcattggaagaattgtcttgggccacacataaaatacactaacattaatgatagctggtaagctaaaaaagtaataattgcaaaaatattttataatattttaagaaagtttacaaatttgtgtttggctgcattcaaaaccatcttggactgcatgcagtccacgggccacaggttgagcaggcttgcaatagatcattctaattcatagacttttatccaataagatttagggttggtttcctgttgactactgtcaatacactattcttttttttttaagagtctcactctgtcacccaggctggagtgcagaggcgtgacctcagctcactgcaacctccgcctcccaggttcaagccattctcctgcctcagccttccaagtagctgggattacaggcacatgccatcacgcctggctaatttttgtatttttagttgaattttgtatttaaattttagttaagttttgtatttttagtcaccatgttggccaagctggtctcttactcctgacctcggcctcccaaagtgctgggattacaggcgtgagccaccatggccggccaatacactattcttaaagtgataaatgcttttctccaaatgcttaaaaccttaggtatctaggaaaagacaaaataactcttcagcagtgccaggtgagtggtgtttttttctggtaattatctaatacatgggaagagggagtaagatttagtagagtagtaggaagaaagaatgcttatgcgaagataggttgaatagagtaggaagagatgtcttcacttttcaccacactaatagcgttggctttggggtctgagtgtgctccaggtctggctctgcaacctggtagaatgagtagcctccttttcgtaaatctttcatatagtcacagctctgatttatctggaaggttgaatgcatcttccttcatctctgtcatcgctaatgtaacagaccagtatcttgatggatacagaaaatctagtctactcagagaagggaatttcaaacctatgaatgaccatgtgtggctctgtcaactgttggtgtgtctttgtagaatgagcttttataacccatctttagagcattaattagcatgctaactatactagtagctttgggggtgtgatagaaatgtgtagatggctgttgtgtgcgtttagagtgagtgttgaagaataatgcattgtgatagggttctagagattgagattcttccacttttgtaggaggggcttaggagcagctgcctattatttgaaatcaatattattgcaagaaaagcaaccattatggttatgttgctatgattcagcaaatggcgcccccaaaacaagccaaaaaaaaaccttacaataaattgtgctgaaatttgattttagatttctgcatgtatagattttatatatatatatatagtaaatctttttatatatatatatatatatatatatatatacataattttttttttctttttgagatagaatctcacttctgttagccaggctggagtgcagtggcacaatcatggctcactgcagccttgacttcccaggctcagatgattctcccacctcagccccccgagtagcttggactacaggtacatgccaccatgcctggctaatttattgagttttttgtagagacagggtcttcctatgttgcctaggctggtcttgagctcctagactcagtccgcctgccttggcttcccaaagcaccgggattacgggtgtgagccattgtgcctggcctatagaagatattaatagttcaggctgggcacagtggctcacacctgtaatctcagcactttgggaggccgaggtgggtggatcatttgaggtcaggagttcaaaaccagcctggccaacatggtgaaactcagtctccactaaaaatacaaaaaaaatgagccgagcatggtggtgtgtacctgtaatcccagctactcaggaggcttacgcacgagaattgcttgaacccaggaggcaaaggttgcagtgagccgagatcacgccattgcactccaacctgggtgacagagtgagaccctgtttcaaaaaaaaaaaagaagctattaatagttgagttttcccacagagttttagtagaaaagatataatgaagctgaaaaatgtgagtatgtaactagtaaaaacacggactgctcagaactagtatctccaaaatttatgtaagaaacaaaatttccattattgactatactagatattttcatcattctcaaatttttgtggaacacttaaaatttgtattagcagatatgtcaaatcttttgtctaggttggaaaactcttaactggaagaacatagctaaatctttgataatgaaagtacaccttcttattaattttggcctctggaaaacaatactgaatgaactctgatttttttttattattattatttttgagacagtctcactgtgttgcccaggctggaatgcagttgcgctatctcagctcactgcaaaccgcctcctggattcaagtgattctcctgcctcagcctcccgagtagctgggattacaggcgtgcaccaccatgcccagctactttttatgtttttggtagagatgaggtttcaccatgttggccaggctggtcttgaactcctgacctcaagtgatcctcctgcctcggcctcccaaagtgctgggattacaggtatgagccactgcacccggctagactgttttatttgcatgctctttacaaaacgtgttttttcaagctgaattgctttagtagttccataaaaatgtagtccagaaaaatctacattgatgattttcattttcaacagattccaagtgaattcaacagaaaagctgtaattcttgagttcctgatagttctggagtgacagtactccactacggtgcaactcctcaccaccatccccagtttctcttttataatctcaggctttttaacttggtgaaatgtttttctggaaagagaaatggtcatatagcactgaacaatagagcaggtgtggcggttcttaggaaacactgagttatgttttcatcttaatctcaaccccttgcctaaaaagttgttagtgtcctctgttgtctgcctaattaaaatataaacatgctccaatgtgataccaactttttttcatctgtactggtctagatctagtgctggggaccgcttccaagtgcatgacagaccccaggtgatcacaggatggcctagctatcacactagttggccttaagttaaaagacttttcactgttattggggttgggggcaggcaggggactgttttaattgtccttctctctactaatgctgttcatatttttccaccctggcagacatacgccatcatccagtctattctcttatctggagtgtatccctcagttcttgctcactcttagtcactgccttctccccaccaccacccccccagatgtggccttgccctcatttgaacactcaaatgaactattcaagatgagtaggcaagtacttaatgaaacagacagactttcaaatctgtcaccatgacatctgtgtgagacctcttttcataagctagttgtttagatggccagtcatttctatatcacagatattaagtacccatttaaagcgatcattttatggaaagataatttgaagttattggtctgaccaaatttattcttcctgagatgtcaagggactcttggatgataagttactggattaggctaaatcgtttgtccacaatttataatgatatagatttatatagatgtatgtgttcttgcagtttttagacacaaaatattgagcattctatgtgactgtattccaaccccacctccaagaatataagctctttgagggaaagatgtatattcagtatcttttcatcacatacaattcttgttgagtatcacacaattagtagataaggaacaaaatcagcaacttctttctccacagtgcttctctttaaggtggagaacttgtgctgaattgtcactttttgacaggagtcagtctgttctctgtccttctagaggctgaagattgtaaagacaaaagtgaatggatttagtttggataccatgtgcatgatgcttctttcctgctagcccattttcatgattctgattttctttcgaaaagcattttaaagtggtaaggttttgcatgaaaatttaagtggataaataactaacagttacatattttacctgttctgaaaaggatataccattaattggctgtagatgtccaatatgtgacccttgagatgagcacttgaaatatgactggactaaggaattgaattttaaattttatttaatcttaaatttagccatatgatgctagtggtgactgtgttagctgtagaccctcaaaagcatgaaaggttcaaaagtagcagagtttaggacagactggaattaattggcagatcaagggcccagaggagcccaattctatctgcaggtttgtcaatttagatgagtagacaagtgcttaatgaaacatgctggattttaaaactaccatcaccaaaagttggatattagcacatctgccttaagctagtagtttagatgtgaatcatttctggaccatagataattactcatttaaatttatcggccttttttttgaaagatacatttggctgggtgtggtggctcatgcctgtaatcccagcagtttgagaggctgaggcgggcagatcacctgaggtctggagttcaagaccagcctgaccagcatggagaaaccccgtctctactaaaaatacaaaattagctgggcgtggtggcgcatgtctgtaatcccagctacttgggaggctgaggcaggagaatcgcttgaaccggggaggcggaggttgcagtgagccgagattcttatatcataaattactggattgtgctaaatcacttatcaaatttatatactattttcatgaggctttctaaaaagtaatttatgaaagagagatgttgagacacaagggttccatattactcatttttggaagaaaagtttagtcatgctgatgtcttgtagatgcaggattggttttaaatctgaagcatagaccgggcgcggtggctgacacctgtaaccccagcactttgggaggccgaggcaggtggatcacgaggtcaggagttcaagaccagcctggccaagatggtgaaaccccatctctactaaaagtaccaaaatgagctgggcatggtggtgggagcctgtaatcccagctactcgggaggctgagggagggaattgcttgaaccaaggaggcggaggttgcagtgagccgagattgcaccactagactcaagtctgaatgacagagcgagactctgtctcaaaaaaaaaaaaatctgaagcataaaatgtttcttcagaaaagcagacacatcttatactaatggtttttcaacattattaatctcctgtaatttagctctgtcttggagaactggaaacatcatagtcaatgacctagatacatgagactttgcatttcatttattcaggactgcaacattttgaatatggatgattttgaactccctatttactatttactaagtgatgatgtacttttcaggcggctagccacctgcgttatgtcccattattaacgtaatccaggaagttgcttagagagcatagaattgtgtaacaagaatttcatctaggcaatagaaaccagtttattcctaacccaaacctagtgaccagaaaaagaggcctgtaactctgcagtccggaccagtagttgctgtttacttttccagtgatgcgagacaaactcttaacatttttatttaacttaaaaactaacattcacttgccagtcttgatagagggccagtgcctttggttgccatagatcctctgtaagcctccaattttgaataaaatacaaaggttttgaaatctgatttgtagtttctctgttgaaagtagaatttgaacttagagacccttgcatgcacttttggatttttaattttctttttctaattttctataaagtctcatctgggtataatttgataatgtaataaccccccctccctttttttgagacagtctcattctgtcgcccaggctggagtgcagtggcatgatcacagctcactgtaacctcgacctcctgggctcaggtgatcccttccaccacagcctcctgagtagctggtattatgggcacatgtcaccatgcatggctgatttctgtatttttttgtagagggagttttgctgtgttgcccaggctgttctcacacctgcccgccttggcctcccaaagtgctgggatgggattacaggcgtgagccaccatgcctggcctggaatgctgcttttctaagaggaggttctatgcctaaatagatactctcttttaactcagcattttgggggcttgagagaagggtgggagttgctgaattgtcagcttgaaactttccagtttggaaaagttcctggtaacttagtcaaatgagagaggactcctgtgctggctgagaactcttaaaggccagcagctcctggcagcagggagggagcagggcagatagaagtgctggcatgcatttaaaagaaaaaaaaatcagtcatggctcttgcctgtaatcccagttgggaggccaaggtgagaagatcacttgagcccatggttttgagacctgtctaggcaacatggcaagaccccacctctacaaaataatacgaaaatcagactgggcatggtggcttactcctgtaatcccagcactttgggaggccaaggcaggcagatcacttgaagtcaggagtttgagatcagtctggccaacgtggcgaaaccccatctctactcaaaatacaaaaattagctggtcttggtgggaggtgcctgtaatcccagctactttggaggctgaggtgggagaatcacttgaacccgggaggcagaggttgctgtgagccaagaccatgccactgccctccagcctggatgataggacgagactccatttcaaaaaaaaaaaaaagtacaaaaattagccaggcctggtggtgggtgcctgtactcccaactgctcgggaagctggagtgagaggatcacttgagcccgggaagtgaaggctgcagtcagcagagattgtgtcactgcactccaacgtggatgtccaagtgagaccctgtcttagttatcatcatcatctctatgcacactgggaattaaacttcgtgataaaccctatgtgttttcgagggagaactgtttaaatttacttgaaggtagtatactaagataattttgtggacacttttgttcaaattgacttatttatttttattttttatttttttgagacagagtctcactccattgcccaggctgaagtgcagtggtgcagtctcggctcactgcaaccttcgcttcctgaattcaagcaattcttgtgcctcagcctcctgagtagctgggactacaggaatgtgctaccacacccagctaatttttgtatttttagtagagatagggtttcaccatgttggccaggttggtcttgaacccctgacctcagatgtccacccacttcagcctcccaaagtgctgggattataggcatgagccaccacgctcaccttgagttgattttaacttaagtgaagttcaacctaagctagcccacaaatattcctttgtttcccccccccccttttttttttcctttttttgagacagaatctagctctgttgcccaggctggagtgtagtggcatgatctcggctcactgcaacctccgcctcccaggttcaagtgattctcctgccacagcctcctaagtagctgggattacaggtgccttccaccacgcccggctaattttttgtatttttagtagagatggggtttcaccatgttggccaggctggtcttgaactcctgacctcaggtgatctgcccacctcagcctcccaaagtgctaggattacaggcatgagccactgcgcccggccagatattcatttaaaagatgggtatgtaatacctgttacctgttaaataaaatctaggatacttgtctaaggtaatagggtatttttgtaacaatttgtagatttcagtcttttttttttttttttttcccccgagatggagtcttgctctgttgcccaggctggagtgcagtggtgcaatctctgctcactgctcactgcaacctccgcctcccaggttcaagtgattctcatgcctcagtctcccgattagctgggattacaggcatgcaccaccacacctggctaatttttgtatttttagtaaagacggggtttcaccatgttttgtccaggctggtgtggaactcctgacctcaggtgatctgcccacctcagcctcccaaagtgctaggattacaggcatgagccactgcgcccggccagatattcatttaaaagatgggtatgtaatacctgttacctgttaaataaaatctaggatacttgtctaaggtaatagggtatttttgtaacaatttgtagatttcagtcttttttttttttttttttccccgagatggagtcttgctctgttgcccaggctggagtgcagtggtgcaatctctgctcactgctcactgcaacctccgcctcccaggttcaagtgattctcatgcctcagtctcccgattagctgggattacaggcatgcaccaccacacctggctaatttttgtatttttagtaaagacggggtttcaccatgttttgtccaggctggtgtggaactcctgacctcaggtgatcgcccacctcggcctcctaaagtgctgggattatagatgtgagccaccacgcccggccacatttcaatcttaatgctattcttggtaaggggtccatagacttccaaattaagggccagacaaacattttaagttttgagggccacacagtctctgtcacaactgctttgactctgctgttgcatcattaaaacaaccagacaatatgtaaaaatgagtaagtgactcgattctaataattccatctgtggacactgaaatttgaatttcacataattttaaaatgtaaaaatacttctggctcacagactgtacaggtggtgagctgcagactgccagtcctgttctagatcataaatgatagctgcctgttagaagaatgaagtgacttttgcctatgtatgcaggtttaaaatgtgaaggatgcttcttgccacctaatcataacagtaacaagcactctgtatcaagaatcgtctttatgtgcatttccctatttctttctcacacatctgttatcttcttagtattcttattttttaggtgaggaaacaaggtaacctacctatggtcatttccttaaatttggaatattccataactaaataaacttatgtgaccatagacctcagtgcatacaactctggctaataagccaagtttctgttttttgtttttttgagatggagtctctgtcacccatgctggagtatggtggcacgatctcagttcattgcaacctccacctcctgggttcaagcgattctcctgcttcagcctcccaagtagctgggactataggcgcccgccaccatgcctggctaatttttttagtagagacggggtttggggtttcaccatgttagccaggatgatctcgatctcctgacctcttgatccgcccgcctcggcctcccagagtgctgggattacaggcgtgagccaccgcgcccagccaagtttctgtttttatcctttgttattatccaataatttgagagttttaccaccagtagtttatttcattagataaggtgatttggtagtgtgaccatgttaatgttaattctgatttcagaaagatggtgtttaacaaaggttgtcaattgcatttttgtggtgtaatgcgtaccccctaattttaattaaattttaaaatattttaatctagaatagagttataaccttgcagaggtttgagaatgttgtttatatacgaagtgcttctcaggctggaagtatacagttatggttcaccttacaggtgctgctggtgagtagcagccggtacccagaccagtggattgtcccaggaggaggaatggaacccgaggaggaacctggcggtgctgccgtgagggaagtttatgaggaggtgagatgttctttcacacaaattctgtttcggagttttaaaaacaaggccctttgctacataacactaagacagcgagacgggtccaggagtgctttttgcctgatgcaactttatttttaattttaatttttttttttattttttgagatggagtctcgctctgttgccaggcctggagtacagtggagcgatcttggctcactgccacctccgcctcccaggttcaagtgattctccagcttcagcctcccgagtagctgggattacaggcacgtgccaccgcgtctggctaatttttgtatttttagtagagacagggtttcaccatgttggccagactggtctcaaacccctgacctcaggtgatccgccagcctcagcctcccaaagtgctgggattacaggcgtgagccactacacctggccttaatttttgtatttttagtagggacagggtttcaccatgttggccaggctggtctcgaactcctgacctcaagtgatccttctgcctcggcctcccaaagtgctgggattacagacatgagccacagcgcccagccagaaatactaatttttgatcagtccttgccgctgatgaagtaaatgacaataaaaacttcacagaagcaggaagatagtgagttggtatggggaggggtattgtatttaattagatttaagtaaatagccagagtgtaacttgtatttatatacattttgttataaaaaggtaaacattttatatttcatctttttttaataggctggagtcaaaggaaaactaggcagacttctgggcatatttgaggtgagttaaaaagtaatcttcactttgctgataatagaattaatgatttcttcctaaccaaccaaataatgtggcagcagcctgaaccagacatttctctcagactagcagtaggcagtcagtccaggattaggtagggagggaagtaaaagccactttttcatatgccaccacttttatttatttatttttaattaattttttttaagacagagtctcgctctgtcgccaggctggagttcagtggtgcaatcttggcttactacaacctctgcctcccagattcaagcaattctcctgcctcgtcctcccaagtagttgggactacaggcacgcgccaccacgcccagctaagttttgtatttttaatagagatggggtttcaccatgttggccaggatggtctccatctcttgacctagtgatccgcccacctcggcctcccaaagtgctgggattacaggcgtgagccactgtgcccggctgccatcacttttatatagcattattatggtagtgattacttctgtttgaaaatacagtggagctgatactgaaatgtttatcttaatccactgtagactgtttagggtatagatcttttaggaggtacaatatttttagtatgacctaagagcttaggtctcatgtgttttatctggaaatgtccccattgcccttagcaaatattatatgatacacctagtgacttaaaggattgtacgaagatataaatctcaggtacatagaacagatgctaaaagaatagaattctctttcatatattctcttattactgaaggcagaatagaattttcagggagggaatttgaatgtgataggcagtctctggaagccagggagaaaggaggtccagatgtatcttcatccaagattcagacctagatacacagtataccagaaacatggtcactttccttttttcagggtgctgtttataggttagtacagcctttatagtagaaccatataaattttatttttaagccttaggaattcagaaaaaatcccgattttgtagcacttggtagaattgatgatgacttttaccggaatacagtaattaagagtaaagttggccgggcgtggtggctcatgcctgtaatcccagaactttgggttggccaaggcaggaggatcactaggtcaggaattcaagaccagcttggccaatatggtgaaaccctgtctctactaaaaatacaaaaattagccgggcatggtgacgcacgcctgtagtcccagctacttgggaggctgaggcagaatggcttgaacccgggaggtggaggttgcagagcggcactccatctcaaaaaacaaagagaaaagtcgttcaagtagaattcagtcttttccagaattcagcagttgcttcacccagttaaatagcaccatctcctggttaaactgaaaaacatactgaggtttttacaaataacacatttgtcaatatgctgacaaggtgtttgaagaaaatgtctcacattataaataaagcttaaataatatgggaaggtaacagtattaagtgctttacaaatactgtttaacagcacacgtcaatcaaaaaatacctttccccttagaaaatataagggaaaattggattgccctgcccattcatcccagtgatttttgtgaatttgtgaatatagcataataaatgtactgatttgtgagacatagaaataaaacaactgattcttaaaaataatgaatgatgtgttaattgacagttgcctctaatttattgttgtttttattccttctcagatataaaaagataatccttcccagctgtaaaaacccactgttttgagtagatttttcaggttgtttgtggccaaaatcaggacaattatctaaagtcgtggactatggcaaagaaggctaactttaatcaggatgaaggaaggccaacttgtttaatttttaacccagaaacaagctcagttgcctgttttatttaatttatgttttttttttttagatggggtatcattctgtcatccaggctttagtgcagtggcatgatctgggctcatcgccacgtccgcctcctgggctcaagcgatccttcacttcagcctcccaagtagctgaattacaggcatacaaccacgcccggctaatattttcgtatttttagtagagacggggtttcaccatgttggacaggctgggctcgaactcctgacctcaagtgatctgcccgccttggcctcccaaagtactgggattacagacgtgagcttctgctccaggccatgggctattctttatgtgcaccttgataggcctgcaggaggagtgcttaaaggaactggtgctgtttgctcttacaaaggtcctaaaggaagcagttttccatgtcattgaaaggttgtcaggattagccccagggaagaggggataggataaaaactatgggaatgcaggtctattattttaataagattgcattcaactcttaagattttctttatgaaaataacatcagataggccaggtaaggtggctcacacctgtaatcccagcactttgggaggccgaggtgggtggatcatgaggtcagggtttaagaccatcctgaccaacatggtgaaaccccgtctgtactaaaaatacaaaaattagccaggcgtggtggcgtgcacctgtaattccagctactcgggaggctgaggcaggagaatcacttgaacctgggaggcagagattgtgggggagctgagatcacgccactgtactcctgggcaacaaagcgagactccctgtctcaaaaaaaaaaaaaaaaaaaaagaaaagaacatcagatatatagaaataagtgtttaaagtttagtactggaggctgggtcctcatacctgtaagctcagtttttgggaaggccaaagcaggaggttcccttgagggcaggagtggaccagcctgggcaacatctccagacttctacaaaaaaagtagtattgagagccaatttcaccaccagtaatgatgaagctctagttctagtcttctgtttaacttttaaatgttttgtcttatataaagtcacttttgtgttggactgtacaactgaatatacttgcctgtgctgggaaatacgctatgctaatcagcagtatgccagactaatttttttcccttggaaaatgtgtccatggctagctcctgtagattaaaatgcatttctttttatattcaagcagaaccaagaccgaaagcacagaacatatgtttatgttctaacagtcactgaaatattagaagattgggaagattctgttaatattggtaagttcccttttgttatctgaatactctgttctaacagaagattgggaagattctgttaatataggtaagttcccttttgttatctgaatactctttgcttatattcctgtgtccagtttccatcctagatttttttttttttggtcacttttcatttagagcagggaagataattcaaatgtagagatgcatattcatcttaattattccccaacatattgttgtctaagtcatttatcggggagtaagtggacattacttatatggcttactttttaaaatggactgtcttgtaaccaatgtcattcttttctctaggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgtattcatggaatttgatttagcatgctcagttgccagttcccattatcgatactctttctttgcagaataccttagaaccgttatttccctcagtgtagattgctcttaaaatgtattcagttatttagtggcccccacaggagtggagtcttgaaatctaattctaaatgccagtcagtgatgatcgcatcacagttgagtgaaatggccttcctgttcagctgttagagactgaagattgttagggcaccttagaatgtctcatcttttctaggttgtcaacaggtactatttgtcacataactaactttcgaggcactggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttgagactcgctttgtcacccaggctggagtgcaatggcacaatctcaactcaccgcaacctccgcctcccgggttcaagcgattctcctgcctcagcctcccgagtagttgggattacaggcgcctgcctccatgcctggctaattttgtatttttagtagagacagggtttcttcatgttggtcaggctggtctcaaactcctaacctcgtgatccgcctgcctcgacctcccaaagtgctgggattacaggcatgagccaccatgcccagccaaagatcatttttttatatagacttcagccctttgtaaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttttatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgattttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgatcatggctttaaaaaaaaaacaaaaacacacacacatgaactcagatttgcaaaccaggtttctgaaactttgggtaaggtgtatgcttttaactttgaaatgtataaacacccagcggaaacgtatacctttcagtgcatagtgcattgtgtgcttaccctgggttgtttaaacttgtgttcaaatattccccctccaagtgaaagcctgtcgggaattccacagtaacacctttactgttctcccattgatgatcatatacgttacctcttcctagcggtacatttgtatgatccttactactggaattaccgggttaaaaggaaatgcttaccactaagatgtcagtattctcctcatggatattttcagtctcaatgttgccagtctaatagtatagtatgtggttgctttactgctgttctccccacccccgtggagttgtgtcattattttaatgaatgtgagctcttgacttactctagaattctaatacagatactttctgcactagtatcacttttattattgcagttccatttaaaagcataactggctaagtcaccgccccacccgccgcattacatttcctaaaacatactgctgccaaagaccaactgtagaatccttaagtcctgttcaagtgtcacttcattttttattaggggtttcttagttggagggcatgagaaacttggccctttccaatgttgtcttcacattggagtataagaattctctataggactctttaatttttttttttttttggtagagatggggtcttgctgtgttgcccaggctggtctcaaactcctaggcttaagcagtcctccagcctcagccttctcaaagtgctaggatgattggcatgagccacctcgtctggcctgcaggtctttttaagcatttgctgttcaataataagcatcttctttatgcctagtatttgtgataagagcacaaaacaattttctaatctcaaagagcttatattctagtggggtagagataagtgatttatcttggtgtagttttggcttttttgtttgtttttttgagacagcatctcacactgtcgcccaggctggagtgcagtggtgcaatctcagcttactgtaacctccgcctgccaggttcaagcgattctcctgcctcatcctcccgaggagctgggatcacaggcgcctgccaccacgcccggctaatttttttgtatttttagtagagacggggtttcaccatattggccaggctggtctcaaactcctgacctcgtgatccgcctgcctcggcctccctaagtgctgggattatgggcgtgaaccaccgcacctggcctatcttggtgtttttacatccttcagtatttttcaaggttttacagcttttttatctatagacttataccatcttcaaaagcaatacaattttatttgtagacgtgatttcccccaccaaatgcacattttatggagctctaggacaaaagtcaggatgaaaagtaatctatcgctggtgctactttaataccttcctgactggtgccactggctaaattctagcagtacgatgagagggccattaaggcctatcttagcaagcaagacattatagcaaagacctaaacactcaaaggttcaacgtcttctagccagggaactattctctaattcttccaccttgatatgatttcagcaaattctgataacccggtattactcttaatgcatttttgtaacatttgacaaacatctcccaatatgtagactcccactctcctgatgctaatcagtatcagacaatggaagtaaattttcctgcttttctcaacttttcctcaaattcatgttagtgaagtactttcatttggccatcattatttatcaaccttaagaaacatgcctattgacgaagtaaatatactaggaattcaacgtatctacgggaatgtggacaaagacatataccaagacaaggcactagagtgaaaagccattaaaataaaatgctcagcagcaaaggatttgtaatggttaacttgcaatatatccatatggtgtaatattacagtcattagaaatgacatttgcgtaaggatctgagtggaaactgatacagcctgtcggagagctactgagtagtattttatcacagctgcatacataccctttcacccaacagttccactcctgggagtctagtcaacaaatggacaagttgcacaaccaagctatggtcaaatatgtgtgttgtaggatttatgaaactggtaccaatttaatattcaaatgtgattaagtcatggcaatctatttactggatactttgtggttaccaaagagctatgtgctgccacagggagtcctttcaatagtgattgaaaaaggcagaacactactagacagaactacctgttttatgcatgtattggcatacactgaaaaagcttagtcacttaaaatgaggttgtacagattgtagattttgtttttaaacgcctgtatggtttaaaaaatgttttgggaaatagacatgagcagggcagagaactacaacctacaggccaaaccccaccccactgcctgtttgtacggccaacaagtttaaaatttttttaatgttttaggtttttttttttttaaaaaaaatactatgcccatttgtttacaaatcgtctgtgggtgctttctcactacaatggcagaattcagtagttgagacagacctatggtccacaaaggccgaaatatttactgttttaggagaaaaaaacaacatgaattgtaataacttggacttacttggttgctcagtcctgatgtgtcctgttaaaacctaagagaaacagcaccaagttcaatctagtgcaatcagcctatcacatctaagctgcttttgccagatctgatatctactcccgaccttaagccaggagactttgtaaacttactaggttataataaaacttaagaactatcgatatttactaatctacatcatggaactatttcaaaagcagtcatatggtaagatggatcaggagtctttaaaaataaaactgagaaagaaaaatcatgtgatcaattcagtagtagagacagaggttggtatcaagtctatgttcatacacttaccagtgccacccagcagggccatacaagacacatgaaatgagatcagctcaagggtgacaagatgaaactgggagagggccggggagacccgaactcttaatattggattccacacaagaggaaaaattttagtccagctcccagcatggcagctaatggcaagttagtaccataaagccaactcttggaatatacctgacttccacgataaaatggagatgagtgcaggggtgagtgtatagttaagaaaacaaacaatatattactagtccaggtggtagatgacagatttttattatttacacttctctcaaattattacattcagcatgttttgctttttatgttatttaaagtataaaccctcatataattccctaagatgggtggcatgccaagtagctaaatgaaatatcatcccagcccaaaagtacttattcgaatgaaatattacatttttcttaaataaagcaataaattaggtaccctattatcatggtattttcttttttggccagcttttctagataaggttgtattgctactgcaactaacaaaaaagatgtggcagggctgggcacggtggctcacgcctgtaatcccagcactttgggaggccgaggcgggcagatcacgaggtcaggagatggagaccatcctggcccaacatggtgaaaccccgtctctactaaaaatacaaaaaattagccaggtgtggtggcaggtgtctgtagtcccagctcctcaggaggctgaggcaggagaatcgcttgaacgcgggaggcagaacctgcagtgagccaagatcatgccacagcactccagcctaaactacagagctagaaagtggctagagcagccaaaaaaaaaaaaaaaaaaaaaaaaaaaaaaggttcctgaaccattcaacagaaaaatgaggcctattcctatcatttcctcgatccaatttagttccacttaggtcactgtgtttataatgtcttttaggacagatttccttccccattctccatcaaacaaccatagcacctgtgacttttatctgttggtttgtatttaatcttatttttaagtgcttctttgaaattgttttacaagtacattcttggtctagagtaaggttctatatagttggccctccatatccatgggttccacttccgtggattcaaacaaccagacaaaatattccaaaaaacattgtgtctgtagtcaacatgtatatttttgtcattattccttaaacaatagtgtaactatttacatagcacttacattataataggtattataagtaatctaaatattaacataagcgggaggatttgtgtagattgtatgcatatacaacatcattttattccagagacttgagcatctgcgaatttggatatccaaaggaagtcctagaaccagttcccgacaaataccaagagatgactttactttagacctaagatcttgctagacagcctttgagaggatgaaggataactagagcagaagcaaatcgcagcgaagtagactacaacaatcaagtcaaaaaacataaagctcctatcaacacctcaagattttagaaaagcctcttaacgggcaattttcttttaaataaagactgggtcccactatgttagccaggctggtcacaaactcctggactcaagtgatcctcctgccttggcctcctaaagtgctgggattacaggcatgagccactgtgcccggcctgggcagtcgattttcaggaagccacttaatgttcagattcttttcttctctcccaggactttgcagatgctgctgttccctctgcctggagatgttcatctggcctgaatccaaaagtctgtccaagttacttctcttttccatgacagagttacaactatttgtctgtcccccttccccattagagtatatggtccccaaaggaaagccccatgccattcactcaccacctaatcatccccaacaactagtgggcaaacatgaaacacttttgttgaataatgtgtttcctttagcccagggattacaaagtcaaaggcttacaagggggaaggactagcaggtgtgctcggaggggactctagccaactggagagtaactggtgagaagacaatgacatgctcttagggtgtctgctactcagatcctctcagttaagtcccgtgcacaaaggtgggtcaggtctactgttgccagatcttcagatcattcaaaagttacccgaattctggattttcatgcaaatctcccaatttttaaaaatgttggcatcaaattcagaatgttttaaccagccacactgtgtgggccagggaaaacaggcccaaaggccaggtgaagctgcagttttcaactgctgccttggcctctcccagagccccttaagtcctaagaaggctcagtcaacacactggcactcgtttcatcccactggttgagaaagcaagtcttagcaaagtaatgggggagtcttaccaaaactgcaaaggaaaaaaatatgataccatgaaattagaaattcactgcatttgaaatgaaaatgacttatttctgtacttctataactcacaaatttagcagacatcatttagacatttttgtagtgcaacagatttaaatctggaatttcatggtttgtaaatcactatgtgatactagctataaccatgagcaatattacgggcagtaaatgttgatttctatttcgtttcttgaagttttgtgtggttcatttttaaagtgagattcaatttccttagctatagtcaaatgtaccctttaaacagcccaagaattgttataaatgacagctgctatcagttttcaaattttacaatattagggttgttaactatttcattctgaattaagctaacatttgttaccaagcaatgcatttatttggaaggataccagttaccagtcatcaaaagcttttgtatgttgaaaatgtaattttaatagttaattcttcatcttacataggagcacaataaaatacaccacaatctgaagaaactccagaattacgagaataagagtgaagaaaattcaaatgggctacaatatccattaccttaaactgcaagagacaaggttgcaacccgaaggttaacatttatgtatttatgactggctacatttatgacttaaaaataacaagaatcaggaattagatatggagagaggtgggaaagaacagttttgtgaggggaggaattcgtcaataaagaagaaaaattactgaattccaaattaaagaataaaacgagctcccacagcaaatactggagggatgaaagcaagaatcattaactgaggacttgatactctcaaagggataaacctttctgatgacacacaagctagatagttgagatctgctcatcaggtttataaggaagactcacaaatgcctcagcaaatcccaaatgatcagatcagtgtttcttaacacacatgaaaggttacagatgaaattttcagataagaaccaagaaaaatgtcataacccaaattttaggcaaaaatgtggcacaactgtgaaagtcctacatgtcagtcacaactgctatctttgctgtgactttcctgtacagtaatttttaaacattgtggcaagacaccaatgatcatctaatcagacaacacaaacacatttatttcaaattcctagaaggttaaaaaaaggtcagatactgatgctttatgcatgctcagggccagtttataaatactccattcagtactatcttaacacaaatctgcatcagtgaaaagaaactggcaaaatccacctcttgccattcaatttgtcagatggtgaagaccaagaaagaatgttccatcagtttcaattttaaaatacgattgtcaaattgggaaaatgaaataaacacagtaaaataaactgtacaaaggcaaagtagaataacaaaaaatattttactaaaacataagatttacagaagtttccagacaagccatacaaaatggtcacaagctttttttgaaggggggaatctacacttgacagcaatgttattagtgagggctgtgatgtttgtttaatgttcccattttggttccaacaatcaagcttgtccatctacagcgtctaaataaagttagacttggctagagcatattctaaagacctggttagctgcttttaaccaatgcaattagatcaccaaaaaagggggaaaggagcccataaaattaaactacctcccccctcaaaaataaaataaaataaaataaaataaaaacacccacacccctgcagctaacctgacaactaccttcattcacagtgctttatacttaaaccaggatgggggaaatgaataaaagcagggaggggccactgcttttaaacgtttcacaacaatccagatgatacttctagcctctgctcatgctttatgacagtgaatcaggacaagacatagatttgctaatgtgcatttaatcaccaaaggactgaagatgtctgggcttttttattctgtaatgtttctaagactgtgtccattaaatgcaaacaaagaggaggaagtcttggcagaacaggagaagtgatgcacacttgatgatcgtatcaatttaaatattattcatggcatatagcctagtccatgctctagctgtagacagaaacaaacatacgattattattttacttagttcaatatgttactttccaaactataaatggcaaacaaccactattaattatggaaatgtcatgctgtaatctgttaaattcacgcctttttctataaattggatcagggctgaaagattttgtaaatgtccaattaccaaaacactacaataaaattaagaagttctagaaaattcaagaggatgaatcaagttgtccatttctagatacacaattctccccactaattttcttaaaatctgtagcagaagcttcttgactccaaattccgtagccataaacagctgaatactttaatcaaatgggttacaaaaacagttcaagttttccagtattctttacatataactagataaatggtatgcactcagtatttgttaaaccaggtgtagttacaagagactccaagatctttcaattacaggttgtctttatatttggggggtcccatagcaagccattttgttaagacgtatttacatactataagcaggatctcacttattatacttttttctatttcttttccttgccaagagctttagaaaagtttaagtggtaatacaaatttgtaaaagtggaagtggtgtgaaggagaatgaatattagatacctgtttctatggcttgggcttcgttggtcttccactgctccgctacatcatttgctaatggatcatctggattgggagcacttaacaaggcctggatcgatagcagaactgtgcggatctgcagtgctggggaccacttatctatgaaggcaacaggcccagtatgataaagcatgaaaaaaacaggcccagaactgcttcacttccctcccacagacctctctgatctttgtataatgtttacattctaaacatggaatgcttaagagaaaaaggagaaagcttaataatagcatatgctgataaagataacacttacctttcaaaatatctaaacatattcttcccaacttgtctacattaggatgataaattttggtcatgaaacgtactttaggggctgccattgggtattcttctggaaggaatagttcaagtttaaaagtccctccctcaaagggggaatcctgagggccagcaatgaccacatgaaaataacgggcgttgctctcatctggttcggctttgatgccaggaactggttctgccagcaaacgctgggtttcctatgacagaaaaacaaacacatttgtgaaacaaatgtcattttgctagacaccaaaagtaaaattagaaagttcatctcttagaactacgcataatagaacagctccaatctcccaacagatttagcttataaaatgcaaaattcaaaaaaataccatttaaataattacaaccagctgaatgaaactgcaagcgaatactaatgatgttatcatacattttggctacaaatgtctacaaatatgttaataaaattagcttaataaaactgattttttactcaagtaaaataaagtaacattaggattacataagtaaggcaacttgctctaaactcaaccaaaaccaagctatttaaaaagtaaaattagcttttttggtggttttttttggcttgtttgtttgtttttgagacaagatctcactttgtcactcacgctggagtgcagtggcaagatcttggctcactgcagcctcgacctccctgggcccaggtgatcctcccaactcggcctcctgagtagctgggattacaggtgtgcgccaccacacctagctaatttttgtatttttagtagagacggtatcaccctgttggccaggctggtcttgaactcctggcctcaagtgatttgctcgccttggcttcccaaagtgctgagattacaggtatgggccaacacactcggccaaaaattagtttttaaacccactgaaaacctcccctctgaaaaatgtaacggactaaagaaaggagataagaagaggcccaggtacctgaacaggactaaagaaatatatttaacaatgctgattactctaaaattgacaattaacttcagaggaacccttaatactcccaacaatcataccattagttctctttttcatcattctccctctcccctaaataattgtattattattatttctcttctctcttcaaacctccagcatctccatccccatcctcacttgtggctgatgtcctgcttcctatttcatgacaagttagatacttccatcagttcccactgtagcatttggacatttccctgcatctgcacccatacactctggtttttctcctgtatagatgaaatgtcacgtactcttggctagggccaatcggtcttgagcactagatcttactgatctctgaaatgtttgttcttcggtaccataaagaaatagcacttgaacataaatttaatttatttagtaaagccatttttacttcctgcagaaagggtacactcgccaggagttttgccacaagagtatactgaacaaaggagacagggtcatttataacctgacgcgtccaccctactgctgtgtccggtttccactggctggaacgggatctcacattctgtatttgtcctgactggctagcaacttagaactttttaaaagaggtaaaggtagaggggaacaaaggaaggaggaagtaacttgtggaatgctgagaaaggtaaaaacacttttaaataaggaagaggaacaggctatgacctaatgcttgcttggaccagtataagcatgccagggcaaatatttaggctaaattgtgggagctaagaacataaagtatattgatttctttattatggctagcaaatatttaagaatgtttgcacaggtcttcgaataaattttgcttctaagagaagttactatttattcctaattagatggggaggaaagtctttgaagaggaacctctactttgcttgtctccaatttctctcctcctcttctgtcttgaacataccctccaatcaagctgtagttatcgctaacttgtttgttaaggtcaccaatgatttccacaaggttaaatcaaatgtccagtgcttaatctttatcttacctaaatgcgacatcttatccagctggtctccttcctctttgcaaagctttatctaacttcctataaacattctcatggctctcttcctccttgtctggcagcagcttcctttagtttccttgttggtttcttctatctcccaacatcgcaacactgaaatgcactggggctctattctagggcttcctctctgtttatacatttccacagtgatctcatgtaatgcaatgaatttaaatactaaacacactctataagctgaagcctcccctaattcatatctagcccagacctctcccctcatcgtgcctcttgcctctataactacctgcttgatatacactcttgaatgtctaataagcatcccaaacttaacatgacctccctatccccaacctttgctcctcccataaagtcttccccacatcagttactggcaaacccatctttccaaatgatccaccttttccttcatatgccacacacatctagcctgattggcaaattggttttttttatacttcaaattctactcatgattggactgtttctcaccattccactgctacacctctgatccaagcaaccatcagctctgacctggcatactacaacagcctcctaacctgttcttcctgcttctgacctcactacctccctcgcaggtctattatccacagaccctttaaaagtcatagtcctgagccgggtgcggtggctcacgcctgtaatcccagcactttgggaggccgaggcgggtggatcacctcaggtcaggagttcgagaccagcctgatcaacatggagaaatcccatctctactaaaaatacaaaatcagccgggcatggtggcacgtgcctgtaatcccagctactcgggaggctgaggcaggagaatcatttgaagccaggaggcggaggttgcagtgagctgagatcgtgccattgcactccagcctgggtgacagggcgagactccatctcaaaaaaagtctgggcatggtggctcacacctgtaatcccagcattttgggaggccgaggcgggtggatcggctcaggtcaggagttcgagaccagcctgatcaacatggagaaatcccacctctactaaaaatataaaattagctaggcatggtggcgcatgcctgtaatcccagctacttgggaggctgaggcaggagaatcgcttgaaccccggaggtggaggttgcggtgagccccgatcatgccattgctctccagcctaggcaaaagagcgaagctccgtctcaaaaaaaaaaaaaaaaaaaaaaagtcatagtccttgtaatgggcccccaaaagacgctctatatgatgccctcactccacctacctctctgacttatcttcagctgttctctctccatcccctaaccttctctgttccagacaaaaattagcttccttgtagttcttcaacgtgccaggcatccgctcacctcaagggctttgtacttcctcttcctccccaagatatccatatggcttgctccctcagctcctaagatcttcatgttttctcagtgaagccatcataactgaaattgcaaaccccattcaaccctaccctgcacactccctatccccactccctggctttatctccacagcactactaacaaatctcatttctacttattttgttcagaatttaagctccatgagaggatggatttgagtctattttatggactgctatatcctcagcatttggaacactgcctggcacaatagatattcaattaatatttactgaattctgaatctatttgatgttatgaaaagagggaaataaacgatcagaatttcatcgttaacatcattaaggcagggttattttcaaggcaggatgtgcacattatggaaggaaaacaaaaggagccactcaggtatggggaaaaatagtctaacttctacttatatttatttttaaccagaaaaatgttcatatttaaataagcttttaggtatgaaaaacaataaatgagaacattttatttacactgccttcacctaaaaaaaaatacatcataaactgtttcattccacaagctacagggcatacgttaaaaacaacaacaacaaataacttctctctcagcacagtaatatactgaaatagtcataagatgtaaatacaaatcaaatgcttccccaaaatgtgttaattaaacccatggccattttaggtaatgtctctggtattttaagactagttttttgttttgatcatggcgatgtaagagcaagtgagaaactgacatgttctttaggttcaaactaaaacatttttagagtattaaaaagctcaagaggcaataatgaagcctctgaccttgggaagtcctttaacatgtgaccagaacaaaagaggctggtcttcattttttaggaaaaaagttaagatattagggatgaatagcaggagtagaaaaatgagaaaataactggatggtaaaattccttgaattctgggctctcctcacctccatcctttaattttaccccaggtcttcatgtttttagaaagccataaattgggtgactggaaaaaaaagaaagccagggcccaagagtcccaatccaccactcaccagttacacaaagtagtagcagctctgtatctactataaaaagctacagaaaggcctccaaaagcgtatcccaaaatagcttcaaaatcactctcaatacacagtggcagagataggtatggcatttactttctcatcttcagttcaccctcaaaatcagatattctttgtaaagaatgtacatattaagcacatcatgtgacctgatcaagcctagatttaattggaacacattctaaaataagctttcgtgtgtagaaaacattttgaaatagtccttataatatatgctgctctcaagttctaatggactgacacaaaaacatgcataattatttcactaaactgttggtttccctaacaaacccacagcataaactgtgggaggggaaaaaaggaataaaatccaaactaaatgaaacaagtctgaaatggcagcatctgaaaaagtctcaaccacagaaactgatgtcaacttttttcctaaaaaggcaaaaactggctaggaaataaaatctttccggccactattcaacacatgactaactaaaataccttctggttttacactattctttggtggaaagacagagtacagtatgatttctttaagtgaagaagtaaagggctaaaattcctactgtttcacttatctatctttttttttttttttgagacaagtctcgctctcttgcccaggctgcagtgcagtggcacgatcttggctcactgcaacctctgcctcctgggtccaagtgagcacctggctaatttttgtatttttagcagagacagggtttcaccatgttagccaggcaggtctcgaactcctgacttaaagtgatctgcccgcctcagcctcccaaagtgctgggattgtaagcgtgaggcaccacgcccggccttatctatcttttggcacaaataatttacattgcaggtgggatgccatggttcacacctgtaatccctgcactttgggaggctgaggcaggcaggggaatcacttgaggctaggagttccagaccaagctgggcaagcatagtgagaccccatcactaccaaaaaaaaaaaaaaaaaaaagttgacaaatgagatcacataggaaggccatagttgtttacagaaaaacagaataacccttaaatgaattttgtgattctattatgtttaaaagcagtccaaggattgaatcccaaacagaagtgagtttagggccatgcataatagaaagcactgtagactatgttcaggaaattagttaatgtagactatgttcaggaagttagttactaaaatagacaggtaagttggtaaaggaatagggtatggatttaaatgtccacaaaattaagtctaaaggaaggtatctcatcttatagaacgcatacaatagttaatgctacaaatatttttaaaaggaatcaaatatcacatcaaattgatctaattatcaacagatctactgggtcttgaagagcaaaccctagactcacactactgtaaactatactgtagttagtcaattataacaactgacattctgtcaacctatctctattaaccaggactcttatttttaagttgaaaaataatttgtgctcagtacgaagcaatgacaggtcttagatgctcttctgcaaggcaatgattggagtatgtacagtaaaattttggggtaataaacagtattcttagaaaaagtgctaatttgtgtgtgagaaaagttggtccagttagtaactatctatatcccagtgcatcctgtctacagtgattaggttttttagaatattctctgaaacacaaaattgcaatatatgaccagtaatatcaactgtagatcttttagctcatctcaaacaagagctgtctgataactcagtaactgccaatttcattactgaaaaataagtgttaaaaaactgagtgatgcttcaatgatacctactctgtaaactccaacctgtcactacatctttaagcgattctaaaatattaacaaacagggttctggacaaagttgtgtgttatagaaaaaaaatttaaataaagaaaaaaattatgaaaaatttgtaagataaaacaaacgggctccttttttgggatcactaataaagcaagtcaattcttcattatgtacacaactgtaagttacttatgagaatctgcaagttcaccctctatatatataagtgggcatttttatttatcactttttttgtagagatgggtttctctatgttgcccaggctggtctcctgcctcaagcaatcttcccgccctggcctcccaaagcaatgggatgacagacgtgagccaccacacttggcccaataagtgagcatttaaaaaatgttaccaccagcctgggcaacatagcaagaccccatctctgcaaaccaaaaaactaaaaaaattagctgggcatgctggcatatgactatagtcctagcgtacttgggaggttgaggtgggagtactgcctgagcccaggagttcaaggttacagttagctgtgatcataccactgcaccccagcctgggcgatagtgagaccttgtctcttaaaaacaaaacaaaacaaaacaaaaagttaattatcatcaatggacattttcaagtgcataccccttgcttcattttatctgtaagccctgtgaattttactacatgattttgtataacataacattcttagaaacatataatgtctcattatagtaaaactgactgcctattttctagctgggattagaaatagaaccaaagttttgctcaagctccccattacactacttccttacaaatcataaggccacctagagatacactaagataaaaatggctgatgagtacttttctccacagcactgctatccaacagaaatataatacaagccacgtaagtatttaaaaattttctagtagccaaataaaaaagtaaaaagaaacaagtaaaattaattttaatatattttatctaaaaatgtattcaaaatattatttcaacatgaaatcagtatgaaattaatgatgtattttatcttttatcatagccttcaatgcccactgtgcaaattacacttgtagcacatgttaatttaaactagtcatatttcaactactcaacagccacatggaatgattagtggctcccaaattagtctggagagtgaaacacaagacaatcatgttataatgttactgcctggtcattatgaataatttaatttatttcatataataggtaaaattttgtacagaaactttaaagcatcactattttcccctcaaaaaattctatacaaaaagtaatgtcaggccgggcgtggtgtctcatgcctataatcccagcactttgggaggccgaggcgggcagatcacctgaggtcaggagttcgagaccaacatggagaaaccctgtctctactaaaaatataaaattagccaggcctcgtgctgcatgcctgtaatcccagctactcgggaggctgaggcaggagaatcacttgaacctgggagacggaggttgcagtgagccgagatcgtgccactgcacttcagcctgggcaacaagagtgaaactccgtctcaaaaaaaaaaaaaagtaatgtcagaacatttgacatcactaataacagaaatgcatgtaacaacagttgctgtttgctacactcacaagattgtgtttgaaaaaaatttatggcaatttcaaaacacattaaatgaacaaaaattaattcaaacaagctaactgaatgatgaagtaaagagttcactgaggaactattttaatttttacagtacacactaccccctagtggacataagacatcatctacttatttcaccacctttcctttgcaaatgaaaaaactgatgctcttaaaagttactgtacccaagtttgctaagctttttaaacttacattatatgatcactccttgctttggtaaaaccaaaccaaagttagcacctacctaaacacgtccttgaaaaagacctatagattccaacagtaaataaaatgaaaatagcttaagaaaactaataaaagcaaaccaagcaaagctaagacaattttgtattccctttctgctttcacctcttgtgcctatcttgctcctaaccacttagactcccccagataagctaactgggtccatgagaatttcctgaaaatgcctatcctaaagtcaaatggagaataatgattctcaagacacacccctcccttgttctttcttttcccttctactcccacatatttaaatctcaaaatttcttaggtggcagattcagagaaggaaaaacggaagaaaaatctatttctaagattctgcgtaccaaagactaaatctcagagtactttagaccagagtattccttttttgggaaaagctttatttatgggttgataggtaacaaataggtaagtactctctattccacttgaagtaataatgaacagatggggccagatgacttgggctagaaatctctacatcctaattttttccctcaaacctagaccagatcaatatttctgtgaagctcagtgaaaaggaatggagacttgggagctggagggacttctgaaagtcaaagtatatataatctgagatacatcagaatgtatctcaggtctgaattagtctaaaagtttctcccttgtacttccagtttcctgttcattaccacctctccacttactgtaactacgcacaataactgctggtttacttctcagaccctaaactatttgaagagaggaaccccagctagtaaatggtggtaaattctaaataaatgcttgcttggtgaacgaacatctgcaatgcttaggtaccacccagagctgatgaggaatactgtatctgctgtgttcattggtaaattccatctcaggaacagcatttaagattattccaatcactgacaatgacaatggacaaaaatcagaataatcctactaacaaattgtcccaccaagaagaaaaactgttaagctgaattcctttatttcttgtctatcttgcctccccaattcttctgcccactaaacacatcaggttgtattatagtctgtgtatattttcctccccaccagtctgtaagccccataaaagcagggaccacatgcaattatcaagcactgtcccagatatacagagaatcaataaaagaaaatctcgggtaacagttaagaacaaactatgccaaatactgacttaagtgctacatatgtattagctcatttaatcctcatactcattttacaactgagaaacaaagagtaatcgaccaaagctagtgaatgacagagtgaagattcaaatccaagctgctgggctctattcagtctggtttcaggatgtgtttcttaatctttttctttcttttttttttgggggggctggggggacagattctcactctgtcacccaggctggagtgcagtgatacaatctcagctcactgcaagctccacctcccgggttcacaccattctcctgcctcagcctccagagtagctgggactacaggcacccaccacctcgcccagctaaattttttgtatttttagtagagacggagtttcaccgtgttagccaggatggtctcgatctcctgacctcgtgatctgccgggcccggcccatgtttcctaatcttgatggtatacaataaagacaattaactacataagcagtaaatgtctaatgtttggcagggacagtaaacagcacgggagttaaaagggctattttcaacccttcataatcgtgaagtggtgcttcatgaaaaaggtaaatttaagccataatgtcataaatttttttttctttttgaactggtaaccagaaaagtatagtcttattaagataaaaataggaaaaaaactgatttgattgaaaaattggtatatactattttgacttggaattatcagatggtaaaccattttgcctatctttgatagtgcatgagatcaacatgctctaaaatgtttcgtgactttgaaatataaatttacttacaaatgtttactcattgctattttgttcatggcattgtggtattaaataactggaaggaagagtaaaacttcttggcatccagcagtttatttcattgtgagtagtcaaggtcttaaggtacaggaggtgtgagttaggatactattaatatatgaagagcagaaccagattacagggctattatgttcttgtttatttctaaagacatttttaaagttttctggaaagattaaaaacctcgtctccatcttttttccctctttgttttttcaaagatttccaaatattggcatcacagctaaagatggtgtcaactattccttcataaaacactcatgaagttcttggtggtaaaaatgtcctttgaatattcagcactataattagtagactcgtggcagtcaagcatctccattttctatggttcctgatttgatgaatgacataacacttcattgcctgaacttttcttagcaccagctcaaaaaataaaaataagactttagtgatttaaataatgtagctgtctatcttaatgaactctgttatctcaggaatgatttgacagagatgtctcagaatgctgaatgaaaagaaaggacctagcttagtaacacagttcattgggactgctgtgtgccatggtcctcgaggcactattaacaaacctattgcatattttaggttctgggagtgggtatataacttagtaggtgaggtaggaaatgttcttctgtattcatcttgaattaaaattagggaaattttttaaaagcctgttttatgtggtgaacactaaaataataagatttattagcaaaaaccagtgaacttggtttttttctttgatccagcttttatgtaaaaaatgatgtagattgtgggttttttctttcataaaattttacttgtttttttcaagttggtaattcatttcaggcccttatgtgtaattttagtcatttgtctatgttaactattaaacaatgttaaaaattcccccactcattcatatgttcctttagctcccactctttagtataatgttggagctgggagataagaaaattgtaaaaattttaagtaacttgtagaaaaagaaaaacttacccgtggtcacacaaaaggactgcctggaagcatttagggcaaaatgaggttggtagtatgcatccagcacttcttgcgcatcacaagcaaagaaataacccattctggagagaactgcagtagttaccactaagacagcagcagagttctagtggtagcattctgcgcttgacatcaataatcacaccgcacacactgtagaatgtgttgcacacagtgtgagcactgaaatcatcgtgatgtgattctgaagtttgttcctggctccctcttttctttggccctcctgaagaatgtgtgaggtaactaataactcttaatatcatttctgcttaaactagccaaagctggcttctgttggttgctaaaatgaagtctaaactcaataggaaaggaagtgaagaaaaggttaagagttagcagaccaaggcaggagggggttgggggctggtaaatacgttaagaagctaaataactctttgggattaaatgaagtcaaaagaggagagcatacaagtcaaccaatctctttatcaaagaacttctacttaaaaccttttagaggaggagctaatttcacattagacagttaaattcaactaagcagcctggtgtacctagcgtggggagggggaagaggctcaagagttagcacatctgaatttaattccaattttaattgtaccaatgtgatatgtgaccacagacaaatcatttacctctccagccttctaaaatgtcccttgaacatttaaaaggttctctatagcaccaaaattgtctgaatactttattattattagaatgagttgaatcttattgctatatgcttctttctactggaaggtccccttttgtaataacattctttaggcctataattactgttttagtcttccctgctgaaggagaaggatattatgaactgtcatcctggtatttatgccaacgttcaatatctaaataaagagaaaatttgttgctaagggcacctgcttttttcccaagtttttttcacttgctcattaaagaaatacataaaattaatctaaataaaattagccattctcctaataaccaaaatccaattaacattctagaatgttttttgttgttgttgttctgataaagacaaaagcccttaaaaacagtttaatatgtttacattttttcactcctgtgtcactgcagccactttcctcaaggctagttgatttacagacaaatcaatattctttaaaaaccatacggcataaacaggtacttttcctggcctacaagctagtgactatactagtatagctaccatgtatttacttactcgaccctttttcttcaggttacttctggtttcaaatgcagcaatcacaacaaaatttaatgcctgaggactccataataggtaaggcaagacaagaacagatggaagcagagcagttgaacttttcagcgaagcaaacaaaaaaacaagttacatttcgctcagatttgcattctcaatccaattgtaccagtaacacaattttgtataaaatccaaaccatcaggaaagaaaaattaaaacagtctttcacactctgcatactaactctgagataaattaggaaacatgaaagcatgcagatattggagggttgtctcccacacagtaagcatcctctctcagggctaaccataccgcacagcttcaggagaggaccattcgtatgacagtctgcataaatggcgcctcttgaagttatacagtgaaatactttggattaaaaaataaaacttcaatttagcagttgcaaagatcaactttattattacctaacccatggaaaatggattacacatatgataattttaatgaaatcaaaatgttatttacccaaaacatcccattttgctatccactgtcggtaaatgagcattcattgtgctttcacaaaatctatgcctcacttcagagagttatatttaatgttatctattttgtgaaacaaatacataaatgaactttgtttcgtttatgaaacgaacaaaccattttcccacacactaggaagacattcaatctttttatgtttatggtgaagcagcatctttgcaaagtcagaaaacagtaataaccaacactacataaggctcagtattacgttagggtctgttctttacattctaatccttccaattaccatagagctagattagtatattaagcagataaagaagcagagaggtcaaatgaggttgcccaagctaatatttggcagagctagaaatcaaactcaagagtctggcctcagattctttgttcctgccatacataaacatacatttcatattccctaaatcagtgttttgctctagagaattaggaagtaaggctctctgagccataaaacattattttagtcatgaaaagcagcatttctaccatcttgaaagtcaattgtcaattaagaggtcagcaaaagactacagtaggaatgaaccttctgtaagccatcccttacacactttgctaccttactgtctctccaactaaactagttcctagagatcaaggcctgtgtctaacatttgcagacccaatgttggacaccagtgtgtcttgcatttcttactggttaatgaacagatcaactgcagaactacctgagaccaaccccacagagtaaggaaaaccactgactgggttaaaaggaaattcaagaacttccaaaaatagtaggcctagccaagcagtgactgcaaagagcaggagtatgcagaaaaaaagacttgcaagactccaaaccgaatctttacaaactatttcacacgtctgtccaaaagccttagctttgacactattcctacaggtcatacacttaaatggaccaattacgaagcaccagagataccagccttatcacttcttttgcccctctaggcagcttcaacaatctaataagcattttcctcaatttaaaaaagtgatcattgcctcaataatcacgagttgacatattaaagatgattctttcccctacctcaaggttttgggaagaatctgaaatgaaacagcttggttagggactttaatatttcacagattatcaattaggtctgaaatttgaacagtcttaagagatccagctggagtaaataactcagcagattttttactcttctgtgatttcagattatctcgtcctgcactactaagccagaagaggaaatgatccagacaactcagattttaatgtaactgaaataagcacaaacttacacactagggctgatgtattacaatagagtacgatggacaataatactgggtcaaattcatccacttcatgtggacagcttgagtctccgaaagaatgcgacaatacattcaaagaacataaatgctggaatcagttcttgctagcaacacgagccagcaatgttattatgtgaaactgcatccaaaaaaaaaaaaaaaaaagctacaaagtcataaaaatagccctgagaataactaatttgaatagtgtaagtaaacagttttcttgaggaaggaaatcgggtggctggaacacaggtaggagacaccctgcaagtcaaacaagcttaatcaaaacaagagctaaaaaaaccctataaaacccctaatctgacaagtctgaagtcaagccacatactgccacatctcaagggcttcttacccatccctatctatcctgggctgggccaggccaggcagttttctaaaaaatctctgccttaggaaactagtaagtcagatataaagtcaatcaatgtctctcactttccttctacacttttgtgattctggaggtaggactctgccaggggctcctagtttaagtctgcagataagggagtgttaagggaaaactgcgagagacgacagtgctgtctcccctctcatgggtgcatcagcagatttttttttttttaagctcatcggctatcattagtgttagtgtattttatgtgtggcctaagacaattctttttttttttcttttgtcgcccagactggagtgcagtggcacgatctcggctcactgcagcctctgcttcccaggttgaagcaattctcccacctcagcctcccaagtagctgggattacaggcgtgtgccaccacacccagctaatttttgtatttttagtagagacagggtttcaccatgttggccaggctggtctcgagctcctgacctcaagggattggcccgcctcagcctcccaaagggctgggattacaggcgtgagccaccatgcccagccatgagacaattcttattccactgtggcccagggaagccaaaaggttggaaatccctgttctaaagcaatgcaggcttcacatgtgactagttttatgagagccaatacagattacctatctcctaaaaattctaccttgcttcccttcagcactatcactttttaaaaggttttatttagaaaacacttcaggtaaaatatttacaaaggaatgaagtactaatacatgctacaatatacatgaaccttgaaaacatgctaaatgaaagaagccagaaagaaaaggccacatattgtataattccatttatatgaagtgtgtacaataggaaaatccatagaattggaaagcagataaatggttgccaggggttgaaggtagagtgactgctaatgagcacagggtttttctttttggggtgacaaaaatcttctggaattagcaagtgatgatgttgtactactttgtgaatacatgaaaaaaccactaaactgtacactttgagtgggtgaattttatggtatgagaattatacctcaaaaaaataaatgaagcatttgagttttccttcaatattcagtgagattttggaatcttaccgatgaattagagattggaatagtaaaagtaagtgaagggaaaataaatatctattacttgactatttagtatataacatattcacagcatgttaacagagttttcagttttttgagataggatcttgctctgtcgcccaggctagagtatagtgacacaatcttggctcactgccgcctcaacctcccaggctcaagtgatcctcccatttcaccctcccaactagtagctgggactacagacatgtgccaccacacctggctaatttttgtatttttttgtagacatggggcttcttcatgttgcccaggcttttctcaaattcttgggctcaagcaatctacttgcttcagcctcccaaagtgctgggatcacagacatgagccaccgcacccagccaacagaaattttagtaatgaatatatattcatggactacacttctgaagaaaagaaacttcaagttaaaagattacttttgaagctaagtatctgtgatccaagcatagacatgctgactcaagttacacagtcttagttcaaatatctcctgggtctggtatgtcgacattctactcccccttttctacttatgcttcaaaattcagctcaaatatcatcctctaaaaacctttccctaaaccaaccttgagggttttccaggccagtctgtcacttctttggtgttcccattgatgcctttgtattcaatatacaaagcagtgctagctgtatgattttacttttgtctcccattctacccatctttgcattgaagccaagcacacatatgaccagtgtttctgcaaagtgtacactaaaatcataagcagctcttaaaacaacaaaaatatgttgggctggcaatgttaaatttacaaacttccccagataattccaatgtataaccatgaactaagtactcagactagaaacaagtgttcagagaaaatagcccatagattcttgtcttggcatccttgccaatacatcagcagccctgccaattaaactaggagaagaaataggcaaggtctggccaagtacttctctaagcacagtcagtgctggcccctgaacagaacttgcagcacttttagtttaacccttacctgaaccacaacaataaagacagggtcctggacagtgcactttatttgaaaaagtgtaggccaggcgcggtggctcatgcctgtaatcccagcacttttggaggctgaggcgggcggatcacgaggtcaggagttcaagatcagcctgaccaacatggtgaaaccccgtctctactaaaaataccaaaattagctgggtgtggtggtgcacgcctgtagtcccagctactcaggaggctgaggaagtagagctgcttgaacccaggaggcggaggttgcagtgagccaagatcacaccattgcactccagcctgggcgacagagggagactctgtctcaaaaaaaaaaaaagaaagaaagaaaacacaaaactcaacttgatatataaatgaatgcaagataactctaacatatttttagacttactgagaaaaaaaattctcgtttaaaattagtctgattcagtggtactttaaatacagtcatgcgctgtatgagtttcagtcaatgatcaactgcacaaaagacagtggtcccacaacattataatggaactgaaaaattcctattgcctagtatttactatactatacttttattgattattttagagtgtattccttctgcttgttaaaaaaaaaaaaaaaagttgactgtaaaacaggttcaggcaggtccttcaggaggtattccagaaggcactgttgtcacaggagatgacagctccatgtgtgttactgcccctgaagaccttcgagtaggacaagaggagctggaagacagtgatactgctgatcctgaataggcctaatatgtgtgtgtatgtcttagtttttcacaaaaaagtttttttaaaaaagattgtaagagaaaaaagcttataggatataaagaaaatatatttttgcacagctgtatgatgtgtgttttaagctaaatgttaatacaaaaaaatcaaaagtttaaaaatataagtttataaaataaaaaagttacagtaagccaaggcttattattgaagaaacattttaaaaaattttttggtgtagcctaagtgtacaatgcttataaagtctatcgtagtgtacagtaatgtcctagcccttcaaatccactcaccactcactcacccagggcaacttccagtcctgcaagcttccttcatggttaagtgccctatacaggtataccattttttatcttttataccagatttttactgtacctttcctattttgatacacacatacttaccactgcattacaactgcctacagtattaagtacagtaacatattaaacaggtttgtagcctaggatcaacagactatacaacatagcctaggtgtgtagcatgctacactatctaggtttgtataaatatactctatgatgttcacacaatgatgaaattgcctatggtgcatttctcagaaagtaactccatcgttaagtgattcaagactgtatattttgccggtaagaaagagcagcaaagagtcccttctcaccagaaccacaaaattcctcaaatccaggactggctgggtggggagggggaggaaaagaatatgccatccagaccagaggcattccatcttaaagtgaactatgttactaaacagggtctcatgtttgtaggaaagcctctaattaaattacaataaagagacttctgattaaaaaaaaccaagaaaagcggcaggctcagtggctcacgcctgtaatcccaacactgtgggaggctgagacaggaggatcacttgagcccaggagttcaaaaccagcctgagcaacatagggagaccctgtctctatgtaatatatattatatatgtatatatattttatattgtacataatatatattttatatatatataaaaaatttttttaaattagttggggatggtagtgcatgcctgtgatcccagctactcgggatgctgaggctgcagtgagccatgatcatgcctgggcaacacagtgagaccctatcttaaaaaaaaaaacacagccaagcgcagtggctcatgcctgtaatcccagcactttgggaggccaaggcgggcgaatcacaaggtcaggagttcgagaccagcctggccaacatggtgaaaccccgtctctactaaaaatacaaaaattagccgggtgtggtggcgggcacctgtaatcccagctactcggaaggctgaggcaggagaatcgcttgaacctgggaggcagagattgcagtgagccgagatcgtgccattgcactcccagcctgggcaacaagagcaaaactccgtctcaaaaaaagccaaccaaccaaccaaacaaacaaaacacaacccaaaacaagtaagctaagcacttagatcctgttcttaaacatgtttccacttcatgtgtccaaatgatacagtataaaaatacatgcactgccagttattatctaggaatagacatgttcttcagtatccacagtctacagaatcagaccacctgggttcaaatcatagctctagaaactaataagtccctctgtgcaggttcccatagctataaaataggaatgatactaatatccacacatcataaaactgcaattagaattaagtaaattaatgcacgtaacatgcttagaacagtgcctggtacacgatgccaatgaaagatgtctatttttacataataaaaactatatgaccaacctcacttcaggaacagctgccacactgcatgctagtgaatagttcacagactaaatatgaatttcataattagaaacactttgtttgcctaacaattcttgatgccaactctttgaacacagtcattaaacagtaataattatttttgatgagaccctgattctattatccatcacatactatatttctagatgatgccatgctttctgtctctccttccagctttcatatctgctgccccatgtgccaaaaactcactcacactccctccttctcttggcccagcaaactcttactcttcaagtttaaaaacacttcctcggctgggcgcggtggctcctgcctgtaatcccagcactctgggaggctgaggcgggcggatcacgaggtcaggagtttgagaccagcctgaccaacatggtgaaaccctgtctctactaaaaataccaaaattagccgggtgtggtggcgtgcacctgtaatcccagctactcaggaggctgaggcaggagaattgcttgaacccgggaggcagaggttgcagtgagccaagtcacgtcactgcattccagcctgggccacagaaatttgtttcatgactgtgttttccattacacagggatgcctttcttgttcacctggcttactggtaaatgcatattatgcattcaatgaatgtccaattaattgaactgaaaaaaaatctcatgaatggataataaagagacacgcaaatcacaaggttacagaaaactgaaatttggccttgggatcggcctatgttactaaaaccactttgtccctgcctcatagtaagatggtaatctagttgtctttaagagtcacaaaaaaaaaaaaacaaaacaaaacagctacttactaacattttcccgagtataagctataatcttaagaaagttacagagcaataaaaaaatcaccaatggtttcatgatataaatttgttagttctttctagtgtttccttaactacaatgccttcaatccctagaactgtaaagactttcaaaatataaattcatttgcccaaaattaaccaaactgacagagacataatgtgaaggtattgaaaactaaaaaaaaaattgaaaatctaaagacaacatagccagttgttttaatgcaaaatatgtcaaccttagattctgaaaccagtatctaaaattactttaaattacagtagaatcctaattattcagaagcatctcagttactggccaattcaaaaccaaaaatgtctgtgcctaagtactcaagaaattttagaatagcttcattcaggtttttttttttttttgagacggagtcttgctctgttgcccaggctggagtgcagtggggtgatctccgctcactgcaagctctgctgctcccgggttcacaccattctcctgcctcagcctcccgactagctgggactacaggcacccaccaccacgcccagctaatttttttgtatttttagtagagacggggtttcaccatgttagccaggatggtctcgatctcctgaccttgtgatcctcctgcctcggcctcccaaagtgctgggattacaggcgtgagccaccgcgcctggccaggatttttaaaaaatataaaatgcccccaatggtgtcatgtagcccttgaaagaatgaataataatgaagtatttctgttgattctgagggctcttaaccaattatccagttcttccaaccacacagtcatgtttctgccacaaaagaccctagggccatcaatcacttcacttgggaagaaattttaaaagctgctaagattttagctgaagttaaaagattccctattatttaattgcctaattggtatatccacattcattccttcatatattacatttgcaaagaaaatttcaactctaatgaaacaacagtccaactcgtttttcgcatacacacataagaattcttttccttgatataatattattacataaactatgcctctcatatttattttgtttttagaaagcagcactgtataagatacgaatttggcacctaaatcagaactctgattactataattgtaatgtcaaaagcccctgctggatgctgctgtcctcatttccttgtttctagtatttatttctatagcacatatgcatccatagttcattataacagaaaacataatgtgtgttcagaatccatacaacttgaatctgtagcatattttcttcttaaatccatttacacaggtaaactatcctataaggtatagggaaaaaagaagaagaaccgaattgtacatcaggaatctggtcatccaacttctttggcctacaaattcctcaccagagaaagaaaaggatagaacagatgttctctaatgtgtaaaactctggtggctcactcccgtagtcccagcactttaggaggccgaggtgggtggatcacgaggtcaggagattgaaaccatcctggccaacatggtgaaacccgtctctactaaaaataaaaaaaaattagctgggtgtggtggcgcgtgcctgtaattccagctactcgggaggctgaggcaggagaatcgcttgaacctgggaggtggagattgcagttagccgagttcgtgccactgcactccagcctggcgacagagcgagactccgtctcaacaaaaaaaaactctggttttaagagtggtcattaacacgtgtggaaaaaattccaaacttgagcaaagcaaatgcataacatttccagtcacagtcatttagcacagtgaatactaaagtacttgataatttgacaaaacttaatttcacttgtgcaggagttgatcaatctggactaaaggaactgcttgacacagaggagcttaaaaaagaatactgaactgactgctatttttaacttactttcagttatgctcacatttcataatcaaaacattagatagtatattaaaacagtatctttagagcctgaaagtttaatcactatcaaaagcagttcaaggattcttaacatggagcacatggagacctagggaatccacaaataaacttggcaagaatctgaatccccagaagtcatacgttaaaaaaaatagctttttttcctaggaagaggtcagaaaattcttaagtgagacaactgaaagaactaaagaaccactgttcctagtcaaattttttacaagttttttcttaaattccaaaggtgattttaattacaacttataacaaatctgtcttcatcataatgagtttgtatttatttatttatttatttatttatttaagagacagggtcttgcctctattacccaggctggggtgcagtggtgccactaatagctcactgcagccccggcctcctggattcaagggatcttcctgcctcagtcttctgttaggattactgcatgaaccaccatacctggctaagtttccctgcccccacctggaggtacatatatttctgaaacatcatggtaacttttccatgcctttttttaattggaagaaaacattatcagacaagtattttcagagcttaaaacaacagataggacaggcgcggtgactcacacctgtagttccagcactttgggaggccgaggtgggcagatcaccaaaggtcaggagttcgagaccagcctgaccaacatggtgaaaccctgcctctactaaaaatacaaaaatcagctgggcgtggtggcatacacctgtaatcccagctactagggaggctgaggcaggagaattgcttgaacccagggggcagaggttgcagttagccgagatcacgccattgcactccagcctgggcaacaaaagcaaaacttcatctcaaaataagaaaaaaaaaatgttcaaggcagagagtaaagctactccagtggctgaggcaggagaactgcttgaacctgggaggcagaggttgtagtaagccgagattgtgccattgcactccaggctgggcaacaaagcaagactcccgtctcaaataaataaaaggtgagttttctaaatcacttttcttacaaaaaaaaataccttatgcactagaatacctatcaaatgagtggcttttaaacagtaacaggaaaaaatgtgtgtacttcaaaaaatcctattaaaaaagtaaactcaagtctcaatgtaaaatcagactgtatctgatttttaagaatttgaggctaaatcacaccaaatagaagagtaaatttttccactgcacttcagcctgggtgacagagaccctgtttcaaaaaattaattaaatgtattttcttaagtaaatttttaagcaccatagacaagggaccagtggggaagggagacataaagtaaattctgcgaaagactggtaaaattctaattccagcaggttgactcactaggttttaatcaaataagtcaacccctagggtaagttaactactttttcccaagactgtattttatcattttcattattatcattattactattttgagacagggtttcactctgtcgcccaggctggagtgcagtggcgcgatctaggctcactgcagcctcaacttcctgggccaaaccaatcctcccacctgtctcctgagtagctgggactacagatgtgtgccacaacacctggctaattttcattttatctttttgtagagacaaggtctcattatgttgtacagcccagtcttgaaaccttgggctcaggggatcctcccgcctcagcctcccaaagtactgagattataggcatgagccacagtgctcagccctcatgattaattctgaaaagaccattaaaggaatgtcagtcactgtatcaacgtaacatgtaaagctgaaacagatttggttttgaccaaggccataactatagatctcacttatcggttcccgaaagtgattctcctttatgacaggattatgcagaacctctcatttgagggacattttaggtacctcctaacctttatgactttaagctttaactgctcacttttttttttttggtggagatggagatctcactatgttcctcaggctggtctcaactcctggcttcaagcaatccttgggcctcagtctcccaaagagctgttattacaggtgtgaaccaccatgcccagcttcagtcacttttattggctaaaagagctttggtccagaagataaggcagaaaaacgaaactaaagattctagcttaaaacagaactactaagactcaatatcactcacacttgtgcaaaatgccatacatacaaaacttcgttacagcattttttatatagcacaatttaggaaacattctgaaagttatgaataagcaattagttacaataaagtctaggccaggcacggtggttcatgcctgttaaccctagcactttgggaggccgaggtggaagaatcacttgagcctaggagctcgagaacagcctaggcaacatggcaagaccccatctctactgaaaaagtattaaatttccaatatttgaaaaaataaaataaagtctaaccataaggttccattaaacagccctttgagaaaaaaaaaagagccaaagcagaacactatgatgcatgtctgtaatcccagatactggaggctgaaggtagagatcacctgatattaggaattcgaggctgtatgtatatagtgtactatgatcacgcctgtgaaaagccactgcactccagcctgggcaacaaagcagcagtctgtctcttaaaaaaaaaaaaaagtcaacttgaagatacataggtggttagaggggaagagaagggaatcaaggtatttgcatgagaaggagaagacgcctaacttatagcagaaagttgctctggtcttcttgtaaggatacacaataaaaatagtggttgaagtcgggtgcagtggctcacacctgtaatcctagcactttgggaggctgaggcaggtggatcacttgagaagaggagtttgagaccagcatggccaacatggtgaaaccccatctctactaaaaattagccaggtgtggtggcacatgcctgcagtctcagctacttaagagactgaggcaggagaatcacttgaacctgggaggtggagtttgcagtgagccaaaattgcaccactgcactccagcctgggcaacagggggagactccgtctcaacaaacaaacaaacaaacaaaaacagtggttttctaagcaggggaactggaatgctgaaggacagatgagggattctctacgtatccttcagagcctttcaaatgtgctctatgtgtgcatttcctagttaataaaaaaagatacataagcagagtaggcacacaaaaaagaaataatgtaaaagattgatgtcctttttaagtgagcttatgggtggaaaacgagactagctttaacttttagctcagacattggttcagacagaatataccaaggagtaacaatgtcaaattattgctcattgagattaaggctcatctattcagttagtctattaatatttcagtatctactatgtgccaaggattggtctaggcacgaatgagcaatgcccgggatatccaagagtccctaacttcatgaaggtttaatggggaatagagagaaataaacagtaaataacataacttcgaacagtaataagcacttatacagaagaaagggagataggaggataaaattgtgggggaggaaaaagggaaactggtttatacgggacaggttaggtagagggtatgacatatgagctaagaacggaacaactggacaaagcaagcaatgcaacaaactggaggaaagtcctgtgactggaataagctcaaccacttattgttcagggtacagcaaagcaacagtgtggctacagtggagtgacccagagagagaagtgcagatgcgctcagaagtaggcatcccaaatgaatgcagggccttatagctaaggggtgggggggaaggcaagattctaatgtaagtgtgatggagaacctctacagtttttagcaggggagtaacatggtctatattttaagaagataacactagctgctgctccaaagtaggctaatacaggaggccaggcagtaaatgatggaagtgaacagaggtttgaaagacaggggggaaagtgtctgatttagtacatatattgaaagcagaacctacagaatttgctactggattagatacaggaatctaaatgagatagcaactgggtgaatagtagtccagaaaatcatcttgtatttgtagttagtcattttacagtaacaagagacaggggaatgttacactaatcaagatccaaattctgcctcttaccagctttaccttaggaaagtcatttaagtcagtttctagactgcaaaatatattgtctagttcacaaaaatgtctgtaagaatcaaatggttaagaaatctacaaatgtaaatagtgatcattataagttagaaagcatcatattaacagtcatgcaaatcaagccaccttattttaacattttcattagatgagaatgctaacactgatgttatatcaacactaaatttcatcctttgaaagtcaaaggtcaggcggggcacagtggctcacgcctgtgatcccagcactgtgggaggctgaaatgggtggattgtgtgaggtcaagagtttgagaccagcctgggcaacatggcgaaaccccgtccctacaaaaattagctgggtgtggtggcatgcaccttgcagtcccagctattgaagaggcttaagtgggaggatcatctaagaccaggagatcaaggctgtggtaagccatgatcctgccactgcactgcagcctgggagcggagtgagacgagtctcaagaaaagaaaacagaaagaaaagaagaaagtcaaagatcacccagaaataaaacaaattaacagtccaatcaacaaagtcatgtccctattgcctcaggacaataccgttacccccatccaccacacagaagtttgtatagtgattgacagaaaagaggcaacttttaaaaataaattctgattttttttaaagcattgtcactgattatggaacaacctacataacacaagcatggacacttttaaaaatctagtcttttagtcttctgtttaaggattagagaaaaccatccttttaagctataaatgacactaaactagtaagataaaacccaaatcaaggtgtcattcattagatagatgttgtcaacaagataccgtaaaattaagattatatatcacagtatgagttactgtcttagtttcaacagcaaaatgtaaatgcccagtgtaaattactgtgtgccaaatggattgaatcatgaggacttcaacttattgccttaaaccatttctgtaaatttataaacaaggttccacagaatttattttttcatccaaggctttcatattactgggcatatcttcataatcaaaaatagaaaaatgcgtgttaaatgtttagttcactatgtatttcagagaattatcatgaatgtcaacttgcattatgtacttagtcaataacctaagtaacaacgaaaacaaggatatttgatgtatggctctatcactccctattcatttttcaactggggcctcaataaacatgacctttggggaccatgtgactgcattataactaaaaccacgttgtacggacctgccaatacatatgacaattaaaactccttggacagaatcctagataaatccacacacaacaaatttcggactatgaagattcacattattagactccagtgctccctgacaatctgttctacttctctcatttctaagaatttctaccatacaaaaacgtcttatttctctacatcagcacccttaggtcagtgacatctccctcatctcagatatatttaaatgcaattggatgaagcagtatacagtacatcatcctcgaagcctaacaggtcttccacttagtatgcatctccccacagatttcacaagaatgagcaagattaacatacacgttcaccaggttatatcaagcaaaatgatgctgcaattgagtcactttaactggcgcatttagtcacataaatgtgcaactaatttccttcataaaaaccgacacaaaaatttaaggtttagttgttgtgatgacaaggaatatctcacgtctgaagacttgtcgatatttccttaagactttacaaaatcaaagaatcgaaaatgtcatggttccatacatacttgtcaaaacacagtattcataaacagccaattaataattaaaacgcacaaaattgaggggcaaaagatttcacgagatcccccacagaggccaaggtaggaagatctctgaagccaggagttttggaagccgcctgggcactatagcgaggcctcatatctacgaaaaagagaggagaggagagaagaggagagagaaagagaatcccccataactgcggccctcccccagccttgtgttaaaactatttcctcggaacagctctgaaagagtttgccaaccagagtaaaatcacttcgcagagataaacgagcggaaacgtattcagaagagagagatcgcggaagcaagggcagcggggcgcggggcccccacgtcccgggacccaggcagccgcggcaaccaggggcgagcatgtgctgaccgcggcaggacgcgcgggcctcccagagccacttcccggggcgcagggccccgcccggcctgaccctcccggttcattcattctgcacccgcggttgccgcacctccgcggccccgtcggggcggagaagaggggcttggctgccgagggaccttgtcgggccacaatccccaccaggcgcccgagccccgccgcgattcccgcgcgcccgcggcctccggcgggggggtggtctcagaagctatggaggcccgcgcccaagcccagagacccccagccttgccgccccaccctccgccggggcgtgggacagcactccctggcccgccgggcagccgcctggaagccccgggtccccgctgtccggctgccccgccgcggccggaagtctccccggcgccccctcctcagcacccgacttccctcgccgccgcggccaacccctctccgcgccgcctcgggcctcccagagcgggccgcgggccgaaggaggcgagaggccgcgctgcctgcccagctgagccgacgagagcagagcgaagagctggaggccggcctgggcggttaccttgatgatcctgcggggcagcccggccatcttgtcagaacccgagttcggcctctggtctcgtctccggctcctctcgcctcacgcacgagtggaagtcccgggctccacttccgggggacgttgccgcgcccgtcgccgcagccgccgccgaggcccctcgggaaatgtagtccctgctcgggcgcgggctcgggcacgggcgggcttccctccgacctggccccctcccccgtgcgccccgccccaaccgctgccggggatggcggaagtgacgctctgttgcggggcagggacttgggacaggccgcgaggggaggcgcggggctctggcgctcgtggccgagcctgcccgcgacggtggtacggcacgacccgcgcgcgactgcgcgcgcgtctctcttaaccgtggccacgcccgcgccggtggacgacgtaacagaggcctggcctacgacgtatcccattcattcattcacgcgttcgttctttcagctcacgcgttcgttctttcagctcagcctgcattgcgcgcgttccctgctggctctgcagtgaacgactgaggtggggctcatcgtcttgctccttcctcaaagggagggcaagaccgaaactcggtggcaaagctctgactgggggtctctccagttactcacacgctgttgggggagttttgatgtttaaattgtataaatcggacctctgacacgcccctaggcccagggtaggctgaaggaaaagggtttggagcgagttggaggcgggaagaatggttctgaacgcctagacctaaaggttgagactcagaattgttaacaggacgaatgaccaaggagaggtttaaagaacccagagtaatccgtaaagcagagattacctatagagtgcgaggtcctatgagagaattagagtgggggtgcccgaaaattgaattgttggggaagcgttttatcctgatgacggatggtttgctgtgtgatggactgtttgcaagcactttacttcatcttcacagcaatcgtgaggaggtgttgtttccattttacaaatgaggcttagatagttaaccttttccaaggagctgttttgtccccaggcagatccgccaagacctggcccttaactacttaaccacagtgtttcctagcacactaacagacagtagatggtgaataaatgaagacaagactgaccgtgccttccaggaacttagattccaatggagaagagagaccagtaaacaattagttacaatccaatgtgttaagggctgtctgtaatacaggttcctccaaggtgctattttagcagagaggcattaactgcttgagaactcagggaagccttcttaaataagtgaagtcctcaatgatgagtaagaacctacctgaccttgtagggaagagtatgccaagcataggaaatggcctgtgaaatggcattgagctatgagagagaaaaaatagtgcactaaagaaactggaactctgaatacaagaaacctactaagaacaataagaaatattttgtgctggcacgatgctaaatggttaataaatttaatacatcattcaattatgaaacagatgaagtagtctctattattaacagaacgttttagatgagaagccaaggttcagaggtaataatgagaatttcaaataaccagaagtctgcaataggtggttctgtgactagaagaatctgcaaaagtaaatgaaactggacaaagatacttttcagaatattttatagaggacccaggataattcatgctggtaggcagaaaggcagagtgctattgtgttgggagtgtgtaggtctgcagtctgggcagggcttggcaggaaggcacactctgcttgtgctgcatcagcctgtgcaaccagaagattggcttccatgatggttcacaaggcgggcaagttggtgctggctgttagtttcactccaagtgggcctctccctggggcatcttgggcttccccattgcatggtggctgggctccaagagtaagtgttctagcaagctgaaatggacactaaatcgccttttttgacccagccgtggaaatcacatggcctcgtggaagtcaaatggcatcacaataaccataatccatcagtcaatcagccacaaaactcaccctgtctcaaggggcagggaacatggacaccacctcttgaaaggggagctgcaagactctaggaactagcagcatatatgtgatggaaagtatggttgtggccaattttgggaaagaaactgccacatgtacaatatttgtcagagtatgcttaccagccacccgccttggaatcatctagggcactgttttttgttttgttttgttttgttttaaaaaaagcattcctgcagctggagcccttcccccagggattctaattctctaggtcagtgctgagacctgggaatctgcatttaaacatcaggggtaattttgatggatactaacacttgaagacaaaaaattctgaacaaacgagaacaaaaaaaacaataagcaaaacaaaaagaggtgccaggtgctttttttttttatgtttttgagacagagtctctcactgtcacccaagctggagtgcagtgacatgatctcggctcactgcaacctctccctctgagattcaagcagttcttctgcctcagcctccagagtagctgagattacaggcgtgtgccactgccccctgctaatttttgtatttttagtagagatggagtttcaccatgttggctaagctggtcttcaattcctggcctcaagtgatcctcctgcctcggccttccaaaattctgggattacaggtgtgagtcactccacctggcctccttttgtctatcttctattagaacagacaataagtatcatttaggttaagagtgagagctctggagcccccagtcggggtttgaaaacacactttgcttaatttctctgtcctttgttttcttcacctattaaatatacttaccttcatgtggttgttgggaagtttaaatgatgtaatttgtataaggtacttagaacagtacacagcacttagcaatcacttattttttgtaatttgatagaaccatgtgtagttttctttaggaaaccagatttttaaaacttgatagtataaccttgtttggtagagattgctttgatggcataaaattctctgagagtattaacactttaacatatacatttttcctgtctctccaaattgttttttctgttttcttcccctcttgaggacagctcgcactaaactcatctggaaacgaaaatctgaacttccgattcatataaatcctgtggaacaggatatactctagaagaacaggttgtcacagggctgagatacggttctcaaattagagggctagttaagaatcctatttactctaatacagagatagacaacaaaacagtggttacctggagcaggttgtggggtggagtgatggagaatcagagatgtagatcagagggtacaaagtagcagatatttaggacaagtctagagagttaatgtacatgagaacaagcctagagagctaatgtatatgagagctataggtaataagtttacgctatgtatgagattcatgctaaataagtagattttagctactgttgtcacaaaaacataggtaactatgtgagacgatggatatgttaatttgcttcacaatagtaacctatttactattgatacgacatattccataacatcatgttgtataccttcaatataaacaataaaataattttatttggccacgcacagtagctcacccctataactccagcactttgggaggctgaggcaggtggatcactcaaggtcaggagttggagaccagcctgaccaacacggtgaaaccctgtctctactaaaaatacaaaattagctgggtgtggtggtgcatgcatgtaatctcagctacttgggagactgagacaggagaatcgcttaaacctgggaggcagagtttgcagttagccgagatggcaccattgcactccagcctggacaacaagagctaaactaggcctcaaaaaataaataaaataaaataaaatgttttgaggcaaggtctcacttgttgcccagtctggagtgcagtggtgcaaacatggcttactgcagcctcagcctcaacctcctgggctcaagtgggcctcagcctcctgagaagctgggactacagatgcacaccaccatgcccggctaatttttaaattttttagaaacagggtttcaccatgttgcctaggatggtctcgaactcctgggcttaagcgacccctcccacctcagcctcctgaagtgctggattacaagcatgagccaccattcctggccaaaacttatttttaaaaatcctacttactatacccataaaatatggataaaataggatatctaaaaaactgactgatcatgtacctcataaatatatatacctactatgtacccacaaaacatttttttaacaaactaactggattccttcagaggtgggatattgagcagctagagaacaaatgtaaaagggaggctttttactgtgtactcttatactttttgaattacgaaccacgtgaatgttttacctattcaaaatgtgaaatatgtattcagttcacaaatttcaatagactgctcaagaggtattcaaagctctaacagtgctgatcaggaattatataatacactcaaaactcagcaaaaagatgctggtccaggtccatggtactgaataaatgatgacagtggccagatagcttcactaagctgagcagtgctagccataactcttttttttttttttttttaagagacagggtcttgctctgttgccccagactgaagtgcagtggtgcaatcataattcaatgtagtttccaacttctccccactcagcctccaccatgcctgggtaatttttaatttttttgtagagactgggtctggctatgttgtgcaggctggtctcaagctcgtggcctcgagaaattctcctgcctctgcctcccaaaatgctggacttacaggtgtgagccaccatgtctggcccagaactcttttttctttccttttttctttttttttcttttttgagacagagtctctcgctttgttgcccaggctggagtgcagtggtgcgatcacagctcactgcaagctccgcctctcgggttcaagcaattctcctgcctcagccttctgagtagctgggactacaggcgctcatcaccacactcggctaatttttgtattttttagtatagacgggatttcaccatgttggtcaggctggtctcgaactcatgacctcaggtgatccacccacctcagcctcccaaaatgctgagattacagacatgagccaccacgcccagaccagaactcttagctaattagtctttttttggttctttgtcaggccgcactcttctccttgtttttttccagtctctgctccttctgggactcaaagtgcaagtgcctttgcattatcttacaggggacaagcaaataagaatgaatgctatgttggaggcattagaggagtcccattgtatgagaaactcttactcccccaaacaatattttactgccccttgctgcttcctcattacccacccccaaatattccaggttttctactttggtcttgtaatggcagagacctaagtactatttaccctataggcaataacttaggacatatgtgcctgatcttctcagagtcagggatcttctctgtcttggttacctctgtatcctgggcccaagtgcagggactgctacatatatgctctcaaaaaatacttgtcaagggaataaatcagtcggtgcaggctgaatataaacacctgtttgagaatggttgccatagattcatgatccgtaagtgaacacttagagaaagcacaggatgtttatgtcaatctctaaacctttcaacttgactttctggagagcaacagagtttttctacaaactaatgctttgcagaaaaagaatagagtagttcagtttggaaaatggtatatcagtcacctttaatagaggtcctatttcaattcatatacaattgtcatcaggcagaagtatttgtttgcaagttcccttattgtttcttgcagcgtagggaaactgtttcgtgggtgatcaagacagtagaatctgtgagaggaaggttcatgaacactgactcaaacaggcagtaggtggggtgggggtgtgggaagaaaagactgctcactgattttaaaaaaggaagaaaaattgcatggtggcttatattcatgccttcatcataagacattgagcacttacaaactcttaaccagcacaagaccagcctgtaagaaggacctaagtgggatcttccagggtcataggcagtccctaaggagtgctgtctcacatggaagaccctgggaaacatgagacccaggagaatcagagtaatacacctttgctttgtttagtgttttatgctttacaaagtgtttgtgaatgttatctcacctagtgacagctttaagtacctttaagtgcatgcaccactagagtgattttgtaggatccatcattgattctgcaatgttcctataaaagtaaatggagccgggtgaggtggctcatggctgtaatcccagcactttggaggccgaggtgggcggatcacttgaggtcaggagttcgagaccagcctggtcaacatggtgaaccccatgtgtactaaaaatacaaaaaaaaaaaaaaattagctgggcatagtaagtagtacgtgcctgtaatcccagctacttgggaggctgaggcaggagaatcgcttgaacccaggaggtggaggttgcagtgagccgagattgtgccattgcactccagcctaggtgacagagcaagactctgtctcaaataaataaataaataaataaaagtggatggaggagggtgttccacacgtatattcgtctcctttgtctgggccagttcccagtggaaacaggactccagaggttggtaactcaagacatttggccagaagcctggctggaacaggaactctgcaaagcagggctcacttctccgcctgtgtgtcaccctttcaggttcccaggagaactgtttgctttccacgtccctgggcttcagtcacttcgtaactctgccagtgattgcatactcagcccctacccagcctaaactgttctcccacttcctcccacctggtgtgccccacccaagtttctttttaattcactcccatcacctttcttcctccttcaccatcacctgtctgtctcaagtctgattgatttctcccatgtttctctattatgtcacttgctatctgcaaaaaaaaaaaaaaaaaaaaaaaaaattcatctgcttctagtatgattagaaatgtttttgaaattgttatttttcttctaagtgcattgatttgggatccgatataccctggaacagatgttttcaaactttagactgcttgctcacctcagagactagttgaacatactagtgaaggggccctgcccaaggtcttctgagttcaagtcatagtccccatgtctctgtggttttaacaagctccctaggggctactgaagagtctgaagcttgagagtcaatgtcatataatgtgatcttttcaagaaaagcaaaacagttgcaacaggaaccttgacttataatttacttactcctgcttttctaaactcttctgacccaatacctatatctttcctcctgcctgttcaaattcttttggtccaagtgtgagatatttcagatggttgaattttaagttggccccaggtgttcagtattccagattgttgggttttgggtgttcagtattgttcacctctttccactcctgaattttttttttcttttgagacagagtctcgctctgtcgcccaggctggagtgcattggtgcgatctcagctcactgcaccctccacctccccagttcaagcaattctcctgcctcagcctcccgagtagctgggactacaggtgcgcaccaccacgcccagctaatttttgtattttcagtagagacggggtttcaccatgttggccaagatggtcttgatctcctgacctcgtgatctgcccaccttggcctcccaaagtgctgggattacaggcgtgagccaccatacctggctttccactcctgaaattataaccagttgaaaaacacaacagacagaaattaaaatattgctttcattattagtaaatctgattggagaatatagctctaaatcagcagtcagttgggcttactaatgttcccccactagccccataattgcaattatagctacgtagtcacttagcacagctagacaactgcaagctccttaacccaagacagcaaatgggaatgcatgaggccagaggcagggacaaaaaaaaaaaaaaaataggagagagaaaaaatgggaggagggaaagataaaaggctgagcagactgagttcattagtatgaaattcaccaatcagaaaacttattcctcttgtaatcacaaaatcacaaaaccacttgactttttcttttttttttttttttttttttttttggagaaggagtctcgctctgtctcccaggctggagtgcagtggcgcagtctcagctcactgcaagctccgcctcccggggtcacgccattctcctgcctcagcctcccgagtagctgggactgcaggcgcccgccaccacgcctggctaattttttgtatttttagtagagatggggtttcaccatgttagccagcatggtcttgacctcctaacctcctgatccgcccgtctcagcctcccaaagtgctgggattacaggcgtgagccactgcgcccggccccgactttttcttatgcttctgcttacttcttgttgttgttgttgttaatagagatgctgttgtaacatccctattaacaacaacaacaaaaagtaagcagtagcataagaaagatgttatgtgttcaagaccaggctagacaacatgttgttaatagagaacatgttgcctcacctggtcttgaactcctggccttaagtgatcctcccgcctctgccacccaaagtgctggaattataggcatgagccaccacgccaggccccgactgcttactttctatgacaactccctgaaagcaaccccagatcacaacctgggcaatctcttcattgttttgaacgtcctataatgggtcatacttgcactccctctaacaccataattttcacatctggttgccttttcacaagtggttctccaccccatctgcctgatggtttcttgccctcctccatgaatgttatatgtaaaatgtttatttaaaaacagaatgcttgttccttggtaccacaaggaaaaattagcattcagacaaaaattctctcaacgaggcaattttactttctgcagaaagggtgctcctcgcagatggaacaatggtgacagcacatctgaacaaaggagggaagcaatttttattccttatgcagcttgtccttgctactgtgtcctgtctccattggctggagccagacctcacagtctaaactgcacccgattggtaacagcttaaaaacttttaaaaataggtaaaagcaatggagaacagaggaaaagaggaagttgcttaccaaaggacttagaaaagtaataatattcccaaataaggaaggggcataggctgcgagctgggacatgcctgtgagcacgtccagcacaaatatcttggttaaagtacaaggacatagaaagtactatgtgcctgtgagcatgtctaacagctacataggatagggcttaacagagagttatttgcacaaagcaaggaggcttaaaggaagttagtctttaaaagaaattattatttctaacacttatgatttattctttaacaagaagggaaactttgaagaggaaactttttactttctacagtgaagttttctccatgttctccaaaacaccttgttcatcatgttctaacaacagtcacttgtaataatctgtttacctgtctccttcaccacattgtgcacccctttaaggcagggaacaccatattcttctttgttatgtgttcagcagtaacataatggctgcacacattctctccttcctgccttcactcattctctgcctatgatgtattatactagaccatctataggaactttttttttttttttttttgagacagggtctcactctgctgcccaggctggagcgcagtggtgtcatcatggttcactgcaaccccgacttcctgggttcaaactatcctcccatctgagcctcctgaatagctgaaaccataggcacataccaccatgactggctaatttttgtattttttttttttttttgagccaccagccaccacacctggtttaggaactaaattttttttaaattttttttttaaagatagagatggggtcttgctttgttgcccaggctggtctcgaactcctaagctcaagcgatcctctggccttggcctcccaaagtgctgggttcacaggcataagccaccatgcctggtctaggaagtaaatttttttttaatgaacaaggtaggaaaggtaggatctctgatcttgaatttgcatttttttttctttttttttttgagatggagttttgcttttgttgcccaggctggagtgcgatagtgcgatcgcggctcactgcaacctccgcctcccaggctcaagcaattctcctgccttagcctcccaagtagctgggattataggcatgtgccaccacacctggctaattttgtatttttagtagagatggggttgcaccatgttggtcaggctggtctgaaactcctgacctcaggtgatccactcacctcagcctcccaaagtgctgggattacaggcatgagccaccacacctggcttgagcttacattctaataggggaaacagacattaaaaactaatacaatttgatgtgacaagtttttaaactgagatatagaagatgcaatgaggagtatatagaagacagagagaaggcttcttcatccatccaacatttatcccaggctcggtggctcacacctgtaaccccagcactttgggaggccaaggcaggtggatcacctaagttcaggagttcgagaccagcctgaccaacatagtgaaaccccatttctactaaaaatacaaaaattagtcaggcgtggtggcaggcatctgtaatcccagctactcaggaggctgagacaggagaattgcttgactccaggagggggaggttgcagtaagctgagatcatgccattgtactctggcttaggtgacagagtgagactctgtctcaaaaaaacaaaacaaaacaaaaacatttatttggttagcgcccactaagtgccagacactatattagactctgcaagtaaaattatgagcaaaatcagatgaagaactactcttatggggccaggcacggtggctcacacctgtaatcccagcaccttgggaggccgagacgggtgaattactttaagtcaggagttcaagaccagtctggccaacagagtgaaaccccatctctacttaaaatacaaaaacgagctggccacgtccctgtaatcccagctactcaggaggctgaggcacgagaatcgcttgaacccgggaggcagaggttgcaggaaaaaaaactacccttatgggcttacggggaatggaaacataatgttaatagaattgtcaccgagtaagtgcaaaatattatgttagtcagggttcttggttacaggcatggaaactgactcaggctgacttaaacagaaaaggaattcactgggaggacatggggtggttcacacgatcacaggaaaggctgcagaccaggctcaaaaaacttaccggcattcctcctcccaagttttcttttttctttttttcctttgtttggagacaggttcttgctctgtcacccaggctggaatgcagtggtaagatcatagctcattgaaccctcaagctcctgggcttaagcaatcctgcaacctcagcttcagcctcctgagtagctgggactacagatgcaccaccacagccggctaatttttctttttctttttgtacagatggcacctcgctatgctacccaggctagtatctaactcctggcctcaaacaatcctctcgcttggacctccaaagtgttggtattacaggcatgaaccaccatcccagccacctccccagttttccattggactcttctcctctgccctcttctaggtataactttcctaaatccagaatctttgggatttgtatttccatttccaactggggtaggctgttagatatgggagtctgaggtctaattgtgctttatgctgattttcaaatattccatcacttttcagccccctcatccctcctgccttcctaaatacttgatgccaccaattcctgagccttggtgcaacttgcatgcttgactttgctctaccaagtcaggtattccagtttctgtcggcttccatttttgttctcattgttgtttggatgtgatttttgagagatgagggcaaaaacaactttgagttgatgtattttgttgtctttgaggcacaagattattcacataattttttttttgagatgggggtctcactctgtcacccaggctggagtgcagtggcacagtctcggctcactgcaacctctgcctcccaggttcccagtttgaaacgattctcctgcctcagcctcctgactagctgggattacaggcacctgccaccatgccaggctgatttttgtattttttagtagagatggggtttcaccatgttggccaggctggtctggaactcccaacctcaaatgatccacctcccttggcctcccaaagtgctgggattataggcatgagccactgtgcctgctctaatttttatatttttagtagagatggggtttcaccatgttggccaggctggtcttgaacttttgacctcaggtgatctgcctgcctcggcctcccaaagtgctgggattacaggtgtgagccaccatgcctggtcatttacagatttttaaaaaattaacattaaattgattgaagtaacagtaaagtgtagtttttcctcaagtcttcaagtttgatttatagttcttattattcttttttttttttaatttaagttctggtatatatgtgtagaacgcgcaggtttgttacataggaatacatgtgccgtggtggtttgcagcacctatcaactggtcatctgggttttaaaccccacatgcattaggtatttttcctaatgctctccctccccttgccccccacccccgacaggccccggtgtgtgatgttcccctctctgtgtccatgtgttctcaatgtccagctcccacttatgagtgagaacatgaggtgtttggttttctgttcctgtgttagtttgctgagaatgatggcttccagcttcatctatgtacctgcaaaggacatgaactcattctttttgatgactgcaatagttcttattattctatttatagactagcagctaaaataatacttgagtaagttaaatacatttaaatattaattttttttcttttttctaagacagggtctcaccatgttgcctaggctggtcatgaactcctgggctcaagtgatcctcctgtgtcagcctcccaatatgctgggattataggcatgagtcaccatgcctggccatttaaacatttaaaattgcactcataaatctagcgtatatgattttcttttccagcccttcaattttctgactgataaatattctcaagtactaaaataattctcataaattaaaaaaatctaaatatggcaactcacctatgaaatactctaatagtgcttccaaacctaatacaattttttacaccctccaacatagacttataagtctaaattggctacctaaagataaatttttaaaatttatttaaaatttaatttagttttagattcaaggagtacatgtgtatgcctgctacatgactgtatttcacactggtggggatggattggggttctagtgtatcccttatccaaatagtgaacatcgtacctgataggtaatttttcaaccctagtccccctgcaaacttcctccctttgggtgtctattatttccatctttatgtccatgtatgccattgtcaagctaccacttctaagtgagagcacatggtatttgatttcctgtttctgaattagatcacttagaataatagcctccagccctatccacgttgctgcaaaggacatgatttcattcttttttatggctgcatagtgttccatgagatatctatctatctatctatctatctatctatctatctacctatctcacattttctttatgcagccaactgttggtgggcacttaggttggtttcatgactttgctattgtgactagtgctgtgataaacgtatgagtgcaattgtcctttttaatataatgatttctaaggaaatcatttttttgaaaaattgggatcacaaattacagaagacacaaaggacctgggaacatgttaaagtttgccccaaggatgcactcagcaaagtccagactgtgagaatcttttcagggcaaacaacccggtttatttgacaaataaatgcaaggaaaaaaaaaagagagagagagaggaattgaggaggaacgtgtaaattaaagaaacttaaaagtgatctcaaacagttaaaatgcatgcatctaatttggattctgattcaaacaagcaaagcaaattcaaaatatgacatttatgaaccatctggaaagctgtatattcactggatattcgagaatgttaaataatccttgtcaatttttaaaaattgtataatgacatatggttatgttagaagaaaggagttcttacctattagtgtttcttactaagatagttatagatgaaattgcaggctacgtgtgattcgcttcaaaataatataggagaaggtacaatgtgggagtacagatgaaataaaattggccatgagttatcattgttgaagctgaatgagaggtacctagtggtttattgtactattctttctaattttttatatgtttgaaattttctgtaataagaagtctttaaaaattagaatcataggtcaggcacggtggctcatacctgtactttcagcatttgaggagaataaggtgggaggatggcttgagcccaggagtttgagacaagcctgagcaacatggtgagacccccccatctctacattaaaaaaaaaatagctgggcatggtggcacacctgtagttccagctacttgggaggctgaggtggggggatcacttgagtccaggatgtcaaggctgcagtgagccgtgatagtactactgccctccagcctgggtgacagagtgagaccccatgtaagaaaaaaattagaattacaaagataaactaataggccacaaggtgaatataatacattctaaggacttacatatagaatacatgcacacaaatcacatatatagtaatatatgatgtgtatatatgtacataccatatatatgatgtgtacacacatatacacacacagacaaatatacacacatatatatatctgtaatgaaataaaccagatccacctacagtgctattttccagtatacacacacaccatacacacacacacacacacacacacatacacgcatgtctacatcacagattggcatctgcaggggtagagggcagtcttgtgtcttatgagactgggcccttaacccatgggaggtgggaagaatggagaggtcagggtaattattactctgggttactccttcaaggtcacctcaggctggctatgcccttcagttgaaggttacttcccctctcaaggtagctgctgcaggactctctttttctgggctctgataactgctccctctctttgtaccttcaggcctggaggggcatgaaggaacagccagttttactaagcccaaattcttcttctactactactactgctactactattactactactacctgtgattctgtgattccctacatacaactcacacttctgtgaagatactttctgtaaacaaaccctcctgaaaccatcccgatttgagtaagtcatctgttctcttctgggaccctaacagatataccaacctttttgtttttatttttgtttagacagagtctccctctattgcccaggctggagtgcagtggcatgatcttggctcattgcaacctccacttcctggattcaagtgattcttctgcttcagcctcccaagtagctgggactacaggtgtgtgccaccacacccagctaatttttgtatttttagtagagatgggattttgccatgttggccaggctggtctcgaactcctgatctcaggtgatctacccacctcagcctcccaaagtgctgaaattacaggcatgagccactgcgcctggccattattgttcattttagaccagatttattttttcatttttagttacatttattagattattcctggtagtcaaaagggatggcttttatttcttttcttaatgcctaagaaataagttatctccttggtatagattttcacaaataattattagacaagattttgttaagcatctataagatatgattatggttagcattgattgagtgcttactacctgcgaggtactttgctaagctttttgctcactttctgttatttattccactcaacaattctatagattacaggtgtgagccaccgcacccagccagaaaacatattatcttacttttacaaaggataaactgagactcaaaaatattaagtagttaaattaccccaaataacatagttaagaagcaaggggagattcaaatttaggcagctagattctcagactccatttcttaacctctacactctactgcctacctaacattatgctggacctccaggagctataaagaaataattaagatggtcctggctaggcacagtgactcatgcctgtaatccaagcactttgagaggctgaggtgggtggatcacttgaggccaggagttcgagaccagcctgggcaacatgacgaaactcagtctttacaaaaaataacaaaaaattagccgggggtagtggtttgtgcctgtagtcccagtcactagggaggctgaggcgggaggattgcttaagcatgggaagcagaggttgcagcgagctgagatcacaccaatgcattccagcctgggtgacagcacaggaccctgtctcgaaaatgaaaataaataaataaataaataaataaataaataaataaatttctatttaaaaaaagaaataagatggtcctacacatggggagccctttaagatgttaaggatagagaagatattaagtgtaaaactcattttgaatggtcataagaaaacttttgaaggaaaagcagtttataactcgtgatctgtattgtactcagtagaatagaggaccttatatttttatcagtactaatcctttatagatatttttcttgaattatttctgatttgaattattttgattctgtcatttcagataggattagtttccactgttagtaaaagacaaagtattaggttgttgcacagcagcctaatactttgtcttttactaacagagcagcagtttgtcttcacagattatatggcaaattcaattcacttcctcaggaaagcctctcctgtcctgagtacactagtcagatgttcctgatatgtgctccatgacatccctttcctctgagacactcaacataattgtcataaaataattaatcccatcattatatatttaatatctgtcacgctctgactatataatctgtgaagactgctgctctggtgtctggcaaaaattggtgcaattacttttgcactaacttttgccattactgtaaatggcaaaaactgcaattactataacagcagattaaacaagataaaagtctacttctctcttttgtaaaaatctgtagtaggaagtctcaggaaccttgtctacaaagccatcaaaaatccagactctttccagctgactgctccgtcattccaaggtcaaggccatcctgggattctacaataatgatcattaaatccacatgccaagaggaaggatgaagtagggagcaaagagggtgcatactagttggctttaaggaagtcacatgaccacacctaggattgcaagggaagctgaaaaatgtaaatttttttttttttttttttgagacaggctctcggtctgtcatctgggctggagtgcagtggcacaatcttggctcactgcaacgtctgcctcgcaggttcaggtggttctcgtgcctcagcctcctgagtagctgggattacaggcacatgccaccgtgccaggctagttttttgtaaaaaaaaaaaaaaaaagtgtgaattttataattgtgagtaaccatatacccctgaattaggggttctgttaatacagagaaagaggagaaacctctgttagaggatagcttgcagtttctgctatagatttctcagtttctggtgggaacatttatccctatgatttaaggtataacatttatcttaacaaggcaaagcaaacacttcttaaagagaatacttagtgtttactagaaaaacagggtcttgaattttggttaagtttgaaataatgtggtctcctagaaagctttatttgttaatttttttttaggccagtcaagtgaagcagcgggagtggagaaggaacaaagaaatctgtaactggttatgatcaatgagttgtaaacaccgctgcacttgaaccagccagtttttggctgtcaggaataacattaaaataaatctgcctttgccatcagcctcattgcttttgctagcaccctatattctagtcacacaggcctcatttatttatttatttagagacagggtcttgctatgcttcccaggctggtctcgaactcctggcctcaagtgatcctcctgcctcaccacgcccccagccctaccaccagttgctgggattataggctgagctactacaccgtctcttttgtttcttaaaagaatcatactacttcctattttagcgccttcacactggctgttccctccggccctcttcctctacctaacttctactcttccttcacgtttctgcttaaattcgcttcctcaggaaagcctttcctgtcctgagcacactagtcagatgttcctggtatgtgctccatgacatccctttcctctgagaaacagtcatacaataattaatcccatcagtatatatttagtatctgtcaccctctcatgatataatctgtgaagacaaactgctgctctggtgtctggtacatataataggtcctcaataaatatttattagataagtaaatgaattagaataaattaaaaatctaggagttgcaggaaagcacctaataatgaattaactttaaaatgaaaaatatcatcttgagaggctgaggaaggagaatcgcttgagcccaggagtttgagtccaggctggacaaaacaacaagatcccatctcagaaaaaaagatgaaagctatattgtaaggatttctctctctctctttttttttctctttctttttttgagacagggtcttgctatgtcacccaagctggagtgcagtggcgcaaccatgactcactgcagcttcaaccttctgggctcaagtgatcctcccacgtcagcctcctgagtaggtgggactagaggcatatgccatcacacctggctaatttttttaatttttgtagaaacaggggcctcactatgtcacccaggctggtctcaaactcctgggctcaagtaattctcctgccttggcctcccaaagtgctgggattacaggtgtgagccaccatgcccagacttcatttttttttttttgagacggagtctcaccctgttgcccaggctggagtgcaatggcacaatctcggctcactgcaacctccacctcccggcttcaaatgattctcctgcctcagcctcccgaggagctgggattacaggcaccgaccaccacgcccagctaattttgtatttttagtagagacggggtttcaccatgttggccagtctggtcttgaactcctgacctcatgatctgcctgccttgggctcccaaagtgctgggattacaggcatgagccactgcacctggccccagacttcatttttaaaaagcaaaattaaaaattttttgtacagatggggtctcactatgtggcctaggctggtcttaaactcctgggctcaatatatcctcctgccttggcctctgatagtgctgggattacaggcatgagccaccatacccaatgtaaagatctttaataatcaaaataaccctttaagtcctgatgatctctaggaggcttgtggttctacactgacaattttagggtgttcacaggaaaaaatatgtgcatacgtgtatatgtatatttatatatgcatattaacagtaataggagaaaacctaaaaataatgtgtttgtgtgaaagaaagggagattgaaggagaatcgggctatctagttcctatctcagctccacttgccatagaactttagaatagtacacataatgtgctcaataaatgctagctattatcataatatagatataagaagagagctgggtgctgtggctcaagcctgtaatcccaattactcaggaggatgaggcagaaggattgcctgaggccaggagtttgagaccaacctgggcactatagcaagaccctgtctcaaagaaaaaaaagaaaagaaatgtaaagtgaaaagttatatatcaaaatgttagcagtgattatctcttgggttttgtttttaaaatctgcattcatttttttaaaatatgttttatttgttgttgagatgggatcttgctgtgttgctcaggctggttttgaactcattggctcagtcaatcctcctcactcagtctcttgagtagccgggattacaggtgcactccacagcacctagtctaatctatattttgtattttgaaataagcatggctcagcctagcacagtggttaagttcacgagcactggtaatagtagttcctgggttcaaagcacagtaacttgtgtgactttgaacaagttgttcaaacctctctgtgcctctgttacttctgtttgtaaaatgacagtaacaataattgtttaagtgtttagaaagttcattccttttttttttttttttcttgagacagagttttactctgtcgcccaggctggagtgcagtggtgtgatctcggttcactgcaacctctgcctcccaggtacaagtgattcttctgcctcagcctactgagtagctggaattacaggcgtgtgccaccacgcccggctaatttttgtatttttagtagagacggggtttcaccatgttggtcaggctggtctggaactcctgaccttgtgatccgcctgccttggcctcccaaagtgttgagattataggtgtgagccactgtgcccagccagaaagatcattcctaatagtttggtcataagattgctctggagtctttgctctctgattgatacaaagaatgacttttttttctgggaagttacagaagaaaaggcaatcctcttttaaatggaagccatttgatgccaattccaaagttctagaattttgtctgtttgtcattttactagcatgaatttaaagcatttgtagctgagcacagtggctcatgcctataatcccagcactttgggagggtgaagtgtgcggatcacttgaggtgggcggatcacttgaggtcaggagatcgagaccagtctggccaacatggtgaaactccgtctctactaaaaatacaaaaattagctgcgcattgtggtgggcacctgtaatcccagctactcaggaggctgaggcaggagaatcactcgtacccaggaggtggaggttgcagtgagccgagatcacatcactgtactccagcctgggtgacagagcaagactccgtcttaaaaaaataaataaataaaataaaataaagcacttttatgtaggccaatataagttatttgctggtatttcaagtttgtatttttggaaattatactttttaagttgctagcactgacctcttaagttaggaacactttgtgacatggcctctcttaactactcttacatcacagtatttgttttccttctacctttctcactgccactcctgggaggcccttgctaaaggttatcctcctccatctgatttctaagccttcgaattccctggggccagcttctaggccctttatctttttttttctatacctagtccaacctctactctccaaacacacctcttcaagtacctgccttttgttttttgtttttttggagatggggctctcactctgttactcaggctggagtgcagtggcatgaccatagctcactgcagcctcaacctccagggctcaaacgatcctcctacctcagcctccttagtagctgggatcacaggtgtgcatcatcaaccttactaattctgtttattttttgtagagacaaggcctcactcactatattgcccaggctgctgacttgttttgtatctccactggagtgtctcagagccatctcaaactcaacaactcccaaacggaagtatgcatttccaccatcatcagactccccaaacctgttcctctttcagtcttccttgtcttatgaagggcaccactgtcaactagtcatcaaagcatcacctgaagtatcttcctccctctcaatcaatccatcagcaagttaagtcatcacttccaatttcaaaatacatctggactcttcctgtctctccatctccactgccaccaccctccatcacatgatttcttgactgcagtactgcagtagcttccttgctagacttgcctgcggtcttgccactctccaaaccactcctcccagggcagccagagtaaccttttaaaaatggaaatcaaattatgtcacttctttcatgtaaaaatctcaagagacagggctcactctgtcacccaggctggagtgcacggcacgatcatagcttactaccgccttgacctcctgggctcaagcaatcctcccacttcagcctcccattcccagggtaactaggactacaggcacacagcaccacctactctatttaatctctacatatgtcctgtgtcctaactccatgttaacccctccaaggcttatgaagcccaacatgacctggctccaaatctcatctcctgccgctctcatccacactatccaccctactccagtatatggtaagctatttccaccacattaaacctttgtgtaagttgttccctcactcagcctaaacctgtctctcccctctcttcccccaaaaatgttggtttcttttctggtctcagctttgtgagaccttccttggtcccactaagtgagtctccctgttggggactggtcccactctgctcacagccatcaagacttgacctctggaattatctttgatccattcttcttacactttacgcagggaatgttcaaccagtccagttgactgctcattcaaatctgtttctcctctctgtcccttcctattgcacagtccagaaagacatcatgggtggctttggaggatggacacgactggaaaggacacagatgggccctctgtgggcttctataagagcaaagattagcctcctgatattccgtgggaaatgaggagacacactacacagcccgtatttagttttctttactatgtgatgtgtgttcacttactttcaatactagtcacttcaggaatatggttcttaacttgttgaggggtttatcaattccctggaatacataataaaagctatagattatttcttagaaaaatatacaaaagcaaaattttgcaaatcatgggagaagggaatttccaggcgaccgcttctgctttaccagccaatcatctactgtcttggatacttgcagcgttatctagtcttttcattcattcagcaaacacttcctggagacctataatgagaccaagcacagtctgagatgctgggtttgcatacagtgaagaacaagatagacatatgtctctgtcttcaaggagcttacattatccagcataagagacattaaacgaggttgggtgtggtggctcacgcctgtaatccagccctttgagaggccgaggtgggcatatcacctgaggtaaggagttcgagatcagccgggcaaacatggcgaaaccccatctctactaaaaatacagaaattagctgggcgtggtggtggccacctgtaatcccagctaattaggaagctgaggcaggagaatcgcttgaagctgagaggcggaggttgcagtgagctgagatcatgccactgcactccggcctgggcgatagagcaagactccgtctcaaaaaaaaaaaaaaaaagaaagagacattcaacgagcaaacaaataatcaatataaagtcaggtaatggtaaatattctgaaggaaaataaagcggggcatggaataagggtgggtgaggctattttaatggtgtggtcctttctaagatgatatttgagaaagacctgtaaggtcatgagaagaggtcagagaagcacattgctggcaatgggaacagagagtgcaaaggcccagaggtctttccttcctcctaagatggaaagcgaggtccaagattctgcatatttacttcctcccataataggtagccagcacagttctgagggcacagtgccaggttttcagagtggaggttctcttcaggttctgatttcaaacgtccaaatcctagcctccacatttcagggcttctctggaatgtctcttcccctgggaaactttaactcatctactaaagagcaatctacgatttctctgaatattaacataatttttttaaaaagtacttataggtttgcatggtggctcatgcctgtaattccagcactttgggacgccgaggcaggaggattgcttgagacaagcctgggcaacataccgagacctcgtctctacaaaaatattaaaaaattagctgggtgtggtggtgtgcgcctgtagtaccagctactcaggaggctgaggtgggaggctctcttgggcccaggaggtagaggctgcagtgagccgtgagggagccattgcactccagtctgggtgacagaatgagactgcctcacaaaaaaaaaaaaaaaaaaaagcttgttactttctaagggtatgtgtttggggcagtgattttgtttttctgggcaccttagtaacactgcggccacgcttccccaactaaaggtaaaagtccatagcaacaatcctccctttctctctgcacccgggccgctttcccgcggagactacatttcccagaatgccccgcgggctgggacggcgcgcgcagcgctgtttcgtgggaccaggattgaaacaagatggcgggttcgtggtgagaagccgtcaaggtaaccgcttccctctactcctcctgtcgaggacttcctcgaaactgggcagtcccacagtgttggtcggcagttgtagaggtctcccgcctgtcgttcccggcagggcgaggttgcctgcatccccagcctttgtccttcctgcagaagagccggcatgtggctgcgcgtttcttatagcgccccctttgttccctggcggacgcccgtggggaggtgatgcagcttgtggctctagggactcctttaggtcgaagagttctggtgctcttggtagcctgttcctcaaacctctgaccctcagaggctctgtagcttttgttttggggttgaattccgggctgagggacttgatctctgaaatgatcttcctggggtgaataatctgactcccagcagggcgtgcttttctctgggcttcggacagaggggacctaatttcccccaagatgttttattcgtggtcagaagtcatgggtttacgtcccacgcatgtattaagcagcgatatactgagcaagtaatcgattgacctctctgagcctttgttcttaatctgaaatggagatgctgcttcacacacttgtgaaagtcagagcacatattgtatatgaaagtgggttgtaaactaaaaagcacacctatgagctcagggttaacggtgttaatgtactggcagtgcaaggtatcagtgtgagtggtttagactagcaaataagagggcctgtgtcctaattctcttttatcactattggggggaagggcacggatactcattgaagactattaaaaacaagatttaacaatggttatttgtcatttattcacaacaggccatgaagattgtggttttccccattttgtcattggagaaactgaggatcgtttagttaatgacttgtttaaagtttcccaatttggcagtgactgactctaaagtccttggaagcaagacgtttaaattttgtactttagtttcttcatgaatcagaataaagatacctcacatgattaatacgagagcaaaatgaaatggtggtgaaagtacgttggaaagttaaagactttgtacacatataagatggtgaaattttatctgggacttgagggcatttatgagttcctccaattgagtaataggctaaggataggccttgtttgatatttctttattattattattattattaatggctcagggcagacaactatttcatttaatcagaaacaggatagtactgtaaatgatgtagtatcttgtgtatggaaccttggagggtgtacacagccacactagcattaaaagaatgaatactctgtgtaccatttgtgagtgactgtttcaagagtaattacacatttactgagtattcattaagtggaaggagctgcactgggtcctgcagagaagtttgtatctaagataaatagtaatggacatagttccagtggttctgatcttatattctgtccatgtcgctcttcgtcctgttgttcaatcatgtggaattgccaagttgtttaaaagcattgcttcagttgacttctaggcagtgattcttaccttgttcttgtggtgtttaatataacttaaatttaccataggtagcactgatttttctttatctcttcagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaagtaagtgaaattttttttaatgtttaaaaacttttaaacttttaagaattaagaaaatttaaagcatttagttattgtatatgcctgtaatttgcaggagtgtttgcagcaatggaaagtgggagaaaacctaaatgtcagtcagaaggggaatggataggtcagatgtggtgtctcatgcctgtaatcccagcactttgggaggctgaggtgggaggattgcttgaggccaggggtttgagaccagcctgggcaacatagcaagacccccacctctaaaaaaaaatgtgggttggggaggggaatggataaattatggtacatctgaactgtgactgtcatgtagctgttactgacatggaaagatctccaaatagaaacaaaaaaagcatgtcagaaccacatctatatatatctatcatatgatcttatttgtatgtttaaaagatgatccatcatatgcatgtgtgcatatgcataaatgcagaggtaaaaggtctggaccaaacagtggttatctgtgtagcccactcttgggatttggctgagggcaggagtaagggactggtcaagggtaactttctcttgttcgattacatgtattacttttttagtatttctctcttttttttttttttaacggagtctggctctgtcgcccaggctggagtgcagtggcgtgattacttttttagtatttcttaaaatgtgcgaataaagggtaaattcacagtcccatcttccaaagataatcattgttaatattttggtggattgtcattgtgttttttctatgtacctagccatttttaaaaaaatgaaatgtaatttctgcctttcttttctaaagaactgtatatagttagtattttctcgaaagcttgttaatacatgtttgacagtcaaagcatggacccaaataagtaaatagagtattaaagtcttttttctcagccaactgtgctttctttttccttttcctgtctgtaaacagagtttatagctcttataaacagctcttataggaagctttccatttctaaagtagacatgtatagaaggcaacagtaggtttgcctttttatattaaactatgtgagccaactttttatttttattttttattttagattcgggcgtacatgtgcaggtttgttacgtggatgtattacatatactgaggtttgggcttcaactgaacccgtcacccaaatagtgaacatagtacccaataggtagtttttcaactcttccctccatccctccattctgttttgagtccccagtgtttattgttcccatctttgtgtccatatgtacccaatgtttacctcctacttgtaagttagaacatgtagtatttggctgtttttgcattaattcacttaggataatggcctccagctgcatctgtgttgctgtaaaggacatgattttatttgttttaatgtctgtgtaataatccatggtatgcatatacaccacatattcttccagtccaccattgatgggcttgtttccatgtcttcgctattgtgaatagtgctctgataaacatgcaagtgcagctgactttttaaatacaactctgcttgaccttgacctttgtctcttctttcttatttcctatttaccaccatttgtaattgaaagtttgcttattgaattagggagaaaagagctatttgaagaatggagtataagtaaagtaataaataggcaatttgttatgcttgagacgaggaaaatattttactcagtaaacacctttgttgaatagaatgctcaaaagtttgccagatcctactctattttattttattttattttttgagactggatcttgctcccaggctggagtgcagaggcatgatcttggcacactgcaacttctgcctcccaggttcaagtgattctcctgcctcagcctcccgagtagctgggattataggcacctaccaccaggcctggttaatatttgtatttttagtagaggtaaagtttcaccatgttggccaggctggtctcgaactcccaaccttaaatgatcctcctgccttggcctcccgaagtgctgagattacaggtgtgagccattgcgcctggcctaatttttgtatttttagcaggggaggggtttcaccatgttggccaaaactggtctcaaactcctgacctcaagtgatctgcccacctcagcctccgagagtgctgggattataggcatgagccaccgcacctggccaccaaatcctgctcttataggaagctttccatccctgcttccttgcttgccccactctcccattttttagggccctaaacatagaaacatttattacattatattcaaagtaaaatcaacttagaattcagtaaatagaacaggacattgcttaagagactttggatataaaccaaaataagtcacaacaaaactgcaatcagcttttgattatctaggagcatttttgttgttgagaattgggagaaagacccttactcttacttcttagattcctctttgccttgcaggaacccagctcctaggctaatgagaagtcacatccaatcagtttttacatagactatgttttgaaacaattagtcctcacacaggcccatcagaaaaccagttaatgtgtccctgaataattgaaaattatttatatatctttttccccactggatttcccactaagtttgtactggatctaattcattttggtgtccctggggcctctcattcatgataggagatctatcagtgtttgttcaagtaatctgaatggtttagagttaactctcaaaatatctagttaactaagaattaggttaccctagaaaatcattccattatcagttatcctaatactcagtgacctaacttcttatatccgaaaagtcccttatactgcaaagttcctgttgctactattattgaaagtaaagggctgggcagggtggctcacacctgtaataccagcactttggcaggctgaagcaggctctgaagtttgagaccaggctgggcaacataggaaacctcatttctacaaaagttacaaaaattagctgggcgaggtggtacacgcctgtggtcccaggagggagccagcttactcaggaggctgaggtaggaagattgcttgagcccaggagttcgaggctgtgattgtgccattgtactccagcctgggagacagagtgagaccctgtctcaaaaataaaaaattaaaattaaagaaagtttcattactgttattattgatgtttaataaaaaagggaaggacagtaagattggaggcaaagcgaaatcatgattaaggaagaaagttcagtgagcaaaaataaaaagccttccttatattctagaaggaatattttaaaatttcccaaatggtcagtcagcccgggagtgtagaacacttcacagttttcaaagcatgttaagccatttgatccttataacagctttgattttggtagcccatgtagtattatcctctttatgaaggtaaagaaacttgagttctgtggccctcataagttcacccagggtcacatatttggtaaacaaaaactgtgaccaaaatctggatctcccaccttactttgtcctgtatactttctactgtacttccttttctgtagcaaggtaaaatactgagcatttgaagatgggacaacttttagctttcatagctctttcaaaatgcaattaaatatatatatgtaacaagaataactcataaattacagaaattattgttaattgaaattcttttggcacattgagcttaattgctgttaactttggcattggtcctaattatatatttagagcttctgctacttctatatccagaattacttccattggtaaaatatcaggtaatgaatgtttccttatttttttttcaaggtgaagtctcactctgttgcccaggctggagtgcagtggtgcagtcttggcccactgcagcttcgacctccctgggctcaggtgatcctgctatctcagtctcccaagtaagcaagactacagatgtgtactaccatgtctggttatttatttatttatttatttttgagatggagtttcactcttgttgcccaggctggagtgcaatggcatgatcttggcccactgcaacctccgcctcccagattcaagtgattttcctgcctcagcctcccaagtagctgggattataggcatgtaccaccatgcccggctaattttgtatttttagtagagatggggttccaccatgttgatcaggctggtctcgatctcctgacctcaggtgatctacccacctcagcctcccaaagtgctgggattacagacgtgagccactacgcttggcctatgttttgtatttctttgtagagatggagttttgccatgttgcccaggctggtcttgaactcctgggttcaagtgatccacctgcctcagcctcccaaagttctggtattacaggcgtgagccaccatgcccagtccttatgaatttttcaaacatcagttatgcagaaacatttgagaggcagttcggcaatcactttttaatgtgtaggcactataggggacacagtaatgaacaaggtacagttcctggccttaaggaacttatttagacttgtaggtgaaacagacatctagcaacactaagaatgcccagaatatgaggcagaatgtgataagtgtgtcatgagggcacaaacaaatgtctgtgtaaacacagagtagaaattttactgagtttcttgttaactaaaatactgttgtcttgagttttcttgtctgcatatttcagaacacttaattctgtcacccagtcatgtttctttcagtgaaaatgtatatcatctagttggtttatattcagagatacaaaattgtttttttttaatttatattttttattattaatttttttttaatagagatggggtctcactatatgacccaactatgttgcccaggctggtcttgaactgctggatcaagcgatcctgctgccttggcctcgcaaagcgctgagattacaggagtgagccaccacaccccaccagttttaatttttttagaaacgattttgctctgttgcccaggctagaattcagtggcacaatcatagttcattgcagcctcaccctcctaggttcaagtgatccttcagcttcagccacctgagtagctgggattataggtgcatgccaccatgcccagttaatttttaaaaatagtttttaaagataatatctcactgtgttgcccaggctggtctcaaactcctggccttgagcagtgttggcctcccaaagtgttgagattacaggcgtgagctaccatgcctagctttataaacttcttttaatattaacccaatccatgcataattaggaaggtcccagtgatgtcaaacaagaaaataaaatatggccaggtgcagtggctcacactggtaatcccagcactttgggaggccaaggcgggctgggctgatcacccaaggtcaggagttcaggaccagcctggccaatatagtgaaaccctgtctctaccaaaaatacaaaaattagccggacatggtgggcgcctgtaatctcagctactcgagggactgaggtaggagaattgcttgaacatgggaggcggaggttgcaatgagctgagatagacaactctttcttctgtgaagaaccttgggggcagggagagtaaaaaggatttcatggaagaagagtgtttgacctttttttttttgagatgaagtctcactctcgcccaggctggagtgcaatggcacgatcttgtctcacggcaacttctgcctcccgggttcaagtgattctcctgtcttagcctcccgagtagctgggattacaggcatgcaccaccacacccggctaattttttgtatttttaatagagagggggtttcaccatgttggccaggctggtcttgaactcctgacctcaagtgatccacctgccctggcctcccaaagtgctgggattacaggcatgagccactgcgcctggcgaatatttgacttttaaggatgaggggtatttgaacaaaatggggctggaattccatactgaggacatggtaaaggcatggagatagggaaggcaggataggttacagttctatatcacaggaacaagaggctctgttgagactttgattcttggcattgaccaaggtgcattcaaaacttgcttttaactatattgagctacttttaaatttttttctttatattaaaagaatacccttttttgaacataggagaatctttcacaagcttttaaaaaagcagtttatagctgagcacggtggctcacacctgtaatcccagcactttgggaggccgaggcaggtggatcacgaggtcaggagatcgagaccatcctggctaacacggcgaaccccgtctctactaaaaatacaaaaaaattagccaggcgtggtgggggcctgtagtcccagctacttgggaggctgaggcaggagaatggcgtgaacctgggaggcggagcttgcagtgagcagagatcgcaccactgcactccagcctgggagacagagcaagactccgtctcaaaaacaaaacaaaacaacaacaacaaaaaaagaaaaacaattttggctcttgaatttgcaggtattctaaaaaaggaaaatatgctttaaaatgtaagcattttgattaagaaaagttaattttaaacaaatcatttcatatttcatcacttcaccaccaccaccccccctttataaactatgcaccttggaaaacccaaatactttatttttatttatttttttgagacagagtttcgctcttgcacaggctggagtgcaatagcatgatctcagctcactgcaaactccgcctcctgggttcgagcaattctcctgcctcagtctcccgagtagctgaccacgcctggctaattttgtatttttagtagagacaaagtttcaccatgttagtcaggctggtctcgaactccttgacctcaggtgatctgcccaccttggcctcccaaagtgttgggattacaggcgtgagccactgtgcctggccccagatacttcaagttctttcttggaaaggctggagtacccaaacacttttattttttttcttacctggagtccttgcgccttttactcactctgctagaaacattgttttcatctcttatcaatccttacttattttctcattcttcagagcaccttggacatcatctccactgaaaaggctttcttgaacctgcacaatttgtttggtagcctttctgtgtggcccatctttgccaatgtttaccattcctaacagtgcttatcctctatgttgtaattgtttgtctgtctctctcacaagcagactatacccttttgagggtagggactgagtcttgtttgttgttgaatccctagcccctagcacaggcctgtttcatactaaacagtaatgttggttgaatgagtaaaactagctttaaatttatggagaaaatatgctcaaattaaccaaatctgttttactgtttggggtttttgcagatggagctttatattgtgtttgtcataaatctacgtattctcctctaccagatgactataattggtatgtattaaaattcaattgaagaaataatagtcttagctatagctgaaatgatttaattttatttcttgttttgatgtctgatgctttcttttctcattattctttccttaattttgtttttaaaaattattttaatgattttatttacccagtatctgggcttataaacattttaaataaaaatcattgtcattgtgtttcattgaatatttaatttgttataagacagacatgctgtttagaactgctatcttttcttcctgaagcatgctttagctttttggaaaagttaattagtttttatagggttcatatctattagcttaagccattattatcttttcttttgtttgatattgaataatcctaaattatacatacttaatttagccaccatttatttggtacttattcaatttagtcactatgataagaactaggaataacatatgacattgtcttttttctctgcagcagagtctgatatgcagaaactgcaacctattttcttaatctatgttgtttttattacaaattataataaaaatattttttcttctctcttgacactagttttatttttattttgttttcgagatggggtcttgttctctcgctcaggctggagagcagtggtgtgatcttggctcactgcaacctgagatggggtcttgttctgtcacccaggctggagagcagtggtgtgatcttggctcactgcaacctccacctcctgtgttcaggagattctccagcctcagcctcctgagtagctgagactacaggcgcatgccaccatgcctggctaatttttgtatttttagtagagatggggtttcaccatgttagccaggctggtctcaaactcctgacctcaggtaatctgcccacctgggcctcccaaaatgctggaattacaggcatgaggcactgcacctgaccttttatttttgtgagacagagactcactttgtcacccaggctggaatgcagtggcacaatctcagctcactgcagcctcaacttctgaggttcaagtaatcctcttgcctcagccccccaagtagctgggactataggtgtgtgccaccacacccagctaattgtgtattttttgtagaaacggggtttcaccatgttgcccaggctggtcttaaactcctgagctcaagcaatctgcctccctcggcctcccagcgtacaaggattacaggtgtgagccatcatggttggccttttatttttgagacagggtctcgctttgtcacccagactggagtgcagtggcgctatgtcagctcattgcagcctcaacctcccaggttcaagctgtcctcctgcctcagtctgcccaagtaactggaactacaggtgtgtgccaccacacctggctaatttttttttattttttgtagagacaggatttttccatgttacccaggctggtctcaaactcctgagctcaagtgatccgccttggcctcccaaagtataaggattacagatgtgagctaccacgcctggccttgatactagttttaattgtacatctaatgagtactataatagcgatgaaattggaataggtaacagtttttgaacctggaaagactgagtcatataagtgttttgcattatataaaactatcttctcgtgaagaaatcgtttgacagattaaatgttcattgtagccatgttatggtattcaatcttgaaaccacggtgaaacaatctaatgcctattctttgttagctacaaatgtattttgttgtggtatttaagctgacatattctgtgggatggtcttcatttgtgtcctgtgttatgggtaccaggtttgccaatccagtgatgtagtatcttcagcaatttgtgattaattttagcttttatttatttatttatttatttatttatttatttttttgagatggagtctcattcttttgcccaggctggagtgcagtggcgtgatcttgacttccttcagcctctgcctcctgggttcaagtgattctcctgcctcagcctcctgagtagctgggactacaggtgtgtgccaccacacctggctaatatttgtatttttagtagagacggggttttgccaggctggtcttgaactcctgacctcaagcaatctgcccaccttggccttacaaagtgctgggattacaggcatgagccaccacgctgggcccagaatgattattaggccgggcactaattttagctttaggctggagtgcccactgcactccagcctgggtgacatagtgagagtccatctcaaaaaaaaaaaaaaaggtaatcattttgccttgaatacagtataactttatttctaaaacattcttttttttagcaacgtagagcttgctctgacttctgatggcaggacaatagtatgctaccacccttctgtggacattccatatgaacacacaaaagtatgtatgagaaaatttcttgcagtttttaatttgctgttagaaatgtttgcacttctttatagtatccaaaaagaagggagtcatctgattttctttgttttagattttcttttggctttttaattttactattttgatttttctcttatttatttttcatctgctttctttacagtcttttttcagaatacaaaatgaaccatttaaacacaattatggcatcagttttctggtctaaaaaatttggtagatttctggttaaggatcaaatacatctagtataaaattataaaatgcattatcccatgctaccccatattataatctagacaattatgagaaagttgtattttagagtgctgggattacagctacttttttactattggttctgacagtttttttttttttttaacatttggtgaatttctttatttttatgttttaatgggccaacataggtatatattttgaatggcccagttagatttttttccctattttttaaaaagccaagtactagatagaagaggattttgtattgtttttaatataatttatttttagtttgacccaagtctttttattgttttgtatttgaaatgctttttcctatttctttaagcctccttctactaggtaatgtttgatttgctttttttttgagacagggtctcactctgtcacccaggcaggagtgcagtggcgtgatccggctcactgcagcctccacctcctgggttcaagctattctcctgtctcagcctcccgagtacctgggactacaggcacctgccaccacgcccggctaatttttgtatttttagtagagacggtgtttcaccatgttgcccaggctgatctcgaactcctaagcttaggtgatccgcctgcctcggcctcccaaagcgctgggattacaggcatgagccaccgtgcccggccttgatttgctttttgaggagaaaattagatggtttaagtcatcacatgatgtatttagtggtacttattttgaaaaatcatcattagggtcagggtgccggttgatttgacaaataatttcttttctttttttttttttgagactgagtctcactctgttgcccaggctggagtgcaatggcgcgatctcggctcacagcagcctctgcctcctgggttcaagcgattctcctgtctcagcctcccaagtagctgggactacaggcgtgcactaccacacccggctaatttttgtatttttagtagagacagggtttcaccatgttgggcagtatggtctcgatctcttgacctcatgatccgcctgcctcagcctcccaaagcgctgggattacaggtatgagccaccgcgcccgacaaataatttctgtattcctttttaaactcaccattttgtctccctgctttgttaggaaacaaaagccaggtatcataggtactaattcagtgcctcttttttatcacttatttgggcaacgtttagaaaaataggcctacatcactgagttttggcctataaaccctccaggtcacactatgttgtgcctttgtccattgttattttgttaaatatcttcggtttatttgctgtgttttagcaattatactaagaatgccaggtcatttcatagcatccagactcttatccccaaatggctctttatatctctgaatctgaccctcctcaactgtcaaaactttcccactgtacttgtagaacttactacccttggcaaaatctcttacaatcttagcctattccagaatgttgccttcaccttttgactctaatagaaacctgcctgtaccctggagacgttacttccccagcagttcttttaagtagttgctgttttctctcgcatactcttttaccactgggtctaaagatggggaaggtatctctgtagctcttcactgtcaaatctagatcatttctcttccttcctaacaatttctagctttgtagcttgtatcattaaactgcatcatttactatctttttttgttgctgttatctaccaactgccaggttatttctcctcctccaccactctgcacttccttgaatattctaagcttgctgtcacactttctccaatactgttttaccctcattcttttacttcaatatccatgtaggtgatctaataccatggtgtctcacttcttgatctctctctacatcagctacccacttccatgggaggattccctatgattccctagagatattctaattaccagtaattgctactcctccttcccagtctaaattttaagaaatccaatagttaactaccagtccctcttggtctcccagctccaagaattattcattccctctttgtaacctacatcgattgatccaaccactttttcacagtccctcatgtatctcacacattctcactccctacttaacccagcacagactgatatcatggtttatcattatcatcattcctctgtacacatgaccacctcccctgcatcctctttctttgttgtgtttcctttgttttgacaattatcttctctgccacatcatcaatattcatctctctagtttaggtaagtaatcactcctacaagttttcaagtaatcaccccactgccaccatactgaccacaactccagctgttcttcagctgtattaggtgagctctccactcagagcttttgtatttcctgcttccgttgcctggaatgcttttacttcatagtttactctctttccttaaggtctttttccttatttgttatcttgtgtggccttccttggctactgcatttaaagttgtacctctgctcctgcactccttgttgtcctttgatttacttttctcaacagcatttatcatttctagcatactggatgttttctggctatctcccatcactaaaatgtaagcttgatgaggacagggccttgtgtgtttttttcccctgcttggtcttcagcacctggaataacgctttgaacttggtaggtgcacaataaatatttttctattaagtgaatgaagttgttccttcctcttcatgcttaagggttttttgttttagggctaagagacattcacatcagaaagcatggaaagtttttgtttgtcaagcaataaattgtagattgggctgcaaaataagaaacactcttgagaacatgttactattagtagaataatagtaacatgggctcaagcaatcctcccactttagcctcatgagtagcttggactataggcacacaccaccatgcccagctaattttttaaatttttgtagagacagggtctcactatgttgtccaaactgatcttgaattcctggactcaagcagtcctctcaccttggcttcccaaagtgccgggcttacaagcatgagccactgtaccttgcccaatctggttctttttttttttttgagacagagtctcactctgtcaaccaggctagaatgcagtggtgtgatcttgtctcattgcaacctccatgcctccccaggttcaagcgattcttatgcctcagccacccaaatagctgggattacaggcactcgtgaccacgcctggctaatttttgtattttcagtggagagggggtttcgccatgttggccaggctggtctctaactcctggcctcaagtgatctgcctgccttggcctcccaaagtgctgggattaccaggcatgagccaccacacctggccccattctggtttttgtgacaaggatctggcttgtctccctttctacttttcactgatatctttgttactttgcatttctgtagtacagtcatgcattgcttactgatggggatatgttctgagaaatgcattgttaggcaatttcattgttacgtgaacatcatagagtgtcacttacgcaaacctagatggtgtagcctactacacacccagactttatggtatagcctattgctcccaggctgcaaacgtatacagcatattactgtagtgaatactataggcaattgtaacacaatggtcaatatttatgtatctaaacgtatttaaacatagaaaaggcacaataaaaatgtgctataaaagataaaatgtaatatacctgtatagggtacttaaccaaaaatggagcttataggactggaagttgccctgggtgagtcagtgagtgtaaaggcctagtacattactgtacactgctgtatactttataaacaaacactgtatgcttaggctacaccaaatttttaaaaaaatatttttctttctttaataataaattaaccttaggttactgtcacttttaaacttaataaacttaaaaaaaatttaatacttttttactcttttgtaataacacttagcttaaaatatcgtgtacagctatacaaaaatattttctttatatccttattctataagcttttttgtattaaaatttttgtttgcactttttaaactttttttgtgagaactaagacacaaacacagtctaggcccacacagggtcaggatgatcaatattactgtcttctacctccacattttgtcccactggaaggtcttcaggtacagtaacatgcctggagctgtcatctcctatgataacagtgtcttcttctggaatacctcctgaggggcttgcctgaggctgttttacaattgacttttttttaacaagtaggagtacgctctaaaataatgataaaaagtatatagtatagtaaatgcataaaccagttgcctagtcatttattattatttttattatttaattattttggttgagacggggtctcactacatgttactctggctggttttgaactcctgagctcaagcctcacaaagtgctggaattacagccatgagccactgtagcctgccgttatttattattattatcaagtattatgtgctatacataattgtatgtgctatacttttatacagctggcagtgcagttggtttgtttacattggcaccaccacaaacatgtaagcaatgcattgcactatggcgttctgcaccatcactaggtgacaggaatttttttagcttcatgataatcttatggtaccactgtagtatacactgtccttcatcactgtacattgttgactaaaacattgttatttcaggcagaatcttgccctgtcacccagggtggaatgcggtggcatgatcttggctcactgaaacctctgcctactgggttcaaacgattcttctgcctcagcctcccgagtagctgaggttacaggcatgcaccacaacacctggctaattttttgtattttcagtagagacagagtttcaacatgttggccaggctggtcatgaactcttgacctcatgtgatccgctcaccatggcctcccaaagtgctgggattacaggcatgagtcactgcgcccggcctcaaaacattcttatgcagcccatgactttacttaattgtgccacctccattgctttttaaaaaacacacacacacacacacatatatatatatatatatatatatatatatatatatatatatatatataaacagagatggggggtcttaccatggtgcctaggctggtctcaacctcctaggctcaagcattcctttgccactttgaccttcctaagtgctgggattacaggtgtgagccactgcacgtggcccacattgcctttttttttttttttaattgacacagggtctgtctgtgtcaccaagactggaatgcagtggcgtgatcttggctcactgcagcctcagcttcccaggcttaagtgatcctcccatttcagcctcctgagtagccgggactgcaggtgtgagctaccatgcctggctaattttttgtattttttgtagagacagcgtctccaactcctgagctcaaagtgatctgcctgtctcagtctcccaaagtgctaggattaacacatgtgagccaccgcacctggccacattgccttttaaagaggtcttgtttcatgtgcataaactagatataaatatatgctataatatttaatacagtggtagaatgtagttgtcactaatagcgtatgaatgtaaagaaaatatgtttgaattgtttcttactggttgtaaattcagattttcattgtattataatacatacatattgttattttaaagcaaggcagtgttacaatcttgttacatatatattattattgaatatgttactttcattatgatagcgttatatagtattgaatgttacaatctttgttacataccttaatatcacttaatatttaaaatataggtaacttgaccctccaagatagtgattccttttgttttccgttttgttttgttttgagacagggtctcactcttgctcaggcaggagggtactgtgcagtcatggctcactgcagccttgaactcctgggctcaaaagatcatcctgcctcagaccccaagtagctgggactgcagccatgcaccaccacacctggctaatttattttttgtttttaaattttttgtagagatgaggtttttaaattttttgtagagatgttgcccaggctggtctcaaactcctgggctcaagtggttctgccaccttgacctctgaaagtgctgggattacagatgtgagccacatagctggccaagacactgattcttaaagtctttagtgagtcactattactggtggaatatgttgtatatcattcatgtgtgttgaggagataagatttttagtaatcattaactttgggggaaagctatttaaattacaataaagcactgtttggtggcattttagtcacctgaaatgaaaatgttgaaaatttttctgcttccattggatgtaagaaatgtcattttctttcttttttctttttgagacagtcttgctctttcgcccaggctggagtgcaatggtgcaatcttggctcactgcaacctctgcctcctgggctacagcgattctccttcctcagcctcctgagtagctgggattacaggtgtgcgctaccgcaccaagctaatttttaagtagagatggggtttcaccatgttggccaggctagtcttgaactcctgacctcaggtgatccacctgccttggcctcccaaagtgctgggattacaggcgtgagccaccgcacccggccaaaaaatgtcattttcaatgaaaagtttttaattatttctcatcttaatgatataaaaggtaaatggtaaacttttaagttaaaaaataataataggcataatttatacctttgagaaacagaaactaaagtaataagtactttattactgcagaaaataagaacattaaatgagggctttctttttttcttttttttttatttgtagtagagacacggtctcgctgtgttgcccaggctggtcttgaactcttgaactgaagtgatcctcccaccttggcctcccaaagtgctggaattacaggcatgagccaccacacccggcctttctatttttctttctcttttttgagacagggtttcactctgtcacccaggctggagcacagtagtgtgatcacaggtagcctcgacctcctggtctcaagtgatcctcccacttcagcctcttgagtagctgggactgcaggtgcatgccatcacacctagatagtttttaaattttttttgtctgaccatgttgtccaagctggtcccatgctttggaactcctgggctcaagtgattctcctgccttggtttcccaaagtgctgggattacaggcatgagccactcactgcacctggcctaaataagaactttattattggaaaagaaacctaaaatttgctgtgagaagaaaaatatttctgactaatgaataatgcactaagtgaaactttgttttgataacttatttgcccaccctaaagtactatagtgaattactgaatatggtaattgttttattgtgatctcaaacaaatgctggctaacattcccacatcttcatgatgtttgttactgattattttgtagcctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtaagttttcttttcttttcttcaatccctactacatacagtaaaggaacacatggattttcttgcaataacaaacttctgaagtggtgttttgcatgaggaaattaaccctaagtagaatcacctactatgttgtactttttttttcttttctgagacaggatctcgctctgtcacccaggctggagtgcagtgccacaatctcagctcactgcagcctcaacctccagtgctcaagtgatcttcgcactttagccttccgagtagctagtactacaggcatgtgccaccacacctggctaattttgttctttttttttttttttgagacaaagagtcttgctctgtcacccaggctggagtgcagtggcgagatctcgtttcactgcaacctccacctcccaggttcaagcgattctcctgcctcagcctcctgagtagctgggactacaggcgcatgccactatgcccagctaattttttgtattttcattagaggcggggttttaccgtgttagccaggatggtctcgaactcctgaccttgtgatccacccaccttggcctcccaaagtgctgggattacaggcgtgagccaccgagcctggctcttttttcttcttttgtagaggcaaggtctcactcactgtgttgcgcaggctgattttaaactcctggactcaagtgatcctcctccctcagctgggattgtaagaatgagccactgccactgtacttttaaatttacatataatttagctaaaatgaaatagtacttctttttttctttattttaatgggggaatttaaccagagctttcagtgaattttgtaagagttcttgaaaatttttacattctatgatgtattcatttaatatgttgtttttgttcattttcctgttaagtaattgattgtgtcttcagccctttatcaatttctttatcatattttgagttatcgaaaaaaacattggggtacagaaaatgattgggcagcgtatgttgttctcagttcccttggaaactgtaattgccctgatgtttgcaaatactcacattttccatcgattcttacctgccatttgactctggcattaattagttttcctctttttgatttttttcttttgtatctatcttcttccataccaaactataagatgtttttgttgtttatatttgaacaaacttttttttcttttttttttttgtgagaaggaggtctcattatgttacccaggctgatcttgaactcgtgggctcaagcaatcctccttcctcagcctcctaagtagctgggattacaggcacactctgccacgcccagctagtttgaacaaaactttgttcttagttgtttaactcagtaactagcactggctggcatatttatggcagggtacatttatagaattaatgaatatacatttatcaagtggctctaagtgctggttagtgtaaaacataatccccagttacaaattgtttatagtcaaggagggaagatagtagagtaaataaacggttaaatcaagtgtgatagagccttgaaggagggttaggagttaacccatggagaatgaggggtaaacttcacagatagaggaaacagcatttcggataaagtgtgtgggggaaattactaataggttgggttatggcacccagaatattaatttattataacaaaacatagcccatcatttcctgtcttaagaagcccctttcttaataatctctataataaaagtgatttttttgtatcattttcccaaggaaaaatattgattttttgggggggcaggcaacatagtctttcaattcctgcttctcttttgtatctccttccttgatttttccttcttattttattttatttatttatttattgagacatagtcttgctctgtcacctaggctggagtgcagtggtgtgatctcagctcactgcaacttccgcctcccaggttcgagtgattctcctgcctcagcctcccaagtaactgggactacaagcatgttgccaccatacctggctaattttttgtatttttagtagagacaaggtttcgccatgttggccaggctggtctcgaactcctgacctcaggtgatctgccccacttggcctcccaaagtgctgggattacaggcgtgagccactgctcccggccttccttcttatttaatacccactttgtttatgcatgctatctggatttttctctatatttttaattgtaaggttaggatatgtgcaaacaaattaggaaaccatctcatagccctgtgccttaaatcattaaatctcattatattctgagatttctttttatgattcttaacatctcaggtttatttttgatttatatcacattatccaggtatttgagttcaaaccttgtttcaacttcttctgtaatggctttcagtacctgtttctttcctgcatgttccatattgctacaatctgttttaagcattcataaccaaatcactctaaaggtatgtaacttgacggagacaagactgaagacagggagactaggagtcttaaaaccgagcatgttgtctttagacatttgtgtctagtaccctatgtttaatcttatttacttaatcttactgctaatcagcttttgactgctagttaatttaatctcctgatattttttcccatcaaaattactaggcgttttttaattgtaaagtgactttaattagattatcccaatatatatcctaataaagagcttggcagagaaaccccagagactagtttatgtgtataaagagaaattttatctgtaggccttgtccttgtagatgtatcatcttgctgaattttaaatatgcctatgtgtcatcacttatcattcaacacatatttatttgatatctacatatgtattttggattaatgtgagtcattttcaagtgttggtttctggatgtcagtggccatttctttctttttgtctgtctatctgtccatctgtccattcatccattgattcattcattcattctcagcttgttttccctagtcagaccatttcattttaaacctcatttaatatatagaaggatgatttactaaatatttcacagttcttaagttacagcagtcaaaagaatgggactcattatgaatttaataactgggggtatataacttcttcttaaataagtttttattaaaaggtataaaacacattttatttttatttttattttttatttttctgagacagagtcttgctgtgtcgcccaggctggagtgcagtggtgccatctcggctcactgcaacctccgcctcccggattcaagcgattctagtgcctcagcctcccaagtaactgggactacaggtgcacatcaccatgcctggctgttttttgtatttttagtagagacggggtttcaccatgttggccaggctggtctcaaactccagacttcaagtgatcccactgccttgggctcccaaagtgctgggattacaggtgtgagccaccatgcctggccaaaacacacatttttaaaaagtatttttaaactatgcagaagtatttaaaatataaaatagaagtgttctctatttctgtgttctccatagggaattgggtataatatgaggtaggactattcatagaggtagaggttaacctacctagatgttgaacatcttttcatgtgcttattggccattcatatgtttgggttttggtttttgtttgttttcagttaagtatctgtagaaatattttgcctattttttaaaaagcaaattggttgtcttattaaggtataaaacttagagaccaaagtgctatatgagctatatgctttgtaaatttttttatctaagcttgcctttcactatgtatatatgtatgtatgtattttaatagatgctgtcttagatgtggtttcctaggagaccctaagataaggattttttttttgttgttttatttcaatttttagcttcagagggtacacaagggtatattgtgtgatgctgaggtttggagtatgattgaacccatcacccaggcagtgaggtagtgcccaataggtagttcttcagctttctctcacctctttccctcctgtctgttgtccccagtgttttttgtttccatctttgtgtccgtgtgtacccagtgtttggctcccacttacacgtgagaacgtgtggtatttggttttctgtttctgtgttaattcgcttaggataatggcttccagctgcatctgtgctgctgcaaaggacatgattttgttctttttttatgtctgtatagtattccatggtgtatgtgtaccacattttctttatccagttcaccattgacaggcacctggattgattccatgtctttgctgttgtgagtagtgctacagtgaacatacaattacatgtgtctttttggtggaacagtttctattcctttgggtatttacctagtaatgggattggtgggtcgaatgggagttctgtttttagttctttgagaaatctccaaattgctttccacagtggctgaactaatttacattcccaccaatagtatgtaagcatttgcttttctttgcagccttgccaacatttattatttttatctatttttaataatagccattctaactagtatcagctggtatcacactgtgatttttttaaatttgcatttctctgatgattagtgatgttgagcattttttcatatgtttgttggctgcttgtatgtcttcttttgagaagtgtctgttcatgttccctagcccactttttaatggaattacttatttttgcttgttgatttaagttccttacagattctggttctagaaggggtttgggaagtcattaacctcttgaaattatttgtaaaaattttgaataggtgtttttctgggcagtggattcaaaacttttatcagactctcaatgaagtatgagaccttcagaatgctaagaactgtccattaaaagtgtcattcagcatacactgttcaattatatttactactcaagactgaaaatgtttgagactctgatagccctaaactgaacaaagtcaagttctaaaatatgctcaataaatgtcaaatagcatttacacatatcttatcatgcatgaattttaatgtgcactacaatcactagccaaaagcaagcaccttaattttacgatgaccttattctatcatccagattgggaaccttgcagacactattaattaatacaagagttaaattgagattgctcctggcaaaccaagttatattgttacacttcttagattacacaatgactcagtgacatctggaacactggtctacagctcttaacccagaaaactttacctcctggttcatactaagctaggtaatcaaatctgtttcctactgatggaagtagctaatttttgttgtctccatgggaaaatattaaagtagtttcttaaataaagtggtactattattcatgcatttgtaagattgccctatatttcagaaatttagaattattttctcctgcctgcctgcctgcctgcctccctcccccgaccccctctctttttctctcctcctttctttcttagagtcacggtcttgctctaacacccaggatggagtgtaatgacacaatcatagctcactgcaccctcaagctcctgggctcaagtgatcctcccatctcagtcttctgagtaggtaggactacaggcatgcaccaccatgcccagctaatttttaaaaatcgtgggggctgggcacagtggctcatccctgtaattccagcactctggtaggccaaggtgggcagatcagttgagcccaggagttcgagaccagcctgggcaacatggtgaaaccacatctctacaaaaaatttaaaaagtagccaggcatggtggtatgcatctgtagtcccagctactcaggaggctgaggcaggagaatctcttgaacctgggaggcgaaggttgtagtgagccgagatcaggtcactgcattccagtttgggtgacagggcaagaccctgtctcaaaaaaaaaaaaaaaaaaaaaaaaagttattatgagaatcagaatcatttatccattttaaaatgtgtgagcacctactatgtgtagatcctaatgattctgtagtacacaaaacaagataaaaatcccgactttcatggatcttacattccaatacaggagataggaaaataagatgaataagctggtcagggaagccttcattgagtaaaaacctgaaggaagtaagagagctagctttactgatactgtgagaaagagtgttctatgcagacaaacagcaagtataaaagccctgagatggaaggaaggacatgttcaaaagcaaaaaagaggccatgtagccagaatacatgaacaaggaaaagacagtagggcatgagagcagagaggtaatgcaggaccaaatcatgtaggtagttgtaggcctagagtgtttctgagtgagataggaagctgtttgaggattttcaacagaaaaattacaagaaccaagggaagtgttaacagtaggttactctggctgctacgctacaaacagactgcagcaaagcaaaggaagcagctgggagaccagttaggaagttatttcaacaaaacaggcaagaatgatgatttggactaggatagcggcagagggaatggtgacaaatggtcaaatctagatacattttggagatagagctaacaagattcgctaatagaccagatgttgggtatgagacagagagaggagtcaagagtggtaccaaggtttttggcccaagcacctagaagaatagaactggcattaactgagagagcaggctgcaggagaagctggtttgtggaggaccatcagaagcacagttagacacataccaagttaaggatacctactacacatgtcaagtaggcagttggatatgtaagtctagaggtcaagggacaggtcttgaccacagatggatttggaagtcatcatcacacagatggtatttaatgccatgggactggacgagattcctgtcctagagaatggaacagaaaagtggagcagtccaaggactgattcttggggcactccaaaatctagagacaagggagatgaaagggaagcaccaagataaatcaagatagtatattaactttagatatgtaaaaagaatttcaaccgttactaaggtcgaattaatgagaaaagtaacagacacaccatcaggaactctagagatatagtgatacaggggtccccagagaaactccgaccagcttgtgcactgggaaaatggggtggagcttcgtgaagttcacgctgtttgcagggaaaaggagcctggcctctgtgatctggtgtggtaacctggggattcaatctgtgagatgtgggcctgttaacaggaacctctcttgctttgctgagttttttccttttcacccaataaaccctgtccttcctcacccttcaaattgtctgtgagcctaattttttgtggttgtgtgtctttagctgacctaagaaaaaagtcctacaataataatattgctcaaatgatgtgttctaggaagattatattagaaggaatactttatgacttgattttttttcatgtcaactaaggaagactaaagactcagcctcctaagtagctgggactacagaagcatactaccatacctggctgatttttttgttgttgtttgtattttttggagagatagggtttgccatgttgcccatgctggtctccaactgctgggctcaagcaatctgtccaccttggcctcccaaagtgctgggattacaagcttgtaatcctggcccacacatttaatagtaaacacttcagattttcagacatgagataatctaatcaacgatacttattagccactggcctattcagcattgattctttagagtcatacaacttacactcccagttcacccaccttgggtgaggccaataattagactcaggtagcttcaagactgaatgaagtggggcaacacttctggatcattaaggatctgctgaccttgattaagaatctgataatgaggaacatcttaacccacctgtgacccacctagataaaatggataaacccatgtaacctggtagctgaactctggaaataaaacttccaagaatcactgggaaatttaccagtgcatcctcaaaacttccataaagtatggtttcaaagaggaactgaacaccttaaagaagctgtgaagacaattaggtgagatagtattccatcagacaatcatttaatacccatacattgtattaaggatactgtgttagaattattgtggaaaattacacaacagatgtttgggttttttgtttttgtttttgtttgacacggagtcttgctttgtcacctaggctggagcgcagttgcacaatctcagctaactgcagccaccacctcctgagttcaagcaattctcctgcctcagcctcccgagtacctgggattacaggcagttaccacaacacccggctaatttttgtatttttagtaaaggcagggtttcgccatgttggccaggctggtcttgaactcctgacctcaagcgatccacccacctcgggctcccaaagtgctaagattacaagcatgagccaccacgcccagacaacatccttaacaaagagaaaatactccagagaagatttaaccaaaaaaagtcacctaaaaatgtaaatataacattaatagatacctaataaactataattatatgcagttgtgctaagagggacagtagatattcaaagtgaatataaaaaagtaaaatgtcatgaagaaagtaagataagagcaaatagcagaggaagagtaaaagtgctgaaaactgagggataaagcatttgaaatagcttgatgttgaaatgagatggggcactgaggtcagattaggtaaaaaaaaaaaaaaaaaaaaaaggcaagctccaactatatgctgcctataagaaatccactttaaaaataaagacagccaggttaaaagtaatacagaaatgacaaaggtgacatcacaaccaatcccagagaaatacaacagattctcagagactattttttttgggggggtttgggggcgggtggggacggagttctgctcttgtcccccagcctggagtgcaatggcacaatctaggctcactgtaacctccgtctcccaggtacaagtgattcctcagagactattattaggaacacttcaagcacacaactagaaaatctagaggcaatggacaaattcctgaaaacatacaacctcgcatgtttgaatcaggaagaaactgaaaccctgaacagatgaataatgaattctgaaactgaatcagtaataaaaaaacaacaaccaaaaagctctggaccagacagatccacagctgaattctaccagatgtgcaaagagccagtaccaatcctactgatactattcccccaacaacaacaacaaaaaatcgaggaggaaggactcctccccaactcattctacaaaaacggcatcatcctgatacccaaatctgacagagacataacagaaaaacaaaactatgggccagtatccctgataaacatggatgctaaaatcctcaacaaaatacgagcaaaccaaatctagcagcacatcaaaaaattaattcaccatgatcaagcaggctttctgcctgagatgcaaggctgattcaagatacgcaaataaataaatgtgatacatcatataaacagaattaaaaacaaaaaacatatgatcatttcagtaaacacagaaaaaaactttcaataaaatccaacatcctttcatgatgaaaatcctcaacaaactaggcattgagggaacatactccaaaataataagagccatttatgacaaacccacagccaacatactgaacaagcaaaagctgagatcatttcctttaagaacagaaacaagacaaggatgcccactcacactactcctattcaacatagtactggggaagtcctagccagagcaatcaggcaagaaaaaaaaaaaaggcgtccactcaggaaaagaaaaagtcaaataatctctcttcactggttcttgtaatttttctgttgaaaatcctcaaacagcttcctatctcactcagaaacactctaggcctacaactacctacatgatttggtcctgcattacctctctgctctcatgccctactgtcttttccttgttcatgtattctggctacatggcctcttttttgcttttgaacatgtccttccttccatctcagggcttttatacttgctgtttgtctgcatagaacactctttctcacagtatcagtaaagctagctctcttacttccttcaggtttttactcaatgaaggcttccctgaccagcttattcatcttattttcctatctcctgtattggaatgtaagatccatgaaagtcgggatttttatcttgttttgtgtactacagaatcattaggatctacacatagtaggtgctcacacattttaaaatggataaatgattctgattctcataataactttttttttttttttttttttttttgagacagggtcttgccctgtcacccaaactggaatgcagtgacctgatctcggctcactacaaccttcgcctcccaggttcaagagattctcctgcctcagcctcctgagtagctgggactacagatgcataccaccatgcctggctactttttaaattttttgtagagatgtggtttcaccatgttgcccaggctggtctcgaactcctgggctcaactgatctgcccaccttggcctaccagagtgctggaattacagggatgagccactgtgcccagcccccacgatttttaaaaattagctgggcatggtggtgcatgcctgtagtcctacctactcagaagactgagatgggaggatcacttgagcccaggagcttgagggtgcagtgagctatgattgtgtcattacactccatcctgggtgttagagcaagaccgtgactctaagaaagaaaggaggagagaaaaagagagggggtcgggggagggaggcaggcaggcaggcaggcaggagaaaataattctaaatttctgaaatatagggcaatcttacaaatgcatgaataatagtaccactttatttaagaaactactttaatattttcccatggagacaacaaaaattagctacttccatcagtaggaaacagatttgattacctagcttagtatgaaccaggaggtaaagttttctgggttaagagctgtagaccagtgttccagatgtcactgagtcattgtgtaatctaagaagtgtaacaatataacttggtttgccaggagcaatctcaatttaactcttgtattaattaatagtgtctgcaaggttcccaatctggatgatagaataaggtcatcgtaaaattaaggtgcttgcttttggctagtgattgtagtgcacattaaaattcatgcatgataagatatgtgtaaatgctatttgacatttattgagcatattttagaacttgactttgttcaatttagggctatcagagtctcaaacattttcagtcttgagtagtaaatataattgaacagtgtatgctgaatgacacttttaatggatagttcttagcattctgaaggtctcatacttcattgagagtctgataaaagttttgaatccactgcccagagaaacacctattcaaaatttttacaaataatttcaagaggttaatgacttcccaaactccttctagaaccactattctgatgaccgttctccctgctttgagagaatgcctttcagagacactattgtactagtacaaccttgattatctggtatgtcaatggaaccttttagaaaaaaacagaattttctgtatgccaacataagtacatgtagaaatgtttatgcagatggtattttactgtgtgtattttttgacagcttactgttccatgttagtatagacagctgtacttcgttcatttcaacttaattcctgtattttgcaaattttcaaaaataaaatcagtgtatcaggaagttgcccatatgaaacctgaagcaaaaaaatgctttagatatcttaatcacaacaactaaagatcacagggtacatgtcttaccatttatagtataaaactgaatttccacattagcaaaagattgaaaacaaaaattaacttgtgaccaacttgccaaaatctgacctgaaggaaatttttgaacgtaactcatcacaaaaacacatgtactctgtgcagaaatgtttcttaaatcagtaaagaaaataaggaaatgcagaggagcaaaaagaattctccatggtgaaatcactcaaaaactatcactgctgacaatgcatttcatttctctatatctatacataagttttgttagtttgcctatttttacatggttatcatcatactgtatatgtaaattttctcctgtgttcttccttaatattttaactactttttctatattcctttgggacagagtgctagaagaggaattactaggtcaaaaattatgaatatttcttgatacatcttatcatactgcttttcaaaagtattttgaagtaaaagtttatacttttaaccagtcgggtctcatactgctaatttcaccacacctgtgcttggattgggcattatgatttttaacatgtttgtgatctcaaaaacaaaaggttcctcactgttctgatttgcagtccctccattttgcatgacattacacatttttccacagacatattactagttttattttatattaaaacatgattttgcatttatagagacctccatttagaggacaatagccccttgtaaataaaacttttaacagaacacgttcatgttcacgatgtggtgtttctttatgttttggaagcctaaatctcaccagatgtgatatttcttcactactaagacaaaaaaccattagtttttatcagaatcagtcatctgggttaccatgttgaaattatcctcaagatatgaaagaaaactatttcaaatgcttaatttaattaatagtcaacaacttagccacgtgtggtggtgtgcctgtagtcccagctactaggcagggtaaggtaggaggagcccttgtgccaggagtttgaggctgtagtacactattattgagcttatgaataacctctgcacttcagcctgggcaataaagcaagacccagtctctagaaaaaaaaaatgattaggtaaagaaaagaaaacaaattttcacaatgggagaatgtggcttattactaagaaatggctgatacgtagtttcattgattttttaaaaaaatagttccaatagcaaaataatcatagaagttagatttttatcaggaataatttttattaaaatcatcttattccaagtattttcttcttttcaaggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctcatttagagaaacctattttcttttttctttttctattttagtgtttcatttatgtgcggtctccaatttaggacttttccatagtgccaaagccatacatattcagtagaacatcaataaattacatcagaaattcaacactttattataaaacgggcttcgtgttagataattttgctaaacagtaggctactgtaagtgttctgagcatatttaagacaggctagcattttcaatttacaatattttcaactgatagtaggtttattgggatgtaaccctatgataagttgagaaacatctctttttgtgtgtctactgtgatttaagtatttttaatcatcagccaagcattgttagtagtataaatatgattaataaaaatgtgcatggctttcctgaaggagattttttaattgcctttgagaataaactcataaggtctaccaagaaaataaatgttatgatgtttcagttggcttctaggaaataattaaattagtgatattttaatcaggttttactatctgctaggccccttccatcaattcttattaaattctcaaaataatcctttgaaaagggagtataattacattttacagtgactcgaaccttacccaaacaagtgggagagccaggagccaaactatcaggctccaaagcttttttttagtgcatcacaatgacaaaggggtggttttctttcacccaagaatgtgctttcctggaaatttttctagatagaatattatgtaatttgttttgaaggttttttttcctgactgtcttaaagattatgctagctttagaacacatgcaaacagctgcagctctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtagaaagttgctttatttaaatttgtactgtagaatgtttgtgatacagtatttgtaaaattgatatgaaaaataatttctcaaagtctattgtttgatctagttattttaataaaggaactctagaagtttcaagtggccagtgaagtgtgaggaatagagagtaaaggaaataattaataatggtgaccctctgttaagtggtttactttttccattaatataaatttcatttggaaagattaaaaaaacaagtttgattgaacttgataaatcagaaatatttaccagctttgtcgatggtgtattcttgaaaaatgtttggttttctttcaggttgacttatatccaaaattctacaaattcttagctatgttataaatgtagaaagaagtgaaaaatcaaaatatgattatgaagattttcttctcttccgagtacaaagctctgctaaataaggatttacccaagatgcccacatccacatacttatgtgtcagtgctttggagaattaactttgactttattctactggaagtatagattaacactgtgctttctgggattttgcttttcatgggttgctgatttttaattttgctaaataagcacatagtccgtgatcaccagcatcacctgccctctgttcctcccccgtcccccagggataagaacctgttatccaccatcagtaacattttatgaaagatctacttatttgtctgttttgcagacattttaaaattcgtaaagtgggatgcttctttaatttaaatacatttagcttcatgaaaaactcactacacagttcttgttcaagcattattgggaaaccaccagagggcactctcacccagggcttaatttgaacatctcgcccaaaagtgacttttaaaagcacttaattagcagagaatttggatgttcattagttgagaatgactagtagaataaatggtaatagtgaaattaagtgctggaatattctgagtagaccaatagcaaaaactgatttttttttttttttaaagaaaaggtcttgctgtgtcgcccaggatggagtgcagtggcacaatcacattgcactgcaacctcaatatcctgggctcaagcaatcctcccaccgcagcctcccgaattgctgagactacacatgtgtgctaccatgcctggctaattgttttaattttttttatagagacggggtttcgccatgttgcccaggctggtcttgaactcctgggctcaaagcgatccacccaccttggcctccaaaagtatgggattacaggtgtgagccactgtgcccagccttattttttttttttaagataatattgttaacattttgtatttctctgcataaatatatttcaaaaataaaaatagagctcataatatatgctgttttgtaatgcttttttcacttaataggaattttttccgtatcattaagtactctgatttaatgggtgcatattattctataatctggcttgtcataatttaattaactccctgctgttagacaaaatcattgtttctgttccatcttgtgaataatgctgttattaacatcctggtggattattaccattttctttttttattttttttttaaatttatttcttcttttttttttcttataatctcatcagaagctggcaagatcattactgttttcttagatttgtttctgtaagtgcaatcgttgaatcaccatgtccggcatccatgtttatgtacatttttaaagtcagtggtttaaactgtatactttttgggttttggagatggaggtttgctctgcccaagctggaatgcaatggcgcgatcttggctcactgcagcctccacctcccgggttcaagtgattctcctgcctcagcctccttaagtagttgggattacaagtgtgcaccaccatactcaggtaattttgcatttttagtagagacagggtttcaccatgttggtcaggctggtctcgaactcctgacctcaagtgtccacacaccttggcctcccaaagtgctgggtgggattataggtgtgagcctccatgcctggcctaaactgcatactcctaacatcagtatatagaaatattttctctttagttctattaaaattttaaaaaatctttatcaatttagtaggcaaagactggaaaatgttttaatttgatcagccactttaatgtatgtctcatttcaaagcatataaagtatacaagtttcaggtcctagcttaaacctataagaggccttattatgggcttatttcctttgcagccctttaccataatgtgtttcttctacctcccctgcacaacattgtttatatgccccctaaaatgtaacttctttagattctgttgttacgtgcaacactgtatatctctccatagcacttaatcagagtttgtaattaggcatctttttgtgtgattatttggtaaatgtccatatcccctactagcctataagctccatgacttctaggtaccctgtctgactacgtgtatcactgtttctaccgcctaacattgcctagcacattcattgcttcacaggcatctgaatatggttttataaaatacattgctctagtgcacaggattttaagctaaggatttcatgaatgggatttggggtaggggcatctatgaaattcctgaaattgtgtagaattttgagaatatgtgttttcctggggatagagtatgtagtttctcagcaactcattacagtctgtcacatcatgccctaattctacttgcctgtagctaaacacctaataacattagaactgaaatgatagtgatatgcaagatagcacgtgtggtttccacatattctaagaggcatcttcaattagattccaaaaatttttaagaaaaaaagatataatgtgccatcattttggatggttctgggcacttcaggtaaacccttactcaaagaatactttttcagtttcaatgtgtatttttaaaatttccagaagatgagttgaatatcagcccacaaacactggtagtaagcaaactattttatttgctaaaggcataaataaatgtctcctttgcttttaggcaaagggaatgcttcttcagatttttttttttccccagaagttcaaaataacttgctcatagtcttcccaaaataattttcaaacattctaacaccaaagaaagatactcccaattgagctcagccatcagcctcctactattttttaatgtgctgtttaaccttgtgaatgtgagaatattttgaatgcactgggaaggaatactcaggaacaatatgtaatgtgctttctagttttgcacaaaggcattcattttgatttagtaacaacctcatacttacatagcatatccttctgcagaaatgcttcacagccatgactgcttgaattcttgtcatgttgcttgtaaatgagctcctgtttttagatggagaaatggaggcagagtctcacaattacatgtgagaatagcaagtagaaccttatgattacttctgagtcttttttttttttttttttttgagatggagtttcacttttgtcacccaggctggagtgcagtacagtggccagtggcatgatctcagcccactgcaacctccgcctcataggctcaagcaattctcctgcctcagcctcccgagtagctgggattatgagcgtgcaccagcatgcctggctgattttttgtattttcagtagagatggggtttcaccacgttggccaggctggtcttgaactcctgacctcaggtgatctgcccaccttggccccccaaaatactgggattacaagggtgagccactgtgcccagcctcttctgagtcttcaattcagcaagaatgtctcttttttttttttttttttttttgggacagagtcttgctcttgttgccttggctggagtgtagtggcacattctcagctcactgcaacctccacctcccgggttcaagcgattctcctgcctcagcttcccaagtagctgggactataggcatgcaacaccatgtccggctaattttttgtatttagtagagatggggtttctccatgttggtcaggctggtctcaaactcctgacctcaggtgatccacctgctttcgcctcctgaagtgctgggattacaggcatgagccaccacgcccggccaagaatgtcttttctttataatgttgtctctaagcatgtaatcttttcggcaaattttattaagcacctatagagttcaagccactgtgggttcaaagatagccctcattcctgattgacaaagtatcttgctatgaccatcccttctttcccctctagtcaaaattagtctcttcttcactcataatgcaaagtacattggattactattatgccacttacttgaataattgtcttgatgagtaatatatgtagtcagtaacatggttaagtgtggcaatttggattgatcccattggacttttcaattgctgcatccaggtgtaattaccataagagcatagaagatagaatcgtaaagctgaaagacatcttaaagatgatttttggggactgatttggaaacagatccaaagacactaattgacttgcccaagatcacagattgtggcagaaccaaccaatgtcttttttaaacattaaggacatcttatatgtatatttatgcatatacatactgatgaaatgtgcctttagcaatagatgtgtccagtgatgtactaatgaagatttaacaactggttctaacttgtaatgtttgccagtttccatgactgggtcttacaagttgttgtgcactgactccatcattccactggatgtgcccctgaaatcatatatttactactaaaaccattagattgtttccttgttccagttatgcattcagagacactccaccttattttctgattacatttgcagggagaaataactccttacttgtcagtttcagccttcacttttagtttctttttcttttcctttttccaacccagtataccttagaaactttcagtttcttttaaggatttaataacttgcttataagtgtttaaaatgacttaatgggttctatcttttaagggaactttggatgaatccttgaatatcagttatctattgccaattaacaaatcaccccaaagctcattggcttaaaacaacaatctttcattagtttgcgttcttccaggtaattcttatagtctggatccagctcagcttatcttggctggacttgcccatgcagctgaggtcactagttgggttgttgaggctggctagtcctagatggtgtcactcatatgtctggtattgagtgactgtcacctggggcattagggggactgtgtctctcatcatccagcaagctaggcctggattcttcacatggctttaggatttcaagagtatgagattggggctgggcatgatgactcacacctgtaatcccagcactttgggaggccaaggttgggggatttcttgagcccaggagttcaagaccagcctgggcaacatagtgagagcccatctgtaaaaaaaaaaattttttgagatggagtttcgcccttgttgcccaggctggagtgcaatggcgcaatctcagcccaccagaacctttgcctcttgggttcaagcgattctcctgcctcagtctcctgagtagctgagattacaggcatgagccaccacgcccagctaattttgtatttttagtagagatgggtttctccgtgttggtcaggctggtcttgaattccccacctcaggtgatctgcctgcctcagcctcccaaagtgctgggattacaggtgtgagccaccacgcctggtcttctacaaaaaaattttaaaaaattagctgggggtggggagggtggggtggtgctgcatgcctgtagtcccagctatttgggaggctgagatgggaggattgcttgagcccatgagattgaggctgtagtgagccatgattgtgccactgcactctaggctgggcaacagaacaagcacctgtatcaaaacaaacaaaaaagtgcaagattggaagcttcgaggcttcttgaggcctagtctcagaactggcacaatatcacttcataaggctatctcagattcaagggagtaagaggagagatgctacctattaaaaggagaagcagcaaatactatggccattctcttcacaatagttgtcaccaaaacgtaatcgatttgtttatgggtttacattgtcatgtctccacaggacaatgcacatggtatgtttgtcagaacccagttggagttttgtttcccagcatccaaaggaaatccctaactttcattttttcttcccgtaagcagccccgaacacttacttataagccatctctacctgaattagcaatcatggataagctcaataactgatcatttccttatcagtttaaaccatatatattttaacactgtctctttttcacacacactagttagctaagaatgagctggggggctgggcgtggtagttcacacctgtaatcccagcactttaggaggcggaggtgggcggatcacttgaggtcaggagtttgagaccagcctagctaacatggtgaaaccccgtctctactaaaaatgcaaaaattagctgggtgtggtggcaggcatctgtaatcctagctactcaggaggctgaggcaggagaatcccttgaacccaggaggcagaggttgcagtgggccaagatcacaccactgcactccagtctgggtgataaaacgagattccgtctcaaaaaaaaaaaaaaaactgccaaaacgctttttgcaaagtggttgtaccattttatattctcaccaccatgaatgaaagttccaattgctatattcttgccctcatttgataatatttttagttttagccattctaatggatatatagtaataatttgatggttttaatttgcatttctctgatgatcaataacattaagttttgattcaggtacttgttgggcactcatatctttggtgaaatatctgttcaaatcatttgctcttttttttttcttagcacttaaaaaagactttttgccaggcacagtggcacatgcctgtagacctagctactcaggaggctaagacaggaggatcacttgagtccagaagttctgggttgtagtgagctatgtcaatcaggtgtttgcactaagttcagcataaatgtagtgacctcctgggtcactgggacccagagttgcctaaggagcgtcagaagtggagcaggtcaaaactcctgtgctgatcagtagtgggatcacacctgtgaatagccactgcactgcagcctgggcaacatagtgagatcctcatctcctgaaaaaaaaaaaaaactttagtttttaaaagtagttttaggttctgagcaaaattgagaggagggtacagaaataacttatatatcctcagtgctcccctcccccatgcctccctcatcaccatcccccagcagagtggcacattggttacaattgataaacctacactgacacatcattatcacccaaagcctattgtttccattagggttcactcttggtgctgtacaatctatgggtttgaacaaaggtacaatgacatgtatccatctttatagtcatgcagagtctacactgtcctaaaaacccttggctctgcctcttcgtcgtgtcctccccactgacccccggctaccactggtcttttcactgtctccgtaagtttttcctttttcagaacgccatatagttggaatcataaagtatatatagccttttcacattggtttctttcactggataatatgcatttgtttcctctatgtcttttcacagtttgatagctcatttctttttagcatcgagtaatactccattgtctgggtgtacaacagtttatccattcacctgctgaaggacatcttggttgattgcttccaagttttggcaattatgaataaaattgctatagatatccatgtgtaggtttttgtgtccatttaagctttcaactcctttgggtaaataccaaagagcacaattgttggattgaatgctaagagaatgtttcgttttgtaaaaaaccaccaaactgtcctacagagaggctgtaccattttgcattcccaccagcagtgaataagggttcctattgctcaacatccctgtcagcacttggtgttagtgttctgaattttggccattctaaaaggtgtgtagtggtgtctcacttgttttgtgtttttctctgctcagacagctcatccacatcacatttattttaatttgcatttccctgataatatgtgatatggaacatctatttactcattattttttcttcttatgattgaagttataatatttctttaaatattttggataaatcttttgtcagatatatgcactggaaatatttttatgggggaccagtgttaagattagatctgtttaaagagaaaggagagaaagtttcaggcagggaatgcaatcgatgtgaaggtttggggtaatttgtttcatttatctttaacaccatgttatggatggcaaaataacttcactggctttttttatcaagaaaagacttaccttttctgaatgcaacagtattagtaaacctaatggtgacaataaaagcgattctgaataaatgaaaaccaatagattgttctagttttactcataaatataattcttcatatactgagttcagttttttagccataaatgaagacatgggaaaaccataacatgttatttgctgagaagttctggcaaatgaagcaataaaataatcaaaactaaatcaacatttaaatacagaacataaagagataaatccaaaaccagaagatctctttgaaagaaaaacctaagtaattaaaaaactgaaagcacagatattcattatttcacaaataaacgttaatgctttttagacatctttaagcaactttagattgctaaaactaaaaaatgcaattaagacaataatcttatatatagacaataattgtcttaataataatcagcatcaaagattcttagaaatgttgggagactgtgtggcaaagaaagtacttcaattaccagttaccaacacacaacaatttgaaatatccaggaagatcaacccatagaacaaagaaagctaataaattaccttttcttgcaattggtttgatgtaccattaatatatagatattactaatatggcaattagtttatatgctatttgaatatgatagtaatatgaaggaagattctcttttttccacttcattgccaacaaacagctaactctaaacaacagtaaagtgtggaataaattactttgttaattaatgtggtttgaagctttgtaggaatccaattggatggatagcagcagtggtaagagaacattccggaataattacctaaattaaggagcttgccctagaatgtaaatcaacctactatatctttttatttgaaaaagtcttggtagaaaaagcatatcaactgaactgtacagtgtgttcagtgacttagtaaagaacataacttgtgtaaaggctaatgcaataagtttgagattgttctctttatgtaatagtttggaaaacaaacaactgtgattacatttagagatatgatgattatctagagggaaagttctgttgagcatatttgaacatttaattattgctgcaagaagccagtttggtcccagctttataaagatatacattgggctgggtgcggtggctcatgcctgtaatcccagcactttgggaggccgaggcaggcggatcacctgaggtcagaggttcgagaccagcctggccaacatggtgaaaccccatctctactaaaaatacaaaaattagctgggcgtggtggcacacacctgtattccttgctactcgggaggctaaggcaggagaatcgcttgaacccaggaagcagaggttgcagtgagccaagattgtgccactgcacaccagcctggataaaaagagtgaaactctgcctcaaaataaaataataaaatgaaataaagatataaattggccagctagagttacctgaagttactatcttcaattatctgaagacagttctgatagcttcagaattctttcatacaaggcaggaatgcaacttgttttttaatggcagataaaatcaaagagcaaaagcaaaaggtagaagcttgaaagaccagagttgctacagattgttattacatgttccataatttaacaattgtcattgaagttggtgattgtcttgatattgcacatctgtaagaagtaatcaaactattgtgaatttgatagaatgctttaagttttattttccaacaaaagaatgtctacatacggcaaattcatagatctggaatccatttatgtcatcaaaagaggatttaaatttaattgtaagcttatatgatacattgttctaactggcaactaatgaaggattaaaaatgaattttgaaaataccacaccacttgcttcattttggataaaagttaaaagtgaatattctgagtatgctgaaattagtttaaaaacttttttttcccattccgaccattatccctttgtaaatctggtttcatcttatgaataatattttttaaaaaccatggaaacagtttagatatacatcaatccatgaaagtagtagtattgtcaatctaccctggattacatattttaacgagaaagaaaccagctcatttgtgacatttagaattttttttttttttttttttttttgagagagagggtctcattcattttattgcccaggctggagtgcagtggtgcaatcgtagctcactgtaaccttgaacttctgggctcaagcaatcctctcacctcagcctgcagctggagcttcaggtgtctgccatcacgcctggcaaatttattttttgtagagaccaagtctccttgtgttacccaggttggtatcaaactcctggtctcaagtgatcctcccatctcggcccccacaagtgttgagatgacaggtgtgagccaccttgcttgacctaaaaacttttgaatattaatatgcattgtgtttattcaaagtatatctaatggtctaataaacagaatcactacttcaattataatcttcagttataattgaagaatgacaaaaagttgagttatagaaattatattaatcttaaattcacattttcagtgaaagtttttaaataattttttctctttccgttttatgtgtgttccaattctatttattgaaatttaattttatatccattaacataattaaaaattggggcttttaaaaaatgtttttcattctactaatttcattttataatttataaaagtactagaccacaatggattaaagaactatcctttcatcacagatagttcaatgactcctgtttttttttagaccgagtcttgctctgtcaccccagctggagtgcagtggtgtgatcttggctcactgcaacctccgtctcccaggttcaagcaagtctcctgcctcagccttccgagtagctgggactacaggtgcccaccaccacacccggctaatttttgtatttttagtagagacggggtttcaccatgttggtcaggctggtcttgaactcctgacctcatgatctgcctgcctcggcctcccaaagtgctaggattacaggcgtgagccaccatgcccagccaactcctgttttatagtgtactttctggaatattattcagctttctcttgaattcttttagtaactaggagttcactacgtttccatggacctaactccaataatgattggacagttttctccctctgctttttctttctttctttcttttttttttttttttttttgagatggcgtctcctctgtcaatctcggttcattgcaacctccacctcccaagctcaagcgattcttgtgcctcagcctcctgagtagctgggattacaggcacccaccaccacacctggctaatttttttttttggtagagacagggtttcaccatgttgaccaggctggtcttgaactcccgacctcaggtgatctggctgccttggcctcccaaagtgctgacattacaggcatgagccactgcacctggccattattggacagttttaatggaaagtgtttccttatattgagtggaaatcagtctgcttatggtttataatcctcagacttgattctccccctgaatctatatgaaataaatttactcctatttgaaaatatttgtcatattccttcttatttttctttaagctttattttttcttattatccatatgacatgtttccagaactctcccttatcctgattgtcctcctttagacacatgcttttaatgatatatttcttaaaatgtattacccaggacaacatatttttttttactgtggacagtatacttttacgaatggtgccaataatgcattacattttttagcagtcatgtcatcctcttgatttgcattgagtcatcatttcttaagagggaatcaggatatcaaaatagtctccaaactcagctgattccttctgcagatacactctccacccttcttgattccttttcgggagaaaagaaaaaagtttattttcattgctaacctcactgatttttaattttaccatttaaatgttagtaacagctggtaatgtaaccaaagaagatttttggcaggggatgatgcattcagagccttcactctggctacagggagaccatggaggatgggctggaacggaagcacgatggactcctgggcacaccgttaagtgactgatggagtcattcagctgacaaatgataatggcctggattaaggaaggagaagaggggaccaagaaatgccagagatacataggaagtaaaaattaataggccttggcaactattttttttttttttttttgagacagagacttgctgtgttgcccaggctggagtgcagtggggtgatctcggctcactgcaacctctgcctcctggattcaagcaattttcgtgcctcaacctcctgagtagctgggactacaggtgtgcatcaccattcccaggtaatttttgtatttttagtatagatggagtttcgccattctggccaggctggtctcgagctcctgacctcaagtgattcgcccgcgtcggcctcccaaagggctgggattacagacatcagccactgcacctgggttggcaactaatttacacggaatggcagagagtgattaatgaaaaagcggggagaaaagctgctcttgacatctgaaagctgacttggcattcacagctaggctatgttattttcctattgggcataagtctcacagaataccaacattaaacaagatgactctgaaaccttaataaagtgagaaaaaacaagtccactttgtaattttgtctaagcacaggcaaaaagagggtcatggtgccatccagaaaataccaaaaatcaccctctctcagctaaaatgagcaactgctactttaccagtgacagctttgtcccagctctagtctgccttccctatagagaagatgtattgagataatcatgaaattctccttctttctgatagtatccaatctggagcaaacccgtttccttagaccctctcccaatcccaaattctatactaggttcttctaaacactctcatactgagacaccccatggttccctatgttgtgtgttcttctttgctgcaatgagtaataaactcaacttgtttaactagaggtgtgttcctggtggtctctggttaaagagcattgatgttaagaataatttcagagtttcttgcttggacagtcaggtgtgagtagtgccagtaatagaaataaagaatactggagaagaagaaaatgtcttcagtttttaacaggttacctttgagatattagtaggttactccaagtggagatatccaagaagtaattggatggatttatgactctggagctcaagagagatgtctgtgctgaatctatctatcagtcatccatgtacctacctacctacctgtagctacacataatatactcagaaatgtacatatttgagagcttttttttttttaaggcaggatctcactcttgctcaggctggagtgcagtggctcaatctggcctcactgcagccttgacctcctgggcccaagaaatcctcctacctcagcctcccaagtagctgggactacaggtacataccaccacacctcgctaatttttgtgtttttagtagagacggggtttcaccatgttgcccaggctggtttcgaacccctgggctcaagcgatctgcctgcctcgacctcccaaagtgttgggattacaggtgtgagccgctgtgcctggcccattgtgtgtataatagctgaagctgtaggattggcaaagagcccccagagaaggaaaacaatgagaaaagaaaagggctgaggacacggcagcaaggaatatcccatatacttatgggatgagcagaaaatgagatacagaaaatgagaaaagactcttagaaggagctgtcatgaggaaagataatcagaagcagaagaccagatgttagaggagagagtttcaaggaggatgagattagtagtttaataggctgctaaaaagtcaagtaagataaagtgcccttcaagctatttgatatatatccccatcatttttcgagcacctctgttttttggcacaataagatgttcaggctcctcttatactttcctgtcctagccctggaatcagccatttctctaaggagtcctgtatccttttagtggaaactggtatctagaaaccaagatctggtgtagtattcctttcaagaagcttgtctgtgaagggttatggctgtatgatcacacgtgggactggaagtacagaggggatacctggctcaggtaaagatgaacaaaacattgctgggcatggtggctcatgcctgtactcccagcactttgggaggccaaggtgggaggattgcttcagcccaggtgtttgagaccagcctgggcaagagagagagaccttgtctctacaaaaaataaagtagccaggcatggtggcaggcatctgtagtcccagctactcaggaggccaaggtgggaggatcccttcagcctgggaggttgaggttgctgtgacccgtgagtgtgccactacactcagccagggcaacagagtgaaaccctgtctcaaaaaaaaaaaacaaaaaaccgcaaagcagagatagtatgatcagaactgaagcttaaggccaggcctagtggctcacgcctataatctcaacactttgggaggccgaattggatcacctgaggtcatgagttcaagaccagcctggccgacatggtgaaaccccttctctactaaaaatataaaacttagcctggcatggtggtgcacgcctctaatcccagctactcggaaggctgaggcacgagaatcgcttgagcctgggaggcgaaggttgcagtgagccaagattgtgccactgcactccagcctgggcaacagagtgagattctgcctcaaaaacaacaacaaactgaagcttaaggtcagaagcaggtttgaagatgatttgaccttgagtcccagatagcgaatagagctcctaaggttgggattcattttttaagaaatgtgggtgaagctctgcttctcaatagacatgaagtgatctcagctgaggaaagaggccatctgcccaggctgggcaccaagcaaaacctgaaaccacctttgaaatgtttgggaaagctacctgtgccaagaattttatcctggtgtaaaagctttgtataaacaaagcaattataactttgtttattaaagtgagaattattattattgttattatttttcttttgagaccgagtctcgctctgtcgcccaggctggagggcagtggtgcaatctcagctcactgcaggctccgccccccgggttcacgccattctcctgcctcagcctcatgagtagctgggactacaggcgcccgccacctcacccggctaattttttgtatttttagtagagacggggtttcaccatgttagccaggatggtctcgatctcctgacctcgtgatcagcccgcctcggcctcccaaagtgctgggattgcaggcgtgagccactgtgcccggccgagaattatttttattgactttaatatttttcattattaaggaaataatggaatgttttagttccattatttgaattaaaatcttccaaagaagattgaagctgtacttcaatcttgatcccaacttgatcccaaccttttttgttctggaaaatgcccattttcttactgcaaatgcatctcaaggggattccctcctcctggccatagtagattggactcgaggtgagtaactatattaagtagggctgacccatttatggtgttttgtttcttggtaagcacatgactcacactaggccagtgagggtcatttctcaggatttgaaaaaccagagctggcgcaagaggcttattcgttttctaggaccaacagagacgggggacattaggtttgtttgtggcgtagttcctaggaagaagccagtgcaagagaaacaagagatgaagagagaagattccaggctgtgtctgaatctctgattcctggtctgtgagccccgggtgtgctcttgccatctcagaatcacgtgaacctctcttccaacacagattccttttggcctctgctagtttgactttgcgtttcaaccacatttcaccaaaaaagagagaccttgctcataaagtgacttcaaataaacttggttttaatttacattgtcaaaagctaacctccttttgataagtatctccagtatcccacctaaaatgccaagaaataaagtgaccacaaatggctgatgtgtttttcctaataaaagcagcaattgttcaaaataatttttttctatctatacctaatattagaacatttatgcaggcaaccccccaaggatctctttcttgtgaatcacattagtctaaattgtatttccacttctctccttcctatcacatgattgcattgaatgtatattatcacttcattcaaatactttcttctctaaagcaacaagaagtaaatcatttgtaagaaaaagtacatatacattcttattttcttcccttaagttacatataatttcccagatgcctactcaaacttatagtatctctaaccacgacttattttaataggttggactgtccctatttgctcttttagatttccaggtccttaaggttaagcagaaaccctaatccttgtgtttatccaggcaaatgctaatttcaaagacagctatctaatctggttagcggttttgttctttgaaaataatcctgggtttgcttataatagcagggttaatcattgtaccgatagtttttggtttgtttttgtttttgttttgtctataccttcatagagaatcagtctcctattttgttctgggattcacccgttccccatttccagtctgagatctcagtggtactctgaccccctgcattaggaatagagtcatggcccagggccaagaaaacctgcacatgtgttcctgaagtgggcacatgacctaaaccagtacaattaggggacatttccagactttcatgaatgccaccaacagataagttttttctctctgctggacatgaccttgagggactatgaggctggcatttctgcagccatcttatgatcatgaaaagattatctgagaatgaagtcagcccaaaaggcttctgagagatggagaaaaggaaaacaggtcctaattatttgctaattacctaagccaaaaaagagacttttttgctaaaactcattcaaatggatctttgttacttacaaccaaaatattcttaactgatattatacttatcatgtgaaattaaattgagtaagaagaaaaagtgggtaaatacatgtgtatctgatttttttaaaaaagaataagatctgagaaatgaatgaaaactcagaatctattggccgtatcagcttatacctatatgtttgccacaattatttatctggaaagagaaacaaggctctgagcattttcttctaagacattcagtcagtgtcttgggacatccagagttggagagatttaacccagtcccttacaatctctatggcaacaatctactgcaataaaacagttgttctgaatagtgaccttgagatgcactaaagccagtcgtcagaaaaagatgcatagtcttacagaattttagatcacctactgcttagtaatgccattttcaacagtatagattgaaatacatatgtagggctgaaactttaaataactgaaagattaaatatatgaaaacaatggtttttccaatgccttcctttcttgatgaaaatcccttctttataaaaactactacacaagagagtttttaccatggctgggccttcttaggtcttggagaacatagaaaactaataaacactacctctctttccccatcctataactcctatgctaggactggaagataaacaaatctttttattttttgaagtaatctttaagaaatgtgatacattttctttcaaattacccagaaggaagcatatggagtagaaaatggaagaaatttacaattagcagattcatctgaattctatccctgtccataactggaagaactactagatgtagttctaagttagacgtagggtaagccccactggggtatggcccagatctgtcttaattcattggcatacaaccaatgccaagcacagtgtctggcacatatactaggtgctcaataaattttctttaaataaactcatatatggactttgcatgagtttcttatcctttcttagtgaggttaactgctgcaacaaccaccaaaaccgcagtgccttgatacagtaaatgtttacttctcacctttgttacagtctaactctggccagtgaatggggagaaatgtgtatgctccacagtgccattcagggatacagcctccttccaagtggtagtggtggcttccccattccttggggccgtgggctcctcttctggattgagggcacccagccagctggcaaggaagaaagaatgtggaaaacagaggatcatgcgctagctttcaatggccagccctggggggggggactcaaatcacttccactcacatcccattggtcagaacaaagttttatgcaagctcaccgctgcaactgcaagacagctgggaactatgctctagcggtgtgccgtggaagaagagaaactcaaacactggtgaatgttagcttgcttggcttcactctctgagccccatattcttttgaaagtggaattaataattgctatttgccagcactttatgaagattaaatgaggcaataaatgtggaagcacttgataaagtgccaattaaatcttagctataaatattcctgggtaatttgcttggttacattacctctgcacatcatctgtgaaatgtgtaggctgaaatgtactctaggagtcctttccagctctaaaatgcttagattctgtgtttcttttaaactttcagcaagtgtctttgaaattttgtcgaccctttaggatcctacatgtgattctacaagctaaccctcttgccctcaaatcctctttcattgctataattttgcccgtgatctttttgagacataacctgactctgttttatctcattttaattctgttatttccaactatagattaaaggtaatctttgccttcctattacattagccagtttcagtctgttagatttcttttttcttttttcttttttttttttttgagacagtctcactctgtagaccaggctggagtgcagtggtatgatactggttcactgcaacctctgcctcctgggttcaagcgattcttgtacctcagcctccgaatagctaggattataggggtgcactaccatgcctggctaattttttttgtatttttagtagagacagggtttcaccgtgttggccaggttggtctcaaactcctgacctcaagtgatctgcctgccttggcctcccaaagtgctgggattataagggtgagccactgtgcccagcctggtctgctagatttcttaatttcagaaggaaattgtagctgtgaggaaaagaacccaaggagatatttgacagatttgaaatattaaaaacaaatatgattaatcctgccttgaaagagtctatataatagaggtttggttcaatctgtctttttttcctgtggcttccttagttgtcttaccccagcttcccagccttttttctccagctaaatgcccctgtccattgacagctgttttgaatggttcctggggagtcagccaggtgaagtctgaaatcttctatattaaattcaggcgaggggctgacattcattaacgctcaagggtatactggctcctaggtcattcacataaaggagagaaactggtctatccacttccattctagccctttctaatctttctctagaccaaaatcagggtgctctttttgcggtgcaaatctggtgtcatttctgtgctttcaacactttagcatgtgtatttaactttttaaaaactttttgatatagacaaataataaaatgcacagatcttcagtacagtttgatgagttttgatatacctgtgaaaccaccaccctaaacaagataatagactataccatcatctcagaaagttcccttgctccccatttcctgccatttcaccctcttcttacctgctacccaaagaggaaaccagtttctgatttttgtcaccatagatttgttttgtctatttttggatttcatacagtcatacaacatagacttttttgtgtcaggttaattttactgcacataatctttctgaaattttcctgtggtggcgtgtgatcagtagtctgtttaatttatttatttatatggagttttgctgttgttgcctaggctggaatgcagtggcgcaagctcaccacaacctccgcctcctgggttcaagtgattctcctggctcagccttccgagtagctgagattacaggcatgtgccaccaagcccggctaattttgtatttttagtggagatgggggtttctccatgttggtcaggctggtctcgaactcctaacctcaggtgatccacccaccttggtctcccaaaatgctgggattacaggtgtgagctattgcgcctggctaagtctattccttttaaatgctgagtgtggatgctctatatgaatatatagctttttttttttttttgagacagagtcttgctgtgacacccaggctggagtgcagtggcatggtctaggctcactgcaacctcctcgtcttgggttcaagtgaattatcctgcccccagcctccttagtagctgggacaacaggcacgtgtcaccatgcctggctaattttgtatttttagtagagatggggtttcaccatattggcaggctggtctcaaattcctgacctcaggcgatccacccacctcagtctcccaaggtgctgggatttcaggggtgagccactatgcccagcctatggcaatttatttatccactctcctgttgattgacatttgggttggttctagcttggagctattttaagcctgctatgaatatttgtcttcaagtcctttgtggatatgagttttcgtttctctcaggtaaatactcaccaaatcatagggcctttgatagtctaaagacccattgtttttaggatgaagactcaaacctaaggccccacatggtcctgaccacttctctggaggcgtcctgcacacttgccccttcccttaactctgaatttcagcctctatgtatatgttcttccctctgcccagaacatgcttccctccctctcttcctgttaaccttgactcatccttcagatctaaacgctggcaacattaaggtaaagccccttatcataggcattcccagctctgtgtgcttgatgtcctagcacttaccaagactgtggctttatattgacatgtatgagtatttgtttaatgtttgcttctcgtgcaacagcaagcgtcactagggcagatgttgtgtttgttttattcacgcagtgcctagcctagcttctggcacatactaatcactcaacaaaccattgtgggatgcatgaatgatgactgccctataccccatggcgaatttttttctctactttggtgaagtctcatttggtcacccagagaagaaaccctctgtgccctcatcatggattttttcatgacctggacacagcaagaggggaaaagacgaggcaatcagttacgttcaggctacctggcttccaggaaagagaaaagcttaaacttcaatcttgatcattcttgtcctaaaccattatgtaaaccaaattcctgctaaacgggcttccaatccaaataagacaacaaggcaacacagttagcaaatatttcaccttgaaggaggccaagagatttgctcctggtattttttccccttggtttgtcttctggaacaaccgggtactgggggcattctcaagatggcactgcgtttcttagaaagtgggactgtttcttggtagaagttgttccagacgctgggtgcaatggcgcacgcctgtaatcccagcactttgggaggccgaggcaggtggatcacctgaggtcaggagtttgagaccagcctggccaacatggtgaaacccagtctctactaaaactacaaaaaaaactagccaggtgtggtggcgggtgcctgtaatcccagctactccggaggttgaggcaggagaatcacgtgaaccccagaggcagaggttgcagtgagtcgagaatgtgccattgtatccagcctgggcgataagagtaaaactccgtctcaaaaaaaaaaaaaaaaaaaaaaagaaaagaaaaattaggggccataatgttcttccatcaataaaatttgtttcccacgtggaaatgcacaaccatggggcatttttactgtctgagtggccacatgggggtgctgagtcgaaaggcacatttaacaacgtgttgttactgtgagcaaggctattcggggatgcgttttgctatgcatccccccaaaatcccaatacatgcagtaataaagatgattaatataatcttacataccttcacatgactctgtctttttcatggggaatttcctccccaggtgggcgttttgtctgtctcgaatgataataatgagtagacaagtgtatggatactgtctcttctttagatgttttgcctttgcaaaaagagtgcaaatcgaagtgatcctacagatgagctgtaagtgttaaagaaaacaacattagtttgtatcaccaccagactacttttattgccaccagaaaatgaaagtgttttaggaaacagcaaagccctataaaaggaatagaatgatgtccgccagtcttgaaatagggatgggtgattcttgaagaggatttgaggaagtcaaaggtgataatacacgttagaaagttgtggggggtacaggtgatggattgctttttatttaaaaatatttattattattcttttgtacttgatcttagccaaaaggccgaggagcaattattattattttttgagacagggactcgctctgtcactcaggctggtgtgcagtggtgctcactgcaacctcaacctcccaggctcaaaggatcctcctgcttcagcctcctgagtgcgtgccactgtgcctggctattttttttatttttttgtagagatggtgtcccactgtgttgcccaggttggcctcaaactcctgggtttaagctatcctcctgactcaacctcctaaagtgctggcattacaggcgtgagccactgcacccggcctggattgcttttataattaaaacagaaaatgatttaaaaatctagcagagaaatgaaggttaacataaaataacaacaacaacaacatagatgatattaacactcctggaaaagcattgaatggaagaaggaaagatgaaaacaactccttctcctcccccaaaataaacaacaaaaaacttgatcttgaatatgggtccatggaagaaactctccttcaggacattttagatggaaatagagtccatatgcagtaatgggtgtgctttcatctaaaatgagcttctgttaataatagttctagagcactttgtgtgtgctaaaatttttttctgagattttggtttgaggatctttcctaatttaagagaattttattcgttcactgttttgttaggtgaagagttggaaatatttctgtctcattaaacagcctcgattcaaagacagaccacctgcctgatttcctactctagtcctctaaaataaagacaggcaactgtgggcattcctgaaaattgtttgccttgtccattcaagctcatttttaaagaatgactcacggccaatctgcactccagcctttgatacttaagagtgtgtgtgtgtgtatgtgtgtgtgtgtgtgtgtacgcagaggaatggtggagagaggtataaaaagaaaatgaacaaagaagtgtgggttagaagccatactctgagctaagggctgcacttaattggaaattaggggccaacctacaagtacaatgctataaaactaagatcaggacaaagccatcaaagtccaagattactctgggggatagagacatgagtctgaagcaaatgacattgtgcctcagtgtgtgggcagacctagctttgaggagactggggaaatgttataattttggaaaccctcttgaataaagaatacaattttaggtacaaatacagatgctcctcaacttagatggaattgcatcctgatatacctaccataaattgaaaatatcctaagtcagaaatatagccaggtatggtggctcatgcctgtaatcccagcattttgagaggccaaggtgggaggattgcttgagcccaggagttctagatcagcctgggcaacataatgagaccctgtctctacaaaaaaatttaaaaattagccaagcatggtggcacatgcctgtagtcctagctacttgggagatggaggggggaggatcgcttgagcctgggaagtagagactgcagtgagctatgatggcatgatggcactccagcctgggcaacaaagtgagaccctgtctctaaaaaaaaaaaaaaaagagggaacaaaaaggaaatgcacctaacctactgaatatcatagctcagcccagcctaccttaactgtgctcaggacacttacatgagcctacagttggacaaaatcatcaaacacaagcgtgttttataataaagtgtagaacatctcatgtaacgtactgaatacagtacattgtagagtacagtatcagttgtttaccctcctgatctcatggctggctggcagctgtggttgataccactgttcagcatcttgagagtactattgaatattgctagcccaggaaaagatcccaattcaaaatgccaagtatgatttctactgagtgtgtaccacttttgcaccattgtaaagtcaaaaaatcataagttggggaccatctgtacaataacaagacgacatggcagtgattactaaacacatacacacatccactacacccgacttcgcgtatccccaagccagattccatagtgtccaggggcactccagagttctctgacacgaggaagattgtgatggaagaaaagtcagagagaaaggacttatttgttaaaatgcatgatcaggtgcagtggctcatgtctgtaatcccagcactttgggaggcagaggtaggtggatcacctgaggtcaggagttaaaataaaggccaggcgcagaggctcatgcctgtaatactagtactttgggaggctgaggtgggcagattgcctgagctcaggagttcaagagcagcctgggcaacatggtaaaaccccatctcaactaaaatacacacacacacacacacacacacacacaaaacagccaggcgtggcagtgggcacctgtagtcccaactacccaggaggcggaggcaggagaatcacttgaaccgggaggtggaggttgcagtgagctgagatcacaccactgcactccagcctgggtgacagagcaagactccatctcaaaaaaaaaaaaaaaaaaaaaaagagaaaaaaaaaagaattttatttttatttctcaaaaggtatacgcactttccattttgatactgtcaaaatgccctcagaaaagttgatgtctgtaggcccacaatggtacacaagtgtcctcttattccttaacaaaactgagtgagattcttttttaatccctgtaaacctgctgggtaaaaaatagcttattgtcaatcatacttgctatttttattattagcttgatggctaattttatgtgtccatttggctaggctctggtacccagtttttggtcaaacaccagtctagacgttgctgtgatggtatctttttagatgcgacttaaatttaggctgggtacggtggatcatgcctgtaatcccagcactttgggaggcctaggggagaggatcccttgagcccagaagttgaagaccagcctgggcgacatgacaaaaccttgtctctacaaaaaaaaggaaagaaaagaaaattagccaggcttggtgatgtgtacctgtagtcccagctacttgggaggctgaggtgggaggatcaattgcaccttggaggttgagtctgcagtgagccataactgtgctactgcattccggtctgggcaacacaatgagaccctgtctcgaacaaaacaaaacaatatttaaatcagtagactttgagtaaagcagattacctccataatatgggtaggttttgtgctccttatgagaatctaatacctgatgatctgaggtggaacagtttcatcccgaaaccatcccccccgacccctggtctatagaaaaattgtctttcatgaaactggcccctggtgcccaaaaggctggggacccctgtcctagaagaactcatgttggcattaagagtgtatccgccatcatccatgtgtcctccacctgagggatgcccttttgctcctccactaccttttcttccacatctcagacatcttggagggcctctgtttctcgaaggagatggtggtctccacctaacaccactttcaaaagatggttcgttggcttgctctacttgaattgcttttccatccaaagactttcccttcatatcgttggcagcattcttagcatctgcagggctctcaaaagtaatcaatgcaaagtctctggacttgattttcccatccttcatcaaaagaacttctgctatgtggccatatttcccaaatactgcttaaagagccttttcattaggttctgtattaaggccacctatgaacagcttgccaggtggatctgcttccacaattttgctccttttccagattttctgagatctcacctttatgcttccctgggtgatcattagctaaactaatctaaatgtctctttatatataattacacatgcacacatacatatacatacacacacacacacccatcctatgggttctgcttctctggagaaccttgtctaatacaattagtgaggttacctaggtcaaatgtttattggtatctgtatttcatttcatcttattcccttcccccttccctttcctcctttcctcttcctcctcctttccctctctttctttttgttctttgcccagatctttttttagatcctctgtgtgaacaggggtcccccaaagtgaggggctctggcctatgttccctaatttgctgggagtgaaaagcctttttgactagggacttgtactaccagtgagattgtgcaaataaatacattaaataaataaagctaagtaatggagaaggctgcttagttatgggaacttactttcaaaaccatttcctccttcatttatcagttaacagctgaatgcagaatttcctgttgtttctttttttttttcctttccttcatagcaagtgatatcatcacagctacctagaagaacgatttcccacagtgacggaggttccgtgatgtcattgggattacaaaagccaggaaagaaatttgctatcggtatttgttgccagaaattacgaagcaaattaatttcaaactttctgggaaagaaacccttcagtgaaagtaaacatttaagaaattattattatacaaggaaattctgtccttaatctgccagagagagaatgcctgcaacctcaaggtactaaataaacaggcctggtataagagagagttctattttggggatatttagtgggctaagtatctgtgccagcggtccccaacctttttggcaccagggacctatatcatggaagatcatttttccacagactggggttggggatggtttggggatgaaattgtttcacctcagatcatcacacattagattttcataaggagcgggcaacctagatccctcacatgttcagttcacaatagggttcgtgctcccgtgagaatgtagtggcgccactgatctgataggaagccatgctcaggtggtaatgatcgctcaccggccgctcaattcctgctgtgtggtctggtttctagcaggccatggacgggtactggtccacagccggggggttgggggcccctgatctgtgccaaaacgctaactatcttcagattggctaggctggtaactggactatttttcaagcaaccagacctgtcctgatgaagctttgaagtgtctcgctttctctatcctaggtcagatctcctgaacacggtctcccttccctttaatggaagtagaggtgctaggtttctgtgactgctgtaacaaattaccacaaaccggtggcccaaaaccccggaaatttattgtctcacagttctgaggccaaaagtccaaactcaaggcgtcggcaggactggcttcctctgcagggtgcagggagagtccgttccacgtctggctcctgtcttctggaggctgccgccatccttggcgttccttagctcataggcgcatccctctgatctctacctccatctgcacagccccttctccatgtgtcttctcccttctcttcaagttttttttttttcttttcttttcttttttttttttgagtcagggtgctctgttgcccaggctggagtgcagtggccctatcatggcttactgtagccttgacttccaaggctcagacaatcctcctgcctcagccccccaagtagctaggaccacaggcatgtgccacaacgcctggctgaattttcaatttttagtagagattgggggtctcactatgttacccaggctcattttgaactcctgggctaaagcaatcctcctgccttggcctcccaaagtgctggggttacaggtgtgagctactatgcctggtcatgtctcttttatggtgatacttaccactggatttagggcccactctaaccaggatgttaggtcatattctcaggtgaaaggtgttagggcatggacatatctttttatgtctttttatgccacaatttaacccactgcagtggatgagggtttatgaccgcctggccccatcttctcccggaggtgatggtgactcttgagagctgactctttcaagtggtggcatgtgaaatcttcacaggttcattcattcattactgtaatgggctgaattgtgttctcctgctgctctcaaagtcatatcttgaagtcctaactcaacacccagtacctcagaatgtgactgtatttagaggtggggtctgtattagtccatttttatgctgctgataaagacatacctaagactgggtaatttataaagaaaaagaggtttaatggactcacagttccacatggctggggaaggcctcacaatcacggaggaaggcgaaaggcacatcttacatcacagcagacaagacagaatcagaaccaagtgaaaggggttcccccttataaaaccaccagatctcgtgagacttattcaataccatgagaacagtatgggggaaactccccccatgattcaagtatctcccatggggcctgtctcacaacaggtgggaattatgggagctacaattcaagatgagatttgggtggggacacagctgagccatatcagggtctttaaattggtattaaggttaaatgaggtcattggggtgggccctgatgcaacatgactggtgtccttataagaaggggagatgaggacacgggagaaggcagccatctgcaaaccaaggagagagaactcagaagaaatcaatgctgccaacaactcgatctcagacttctagcctccgggactatgacaaagtatttttctgttgttgaagccactcaatctgtggtactttgttatagcagcccttgggaactagtgcagttactaagaacccactctctgccacatcttccacaaggcagaggcacatcctctgggactggctgtgagtctggagatagttaccattttagtccagatagttagcccaccaagtacccccagagaaggactatttgtctcttactaacatctcactgatatggtttattattctaaagatttgggtgtaaacaagagtttattatgtcttcaaatataaaaagctacagtaaacagctgatttttgaaagtataatgaggaagatgccatagaaactgtgaaagaggtcagtgaaactagaggagtccacctgggcttagatgatgtgatgtttaagctgggatcaaaaatgaataaatcacaggtgaacgaggaggaacgttccagtcagggaaaagtaaaagtctaaagaaagcctgagcaacatggtgaaacctgtctctaggaaaaataaaaaaaagtagctgggtgtggtggcgcacctgttgttccagccactcaggaggctgaagtgggaggattgtttaagaccgggaggtggggagtgcactgagctgtgattgcaccactgcactccatcctgggtgacagagtgagacccagtctcaaaaaaaaaaagtctaaagcagaaaaatattcgaaaaactggagaaagctggggagataggctgggccatactgtgaaaggacaatgagaagaccccaaagtgttttgggcagggatgttcttattggaaagatcactctgactgcagcgtggacccagagttagataggagaagactagaaccaggagactcagttaggaggccgtcccaggggtctgcaaagggggatggtggatggggtgagagattgagtgcagatagagagaaatggaaggattagatatttaggaagttgaagaaaacacatttcctcattagttcagtgtagaagggttgaggaggaggaaggagttaagtatgatttggataatttgatgggtaatgagtcatttactttggggaatattggggatgcttatggggaaagggattatatttatcaggacttccatgattgcaagtgacagaaactgaattcaaataatttaaggatataggactgatgtgaagaaacagagctactctacccgcttcatttctctctttttaaaattttcacttctcttggtgtgttggcctcattctttcctattgcagacttgcttcctccaggcaatggagagaaggtggtattgttgcaacttgacatttacgtcttcctagctcagggactccagagagagagcttttttctcccagcatcttagtttgaatttcactgtgcaaggtttagccccacccaattttaacctttctgaaatcggaagcgtcttttaatagatgtcatcttccttttttgttgttccaattggcagtattatttcttagtgatggataaaataacagtgtttcttactgtaatggagtcttagatgtaatgaaatccgtataaaattttagagaagggctctgactggtttggtgtgtgtcattgattgccactgggccaatcatggtgacccaagagataggggagtagatgatcagtactgggatacaggcccatccctgtggccagtgccatagggtgctatgattgaaaatcccatctgaactacacttagtagggagtggcagttgctgcaaataacagaaatactgctgggaacacatgaagcttgtcaggcccaaaaacatgatgaagagtgcttgagaaaacagtgagttcaatgtagactggtggctaaactggctggtgagatactgtattagtctgttctcgcactgccataaagaacaacctgagactgggttatttatttatttagagacagagtctcactctatcactgaggctggagtgcagtggcacaatcttggctcactgcagcctccaccactcgggttcaagcaattcttgtgtctcagcctccagagcagctgggactacaggcgtgcgccaccatgcccagctaatttttgtatttttagtagagacagggtctcaccatgttgaccaggctggtcttgaactcctgacctcaggtgatccacccacctcggcctcccaaagtgctgagatgacaggcatgagccaccgcacccagccgagactgggtactttataaagaaaaagaggtttaattgactcatggtccccaggatgtacaggaagcatggctggggaggcctcaggaagcttacaatcatggtggaaggtgaaggagaagcaggcatgtctttcatggccagagaaggaggaggagatagagaaaggggaggtgctacacactttttttttgtttttgtttgtttgtttgtttgtttttttgagacagagtctcagtctatcgccaggctggagtgcagtggcgcgatctcggctcactgcaagctccgacaccctggttcaagcaattctcctgcttcagcttcccaagtagctgggaatacaggcacacacccagctaatttttgtatttttagtagagacggcgtttcaccatgttggcctggctggtctcgaactcctgacctcaggtgatccacctgcctcggcctcccaaaatgctggcattacaggcatgagtcactgcgcccgactgctacacacttttataaacaaccagaccttgtgagaacttactcatgggaacagcaagggggaaatctgccctcatgattcaatcacctcccatcaggccccccttccaatgttgagtattagaattcgatatgagatttggacagggacacagacccaaatcatatcagatacccaaatgatgatgtcccctgcccattaaatttggcagcaaatttgtcaccttcaacttcactgagagcattttcaatagagtgcagggcaggaggccagctaaagggagttgaggaatgaatgagaattgaggaaaatgagatagggtggtcagaagccaaagagaattaaggtttgtttggggacattctctgcattgaggacagaattgctcatgcagcccttcaggatccaaggcaatgccctagagcagtagttctcaaagaccatcaggagccaccacctgggatttactagaaaagcaaattttcgggacccacccaagacctactgagttagaaactccaaggtagggtcctgtgatctgcattttaacaagcactccaggtgatttggatgcaggctaagtttgagaactagggccttagaagcctacagcaacaggcttttatggagctgaactatgatattatctgtctcagggaggcaaatgtgtgttgttaacatgtttacttcagctgggcttgctggaagcaaagaatctggtttgagttggggctaaggggggtaagggcacagatttctataaagcaatcaaatgagaaaaaggactgttgccttcccagggcaggatccctgctgtatgaaatccacctatttgggtttttcaagcagatgagcaatttgacatctttccactcctctgagcaacacagtgttaagtggatctcttgaaggatgagcctggtgcttggctgaagctgtcacaaagtggcatttctcacagtatttgcagaggccctgagaaatgttaaccagagactcagtttgctctttgatttcagtcttcacggttgaaaacctttcttaaatgcatctttttgccactttagaggctagaataaaaaccaaaagagcaaagtttgtgaaagattgttttatctttacaaatcagaatgggtttaagatgtagctctctaatgtcactcttactcacttgcattctgatttgctttcttgagagaaagagattgggatgcctggagttcctgttggctgctgggatttgcatgtgatccccgacatagactatttgtgacacacgctggtatgtgtgtctgtagctgatgtcctattaatagctgatacatgaatgtcatttgttggttgggcagacacaggaagtgtggcacgatgtaaattctgtgaagacagggctggttgattcaatgttttatccccgatacctagaacagcactcaataaacatgttgaatgaatgaaaaaaatgataattataattgaatcctggatcactcagaaacctacagattcagggtcaccagtctgagcattaattctcaccatctgggatcctaaatatagcatgtgtaggcagcactggctgcataatttgttggggccagtgcagaataaaaatgcagagcttcttgttcaaaaattaataactgtgagacagcattagcagagtattcagccaagcatgcagctcttctgagtgtggagtcctgtgctcctgcacaagtcacacccacgatgccagcccagcaggtaaggaatgggacaaaattttaccaattctggtaattttctggaaatggctttacaattttttccagaaatccttgaaatgactttttaatttaatttaattttattttaagatggaatctcactctgttgcccaagctggagtgcagtggcatgatctcagctcactgcaacctctgcctcccgggttcaagtgattctcctgcttcagtcccctgggtagctgggattacaggcacccaccatgatgcccagctattattattattattattatttttagtggagatgagatttcactaaaccccgttggccaggctggtctcgaactcctgacctcaggtgatccacctgcctcggcctcccaaagttctaggattacaggcatgagccaccgcgcccggccatgaccttttaatgtagttattttccatgaaaaagaaagtaacattaaaaatgaaggttgtctgtgataggactggattatcccaattcttttcttcctccttggaatgtatcctttctttgctatgttgctctacaatgcctcctactggagagattagagtctgtttccccacttcctcatgtcgggctggatcgtgaggcttgctttggccaatggaatgttagtgggcatgatcagaggctttaaatgtgctcatgaggtttggctttgcttctcaggctctgtcctttaccatgagaactgtcctgggtaagctgttggctcaagcaaatgacagaaatatggggtagacttgatcccaatcagctgccccagctaacctgcagacctacatagaaagatggaaaagaaatgcttttggtaagccaacaacgttttggagtcttttgttacacagcatttacataacagaaacctaagaaggcatccttcaggaggatcctaataaatgaatatcaactggtttttttttaaattttgaggatgctgaaaaagaacgacaaaagagactagaaaaagaatcaaaattaatgctgaatattggtatacaatcctgctcagaagatggtttaacctgatgctcaaatcaagtcattaagtcctaaaaaaactcagtgctaagcactttgcaaactttaattcaagtaatcctcccagtaacactatgagtgaagttgctaatatcattgtcgttttcagctgtggaagcaaaaaatcagagagatgtaagtaactcagctaaggccacacagcttggaagtagtgaagccaggatcctaacccaggtgggatggatccagagctgcacacttaatcaccacgccttgctacattgccatctagaaagcaaaggccagtggctcatgcctgtaatcccagcactttgggaggccaaggtgggcagatcacttgaggccaggagtttgagaccagcctgggcaacgtgatgaaaccccgtctctacaaaaaattcaaaaattagccaagcctggtggcttgcacctgcggtcccagctacttgggaggctgaggctggagaatcacttgagcccgggaagaagaggttgcagtgagccgagatcgcaccgctgcactccagcctgagcaggagtgagagcctgtctcaaaaataaaaaataaggaaagtcctggggaaattcaaggtacttttatctctgtcctgaacttgacttgacttcagaccacttctccttctgcctcctccttgatgatcaactcaaatacctgtttctttgctcttgccttcacccacaccttgagtttgatgcccgagtggatgatgctcccagctcccagcagcccaaactccactctccttacctagcatgatgtgtctgaggaaactgagccaataacccacttgtttgcatagcctagggctctttctcccaggatgtagctaccattcccaaccttagaattgggcccacaagaagaccttgagattcaaaagctttcaaggtatgtgggaagggtttgcaaaaggggaatcaggtttatggctaaatgtcaataagaatgtatgcccctgcctttctacacttctctgaatgcccttcagccaggcttcttggtgactgtgtggtggctgaggccattcctatagcatgaatatattaaaacatggtataatccagacatttgtcattctccctccaggtcattacatatgagcgggtctctttgacaatgctgtaatatgccctcaaggaggcttcatttatttagagctgcatacagattttgaagagaatgtatttaagacaagtagaaaaagaatcttccatccttattagagattatgtaaactccttgccagattctaatcttgctgatcccaaacttgccaagaaagcttttttttggacatcattaaatagatcttattctagttgtctttgtttgttttttagagattgcaagtactccataggatctccttaaagaagcagcaggaggaagaggcctcatttttaagaaagcttgtcttatgcttgggcaaaggtggacacatcagctactggtgcatgggccggcagtggagaggaaggatattcacaagacttaacagctagtccagaaagagttctgatcaatcagggagaggccctgttcctgacccatctgccaagcagatgggctgtgatcagaccggtcatcagaaggggagcatctctttcccaagaatcccagtccaagttccaagcctgtgctgggagccaccgttgttgggttgaactgatccagaatatacggtctgagagtagaaagggaaggttccctgcagtaggcagaataatgtccccaaacccaccacaaagaggcctatgtgtgaatccccagaatctaggaatatgttacatagcaaagggaaattaaggttgccaatccattgactgtaacatagggatattaccctgggttttccaggtaggcacaatgtaatcccaaggatctttaagaggagaagaaggaagtggaagaggaaccaccaaagagaaggcagcataagagggatctggcctggcattgctggctttgaggttggaggaagggactaccagccaaggaaaaaagaagctaaaaaagggaatgagacagattctccctagggcctccagaaagaacacagcccagttaacactgtgattttagcccagagagatctattttggacttctgatctccagaactataagataacaaatttgtgttgttttaagccactaaatttatggtcatttgttgtggcaacaatagaaaagaaatacattccccaacaggaaattagggcggtcttacaaaaaggaggaggaagatgctgggcaggccaacaaaaatatcagaacagatgtgtactgcagatgagatctctgggagtgcttgttctatagctccctggatgggtattttcccaggggagacagaatatactttcaaagtatcaatagtggtatggacctgttccacaaagcaaaagctaagctcatagcacctgtcagcaagaccagaagagctggagttaggagtgtggcctctgaaggcgctccacacagattggaaacctggttccctcattcaccagttgggtaactctgggcaagttacttagactctctgtgcttcagtaaaatgaggatgataaatatctgacagcattttcataagaatcgatgacatttatacacataaagaattaagaatcacttctggcatatggttaaggctcaatgaatgttaatggttgctcttatgactaatactataacctagctctggagccagactacctgggttcaaagcccagctctgccacttagaacttctatgcttgggcaagttacttagcatctctgagccccaggttttttcatgtgtaaaatggggatattaaaggtacttacctcatagagttgtgatgaggattaaaacattaatttatgtaaagtactagaacaatgcctgatatacacgatacatgttatctagcatcatcatcgttagtactagtatgaggtcactgtcactctggaggactaataactaaaacaccaccgccgtgatgatgcagtggcatcttatgtgatcattaagaccttttaggttgggaataaccatggttcccaaactgtagggacctctgggagcaacattctctatcttcctatcagaattcaaaccatggaagcaccccagtgagatggctatataatatatgaaaagaaaagaaagtagaaaaattcatcatcagaaacacactgtaagactcctgaaagggatgtagagagaacccacttgtgtctcctatttctctgctctgcagttctacagggttgcatttgcctgatgcttttgattcagtgtttttacactatgtaacatagtgagaacgttaggttaaggaagcttgccatttcccttttcagagcagtcctttcaacaataccaagaattcgcactttggtagataatgacaagaaatacgacagcccagccgttagtaaacaagcaaatcatctaatggcaaaggctgatttaatcaaaacattctggttctccctcatctgaacccacacaaggaatgaaccaatccaactggaaaaaaatatttgttttatctttgccacatttatttactcttaaggactgtttaacttgatggggcagagaagttggaaagaacaaaaatactcaaggcagtgaacagcctcccaggtctctggcagcaggcaggaatgccagtggcctggaggtatttccacaggggcctgtttgtgagcagtttctgaagttgtttgccctcatcttgaggggtggagaaatgacctgcttatgtggcaggtttgcagggcagggggtgcagaataagaactagagaaaataagccaggaatttaacccctgctctgtaaatgattccaaaatatgaaatacttattccaaaaactctactgagcattctatatgtgcaagacattgagacaggtgttacaggaaggctaagataaagtagacatagattcgagctcaagaaactctgtcaaatagggcacgagaaagaaacacagatacctacgggatgtagaaagctccaggtgtgttttattttattttttactttttttagacagagtcttctttcgttgctcaggctgtggtacagtggtgtgatcttggctcactgtaacctccacctcctgggttcaagtgattctcctgtctcagcctcccgagtagctgggattacaggcatgtgccaccatgcccagctaatgtttgcatttttagtagagatggggttttgccatgttggccaggctggtctcgaactcctgacctcaagtgcttcacttgcctcagcctcccaaagtattgggattacaggcatgagctactatgcccagcctctaggtgtgttaaattggaagccctagaaacaggactggagatggggcttgtgtacaggtgcttactgttgtaaattgtttttatttttttagagacaggatctcattctgttgcccaagatgggtgcagtggcatgatcttagttcactgcagcctcaacctcctgggctcaagccatcttcctgccacagcctcctgagtagctgagactagagacgtgcaccaccacacctggttaatttttttattttttatagagacggggcctcactaagttgcccaggctggtcttgaactcctggcctcaagccatcctcctaccttggcctcccaaagtgctaggattataggcataagccaatgtgtctggctttataggtgctttcttgtagaagagctcttgggtggaacctttaaggatgcaagtgaagcagaatagggcaggggagaagctgggcaaagaggtgactgcagccccagcctgaagccattcttagatctggagggtgattggtacctgtggtaaaatacaaaatatatatttactcttggtccctggttcccagcatagagctcctaacacccttggaaattactcttttgctaatgagaagactcttgttgggcagagggggcctaggtagctttaggatgggacctggacacaggaaaaaccaaccatgtactgagaaggttagaacttccagccttgctcttccacctctgagagcaggagaggggctagagattgagttcaatcaccaatggccaatgatttaatcaatcatgtgtacttactgaaactgccataaaaaatccctacacaatggggcttggagagcttctgagttggtgaacacatccaggagagtggctcatcccaactctccagggacagagcctcctgcattcagatgcttcctcagtacccctccatctggctgctcgtgtgtgtccatcataataaagtgtaatagtaggtatggcattttcctgagttctgtgaggattctagtgaattatcaaagctgggtagggaaagtcacagaacccttgaatttatagtccactgggcagaagtgtgggtcacctggggaccccatttgtggctggtgtctgaagtcttgtggagctgagccctttaatctgtgggatctgggcttggtaaagtgaatctgggcatgacacaacagcatttactacaaggtaatgttactgaaacaccagggttccagtctaggttctgctgcttgttacacagaatgccaatcactgagacagtaactattgccagggaagaaaactttaacggggtgttgcagccaaggagaacaggagataaagtctcaaatgtgtttgtctgaccgactaaaattgggggttttgtatagcaggaaaggtgggaaaataggaattaaggaggagtatagaagcaatcatgatggatgaggggtctggcgtctctgtctggatacagtgatctgatgagttttaggtttttgtttttgcctgagtgtctgttttttgaggaaggaattcagatgagataaatgtaagttttaaattttaaaaacaggaaggttaatttttatgtttcttttaaaaaccgtaatatcatttctatgggacaattgggctggttttaatccccttttttctattcatcaatttttcgatcatggggaatatggttgtctgcctttttggctacttaatgctaaggggtgcattgtgggataatgatgggaaatgcaaacatcacccctgaatctgaagtgctcaggattacctgactggcatcccgcttgttggagcaccatgattaaaaaaaaaaaaaacacccaagaattaaagtggatcccttaaggaatccaagagaacaatcctaagcctattaaaaagtatttctgattcatggctgggtgtggtggctcacacctgcaatcctagcactccgggaggctgaggcagatgtggctcacttgaggtcaggagttcaagaccagcctgagcaacgtggtgaaaccctgtatctattaaaaatacaaaaattacctgggcatggtggtgcacacctgtagtcctagctacttgggaggctgaagcatgagaattgcttgaacctgagaggtggaggttgcagtgagctgagattataccactgcactccagcctgagtgacagagtgagactctgtctcaaaaaaaaaaaaattactaacaactatttctgattcattacatcctgcatgcaagaagggttttggggagaataataccaacctgaaaagcacatgtttcctttatgacttcttatttagggtctttggctgggcattgaatattaacttaaggccatcttagggttcacaacagcatgcctgtttttttctggagggatcccagaggggcaggttttatctgagcgtggtgaatccatggcttaacactggctaacttggcagataagtgggtagtcagcagcatctcaaaagggctgacccattgtagttgcagctggtttgcagcctgctgggatttccaggtcttcagcatgacttggtttctcagcttcaaagagaaaagaggcacatctgtaggacactggagcctgttggaagcaagctcagaaagactagttaatatatttttaaaacacaaagttaatattcccatcattataaagccagttcccaatggcttgcatatgaagcatattggttgcttcctctggggtgttccacttaatattgataagtggagttgggcagtccacttctcagggtaaatagatcgtatagtggcttttatccagttcaccaggctggccgttctctcaggaatagcctcctgtgtgtctgaattatatataccgatctgtgattgttcagtagtgagctgcgggtcttgtattaaccaaaacatactctttcattttgcagcatttaaaaccaaagacattcctctcaaattagttatttttacaattcattttagaggaggtttttttgggaagctgatgataccaattggtataccaacacaagatggaacaatccctttgcatcatatcctctggttttaatagttatttggtgttgcattttcccccactttgactaccttcttggaaaccacaggtgtgagaggtactttctggtgtactggcatagtttttcttttgtgggtagtctcgaggctagtgatctgagcttagacagacccacatctgagcttggtccagccttaaggcccaactcagtgtttttaaatttttaattttagctattatagatagtgataaccaagggattgaatatttcactttttccttattcgttcacattaaaatagatgtatatttagtgaaccaatttccctgggagttgaattcatttttattttacttttatttattattattattttgagacagcatctcgctctgtcactaaggctggagtgcagtggcatgaccatagctccacagccttgacctcctgggctcaaatgatcctcctgcttccacttactgagttgctgggactacaggcacatgccaccatgccaggctaggttttttttaaactttttgtagaaacagggtcttgctatgtttcccaggctggtctcaaactcctggcctcaagcaacccttcttgcctcagcttcccaaaatgctgggattacaagtgtgagccaccatatgtgggtgaattcattttaattttttttctggtaatttttacctttaacaattgaatgcagcacagatgcacctccataccacagaggtccgctattagtttagtctgtgcaattaactcctgttttgctttatactgggttagcattccttatgtacacatcagccttttaattgcagtcctggaagtttttttctagttcaacggcacaatgtctaaagttaccagaaacctacattcaagagtctttttatgaattttcctaaaggaggatcctttggattgtaactgattctaagccactttttgagaagaatcaaagtaaaataataactatagatgacaaaaattttaggacagccataaagacacaatttggttattttgtggcatataataacttaatgtaataatcataataattacagaaaacatacactgacatattagaattttagaaattttgtgatctgggaatacatattaacaatatatttatatagctataactcagaatgggtggacatgtaccctagaacttaaagtataataaaaaataaataaataaataaataaaactcaagaaagttacacataattttatatttgacatataaaatatgctttctgtataattctaaaataccaaataagcataatatgtctctcttggacttttggagaccctaatatcttaaaagttagtttgaggtcaaaaagactgaattttgaatttgacatttttgctttgggaaagtttgtcaaatatcaaaggtttaaaacacttgatatcacaaaatagaatcacaggtcatttatttagccaaaacaataatttaaagatttaaaaaaacaaaagcctttattctttgataaagggggtactcagtttcccaaacagtaagaccaaatcaaggcacaatgagaccaactaaatctgtctctctctctctcctcttttccctgcagtttattcaaaaggtaaaatttttaaaaattattttttattaattgtacatgaaaatttagttcaaaaagagaaaaataaattttacttttgtatagtatattattaattttgaagctaattttaataaaatcctatttaaaaaaagtatctaattttaagcagtttgaccataagttaagatttttataacctttcataggtttttacaatttgttactaaagagtggatcaatattctaacaagagcctgttattctgacacgggggcccagatgctggccttgcagcagtgtgcttttgatattaacgtttagtttacagaaaagctctgaactattgttatgtctcaaaatcggcccttacaatctcacgtgcccacctcttcagcaatagtccccagggctagagggattgaatagttttaatttctggtcctgtgtctcataaaagcagtttattttgattgttaccttttcctgggtctgaagatgaggctttgactagtgccaatgttcaagatttagcaggagtcagtgagtgtctgtctttcttttcctcccttccttccttccttccttccttccttccttccttccttccttccttccttccttccttccttccttccttccttcttagatagggtcttgctctgttgctcaggctggaatatagtggcatgattacagctcactgcagcctcaacctcctgggctcaagtgatcctcccaccttagcttcacaagtagctggaactacaagcacgcaccaccacactggctcattttttaattttttgtagagatggggtctttctatgttgcccaggcttgtctcaaactcctggacttaagctatcctcccaccttggcctcccaaagtattgggactacaggtgtgagccactgagccagggctagaattcttattcttaataaccttaaattttagtgaaaaatctcggaagcaagaaatcctaaactgtctatcagatattagcactttattagaaccttccacaatttttttaaaaatgtttatttttattacaacgctccacatttataagagcctttcacaattaaaaaaaaagtttctccatatcacaaccttcttaaaattggccaaacatctaacgagtatcctaaattattttaagattttaaattacacagaagtttatttatagtatttattccattaacgttattcatttttagcagtttatctaaatgacttatgagaactgagatattagacaaagctagtcattatttccttgttaatcatttttacaacctgtgcatattaggtgttcacctaagtaagaaacttaaatacatggatattttcaccaataactcagaagattcggctatttgcattaaaccgacaatattaaattgttcttatttatcaaaaaatcatacaaacaaagattattttgtttttggctggttttacagtattataacctattgtgctaaaccctgataccttaaaatatctagcagagacaaacataaaacccagacaaaaatatatgctagccggcacctgagctgagatcatgccactgcactccagcctgggcaactgagcaagacttcgtctcagaaaaaaagaaaaaagaaaaagaatatgcagaggcctcatcctagggtggggaagtcaatttccccttcccactggctcagtgccccagtccatagcagacaggccatcatgcccaccaacgctaattgcagcctcacaccaggacatgctcagcacctggatcagggatgggaagaagcccccgataagtagcccatggattgagctggtgctgccatcctagagtggggacagctgctgcctggctctggcctgggcaccatgcagtgtgcatgcaaccccgatcctctctgtgtttgtgcccgggcccccaccaggggcagagggcaatggcaaacacaagcctcctctcatcaacacaagctggctgccacctcgagtggagggtggcagtggtcattgggcagggtgggagaccaagtagggaggatggggtgcaggtgctgagaacccagggtggaaaggggaagcgggatgtgagccaagtctccaaacccccatgcttgctccattgtccaactggacttaggaaacacaaattagaaggtaaaattaaacttcagattcgaggctctgtgtggctacactagttgcacacccatgaattcaactctggccagataatatttacatttctagcaggttcccaggtgaccctgagaagcacttgatctttcctttcttttcttttctttttctttctttcttttttttttttttcaagactgcccaggctgggactatatgtcccttcttttttttttttttttttttttcctttgagacggagttttgctcttgtcgcccaggctgcagtgcaatggtgcaacctcggcttactgcaacctctgcctcccaggttcaagcaattctcctgactcagcctcctgagtagctgggattacaggcactcaccaccatgcccggctaatttttgtatttttagtagagacagggtttcaccaggttgaccaggctggtctcgaactcctgacctcaagtgatccacccactttggcctcccaaagtgctgggattacaggtgtgagccaccacgcccagccagtcctttcttttgaaaaggtgcaaagcattgctccacagtgtgactttcctcttttcctcagtaaaatcgtgatgctatttcccgcatgtcctgcctcataggctttggtgagaggacaaagggaaggatgcctgaaagtgcccggcacagtggttagaacaaagcatgcactcgggaaatgttagcagcagcactaatagtaatagtcataattattcttgctgccatcacttccacttttgttcgggctattgtctctgatgactttctattgctccctatttaccctctgctgtcttcagaaaaggaactagagaagtacaggggcagggcagggctagggagggacacctcaggtcagagccagttattgccaaaagtcaaatcatgaagagatatgtaaggatgctgagatttgccagaacaaactgaaaactcagatcctctgaaactggccctggaggaagaaatctgagtgtgaggagaatataggcagaccattgcaccccattgttccctggagattgagtgcccagtctgtaaaagacacataaatatctctaaggggtggaaagctccaggtgtccttcagaggaggacagatcaagtcctagagataaagatccaactcccacagccacccgctcctgtcctttcaggagtgagtggggaggtaccactttcccttcaacgtttagaccaggttatgacgtccagagcacaagaaccctgcacagccagccacagaggcaggcttctccccacagggctttaccacattctagattacatggtcttgcttgctctctagggctcacccttcccatctcacatggcagacatccactgttctcaaactccaggccaggagaccacagccagagaaagagaacaagcctgagtgcctctgcagtgggtcttgactgtggaatcttccaggatgcttaaaaaataccgatgcctgggtccctcccccaggaattctgatttaattaatttacggtacattctatgtatcagtgttttgaaaactcagcaggggttactactgtgcacttgaggctgggagccactgctgtcccgcccactcagttgtaggatattctctgaggatccttctctgaatggctgacaggcagggtgaacaaccccctcagaggcacctccattaatcagatgcatgaacttgccttagtagctatccaggaaggtcttcaggaaccgcactgcatgaccacaagagagagccagccactgcaggcgaggtgaggatggcctgtgcacacggaattattttgggaagaagtgggaggatcaccaggtcagcacagggtcgattgtagggctgtgtctagggcatattccctggaaataaaataggttcttggagctgtactgagagcagctttcgaccatgctaaattcctattagtagttttttttaaatgaaccaatttgctattaatatgtattctttggtgaaactgtccaaatattttgaccatcttttattttattattattattattatttttgagacggagtcttgctccatcacccaggctggagtgcagtggcatgatctcggctcactgcaacctccacctcttgggttcaagtgattctcctgcctcagcctcctgagtagctgggattacaggcgcctgccaccatgtccggctaattttagcatttttattagagatagggtttccccatgttggccacgctggtctcgaactcctgacctcaggtgatctgcccccctcggcctcccagagtgctgagattacaggtgtgagccactgcccccaatcagttcaatttttaaaaaatattttttattggcctggcatggtggctcacgcctgtaatcccagcactttgggaggccaaggcagacggatcacctgaggtcaggagttcgagaccagcctgaccaacatggtgaaacccaatctctactaaaaatgcaaaaattagccaagcgtggtggtgggtgcctgtaatccaagctactcgggaggctgaagcaggagaatcacttgaacttgggaggtgggggttgcagtgagctgagattgcaccactgcactccagcctgggcgacagagcaagaatccctgtcaaaaaaaaaaaaaaaattattattgagctgtaaaagttctttttaaaattaaacttttttttttgtagagttggagtctcgccacattgcccaggctgtcctcgaactcctgggctcaagcaatcctcccacctcggcctcccaaagtgctaggattacaggtgtgagccaccatgtccagaccaaaagtgctttatatgttctgggtacaaactgtcagatatagaagccttcttctggctccaagcagttgtgctagagagtgttcaccaaagcctggtataggtgccccgtgtttatgagcatttggcctggtctgccctctcttctctgccaggcagcactgccagctcaggtacaacctgctcacatcagatcaattccacaaacatttactgaacatctattccctgacaggatcatgctaggaaccggggagaatgaaataaatagctcttgtttattaatattctttgtagaatgttgacctcgagcaagttacttgcttctcgatatttcagtttcctgatctgtaaaatgtgactgtgaaagggcccaccctgaagggttgtagtaaagtctaagtgagttaatacatcaaaatactcagtaggatgtctggcatatattaagtacctaataaatgttagccaatgttgtcattattttaaaaattctcattatttgttatggcctgaatgtttgtgtccctccccccaaatttttatttacatatatatatatatatatatatatatatattttttttttttttttttttttttttttttgagacacagttttactgtttcccaggctggagttcagtggcacaatctcagctcactccaacctctgcctcccaggttcaggcgattctcacgcctcagcctcctgagtagctgggattacaggcgtgtgccaccatgcctggttaattttttgtgtgttattagtaaagatggggttttgatatgttgttcaggccggtcttgaactcctgacctcagttgatctgcctgcctcggcctcctgaagtgctgggattacaggtgtgagccactgcgcccagcctccaatgcaatattattaagaggtggagccttttggaacttattaggtcatgaggcagagccctcatctatgggattaatgctcttatgaaagaggcctgaggtagcttgttcatccccactgtcatatgagtatgcggccagaaggcaccgtctttgaagcagagtgcagccctcaccagcaactgactctgctggcgctttgatcttggacttcccagcctccagaactatgaggaatacatttctgttgtttataagttgcccagtctaaggtattttgttatagcagcctgaatggactaagacattatgacaactgctaccatggtgagacggaacttagagggtaatggggaaaacaagcaattataatagagtggtaggtactaatatacctggaagcagaggtgcccctatacaggattgggggttattgaaggtttcctaaagaaaacaatggcttagctgagaacaagaaatgatcaagacatttccaggtgtgggaaggactgtgtattagtccattttcacgctgctgttaaagacatacccgagactgggtaagttacaaagtaaaagaggcttaatggactcacagctccacgtgcctggggaggcctcacaatcatggcagaaggcaagagagagaatgagagtcaagtgaaaggggtttcccctcataaaaccatcagatctcatgagacttattcactaccatgagaacagtatgggggaaaccacccccatgattcaattatctcccaccggtccctcccacaacacatggaaattatgggagctacaattcaagatgagatttggctggggacacagccaaatcatatcagactgtgaggaggaggaacattccaggcagaggcactagcaatgtacagtctgcagatgagagaggaatggcttgttggagaagttgtggggtgctgagaggaagaatggacacagcggtgaggtcatccaggcctgataagccatgataaggagtttggacttgatctaaagatggagaagtcatagatcctgccctttgagtagctccaagttaaacaggagaggtggacataaaacagatcatttattaattatgtcatagtttaatataatgtgagatgacagaggagagaccccaaaccctgactatggcagagaagtgcttctggaaaaaaacaagatgatatataacaaaaaaacaagatgatatataacaaaaaaacaagatgaaatgcccagatcaacatggacaggtatcacaagggaacacttcctcttcccaagcatgccgtcttcccctcttcccagagtcttttggtgtaacatcatcctccaccaagtcagaaaccttaatgtgaccccccttgctactttttccctcatccctccctcacattcgaccaatggccgagtcccactgagttgttgcctctaactctgttactcccaatttccctaggcaagggcttcagcatctgttcaagggatgctttcagcaactgggtctatctatctggatttgccctgatcaaattccctttccacacggtgactgccagagtgtcttccagcacttccaacatgtcaatccagtcatgtctctctcatgggcaaaactatttagttccacaacatcttgctgtgtctgaatttctacgcatccatagatctattgagagctaagaatgaatgtgtgtaaaatatctttacctcctctggggaacttaagagacctctttttaatcctatatttagtattaaagatatgtcaatatcttttcttatgtgtcatttcactaaacctgaactatcctttcttgaaaaacctgaattaaggttggaaggtgtgtctagaccttctggtagtagggattaaaaaaaataaatatgtaaatatgaattcttaacgtccttatttgttttcccagggtgagcaccatataaatgctaaattattggttagtaggaaggaaggttattccgtgatggagtcctccatatacactgacctcagcctgaataatgtaagatttcagcattttcctccttctttgttcttctctaaggtggttcttttctacttttgcttttgcttttaagagtcaggtttattagagactaattttaataaaatttaccactgtacagtacataattcagtaagtattgttgattgtctacagtcatatatctttgtgaagatatagaatacttccatcaactccagaaatcctctcatgcatctttgcagttgatctcctcatccacccccatttcctggcaatagctgatctgttttccagaatgtaacattaatgaaatcatataaaatatagtcttttgtttctggttgctaatagtatattggttttgagaataattaatattgttgcatgaatcagtagtttgttttttttcattgctgaccattattccatggtctgagtgtagtggaatttgtttatccatttccctgttgatggacatttgggctgtttccagtctttagctattatgaataaaattgtaattgtaatgtgaatacaggcctttgtgtagacatatgaattcatttctcttgcataaatccctgagagtggtattgctggattatatagtaaatgtgtatttaattttataaaaactgccaaactcttttaaagtggttttatcatttttcattcccaccatcagtgtaagagagtttcagttactccacatgcttgtcattgtttgataatgtcactccttgtaattttagacattctagtgggtgtgcaatggtactttgtcatatcttaatttacgttccccaaaattcaaattagcatcttttaatgaacagattttccatttatatatatatttgttggtgaaagtgtctgttcaaatattttgatcattttttagttcaatttaaaaaatatttttatttttcagctgtcaaagttctttatatattctggatacaagttatcagatacagaattttataaaatttttctgtctgtggctttaaatttttttcttatctttttgcccaggcatggtaatcccagcactttgggaggttgaggtgggtggatcacttgaagtcaggagtttgagaccagcatggccaacatggcaaaaccccttctctacttaaaatacaaaaattagctgggtatggtggcacatgcctgtaatcccagctactctggaggctgaggcaagagaattgcttgaacttggaagatgaaggttgcagtgagtggatattgtgacattgcattccagcttggtcaacagagtaagaccctgtcttaaaaaaaaaagaaaagaaaagaaagaaagaaaagaaaagaaaaaaagtttatctttttatagcagctttattgagatacattcatatgacatcttttgaagagtagaacattttaattttgatgaggtccaatgtatcagatttttcttatatggtttgagatgtttgtgtcctttctgagaaagctttgcctaattcaagatcatataattttatcctatgttttctcagaagttttataattttgacttacatgtaggtctataatccatttcaagttaatttttgtatacggtatgaagtaatgatcaaagttcatttgttttgatgtatgaatgtccaattgttatagcatcatttgttgaagagctatcctttctccattgaattaccttggcacttttgttgaaaataaattgactctatatttgtggtctatttctggattcccttgtctgttcctttggtctatatgtctattcttacaccagtattgcactgtcttgattcctgtagctttagaataaatcttaaaatcaaatagtatgactcttccaactttgttattctttttcaaaatcatctttaggtcctttgcatttttatataatttgttaatttttacccccaaaaaaggctgttgaggttttgtttaggttatgttgaatctaagactaatttggggagaactgacattttagcaatgttgactcttccaagccatgagcatagtctgtctctttatttattctaccataatttctctcagtatttaaaaacattacttcaatgtagagggcttacattactaattatttcacgttttaaaaattattataaattgtgtttttaacattttaaatttccaattgtttcttgctagtaaatagaaaaactattttttatattgacgttttcatatcttgaagcctaactaaatttacatattttatttttctagcattggctagaaccttaggggggaagcatttgattttttaccattaaaaatgatgctaactgtaggttgtttataaataagatttatcagattgaggaagtttctttctattcctagtttgctgaaatttttttatgaggaatgtatgttgaattttataaacactttttttgcatgtattgagataattatataattgtactattttagtacattgagatcaagagtttcagtgattgactttaaatgttgaactaaccttgccttcctagaatatgcccaagtatgtcctttttaaatatttctggattcagtttgctaatattttgtgactatgttcatgagagatattggttgctagcatcatgatgacaggatcaaattcacacataataacattaaccttaaatgtaaattggctaaatgtcccaattaaagacatagaatggcaagctggataaagagtcaagagccatcagtatgctgtattcaagagacccatctcatgtgcaaagacacacttaggctcaaaataaaggaatggaggaaaatttaccaagaaaatggaaagcagaaaaaagcaggggttgcaatcctagtttctgacaaaacagattttaaaccaacaaagatgaaaacagacaaagaagagcattacataatggtaaagtgctcaattcaataagaagagctaactatcctaaatatatatgcacccaatacaggagcaaccagattcataaaacaagttcttagagatgtacaaagagacttagactcccacacaataatagtgggagaccttaacaccccactgtcaatattagacagattatcaagatggaaaatttaaaatgatattcagaacttgaatttagctctgtagcaagtggacctgatagatatctacagaactctccacccaaaaataacaaatatatattcttctcagtgtcacatggtgcttactctaaaactgatcacataattagaagtaaaacacttctcagcaaatgcaaaagaactgaaataataacaaacagtctctcagaccacagtgcaatcaaattagaactcaagattaagaaacccattcaaaaccacacaactatgtggaaattgaacaacctgctcctgaatgactcctggataaataatgaaattaaggcagaaatcaagaagttttttgaaaccagtgagaacaaagagacaacatacaccccagaatctctgggatgcagctaaagcagtgttaagagggaaattcatagcactaaatgcccacaacacaaagctagaaggatctgaaattgacatcctaacatcacaactaaaagaactagagaactaagagcaaacaaagtccaaagctagaagaagacaagaaataatcaagattggagcagaactgaaggagacagagacacgaaaaacccttcaaaaactcaacaaatccaggagctgggtttttgagaaaattaataaaataggtagactgccagctggactaataaagaagaaaagagagaggaatcaaatagacacaataaaaaatgataaagtggatgttaccactgaccttacagaaatacaaacaaccatcagagaatactataaacacctctatgcaaataaactagaaaatctagaagaaatagataaattcctggacacatacaccctcccaagactaaccaggaagaagttgaatccctgaatagactaacaagttctgaaattgaggcattaataaataggccgggcgcggtggctcacgcctgtaatcccagcactttgggaggccgaggcgggcggatcacgaggtcaggagatcgagaccatcctggctaacacggtgaaaccccgtctctaataaaaatacaaaaaattagccaggcgtggtggcgggcgcctgtagtcccagctactcgggaggctgaggcaggagaatggcgtgaacctgggaggcagagcttgcagtgagccgagatggtgccactgcactccagcctgggcagcagtatgagactccgtctcaagaaaaaaaataataaaaaaaataaaaaataaaaaaaaaataaataaatagcctaccaaccaaaaaaagcccagaaccagatggatttacagctgaattctaccagacgtacaaagaggagctggcagcatttcttctgaaactattccaaacaattgaaaaggagggactactccctaactcatttcatgagaccagcatcattctgataccaaaacctggcagagatgcaacaactaaagagaacttcaggccaacatccctgatgaacattgatgcaaaaatcctcaataaaataatggcaaaccaaatccagcagcacatcaaaaaacttatccaccacaatcaagttggcttcatcccaggatgcaaggctggttcaacgtatgcaaatcaataaacataattcatcacataaacagaactaaaggcaaaaaccacatgattatctcaacagacacagaaaaggcttttgataaaattcaacatccttcatttaaaaaactctcaataaactaggtattgacggaacatacctcaaaataataagggccatttatgacacactcacagccaatatcatactgaatgtacaaaagctggaagcattccccttgaaaacctgcacaagacaaagatgccctctcttaccattcctattcaacatagtattagaagttctggccagggcaatcaggcaagagaaagaaataaaaggtattcaaattgaaagagaggaagtcaaactatctcttttggcagatcacatgatcctatatctagaaaaccccatcatctcagcccaaaagcttctaaaggtaataagcaacttcagcagtctcaggatacaaaatcaatgtgcaaaaatcactagcattcctagacacaaacaatagacaagcagagagccaaatcatgaatgaactctcattcacgactgctacaaagagaataaaatacctaggagtacagctaacaagcaaagtgaaggacctcttcaaggagaactacaaaccactgctcaaggaaatcagagaggacacaaacaaatgcaaaaacactccatactcatggataggaagaatcaatatcatgaaaatggccataatgcccaaaataatttatagattcaatgctattcccattaaactaccattgacattcttcacagagttagaaaaaactactttaaaattcatatggaaccaaaaaaagagcccctgtagccaagacaatcctaagcaaaaagagcaaagctggaagcataatgctacccaacttcaaactatactacaaggctatgataaccaaaacagcatggtactggtgcaaaaacagacacatagaccagtggaatggaatagagaactcagaaataagactgcacatctacaagcacctgatcttcttcgaatctgacaaaaacaagcaatggggaaaggactccctacttaataaatgatgctgggagaattggctagccatatgcagaaaatggaaactgaactccttccttacaccttatacaaaattaactcaagatggattaaagacttaaatgtaaaacccaaaactgtaagaactctagaagaaatctagacaataccattcaggacataggcatgggcaaagattttatgacaaaaatatcaaaagcaattgcaacaaaagcaaaaattgacaaacaggatctaattaaagtaaagagtttctgcacagcaaaagaaactatcttcagagtgaagagaaaaccttcagaatgggagaaaatttttgcaatctatccatctcacaaaggcctaatatccagaatctacaaggaacttaaacaaatttacaagaaaaaaaaccaaacaactccattaaaaagtgaggaaaggacatgaacagatgcttctcaaaagaagacatttatgcagccaacaaacatatggaaaaaagctcaacatcactgatcattagagaaatgcaaatcaaaaccacaatgagataccatctcatgccagtcagaatggtgattattaaaaagtcaagaaacaacagatgctggcgaggctgtggagaaataggaacgcttttacactgttggtgggaatgtaaattagttcaaccattgtggaagacagtatggcaattcctcaaagacctagaaccagaaataccatttgacccagcaatcccgttactgggtcccaaaggaatataaatcattccataaagatacatgcatgcatatgttcactgcagcattattcacaatagcaaagacatggaaccaacccaaatgcccatcaatgatagactggataaagaaaatgtggtatatatacaccatggaatactatgcagccataaaaggaaagagatcatgacttttgcagggacatggatggagctggaagccattatcctcagcaaactaacgcaggaatagaaaatcaaacaccacatgttctcacttataagtgggaggtgaacaatgagaaaacatgaacacacggagggggacaacacacactggggcctgtaggggtgatgggggaggtgggagcaagagcatcaggaaaaatgactaatgcatgtggggcttaatacctaggtgatgggttgataggtgcagcaagccaccatggcacagatttacctatgtaacaaacctgcatgtcctgcacatgtaccccagaacttaaaatttaaaaaaaattttaaaatgagagatgctggcttatacttttctcttctgtcttgcctgtccttggtatgacagactacataatgttggcctcctgatacaagttgttaaatgttctcacatctccgatttattttttttttaagtttatgtagggtggatattatttttccatgaaatgtttggtataattcatcaatgaaggcttctgaacctggagactttatttcattaatataaatagggctataaaattagccacttgtttattgtttgtttgtttgattatttatttattctgaaggtacatcagcaatctacttcttcttgaataagctttggtagtttgtgtttcattttgtggtggtctttgtgtgggatgttggcatataactatcttctgacttcccagtgctacagtgatcatctatgtatttattcatatcatcttatgctattgttatttttgtccattcaatggctggaatcaatagatcacaatataatctgttgtcaatgaagatgtggcagggggaactttgtggttgtggcaaagtagaaggcattgtagatcttgggctaaaaatataagaaagacaaggatttgcctgatggctttgtcagtcaaatttgcctcttttaattagtatgggttttaaaaatgggagaaaaatttagaaaagagtaattggctcagagaaacttgtaataaaaaaacactccttccctgcaagcattggaaaagccagagaaaagccagataaattggcaggacttactagcatgatgctttctctctctctctttttatttattattattttttggcattgtataagaaacaagacttgactttagtatgtattttagaattgttggcacatactgaaatgtaacatttttttcgattgggagtttttgataacaaaacagacaaaaaaaccaattttcctcaattctttatcccggtcctatgtttaaatattgtaaatcacatttgagaatattatagttacatttgttggaatagtacacagtgatttgaatcacctattttaaaagcaagttacttgccaagctactttttcacttaaaatgttactttcatttatattaaaccctatatatactgtttttctaaggacaatttgtttacaagtacagaataaactacttaatgtactttggtttaatttacttacatgtgaggtaagtatttttttctaccatcatcaaagggttgccacaagaataaaatcaggcatatgctataatatgttggtgaagagagattaaaaccataagtaaaggcaaagtgataaaggcaaactgatattattatatcacattcctttatggtgggacatgataattatgattgtaaatttaacgcgataggatagcagaaaaggcctatatgtgtgatcagctggcctttccaggtggaatgtatatagaagttgtcctgtggtttgaggaagcagctactatttgcagagcctccctcatgtggttctgccacaagccttggctaaaggtagcctcacccgtgattgccagcctgcaggttggttcactgggtgctgctgcttctcagaattccgtgactaagccaggagtggtgtttgttctttactgataggtattcttctgcctgctctgcttaccacatcatcacaccaggccttgacctttgtgaacctctctggaaagtcaaacatacctagaggctgaccaggcttaggtctaataacaccatcaactgctctttgcaaggtcatggaaaagaggttggaagtgattcaaatgagaaggaaacttaatagctcatccagtccaaatttctcatgacatggatgggaaaacaaaaattcagagacgttagggggctccatccgggtcccctctactgtgatgcctttctggacatcccaaggtgattacagtggtgcttctggctgtttgcaaaaccattctgtgcactctcccgtgacttctcaccctttgttagaattatctgttgatggtttctctctcactagaactagacctctttaagaggaaggctgagtccccctagtgggttctacgaggcctggaacattgtaagtactcatgcatgtttgttgacttgatgaatctctctcatgctactaggtactattgttttggggccaggctcatggagattaagcaggaacttcaagaaagccaagctcttcttggtagcacaccagagtctgaagggtaagccaaagagtaagctgggaagcacatccaagtaggggaagataaaaaaaagtggatccagggcagaaagaaggtggcaaaaatgtttcggttccctcacttacagacgcattagattcatttatttatttattcattcaataactttatattgggccagaagctgttgtaggcactgaggatagaggggtgaatataacaaagtccctgcttatatcacagtgggaagaaaggcagtaaacaaataaatgagtaaccattatatggtcagagaagagtaaagtgttaggataaaaaaataaagcaggaggaagaaatggtcactggtggggcttctattttacataaagtggggagggaaagccactcagagcaaagacatgaatggagtgagggagcagcgacatgggactactggggaaagagcatttcaaagagaacaacaggtacaaaggccctgaggcaggattgttgtgtttgggaaataaggaagccagaaggttagagcaccatggctctaacgagtaaaatagtgtccttcccagcaccaaagtcttattgattgatgatcctctgactatacaaaccaattccaataaagagagtcccagccaggtgcagtggctcacgcttgtaatcctaacactttgggaagctgaggtgggaggatcacttgagcgggggagtttgacaccaacctgagcaataaaaggagatcctgtctctacaaaagtacaaaaattagccaggtgttgtggtgcacacctgtggtcccagcaactagggaggctgaagtgggaaaactgcttgagcccaggagtttgaggttgcaatgagccgagattgtgccactgcaccccagcctgggtgacagagacagtgtctcaaaataaaaacaaacaaacaaacaaaaaagagtcccatacaatgctcaaggcagacttttatttctcagggttatcttaataaagaccttccactcccttagaacaagtgttctcacctgaggtcaacagacccatgcggatttagagtgaggtgtcaggttgtcaatcaagcccccaaatctgtgcatctagaacatttttctgcagagaaagtcttaggtgtagcctgccaataaatgcctgcagagctaggtgggaatatagaagaatgaaatacatcaggtgtgagaacccagtctcttaaacacagaggaatattattttcttccacagagaaatatgccttctcccttttattctgacatattcagccttctgggtctgtcttttatttcgtcacttctggtagagacttgggtccaaataaatatctctccaccataagaaacagtaatgcaagggtgatgacaaaaggcaagcaatgctcagtgttggggagaccttggggcgggtgaggattgggcaaacgggagggcacatgccttctaaggcaggcactcactcctctgcttcagttgatcactgccttgaggaaatgggacccagtattgacagaccttatggctgattaagagaaagcagaaatctggttctctttggagatgaaatctcaatttagttcacattttctttagagaatcctggcataccaaccagaacactctgagtgagtcaaatatggtcccgataggcaggtggtttgtgacctctggtctctagattctaccggaatttctgattgattcatgtcttaaataagattgatgactgctgtcctagaacatgtttcccctccattctgtgggcggaaagacagacggcatggacatttaccatgttcttgggtcccagaagtccaggagaaagccatctgcctcactgctccctgccccatcctgggcccagagcactaatgccagtggcatcagctctgctcctctccctcttcctttgtctaccagtgagtgtcctccattatggggatggagcaagcagtatattgtaaaagggacttagtgctgagaagcaccagaggaaaagtaggagatgctcattaaagtggaaggcagctctcttcttccccttctcaattctgcattctgctctctcccctaaatgccccccacccaacccccaaactcttgagaatgcccaaatccaaccaggtcaggaaaaaataaactcactggctcctgtattgagaagtccaagtgtggtgcggcttccggcatgtgggattcaagcactcaggaatttctccctctcacccaacctcagctctgctctcttctctgttgcctttgttctttgacaggctccctccaagtggtggaaaagttgacctgtatggtcattatcactcatcatttcagaaggggagagcctgcttctcttgtagcatttccatcaaatcctgaaaataaaaataatctggttggttctactggacttgtgatactggacaaacctctatgtccaagagctcgagtcattcccattggctcacctgggccacacactcttcgttgagtgcatcccaggatcacagggagtcttgagggtgctgtgtgtggtggtggtggtggtacggagatggcaaactctaaaaggaagagatggtggatacttaaagcctaccttctgcccacaggtgtgtcagacacaatctccaaaggccatcctattgttaccctatcccccaaacaaacactgaaaaactctcctggcaatttggcagtagctcagtgtggagcatttgttaattccagtactagaacgtctgcattgcaaaaccagaaatgtccagttctggtttggcacacagaagagattttcaagccttggcaactcctcagtgcaggcagtggaggaaatgctccagctttgtgaaaatcttctcccttcgctcctcatggagaataaccgttcatcactgcagccatgaatctgccacactgaatagatatggtctgaaaatctaggaacaaatggaatcactttggaaacctgtaaattttaaagccgaaagggcgctccagggaaccaactacatgaagttctctggaagccacaggatgggaggtttggtgggggtggaggtgaccattgaattttacataggcaaatgtaagacaatcttatccatagacagaaaaatccaaactcaccgagagtaaaaggatgacagttgaaataacagctaattgttattaagtatttgctaagttccaaagcacttttcatagattagctcaattaattctcacaacagccctgtaaggtagggaccatgatcatctccagaagaggctaaataaattgccaaagatcacatatgtagcaagtggtggcagagtgaggattcatacctggacagcttaactttaaagccatggtgctaatgcattcattcattcatccatccattcattcatccatccattcattcaatgattatattggatgcctactacatgctaagaactatgttcaaggtgctgaactacagctgtgaacaatgcaagtacaaatacatgaagcagagttggggagaaagtaagctggagaaataagacataaactaggttagatggtgaacatgattaaggaaaaaactagagcagggaggaaagagaaatgtgcagggggaaggtcaattctgagtgagccaacaggcaaggtctcactaagaaagcggcattaaataaagatttgaggaagtgagggagtaaaccttgcagctatctaaaaggagagcatgagaggtagaggagacagcaaatacaaagaccctgaagcaggggcaaggctaatgagttctagaattagcaaggagtccagtgtaacttgaacagagtgatcaaagaacagagcaggaggaaatgaggtcagagaggtaaacaggctggagtgcagtggcaccgtctcggctcactgcaacctccacctcccgggttcaagcgattctcctgcctcagtctccctagtagctgggattacaggcatgcaccaccacacccggctaatttttgtatttttagtaaagacggtgtttcaccatgttggccaggctggtcttgaactcctgacctcaagtgatccacccgcctcaacctcccaaagtgctgggattacaggcgtgagccaccgcgcccggccaggattcttttaatcaagtatgatgcagccatcagggttggagcattctaggaagagggaacagcatgcaccaaggcaacaggaaagcacataaaaaaggagttgctggaagattcatttcaacccactatcaagtaaatattaaacttactgtataaaaatgttagggccaggaggggtggctcacgcctgtaaacccggcactttgagaggccgaggcaggaggatcggttgaacccaggagttcgagaccagcctgaccaacagggcgaaaccccgtctctactaaaaatacaaaaactagccgggcgtggtggtgggcgcctgtaatcccagcttctcgggaggctgaggcaggagaattgcttgaacctgggaggcggaggttgcagtgagctgagatcacgccctgcactccagcctgggcgacagagggagacttggtcatgctccctccccgccctccgtcagttttaggaataaatacctttttatttaagctaaagtgtgggtacacccttcctctaggattctccatcaaggaataagaagccatattaggacaatttagagggcagttaaccctagtagacatagtggttcttaaaaggcttggggcctcagactgtacacaggcttcacatggaatctgatttgttcctttatcccagtccctcacccagaacccgaatctagcccttcatgttataaaaagggccagaggtccaaagagggtaagtgccttgtgcaaaattattcaactactttgtagaggattttaactagggttcagttagctccgcccacactataaaaggctctttctaaaaaacgaaacatgattaagggcacacggctccagcgttaacaaagctctttgttagctgggaaatgcccccctccccgactcatctgcttatcatctgcatagaattatgtactcaaaagcaggaaaattattgagaaaaccattggtccccggctgcagaccccaaggttgggagctggttcccgtttcctcccagagccggcagggggggcaccaggcaaagtttgcaagacgcgcctccctcccacccctcccccttcctcgcccaacttcccatagccgcggcctcaactaaaagtggccattgacctttcaagctttcgagcagtgatgcaatagaatagtatttcaaagaaaaatgcttatcgaaattttggatccggttttcccgtgattgttaagggtttcttttaaaaagtaggtcacatttcaagtaggtcatatttcgggggcgggtgcgcagacaaggagatgagtttccactaaggccagggggcctccaacggggttggaggtgagaatcccaggtagggtagaggtgccgagatccttccgaatcccagccctggggcgtcagccctgcagggaatggcagagacactctccggactgagggaaccgaggccagtcaccaagccccttccgggcgcgcaggtaagggcgcccccttagcagccggcgcaggtgacccgggcgggccgccgggtctaccggagacgttggagcagaggggaggaggaagggaggagccgggtgggtgcgggtgacaaggagccggagcgccagggggaggggactaaggacggccggcgccgcttaaggaggcgctgctctcccgctcgctgccttccaggacctgatcaaggggaccgcctccggtccccggccgtgggcaccgggacgagcacggcgtccccacgccatcgatgtgtcttagagccggagagtctggtttccgaggacccacagtcgctcctgcacgcccaccccccgcaaaagtgcggccaggagggtcgcatcgagggggcgccgccgggatgtttagaggaacccacccccgtggcaggccaagggccaaggatcgctatccttccctgaacccgggcgctcagctggcccgggtagggggcaggctccggccgccgaaacggggttggctgtagccggtggccggggagatctctagcttgcgcccgagcaccccggggtgtggggccagaggcaggccgaccccggcgtgcacaccgcccgccctgcacccgagcgctctcacccggtcttccctgaagcctgtgtattgcgaccgagcctctttaaagcagtagcggggcccgcggtcacgtgaggccgattcctggaaagttcctggaaagccgcctccgcagcagccgggcggggcgcgagcggagcgctgactggggagggaggcggggagcaagggaggcgcgtcggtctgggaagtcgcgcgcactcgctgctcctgggaccgacgtttaactcttgccaagtctcgtcgcagccgccgcggctggcgggccttgggcttcccctgaagcatgagccctctcgcccgcagccaccctcaccgcgtggcccgcggacagtgcgcgccggggtcccgggtgcacagcctcaggataccccgtgcccgcagctcgggcgcccgcggcaggtaccggtagtgggggaagcccgaaggctccgccccgaggagagttaccggggagggcggcgaggcgcggccgcgtgcgccggggagcggcggacggcctgggcttccgcagctcggagcgccggggaagagagagtccgaaccgcggctctgccccgcggcctagcgttgctgcctgctttctccagccccttctcggcgtctggaagtgtctggagtttcttttttttatttcccctaaactgccattcaaattaataatcctcctaataacctgatctcccgctcctccccaccggcctgcctcccgccctcgctccttcctccctccctccctctctccttcccacctccagggtcgcagccggagggaaacccggcagcagtccgagagtggaggtgtcccagcccgtagggggcgtcgccgcgcggtgggggatggggtcgaggcaatgatcctcgaggcttttgtgtgccctctgcgcacggaactccgaccgccgcctccgagcgcggggctggttgcatccccgggcatctcgttcccaaattaaacgttaacgggggaaacaagggcagacgcccctcctctcccgggcccctcccacctccccttttccccccacccccccgccccatgtccgctgaggaggctgcctggtgcggaggcggcggcggcggccgcggccgaggtcgaggtaagagcgcggcgttggtggtttgcattttccgcagcgctcgcgaccgcccgctcggccccggcctcgcctcggagccccgcgagggctgcgcgctcgggccgattcctcgacagcgcccgcggcggcgagaaccaccgcagccatcctggtccgggagcgaccgccgcggcacccccaaccccgccagagcgggcaccaggaagcggggggaggggagcgaggagcctcccgggcggagatgcggcagctcccgcacctccgcaccccgggttggtgcctcggggccccgcagcgctttagggcggagaaccaagtttgtgtgggtgcttcttcctgggggccctcgggctgcgccaggtgtgagaccggaatgccaatttggggaatctctcctgttctttcctttttaattttttctacttgtccttgacaagggcctattcccactggatctgcaggtgactatttgctcttcctaggtcgccagtctttgatttcagctagtgaccctgggcgggaagacaccctgttcaccctcctcctgacctccgccccccacctcttcagccaactttatcttggatctctgctctctttatcttttctctagagctgggccagggcgctaactggaagcttggggttaaatggtgcaggaacgtagaggcggaggagtccctgggattttccacgtctatttccccacccccaccccagccgcaggggtccagtttggactgacccaacctcccgctttctctttgtaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggtagggagccgatcggccgcgacgcgtgcgggagggagcgcctccccaaggaagcagctaggaagcggggtcgaggtgggaagcaaagaataagatggaaatacgtcccttgcttccaagggaccgcggagagcacgctcgcagggtcctgggtccttgggaatgcgtaaggaaagtggttctccagggactcaggcctggcggagcgcagagcgcgggaagagcttcttggaaatagcttcttagcacgctggaagatttactgttttccgcagctgctcagggttaggctcccgggctcgaaccccggccggggaaagcgtcgggcgcctccctttgcacggggtgcaatcagcaagtcggtgccgcgggccccgcaggcccagcagcatctggctcccgggcggagctgcggctgcagcccaggatcttggcggccaagttcagggactgacactgccgcgagggcggctgcccgggcgtcgagagtaggctgcgaagcccccgccgagcgcggcttccatggtcggcgcgcccagggtactgccgctttcaagtacagtcaggcaattcgcgcggcacgctgtctctaggcatctgaaaaaagaaaaaagaaaaaaagtaaagtatctggcaaatcattctggctttccaaatccgtatcctaaaagcttacagttgtggcacagttgaaattttggtagcaacagggggagggagagggaaaagttctctcgcttgcgattccggtctttccgtgtgggccacgggctttccctcccggggaggcaccggcagattgcaagtatcccggtaattgtgggggtggggggagcacaaatgttcagacttcttaaatacggacggtctctgagccttcttagaaagcagagtgggccggggagatggtgcaggcagatgaaatcaagaatgcaggggagatggatggttgtgattgggtttggattagggcaaagttcaaaagagtttagggaagattgtaaacttgaagtagtaattatcacttgggaattcccatttcttagtgactggtaaggtagtcataaagcagcgaacagaagctattgtactagagctgtgcttttacaacaagtacatagcagtgctttctacatagaaggctgttcatagcaggctttgcagattctttttttttttttttttttttttttggtggggggcacaccaaccatccaaaaaagttgcttctgtttttactgtagttcaattacaggagttgggttttccactttttaaagggcatggcttttatttctaacttctgatttttttctaatttacctaaatctttattttacttaaataatgttaaaagtgtcatgcttcatcagccagtgtgtcatgctgcagatgttcttttggttcattagaagaaaatcttaagaagagcttcagaaagttgattttttaaaaaagaaagaaaactggctcgccgtttgtgttcataaaatggacccaaatttttattaaattcctactgaaagtatttgtggtggcccggtaaactttcgctcacacaccaccttttttttttttcttttttagagctaaaaaaattattgccaattacttgctctgttctaagaattcttataataactgttttaccctcttttctttttctttttgaacaaaaaccccaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttctacaagttgcacttattgagttctagagaacgtacactttcatggtaatagaggattgccataaaaacttacgtcaagtgaaataagccaattattcaacaaaaggtagaacattacttgccattctgtaaagttatgggctgtacctgccccctttgcaatttggaaagcatggtttagaaactacaggcattgtcaagtggccgggtcttttataatttgaataggcataacactgatgtcctctgtgtttccaaaaacatggtttagaaactacaaacattatgacatggccagtcttttacaagttgagtaggcataatactaaagaaaaatacaaagttttgtggccacttattttttgctatgttagtctgcataactgttataaatgtaccatcttttctagagtccagacattatttattttatggctttaaaattttcctgcatagctacaatcctgtggtgtgtcaccataaaggtggaccctgtgtgaatgagaaaattcagttataaattgtaataaaacctgcttactggatatcttaccttattttcatgaagaagttgaaaaatggttttgtgcctggcaggaaacatactatgtatatccaaacagcagagccaaacacaaaagattgctaggtgtgcctcaggaagagtttacttgtggcctaaaacttcaagaaaagctagacatttggggtcggatctatgatggggccataaccatttgatgaggatgcttagaatctgtgcttcattcaccgtttttctcccactgacaacacctgtttagtgttggatgtttgatttttctggcaaaacttctatatgatcagtgccaaggggctttgtggaatttctttaaaggtcttttgcctttctattgtcactgttttgaacactctatttctcagttactgggagtggggaggcagttgtgaggcatgagtacctgtgaaattggaaaaagttctgagttactgctcgcaagtgactaattatgagaaggctggaggacagcacaaacatctctggagtgtgccatgaaacctattgccttatatttcaatcttccatattgcaagtaggttgataaacatcaggaggcaattatttttggttttgttttgtttttttacgatgactgacatcatttatttattgagtttattgtgaaccaggttctcactcagcacttgtattatctcatttaattttcccaagaacgaaatgagcaaagtacaatgatgataggaggttcccctcctgatttgtgagtcaagaggcattccaggaatatcctagctcttttttttttttttttcccccgggagaggaattgggaagagcaaattgctgctgaaaatttctacattgatccagacaaacaagttagagcaggctgaaaaagaacccttggtgtttttactgctgttcaaccagatcaactggaaaagtatagataccttaattagcactgtgctctgtgggattctggtcagcctggcccagtggtttttttcccctgaacacgcctgaaaggggagctcataatgactgctgtgcaggtgggcggggagggggcttcctatttgatttagtggctgatcaatgccagttaccaattattggtagccccatttatacatggtggaaaaaaagtacacttgtctaaattatcctcaccaaagcctggaagaatatccagtgttttctcccaatgtagggcaatttagggcatttgtgaggatatttattattgttgttgttgaagaatatggtatacaagacttatatatccccaaactctgaaaatattttgacctcagtttctgttctgggcagagatgaggcagtgcagtttttcatgaccattacagtgagcagtggtgattgctttttagggacttggagattttttggaactttggatagtggagaaaaaggcagttcagcttatgagatgagaggtcttttttggtgtgtcagtaagaaagtcttgacttcataataattatgtaatccaaataggtaacagaatgggacagttgtttgggagtgtttattttcttgggaaggattttctctgcttttagaaaattgtaccctgttaggagggtaggagacagagacgtcatcttcgtcaagtaatccaaaggatggaatgtcctgagaccaggctatgcccttctcagttgtgagtttaggcacggggtaggtggggtttgagtggctgtggttatgtctaacagctgggctgaagtctccgtctttaagtcgtcctttctatcctttagagcaaaacaatgttcttgtaggcctttcatttacttaagaggtcttctgtattctcctttcccagtttttttaacttcttagaattttaaagcttgaaaccactttttagatcacatattatggattttatggaagactttcagatccagaggggctgggagatttgcatgctcgcacacacacacacacacacacacacacacaggcacacaacccagccaatcaatgacagagtcaggattcaaacgcagatattttagtcttaggattactatttgtaaaagttgcacgctcctaccctttgataaaattgccgagactcttctttgctttcctgcaagtcctacagttctcttaacatcatatatttcttccgctgggattcagaagccaggcctgtggaataccctgtgggataattacagttcttggcctcctctacccgattctgaaaaatctgcctctgctggatttcatgatgtcttgatccacattagttttttgttgattttaactccttaacatttctaatctgtttgctgttttaaaatccaaaacctcccatccatgctgtttgatgatctcatttctacctccaccagatgtgacacacacccagccacaatgcctgggcgactgcccgccctcccatccttaccagcaggacccattcttgcttttgcccattcatgggcataagggatagttaattcctgccttactttctccctttcctatcataaagttgccctcttgacttatctaacacagcctttctggccgcatgatactccagtgaaagaggataattatactctccttgagttgggtaattgaatgatttggactaccttaagattaaatctctttgtatctctttttggttccattcaggttgtgaagcaagtaaccagccccagatgccacacttttgttatgggcattttttttttaaatctacttattttttaagtatggcaggctcctttttcagtgttaagttaaccttcatttgcacggaataaaaatgccctccattcctttgcttctgctgctgtatgtctgtaagtaagaacgattctgtgagagttttgtttcatttcttcatatgcatggttcttatattctcatcttcacatatttttgatttttctaacttttcctctgtgtggcttgagttcaggtgactattactatggtaataaaggtaacaagtgttgttagagtggcctctaaaagtcctggagtccccagtgtctgaagtcatggagcagagctggcttttcctatctaccccttcctgagctttgtcagcaaaggaggctggatcagctaagtgtgccacagagaataggacttacttcaataaacatgcatttgtaaagataaaactaactgcttttacagacaactctcactttgacccacatccttaacttataggcattctgacttgccctagatcagaagtgcattttgtgatgtattattcacgtggctttgcctctcttagagaaaggcttgccagagtcctagtgagagaaaaggaaatatcgccagctgccttcttctcctgtctcagcataaatgccacccaaggagcccccttgccatggtggggtgagactttttcgccagttaaaccatcacacaacttcataaaattttcctacatctccccagtttccggtttcctacagtgttaaagataaaaatttgtttgtttttgctaagcattttttcccttctgttagtttggtatcctttttcctgtttagtgtttggtccagaatgctgctgtgatctttaacattcagaaaaaatccatgttagccaggcacagtggctcatgcctgcaatcccagcactttgggaggccaaggtggacggatcacttgaggtcaggagttcgagccagcctggccaacatggcgaaaccacatctctactaaaaatacaaaaattagccaggtgtggtggcgcacacctatagtcccagctacttgggaggctgaggcaggagaattgcttgaacctgggatgcagaggttgctgtgagcggcaatcttaccactgcactccagcctgggcaacagagtgagactgtctcaaaaaaaaaaaaaaaaaaaaaagaaaaggaaaagaaaaagaggccatgttatttctacccagagaaagttgtttgacttcccattttaacattcccccttgccatcttgatgaacttgacccatcttaggtttccagcatagcttgtttctcttcatttttatttctaggttgtggccatcaattctgtatttggtcagaaagtgtctttgtattttgcatattggattagagcatctgctcttaattatctgtaggaataagaggcagagagactggggaatagtagaagcccataaacacatctagccaatagtttcaacttcctccccattctgtctcctttgctagaaccactgacagaaaaatcagctgcttctctgttctctcattttattttccttgtccatcatgtgatagggatgttaatatgcaacaaactggctaaaaaaatatcaagagagaaaagtaagggagatggagcatcagtagtgtgtggaggctcctgagagtcaattactaaaaactgagagattttgtgagctcaatcattatgcataaattattgatagattgaatcagccatggtgggagtattacaccacagaaataggcagatgctataaattaagactctccgccaccagatagctgatttaacaacatagcactgatctaggtattatgtcctcctcaataattgagacctcattagggtaagatcagtttatttgtagcctcttttataccaagcccagtgcttagagcagaataggagtgaacaattcaaggaatgattttttttttttttaatgtgtgtcaatcttatattgggttacattgtcttctactatggatcaggccatctcctgattctgtgtctttttctagttactctggggtatctgtagctaccttttcaatttcttagtaggaaggtgttaggcaatctcaacatcatgtgatcattgtttacaacaactcagctctaatagatcagggcctcttttttccttctagcttcgttcatttatctcattagttttctctttttttttcttcctccctcccttctcacctgctttctccctccttctctcctttctgccaacgtttattgaatgtctactgtattactcaacagtaggaagtgttctttcattgagggagctcttacagaccatgagaaaggatggagaggatggggactaacatttattaaacagtctaatatatcccattaccctgcttagccattgcatttcatcttcacaacaacctgatgaggtatgtatgaccctcatttattccaaatgaaacagaaacttaggtcaaatatcctgcccagtcaagtagggaagtcatgaatcaaacccaggttctgcatctcaggataccatattgtataggagctgtaattacatgaataacttattgtaaaatgcattgttaaaggcagtgtagttactttgcggacagggtgccattgacctgctttgagggtttatgaagacaagcccccagaggaaggtatcttgtgtctgagtgttaatagactggaaggagtcctcagacctgctgagtggggaagatcttttggctgaaaggttgaagaagagggtagagatgaggcttctgggaggtgctgtctgagggtgacttggggcagatcttgcaggcctggctgaaaaccttggaatttatcctgagggcagtagggagcagatgtcagctttttaaatggaggggaaaacaacagaactaagtttgtgttttatatcatccctctggaggtcctttggaaaaatggcttggaacaaagcaagggcggagagagggagaccggttaagtgttaggtaggagggaggtagtccttgtgagaagattggagagagagtcagaggttgactctttccttccttggctgcaggctcagatttgccctggagtatgcggctttgagtcacacagattgcacgcttccctttgaggagcggcttccactttgggcaagttggggtaactggcacagattctcttctcaggaaagcaagaggtcgcggtgcagcgggcacaaccctgaactaggaattggaaaacttggggtccactctggttctctgaccttgggccaaacattgaatctctgttatctgtaaattgaagagcctggagccttcaggatttttggtcccttccaaggaggtcccatctgcccagatgtgatagtacattggggtgagagtgctcagaggagaggcaggctccacctatcagtggagtctcagtttctacgtagattgtagtacagattttacctctatgctataatatattctcatttattttgaaaatatacttccttcttaactctgggttttgtttttttttttttttttcacagccagctgttttttatcctggttagaagaattttgtgttttcttttagctatggatctttgaacattaccctatgatcgaagagttttgagttgggtttttagatgttggttgtcatggagaaacaggaatctggtgtatgccagccatcatcatcatcatcataaccctttggatgaattttcattatcaagggatctggaaggctgtcttcgctctgcttcccagctaacaaacagatgtgttcccagaagatgatgggcatagggtgtgtttttgcaagtcatttttcccatttacgtagattattcttatttccaattgatcctcaatagataagagtgccattgagctttattttcatctgtcaggcaattaagaaaaaagtaaaggaaacaaaaaagctataatatactaaggaaattcttagattctttggtaaaattaaaagaatcttggtgcatgaatgatccggccctaatctatccatcttgcacatttgggttttcctggatctctcttaaagtggggcacatctctggtcttgatagtcaaggaggagggttggggtaatcagatgtctcaagcagaggtgcatcattgagcctgggtaatggctgaaagtcccccagatatccagtttgaagctgcgttgggcaggccatgggttttattacgtccaaggcgtgacaggcaaccattctataacagaccaactcttgggcttccagaagactgaaaaaagctagaacatttactaatgccaggtgttgcatttgacactttacaagtataacctcactgaaagttccccacaaacatctgaagtagattctgcttttatctccacttcagagacaaggagattgacacttacacagattaaatgatttaatagtgtcgaaagacaaaatcacaacaatttctcttaaagatcttaattacctttatttgcaattccagaattgggtaacacttcattccataaaatagagtaagtgttccaattagctaagcagaagaggttggttttacagccagagaggagtagaagaaagcaaaaaacagaacccagagtggattggtcctttcaaagttaagttccttgtaaggtggggacagggagacagaacaatagaaaagtaactgattggttaacatcaggttactccaggttacttttttgtaaggattacagtagagggaacttaattatcatgctgattgaaactagcctgcttgggaaattaggctgttacctctctcccgatttctcagagggtcagataacaacctattttcagtttggtaaaaatctcagcttgagtgactccattttgattaaattagatttttggggtctagtgcaagaccttagtccaaaacaatgactttctataatttttatttaacaggagggaaacttgagatttgaattcaagccactctgactcaaaagccatggttttctcactcttttgttcattttctcaataagcttgcaaatgcttttaacctctgatgcctgcagccagcatgtacctcaatattgtctgctagtcacatgtaggtaatatttcatcatgtggttaatactaagagggctatgacctcttaataatgatgcatcttaataatgatgctattattgggactttgatttcagaagtaatgcaagatctgcctaaatcctaattatccagcttggaagagtccctgacatctgaatttacaccttttcttcccttcttttttttttgagacggagtttcgcttttgttgcctaggctggagtgcaatggcatgatctcagctcactgcaacctctgcctcccaggttcaagtgattctctcgcctcagcctcccgagtagctgggattacaggtgcctgccaccatgcccaactaatttttgtattttttgtagagacagcgtttcaccatgttggccaggctagtctcaaactcctgacctcaggtgattcacctgtctcggcctcccaaagtgctgggattacaggtgtgagccatcacgcctggccattcctcccttcttttaatctcctttaggtgtctatccagtgcaaccataacccacaagctcttccctatcactcctttcctttctctggaggtaaattttataaatgatgtgtccatcataatagccattttacgttgcagaacaaacaaccccaaactctcggtggcttaaaacaataaagatttctacatctatacacatctgtcataatcaccagggaggctcttttagccactcagaaccaggctgatgaagcagctgcagcacctcctcaaacagctggtctgaggtgctgagctgatgggcaaggagaatcagaggatctcttagtggtgtttaaatgccctgtcacttctgctcctgacagattggccagaactctgtaaaatagtgccacccaaccataagggggccaggaagcacagttctcccctgtgccaagaaggagagaaacagaaatgtttggtgagcggcatggtgtaaccaccacatataccatgccatatatatcctgcttccttctttttttctgcctagcttggcaaatctgacttcacgtaaactttatagaacatgtatagcctctttaattccatttctctttcgcctttgtcttccaaaagtttttcaggtactgcaaaacagtgtctctccttcgtgtaagccaaaaggaaagatctcaagccttgaagtgaaatatacataattcatccctcagtatcttcagggattgatcccaggactcccgcccctgccccctcaaaagccctgccaaggataccaaaatctgaagatgcttaaatctcttatatgaaacggtatagtatttgcatataaccggcatacaccctcacatataccttaaatcatctctaaattacttaataatacctgatacatgtaaatactatgtaaatagttgttatactatattttaaaggtttgtattatttattagtattgtattgttattttttattgcttttttttccctcccccaaatattttcgttctgtggttggttggatccgtggatgggaaacccacgggtacagaggactgaccatattaaagagttagggctactaacctcaaaaagtttctgaatgaccggaagttcttctgatcttcacaaacatctcttgggttttctcacttgctaaaattaaatctgtcttttctccagtgtcaatattcaagataaataaattatgttcacattcactcctattgtttactgttttgcttaattggctatatttcaataatattaaatggtattattttctaccagtttttaatcagacttgaagcttttcaggcacattagagagtaaatggacttttgtgtgataaattgggtacctaatcaccaattttaatttacttctgaggaaaattctattgtaaattccagacaactggtttgcaaaccctgctttagaatgcaacctctttctaggatgaggcctttttctgtagcaaatttctgtataacgaaaataccagaataaatgctgggttttaatggacagttatgctctactacattcatgaaaaatgtacttaatttacaactctactgaacacaattcagttttttccttcgttcagttttttttcatttcagtttttctactctaacccagattgaaactttgcattatctttaacttctctgtctttatatttatttccttcatttagttattcattttttcaatcattcattcactcactcattcaataaatatttactgagcatctacttgttgtagtcatgaagcaaggttctgaggaatgttaaaaaacacagtccctggccgggcacagtggctcacacctgtaatcccagcactttgggaggccgacacgggtggatcacttgaggccaggagttcaagaccagcctggccaacatggcaaaaccctgtttctactaaaattacaaaaattcgccaggtgtgatggcgtgtgcctgtagtctcagctactctggaggctgaggcacgagaatcacttgaacccgggaggcagaggttgcagtgtgctgagatggcaccactgcactcctgcctgggtgacagagtgagactgtcttaaagaaaaaacaaaaacaaaaaacatagtccccgacctcaaggagattctgtatagcagagaaacacacaagccagcatgccatgatacatggtacaataagataatggctgcaacggaggtctctgcaaagagcagctgagcagagaagacctatctggatctgtttgaaggagtcaagaaagaaatcagaaaggaggcagcttttcatctgagacttaaaaaatcagttggtggctgggcgcagtggctcacgcctgtaatcctagcactttgggaggcagaggtgggcagatcacgaggtcaggagatcgagaccatcctggctaacacagtgaaaccccgtctctactaaaaatacaaaaaagtagccgggcgtggtggcacgcgcctgtagtcccagctacttgggaggctgaggcaggagaatcgcttgaacctgggaggcagaggttgcagtgagctgagattgtgccactgcactgcagcctgggtgacagagcgagactctgtctaaaaaaaaaaaaaaaaaaaagtttggctaggccaaagagccaggcaaggcagttccaagtagagcagaccacacgaaggtgtgagagaacacagtttgttcccataagttctaccactgtgggtggagcttcaaatgcaaaagaggaaaccaactaggagataaccctaagttggtgggcagggaactgagcactcagggctttgcctgcctctcaaaagagtttgtattttatgtgggaagtgaaggagctatcgaaggcttttgaacaacagagtgaccgcatcagatttggtggcaatatggaggctgctctggagggacgtgacctgagatcagggcttctgaactttatccctagacttgcaagggacccatggataagatgtctgggatctgtgaacttggattggaaaaaagcgttatactgtcattttcactatcctctaaactgaaatttagcatttccttcaaataagaatctaggcaacggatcacagtagaattaacagaagatgtgagtttatcaccagtagaaatgctctgatagcatattacagttgttgtaggtatttcaaaatatcttttacacttatcactaaactgaaattattatagatattagactcactgccataaattgttacttaatgaattaataaagaacatatataactgtgtgacaaatataaaaaataatttgatatttacattttaatataatgtatcttttgtttttattttatgatttaagcacagtattctgagaaggggtccataaaaaaagtcaaaactcaacacaccagaggatgtgagtcaaaactcacatcaccaaaggaacgtgatcgttgaggaggtcagtgtagcctaaggcagcgatggggagaaggaggaagaggagttggaagaatttgtgagaaattctggagacagtgaatttttttttttttttttgagccagagtctcgctctgttgcccagagactagactgcaatggcatgttcttggctcactgcaatctccacctcccaggttcaagcaattctcctgtctcagccttccaagtatctgggactacaggcatgcaccaccaagcctagctaattttttttttttatttttagtggagaaggggttttgccatgttggccaggctggtcttgaactcctgacctcaggtgatccacccgcctcggcctcccaaagtgctgggattacaggcgtgagccaccgcgcctggcctgacagagtgaatttgttgatagatcagggacataaagcaggggtaggggtacgcatagaccccatttcctccagcagttttctggctggagcagaatgcttatgcttgccacatgtgttcctttcttcccagtgctatcattatttaccgtacagcatggtttaaaacacggaaaacatccatcctttgcttccctcctctgtgcctgccagtcctacacctttctcaactcttttagtgttatcttctccagctagactgcagattctgggcaggcagtgccttgcagtctgcgaccccatcatatatttttcacagttgatgttgaatacatgactgatagatttcaaaggcatttcctgttttgaggtcaccatgtacaccatattctagttacagaaattataccaaccttgacattctgggaattttttttttaaattcccatgggttctatcatttgtcttctcataaaataatacaaaatgtgcaaataaaaaaatccatatgcttgggcttcctgattgtttttattaaagtgagtttagtgatggtgggttaaataatgctgtaatcttaagccagaaattgagaatatggatttgaaatgtccccattccctttttttgtttgtttttgttttgttttgtttgctgttgcatgttcttggcagcagtggttgatgtcagtattgttgcccatgttgtagactgcagatgttgcagtgtagcttagtactttggttcgcttgctgaaattcctcactgtgcttcttatgaggtccaggaacatatagatttgcagtctgatgtattttgatgattgccagataaaactgatgtctggcactttttccaggagaaacacatgtagacgtttccaagttgatttgtagggacttagtgttattagaactttgtggcaaaactttttctcaagtggcagaagaaataaaggaacttcagttttgagggctgttaacagcacttccattagtggcaaagctgagatggttgacaaagtactggattgttgagatggaccttccaggccgggtgtggtggctcacgcctgtaatcccagcactttgggaggccaaggtgagcggatcatgaggtcaggagttcgagaccagcctgaccaacacgatgaaactccatctctaccaaaaatacaaaaattggcctggtgtggtggtgcgcgcctataatctcagctactcaggaggcttgaacccggtaggtggaggttgtagtaagctgagatcgcgccactgcactccagactgggtgacagagcgagactcagtctcaaaaaaaaaaaagaataagcaagtactgtatttggacttttaagcattactgatacagtaaaatacagttttagctaccgacgcaagactagcacccaagattttagaaaaaggcactttttcccttttattttccaataacatttctcaatctggtaaccagagagactactctgggattaatttgagtctgattgctgtttactgttctaacaagaacagtttttttggagaggagagcagagtttaggagaaacgaactattaaaagttagcttcccgtatgggcgtggtggctcaggcctgtaatcccagcactttgggaggccgaagtgggcggatcacgaggtcaggagatcgagaccatcctggccaacatggtgaaacctgtctctactaaaaatacaaaaattagctgggcgtggtggcacgtgcctgtaatcccagctactccggaggctgaggcagaaagaatcgcttgaacccagcaggcagagccgagatggcgccactgcactccagcctgggcgacagagcaagactccgcctcaaaaaaaaaaaaaaaaaaaaaaaaaaaaaaaaaaaaaaagttagcttcccagtgtacacatgaaaagtacaatccttttcttcatttatattataattatttgaagagcaaattaggtattgttagtgaagaaatgagagtgattacctggtaatatgatgagttactttttctttaaacttactggcttttcccttaacactaatggtctggataacaagtttttacttgttggcagtgcagtttagcctccgaacactcttggaacaaaatgactaattttttttaacgctttattgaaatataaattttaggagagtaaacattttcgatttggaagaagtagttacgttacagaccttcaaatccagcttgttcgggagacttgacatttaatcactaggctaatgaagcgccagaagagagagcttttatggttagaaagggaggtgttttttaaaaaaaaaacaaacgaacaaacaaaaaaaaaaaaacaaggctcagcccgagatactggaagcgacttgaccttgatttacatatacaaggaacggaaatgaattagcccggctagatatttctaggaactagttaagggagaatgaacaagatgggagcgaggagaaagcgtgtgtgcgttcgtgtgtggctgtctgtctgtctgtctgcggcaagaggaatctcagagtttcggttatttctccttgaagaattttcaaacggagttcctgcaggggctggctctagcgtctacgatgtgcacacactgtctctcaagagggaagtgatcctggcgccacggggtgatgcagcagaagttctttttgtctgtggccagggtagagtgcggagccccacggagctgtggcgtggcggctcctcccagacgcgtccggggcgccgctcgggtctcccaggaccttatgtaacccagcgtcggcagcaaggagccggtcacaggctgaccaacgtcaaggcgtttcactttggaagcgcaccagatgagtgtggtattgagagcagacggctgggtgcaatgtttttgccgcatatctcatgggttattttaatcttttcacgtagtcttaagggtctcactagaccgtatatgagaatgtggccagggatgtggcttctatagattgtcccagataagagcatcccttttgtttttgttaatgcagggtaaatacaacctcttcttaggagctagtttttcaattattctaaaagtgataacatgctcatggttcaaaatttagtcagttcagaagtgcacaaaatgaaaaaattgtccaactcccgtcccactccccagaggtaactattattaaaagtttcctttttattgttccagaatttttttaatgcagtcgaagcctctatttaaatcatgttttaaagcacacacaaatattattgtactatactttctgctctgcaatttgcttttaaaatttaatatttggactctctatgtctacctttctctctatatatctatttatatcttcatggcaacataaggctttgcctcattcttttcaacagctgcacaatattccatgatatgaatgtaccattactgattgaatcagtctcctgctagtggatatacaggttgttcccagtttcgtgctattacaaacaacggtgcggtacaaatctgtgtgctaattgttgctgtgtgcttatgggaacatatatgttgagtacattcttagaagtggaactttggggcccaagggtacatggcacttaacattttaatagatatttactttcaaatcacattcccaaaaggttgttcccatgcatatttcagatggaaataaattctgtctttcaagttgtacacatagctgagggttttccttaaaatactgttcatttttaaacagcatattttccattgagatcgaataaacttgtttatttgctaattaattgcccttgaagttaaatctctattctagaaaagatgtctgagaaacctagtggaaaggcctcaacaacttcgtcccagccttgatcagagacattcacagctatgggacaggcacatggctctatgccttgactgtggcttcatagacagctgtctttaaaaaccctagggtaggactgagaaagctttttttttttttttttttttggtatgtgtaataatatcatcttcaattagttctgttcaaaggacatcgattaagcacaactatagtaaaagtttctccagttccctactctctgtccccttatcctggtttcctgccttctctctccccttttgtgtttgtttcttttcataccagttatcctctgcacccactcctgacaccagattgggtggccagttctaggaacaatgaaactgatttcctacaactggaaggtggttctggagagggaattagctttgcctaagattattatcacgctgacccgactctatatctagatcctgcctccagtgggatagctgatctgctatgactcccaaatgcctaaagctctccgcctactcagaaacacagcatcttctttaaagctccagaagagagagcttttatggttagagaaggaggtttaagaaaagcaaacaaatagggctcagcctgagatactggaagcaacttgaccttgatttacatatacaaggaacagaaataaattagatattagaattaaattaaaatcaaattttaatttagatttgtataggtaagacctattacagatgaagccagataccaagatatgtttcaaaaaacatgtggttcacattgctattaaattgtttataaatgatcatagtagcatcccaattaccttttagattatagccaactttttgggaattacaggacttttacaagtattttatttcccaaattacctgcttatctggaaaataaccctagtaagaccaagcccactcatcctgaaaactcatcttaaatgaagccaagtcaagtcagaataagatctgggtgtcagcaaaaaggaaaacaaacaaacaaaaatcaaaccgaaccacgctaaaataaaataaaataaatttcccatttaaagtctgaatccctttggctttgtaagctactgttaccatacagaggcatctgccttaaaataaaggaaataaatcaagagcgtagaaaacctgtttaatcaaaactcttaatttcaaatcagtgtttccataacacattacaagccagcaggaagagaggggaggcaaaatgtgcagttccatgatgtccccaaatagaatgttcacaactgacaggaagcacctgggggattatgattatttgctttagaaattcaaaaataaattgttttttgaaataaaaagggaagaacaaatcggtttctcagttcaggttgtttttaacacttcacacacatccatttttataatcccaattcagaagacaatgaattcaagttaataatgtatttaaatttaaggataatgcagagaatgtcaaaatagaaaattgcaatagaacagttgagctgaactctgaggctccttttcttattttgactcaagttgaccttcaatattatagtactttcatttttacagctctttacatattctgtaaaaaagcttttaaaaagtgaaatgaagatgtttcttaactattaaatttctattgcctaactcttttaattttttgagtccattaagactttagaagatattctttctcaaatgtgtcatttaattaacaatttgctaatggccttgataggatttttccatttttgttttccaaatcaagaaatctccatgttccttttattattttcactttgtttctttagatataattcttgtttttcctggataattagtatagaatttatttattgtagagaactctgttctgacagctgataatataaatatatgtttgacccacattactagaaagaatgttatgtaagggagtttgtcagggaatatcagctctcgaacactgggagttcagggaaagaaatgaatttgtaggtcattgatctttgtgttttaaataagaattaaccaagaattttatggttacataaccagtacatgaactagtttttactacattttgttaatacatcgaattgaataatccaattcaaaacatagggtaccaattcctcttgtcagcaatactttgaaagtagggatttattgagagttcttttattgccttgacttccttacgtttgtaaactatgtgatgggtattacacttagatttattagggtacttaaaatcttgccaaaatgaaacaatctctttttgtcataagtattgccgacttaaaagcatttgtgaggggacggggggtgattttgcttttggagtcttactcgttactgaaaataaaatatgctcagctttttctttttctagtagacatttattttactgagttccacactgatagttaactttaggaaatgcttcacatattttaactaattttatgatttaatttttaaaaaggaggtacattttagaattttttcccccttttagatacctgacttacgtgtttctgaagataaattgcagatccagtcactataaattcagttgaaagaccaatctttctacccttctttgttgttctgatttcagaattccaggccagtttgttgtcaactttaatgtaccttttgagaaataaattgagtctcacatttcttgcatgtgtttgtgcccctagagctggaatgcttttcttcggccaactgaaagtagagcctgctccttctcctctcacagattaaatctgctttcattcgtgttaaattcagttagttcatgaccaaaagaaaagacgtgctctcctttttctttttaattttaaacaaccaccatctatagtcttcctgtagtttttgagagcttcaagttatatagctatttttgactttgtgtttggttaatctaatagagtctacatttttgggaggcatttaatttgtgattatcccttattgtagtctacagagtcacatcaacaaaatgagctgttttattttattttactttactttcttttctggtctttttgttttgtaatttatttttaaatttattaatttgtttttaatttttttttatgtgattcttccagctactttccagtagcaaatagagggcaaaaacagtcataattttattgaatttgcctcacccctgtgtttgcccctgttcctacttactcacaatttaatacttctcagaactttcacatttcacctagcatggaaacctgattgttaaatggttggataggacagtgtgtaggagaatccttgggatcaataatagacatatttgggtttatttcacaggtattaggctgtgtttcttgacttttagttgagtgcttactcttgccaaattttatgccatgcactttacatacattatttgatttaatccccataacaccatgcttggcatgaaaccacatagtctgtttacattttgcagatgaagaaactgaggctcaaagaaggttaaagtagaaaggcatccctttactaagtggcagagccgagatttgaatcagcttatctgattttaatacctgatttaatatttaatatttgggatcttaagctatgccatgcagcctgagttactaactgggaagtcatggttatatcagattcctaagataagactaccaagagacccaggcccatgcatttgatctcttgaatgttcaaaggaaactgcaggggctgggcacagtgactcacacctgtaatcccagcactttgggaggctgaggcgggcagatcacatgaagccaggagtttgagaccagcctggctaatatggcaaaactccgtctctactaaaaatacaaaaattagctgggcgtgttggcctgcgcctgtaatctcagctacttgagaggctgaggcatgagaattgcttgaacctgggagctggaggttgcagtgagccaagattacaccactgcactctagactgggagacggagcaagaccctgtctcaaacaaacaacaacaacaacaaagctgcaggttctgcaggcctttctgccctgcaccctccaccacctactacaaattgtctttcttcttgggggcctcacttgtctcatctgtaaaatagaagtattatttcatgtggtctatatctctcctttaaaagaacacatttttaaaaatttcaaaagaattatagatctcaaaggaagttgtggagatagtacagagaaggcctgtgtacctgtcacccagtttccccccagtggttggctacatcttttgtaactatagcacaagtaaaccagaaaactgatcttggtataaagtgtttgtgtagttctgtgccattttattacctgtagattggcgtaaccaccactgaaatcaggatacagaactatcattacaaagatctcctttgtgctacccatttatagtgactcccacattcctaaccctttgcagctgctgatttgttacctatcactataattttatcatttcaaatcccttttttttttgagacacagtcttgctctgttgcccaggcatgatctcagctcactgcaaaacctccttctcctgggttcaagcaattctcctgcctcagcctcctgagtagcttggactacagttgtgcgccaccacacccgcctaatttctgtattttcagtagagatggggctttgccatgttggccaggctggtctcaaactcgtgacctcaagcgatccacccacctcagactcccaaagtgctgagattacaggtgtgagccgccatgcccgaactcaaatctcgcttttaaaaaataattttttgtattatgaaatagctcatcagaaaagtacagggaatattgtaacaatacttatgtaatcaccactcagccataacagatagccagatttaataaatattgttgtacttcctttgctgatttattttaaggcatctttgtcctactttttgaccctactgacctcctaccctccctagagataaactctacccaaaagttattgtatatccttcctgtccatgttttttctgtttcactgcataactaggtgtctacaaacactatgtagtttagctttgtaggttttaaaaattcacataagtcaacaaatatatattgagtgcctactgtgtgctagacctcaggaatatggtagtgaacaaggcaaatcttttgttctaaatatgtaaacatttgaatacatgagataattgcaggcatctgtaactgtgtgaaaatgataatataggatatcagactggcagggaaagtggggaagtgaggggattggcagggcaccgaggaaacacgttgctgacgatactgtgttttcgatcaaaacctgattgatgagaaggaagagcaagtgttgatgccttaacgtaaggatgagtttggtttgtacaaggaagggcaacaagcacaatgtggctggaacagtgtagactccagggaggaagtaggagatgagctcagaggggtagaaggtgaaggtgggaggagagggggagattaggaaggaccaaagagatggcaccgaggagtttgggttttattaaggctgcagtgggaagccattgaaaggtataagcagggtcatgccatagttatgatataggggatggcataaaaggcattcaagtgagaagagttaggacgctgtttccattttccagggaagaactcaaccagagggatggtgataccttctattaagatagaaagacttgatattgatttatctgtctggatttgcctgaaggattcaacattgtttcaaaatttacttatgttgatacttttagataaagttaactcattttcattgctatgtatattccaatctatgagtacagtataacaaattttctttatctattaatttacttattagtagatgttaaagaaattctagcttttttactcctgtacacaattctgccaaagcatccttacatagagaggtttgtggataggatactagagtttctctggagtgtatatctagcaatagaattgctggggtctttttgatatgctcattgtcaactttgtcagatagttcaaaattgctctccaaagaggttgtaccaattattgtccctagtgcctagctgtttatgagaatttccatttcctcacctcctcaacagttagtgttaagcttttaaccattgctgatctgatggatttaaaatcatatgtcattgttataatttgcatttcctgcttactagtcactattttttttgaccatttagatttagatttcttttctaattcctattcctgtcctatgtccagtttgctgttgtgctgtttgtctttttttttttttttttttgagacagggtctcactttgtggtccagggtgaagtgcttacggtaacttcaaactcaggctcaagcaatcctcctgccccagcctcccaagtggctggaactacaggcatgcaccaccactcctggctagtttttaattttaatttttatttgtatagatggggtcttgcaatgttgcccaggctggtcttgaattcctggcctcaagtgatcctcccactttggcctcccaaagcgctaggattacaggcatgagccactgtgcccaggctgtttattctttttgagttataggatttctttacatattccaggtaaacaatccttcgttggattttaagcattgatatatacattgaaaaaacctttgttggcttttatgcactactgtggtttgaatgtatcccccagagttaatccccagtgcaacagtgttgaggagaggtgggacctttaatagatgattaggtcatgagggctctgccttcttaaatggattaatgtagttataatgagagcgagtttattatttcaagagtgggtttgttataaaagcaagtttggctttctcttgctctcttgcacatgcatgctgtcttgctcttttgccttctactgtaagatgatgtagcaagaaggcccttgccagatgctggcacctagatattagatttcccagcccatagaagtgtgagaaataaaattcttcatatgttaccctgcctcaggtattgtgttatagcaacacaaaatggactaagacatgcactgaaataattttgtcttccagttttagcttgtcttttcactgtttaaagtaatgctttacatttacaatattactgtagtcagatttaccaatcttattctttacattttgtgttttcctaccctgtcataaatatattcaagttgtgcttttcactttagttgttgaattcacctgaaaaaaaaattaataaatggagataaaggtatagatttaaaaaaaattatttttcttttctttatggaaaatgaactaacccagtaccacttattgaacagtcttttcctttccctactgatttttaatgttacctttgtaatatatcaagttttccataagcatgggtctgtttatgagctcactattctgttctgctcttctatttgtccgtctccacaccagtgccattcttttgtaattactatagctttataataactttgctatctagtgtggtgagtggtttttgtttattcttctgtgttatcttggccatttttgattctttactctttgatactagcttaaggatcaacttgtcaaatgctgtgatgggaaaatgtatagattttaattgtaattacaatgaatttatagattaatctgaaaacaattgccatctttgagcttttccatcccatacatgaacatgaatatcctttcatttatagagatttttttatgtacctcaatcaagcttcacttcataatgatcttgtatttcctttgttaaatctgtttataagttacgtaaagttttttttttttactattgttaatggaatcttttaaaattttgattaaataaaacattttattatttattattttcatttttttttttttagagatgaggtcttgatctgtcacccgggctggagtgcagtgacgtgatcatggctcactgacgacttaacctcctgggctcaaggggtccttttgcttcagcctcccaagtagctgggactacgattgtgcatcaccacacctgactaatttttttaaattttttgtagagacagggttttgctaaattgcccaagctggccttgaactcttgcgctcaagttattctcctgcctcgacccctgaaagtgttgggattatgggtgtgagccaccttgcctggctggaatctctctctctctcttttttttttttttaaatataccttctgttagttttgtgctggtatatgggatcactattgatttttggatattcatttgtatccagcgacctttctgaattcttactaattctaatagtttgtctgaagagtctggagtttttaaaaatttcatatttatttatttattattattacttttttgagactgagtcttggtctgtcacccaagctggagtgcagcggtgtggtctcggctcactgcaacctccgcctcctgggttcaagggattttccatccttagcctcccaagtagctgggattacaggcgcccaccaccatggccggcttttcagtagagactgggtttcatcatgttggccaggctgttgtattttttgtagagactggatttcaccatgttggccaggttggtctcgaactcctgaactcaagtgatctgcccgcctcagcctcccaaagtgctgggattacaggcgagagccacagcgcctggccaaagtctggattttttaaatgtatttgttcatattgcttataagtagctattagttttctcaaagaacgagcatttagataatctctttaagtctctcttccaaactctgtgatatatgattctattcagtgcttttgtatctatatatgggtaaaaattaagcatgaccactcattcttggtacattgcacaatatcttgatgcattatacaactgtcttttttttattcctgcttcctattcctgtctctattgaatttactagaaaattttcacataaacttagattaagattttaaaaatatatagcaaaagtaaaaatctttaagagatttaacaaccttatatcacttgctgatgaccatcagcatgtacagttactgacagtgtgtgactatagactcaaacacattctagacatattacagattgcaagatggggccaagaaaaaacaagaaaaagagaattatgtcagtccttagtatttgtttgtttttttaaatacaagggcttgctgggtcggccaggctggagtgcagtggcgcgatcacagctgcctgaagcctccatctccagggctcaagcaatccttctgcctcagcttatcctagactacaggtgtgtgccactccacctggctaacttttttaaaaatttttatttttagtagagacgaggtctcactatgttgctcaggctgttctcgaactcctgaggtcaaacaatcctcctgccttggcctttcaaggtactgggattacaggcataagccactgtcactggccaatcctcagtatttgtagcatatacatacacatgaaaaccacacatatgaatgtatgtgtatgtataaagtcatgtgacctgtacaacatatcggcatgagaatgtgtgaacgtgcttcctgttcacatgtactccaggaaatggaaccagtttccaattaagattcaaaggtatatgacaggtctacaagagactttgggagatattatttcagagttgagtccacttcaccaggcctttcagaccaggagtggctcaaatttgggtagtactcaccacttaggattatggtcagggcagttcacagggtgcttcgtaacaaaactccccttcacttctcagctcccaggaaagaagggggctctttcctgcctcagagccctgcattctgtaatccactaagatactcaccttgactctgcgaggagagggtggtgacagggaaaacacagaagtcagtgaactcatacaactcacagccaggttgtcatctgggtcctttccatctttgtagttttctaggtgaagtagctgacaaagggcctggcctagagagcgctgctgggcctgctttactgggttgtccaaacttccctggagtgaggtccattcaagatgtgggctcaactaagaggaagttaccagactatttagtccactgccgaaccttggtccgagaccaagtcgtagctgttccccgaagctatgagagtaaacactgcctcctatttttagtagttaattgcttgcaaaaaatagctggaaatccagacctttaagtctcagcagcctttagcttcacagaccgtcctgtggcaacaacaatcttaacaacaacagtaaaaaaaccactaacacttacctggggtcactgtgtgcagggccttgtgctatatgcattgttttgtttaatcctcagactgagtggtcattgttattatccctatttttttaggtgggaaaaagaagactcaaaaaggttaggccctctgcctcaagtcacacagcccttcagaagcagaaccaagcccagtccaagttagtacagcctaaggctacagcctacggttttgaccacttctctttcccacctttccacatcccataatggcatccatggtgggatgtttattacatggatctggtccagtttcctcaaagcactttcgttgataaactggactcaatcaagttaaataaacaagagattattacctttattattttttttaaagccattagatttacaagttaccttgtcttcctcctcatgttcccttttttacagagaaacccggtatttttccagtgcagtattatttggggtaatgcttgacaatttaaagggcacgcagcagttgtgtggaatgtagtctgaaaatggccaataaaaccatcagagtatgagcaagctccagggtggaaccagaaatgtggccgcctgctccttgggctgattgctttagcagaaaaatcaagttcaggatcctgtgtttactgagatgattggcatgtattatcagagtagctgcacctggaagatttccgacttaaatctattgacttcatgtaaatggcatatggaaaacaacaaatgatagtttggttgccaaataaaagtacacagaacacccacatggaggcaacatgcttgtttctattttgacagctctcagagggaaaacgttgcggtgttggcctcttcctggtgagtcctcattgggtatatgggtataaaaaagctttgaaacatcctttgctcctactcttctgcactcatagattctcaaaaaaacaaacaaaacaaaacaaaaaaaacaagaaaaatagtttttctcactgttaatcctctgatgtggaaagaatgtgaaaagcagacgacattcttacatgaataagccatatataaatgaaatattgggcaatgcctatttaaaaaaattaacacccaataatctgcatttttattccccagaccaagcagaaatgattcattttatcctaatctaatatttttatgcttgagttttattgttcaaattaacaacaaaaactacaataaaaatgtagttttgtcagaagaatgattttataggcacagttatgcctgccaaatatacctaaactcaatgttttaagaaaaaaaactgtggtgggtattttagaaagttagacttacattcgtaaagtgtttggtcacctattaacatatgagcaagttcagaatttttgcatgttgggttttttctttttctttgcttttatttatttatgtttttttgagacagggtttcgttttgtcgcccaagctggagtgtagtggtgcgatcacagctcactgtagctttgacctcccgggctctagtgatcctccctcctcagcccccatcgtagctgggatacaggtgcacggccccacacctggctgatatttttttcttttttgtagagacagggtcccactatgttgcccaggctggtgtcaaactcctggtttcaagcgatcctcctgccttggcccccgcaaagtgctaggattacaggtgtcagccactgtgccggcctggattttttttttttttaagttgattgctcacatgtatagggtaaaatttttaggaaataagcagccatgcccactccccactcctgccccagtagtcttgtaatgttatatgtcaaagcagctctcagtgcttttacattttcttacttttaatttaaaattgtgtttataatgtatttcaaatatacaaaaagcacagagcacagtaattaccaatgccaccaccaccacccacatttaacaaggatagttgttgcggcttgtctttatcgctctcttaaacgagcaagttgccgagtgttacacacactatataactaacgtatataagataagaaattaccccaaagtctactatgtattgcttatggatacttatacttcttaagacataaatacacaatggggaaaatacttaaccactcctgaagggccattacctgtcagaaattgggtggatgaggccaggggcttcaaccatacctgtgaagccttatttttaaaaaaagtcatctgaggtgaatatgggaaatgttaatagttgttgatccctggagattttcagtgtaaagcatatggtgagacagtttgactcttcaagcagaaactggtcccttagaaatgcacctcctccgccaatcaggcacatttgtaattaacaaaaaggaattatgtgaaatgactacaagtggatgcctcctgcatgcatttctatggtatgaatatcacttgagtcaggtaatggggaaaaaacaaatgtaaaagaaagggagcagggaaaggaaatgtacttcaaattgtgtccttcctaattttattctgtctgacactcttctgaggggcagtagaggcagaattcataacctccaccatcatcttcataattgatatttactgagttctttataatgtgtctgtcattgccaagtactttacttcagatattagacagggtatagtttcatatgcctgaacagagacccaaagtaacagcagcttaaacaagatagaattttatttctcactcacatgacagtctggacatatgtagtccatgactgatatgatggttccacgtgggtcaaggatccaagctcctcctatcttgttgctctgctcttcctagagtatcgcccttttactcatgacccaaaatggctcttgactctccactacaacatctagttgttgtttatatttcactggccagaatttaatcatgtgagtgcatctggctgcaaggaaagctgggaaatttggtctttgttctgcacagctatggatggcagccataaaaattggggttctattcctgtagaaggagaagagatggatattgagggccactagaagtgccacaagtggatagtttctattaatccttctgacactaggagtcaagcccaagttaccccattcaacacatcagaaaaagactaggtcaaatgctgtaggtcacacagttaatactttgtggaactgctgaggtgtggctttatttttgttcctttttgcttttgcatctagtttgctgagaagctctaatactaggatcagggctgagagttcttggcctccttgggattaccatacctcatcagtgtttgcttgatttcatcacaccttttaaaacaattatccagcaaggcactttgtggtgtgttctttagagttgaaaacaagcacacatttaattgtttttgtttttgggacagggtctcgctctgtcacccaggctggagtgcaatggtgcaatcttggctcactgcaacctctgcctcccaggttcaagtgatcctcctgcctcagcctcctgagcagctgggactataggtgcccaccaccacacccagctaatttttgtatttttagtagaaatggggctttgccatgttggtcaggctggtcttgaactcctggcctcaagtgatccacatgccttggcctcccaaaatgctgaccttacaggcgtgagctaccacaaccgacccatttaattttgttcaaggaattctgtgacacttatttagcagtgggtagtacatttgggtgttgcctaatcagaactggggacctagaccagggaaatatcattctatagtttgattcagattatacctggcttctggttaggctagaatatgtgctcccaaaatcttttaaataaggacatcctttaataaaatatgtgttctttttctataacatctttttctgagccctatcttgagaccatagactatctcctacatattaataaaagatggcagattttctaggaatggttttatttgaaggagaaaaaagtagcattgaaaccagcttttgcttttctacatcctccaaccactggcatcttccatgaaacacaatttgataagggagtgatcccttttttccactcagagtacaatttccaagagatggcatgtgctgaaaacaaaacttaaaaagggaacctggttcctgagagttcacatttgacatttttcaaggtcatgccagataaaaaggatacaccccaggaagaagaacacaagatacctgctgtagccctctgcctttggaaacgttaaaattgaagtcattgcatggtgcaatactggagtaaggaatagggtgaggcaaatgaggcattcactcctgacagcaaaattcacaggggtgccaagcaaaattcacagggatgccaaaccctttgtaatcaaaatcaatactattttaatgcaatagttgaaacttcatgacgagcaaatatcaatattttaaataaaaatacgctgtcatttgtttgttttaccattctgcatcatcgtgtgatgggaacagtcatttccagtcagcctgagggtcctggccccctggaatacccctcactgtgtggatttatgaggattgacaattgtgagaacagactgtatgatgtggggctttattacagttacggcttctaaaaaatttattctcaactttatggaagaaaattagtctgtcaactaaattttgtttttagtagttatggattttgactgtaaatctttttttttttttttttttgagacagggcatcatttatcacccaggctggaatgcagtggtgcaatcataactcgctgcagccttgatctcctgagctcaagtgatcctcctgcctcaaactcctcaaactccatgtgccaacatgcctggccctttttttgttttttggttttttttttggtaatgacagggtcttgttacattggccaggctggtctcgaactcctgtcctcaagtgattctcccaccttggcctcccaaactgttgagattacaggcatgaaccaccatacttggcaatgttaagcttttattaatttttctcacttggctaaaaatacagaaggatattttgatgaatgtatataggagggcacatttttcttttgctcctggctctaatgtggctctacagagcactgttctggacctctgagaagcctgttcttcatgctagatgagtcatggctcatctaggttctattttcaggatgacatcacttactaactctgtgaccttggggcctcagtttcctcatctgtaaaactgaggatgatattacatagttcatatacatatacttcatatacatgcagcactatagaacatgatgtaagcactatatagacatgacataagcaatgttgaactatgtaagtattagcaatttttggtattatttctgacaatgcgatgtcttatttattgctatgccttctaccttctaaaaatcacctcctatatcacattaaatcatctcccattccctgatgggatgcatcccactcggtgcaacatcagtttaatggaaccaccacaggctctggaaagttatatccctgaaccccaaaatactcagcttaattggtgttcctttaagcaggtcactaagttctctaaatttgaattttctagatgaggataaaaatacctactttccaggggtaagtatttaccttaataaacactgtaagaggccaagcatgctggctcatgcctgtaattccagcactttgggaggctgaggcgggcagataacttgagttcaggagttcaagaccagcctgggcaacatggtgacaccctgtctctatttaaaaataaataggccaggtacggtggctcatgcctgtaatcccagcacttcgggaggccgaggcaggcaaatcacctgagttcaggagttcgggacctgcctgaccaacatggcaaaaccctgtctctactaaaaattcaaacattatttggacgtggtggtgtgtgcctgtaatcccagctactcgggaggctaaggcaggagaattgcttgaacccgggagacagaggttggggtgagccaagactgtgccatcacactccagcctgggcaacaagagtgaaactccatctcaaaaataaataagtaaataaataaataaagactgtaaaatttacttatttagataaagtattttattaatttattaatttttattaccttaataataaattaattacattgatttacttaaatattaccttaataataattatttatcttaatttattaccttattatttactttaatttattacctttattatttggtaataataatttgtaactatgggaataaataagatcagagataaaatagagagcatctattcaaacacttgagctgtaaaggatgatcagtaaatattggtttacttaaaagcagtaatttatgactgttccctagggatctgtggaaatctccagtggaatcttcaaacatgttgcctactgtcttagtttgttttgtgttgctacaacagaataccacaaactagggtcatttataaagaaaagaaatttatttctcacagtttaggaggctggaaagtccaatgtcaaggtgctgatatctggagagggccttcttgcagtatcatcccatggtggaaggtggaagggcaagagagaacaagaaagcaagaaggggctgaagttgcttttagaagaagcctattgacatggtaatgacattaattcattcaagagagcagagccctcatgatctaatcaccttttaaaggtcccatctcccaacacagtcgcactgaggattaagtttttaacatatgaacttcagggaatacgttcaaactatagcacccaccatattatattaattgtaaaatatccacacatatgttacaacagtcgttctcagactttagcacacataagaatcatgtggagctagggcaaccaagtcatctcagattgccctggactttccagttttagcactaaaagcccctcatcccaggacacccctcagtcccgggctaacctggatggttggtcactctgcctggaggatttgttcaaacacaacttcctggacccccacctttagagattctgattcatcaggtctgatctgaaggggagcctgtgagtttgtatttctgacaaagctcccaagtgctgcaggggtgtctgagaccacagtttgagtaacattgtgctatgacttgaatccatgtgttcctccaaagtccatatgttgaaacctaatacccaatgtggtaatattaagaagtagggccttttggaaagtgattgagtcatgggcactccagttcatgaatgggctcagtactctcgtagaagaggtagaagggagtgccctagtccgtttttgccctgccatctcttttgccatgtgaagacacagtgttcatccgttttctgcccttccaccatgtaagaacatggccataaggtgccatctttgtagcagagaatggaccctcatcagacactgaatctcctagatccttaatcttggacttctcagcctctgaaactatgagcaatgaatttctgttgtttctaagtcacccagtctaaggtgtttttttaatagcaataggaatggactaagacacactttcacaatatcatactaatggccatacttggtgttttatttctaaaagttgagaattgctcaatttttagaactccacagggttccttacatccctaggaggctggtgttttaactctcattttataaatcttcaaggaggtgtcctagtccccctagtttcctggcctagactggccaggagatgaacttctggccagttattaccatagatctgcagtggacacatagagactcaagtggggacctctgctgagcaaattttgcttacatatcccttttctaattaggaactgtcaaaaaatgatttttttttctttttgagacaggagacggagtctcactttgccacccaggctggagtgcagtggtgtgatctcagctcactgcaacctccacctccttggttcaagcgattctcctgccttagcctcctgagtagctgggattgcaggtgtgtgccaccacgcccggctaatttttgtatttttgtagagacggggtttcaccatgttggctaggctggtttctaactcctgacctcaagtgatccgcctgcctcggcctcccaaagtgctggaattatgtgcatgagccacctcgtctggccaagaagcaatgtttgctttgcagacggcattatttcaacaaatttcacaccatcagctatagcaaccaaagcacctaattgcttaccaaaaatgtatttaaaaaattctctttcattacactgtaattattggcagccccaggagtcatattttattctgattttatgtttcagcacaatttatccaatttctgcagtccccaaaatgcagaattgctaaatgattgcagaaataaacaaaatctaatattttattgtattgtttcaataatcagtactattatgtgtacatttggtaagacttcctttgatattcagtttatattgattttttttttcatctatcacaaaggaggcctccgttggtttgcttctctgttttctttacaactcctccctctgctcagagaactgctttttttgtttgatcagcccccatctactggttatacttttgattgaattctcagtcaggccttgtcatttctgggattggagcttttccatgtagctccagggaatgttgttctttgattccaggagatgctagaacgaccctgtgagcaacacctacttcatggggttggaagcaaaataaaaggatgtatctaaactgctaaacatgagacctgcccattttgcactaaaaaaatttctctgatctgtccatttcccttcacacttcctcccaacccactgcctttccatgaatactccccctgcctgaaattcaacctctcctgcagtctaggttgattcctccatggtacttttccatggtatcatgcacctgtcctttggagcaccaatcacagtgccattgtactttttttttttctgtgattacttcatggctgtcttcctcctctacactgaggacaacactgaaaggtcattccatatttacaactccttgtgaggctggcccaggcttcctttgaaccagtttcatattttggcattgtcccctgctcaatcctgctatcttcacttctttccatggtgttaatcctaagtgtactccctaaagcaaactatgcattctaatctctgtctcagaatcatcttcctagggaacccaacttgtgccatggtactcccaacatagggaggaattgtattgtttttttccaattgtgtatattctcagtctatcatagtccctggcaccaggaggatgtcagcagatagctgtgaaatgaatgaacaaatgaatcaatgaatcaatggtggtagtatcattggtaatttctgttttatgccccacccttctcctttctttaaaggcaatgtaacccctacacgggaatttcttgggtttctgcccagggatctattttactcctcttcatttccttcccttttcccttttacagcccctttttctcctacccctcccttttgtaaaatctctgcctagcaatagctcttagctgtagctaaggagtgaggaggaagcccaaggaaagtggctgagagacaaagacggaaaacagctaaattagtttagaggccaattcaggaactccggcacttctttctatcagagcctgtgtggagccctgcaagaaagggcaatgccaaggaacagaggaagccaatatctgaaggctctgctcattgcatggctttccgaaggtattttctccttttgaatgagaataaagagccttttaaaacaacaaagcttctgtataaatagaaaaaagggagaactcacattttcagtccatatgaaaaatagcctcttcgttagtaatttctcatcctcatgtacagcctactgcggtcaatgctttatttctgcagccctgttttttgtttttatggtcctttttttctttttctttttgctccttccgcccctcccagaaaaaaaaaccaaaaacaaaaacaaacaaacaagcaaaaaaacagattcaagctagaagacttgagtttgagacctagttctaccactttagtagctgcatactgtctccgagccttagttctttatctgaaggtgggcatttgttaaccagctcacagagacgggctactgagaagctcaaatgaaacaacggatgtgaacaagctttaagaattgtgacactctaaagagaaattgtcattgccacttaatttttagtgaaacggaacagcatgctgaatatagttaacaattgagtactctggctttcaatattggttaagaaagtaactttctaatgttctcatcacaaaaatgttaaatattggtggcaataatatattaattagcttaatttaatcactccacactgtagtcaaaatcataacaccactttgtaccccatcaacatatactactatagcgtgtcaataggcaataaaaaaataaaaagaaatttaaagctggtaccctcccaaaaaagaatagaacacacttcaaagccaagtataaaaggttttttaattattcctcattttgcatgatgtttggcaaaggtccttgttagcccacatgattaggaatccactttacttggaatggactgagaatgtcaaacttctaggttaaccagccattttttttttttcattgattcattgatacatgacagacttggaagccactcgctctctcaaccagggttttgggttgatcaagtagatgttattgtcacagctcaatgaatacttcttatttctcatctgcctaaggcagccctggtgttcaaacatatccttgtttttcctccaaacacacgatgctctgagaatttacaccattaggaataatctcctaccctcaactctgggtgtatagggattcaagatttcctttgtatatagcaattttccttctttctttctttctttctttctttctttctttctttctttctttctttctttcttcctttctttcccttccttccttccttccttccttccttccttccttccttccttccttcctttccttccttccttccttccttccttccttccttccttccttccttccttccttccttccttctttctttctttctttctttctttctttctttctttctttctttctttctttctttctttctttctttctttctttctttctttctttcttttgatggagtctggctctaatgcccaggctggagtgcagtggtgtgatctcagcccactgctacctctgcctcctgggttcaagcgattctcctgcctcagaccccgagcagctggcattacaggcgcctgccaccatgcctggcaaatctttctattttagtagggatggggtttcaccatgttggctaggctggtcttgaactcccgacctcaggtgatccatccgcctcggcctcccaaagtgttgggattacaggcatgagccacagcgcccggcgccttgtatgtagcaattttctatttaaaaaaaaaaaaaaaagacagactgataagggtcattgagcagccggcaaaggatcctagggagaaattgtcattgccacttaattttccaggccctgtttgggatctccttctttgggatgacttctctgaatctctccttatctcctcatgccttaaccctctcccccactgggataggtgccccttttctgagctgccttatcatcctgcctctgcccttgcttgacattctgaattgttcatcagtgatctacttgtctgcacccacctcaagactgttgttttagagagcaaggactttttttggttcattgttcattcccagagtctagtacagctcttgagatgtaagaattacatcataattgttggttgagtttatcaatgaatagatgcttcagattccatccgtttctctccactggcaccaatctctctggcttgttttcctgtgacattcctgggcagggatcctgcagagtagatagaaaaggcctgtgtctatcatggaacttgtccctcccaattggcttgtacaggcagttatgtcactacagatcctcattttaattggattaaggtattctcctctgagaagtgaaaacagcatataatttacaagggatattaggtggagttataaagtgtgaaagtatttgttctgttttgtttgagacagagtctcgatctgtcacccaggctggagtgcagtggcaccatgtcatctcactacaacctccacctcctgggttcaagcgattcttatgcctcaacctctgaagtagctggaattacaggcatgagccaccatgttcagctaatttttgtatttttagtagagacagggtttcaccatgttgaccaggctggtctcaaactcctgccttcaagtgatcctcccgcctcggcctcccaaagtgttgggattacaggtgtaagccactgagcctggcctagagtgtgaaagtagaaaggaccttagaggttacaggatccatccctcttattttacagataaaccaggctcagaggtggaaagatttgtccaagctctcatgattaattcatggctaaggaagatatccattgctttagcctgcctcaggccctgtggggaatcagcccttcccactcttggtcctagcattttggctggtgctgactttactcccaaatccaggatgagcatgagaactaggcctcttcaatcagagcaccaggacttatgttcccagaaggccaatcaaagccagtgagacatgatttcaggacattggaaagagaagtttatgtgctccattggggttgctgagaggatgagattcaagcttgagactgtagacagccatcttgtcaccagaggcagacagccaagggaagcagtaccaagagatggagagaatgaaatccagttttcttggtttggcactgaggtctctcataatgacatcattggagaccctgatacaaccatgcctgacctctgatctctgtaggagctaattaattactggggtttctgtttatttcttgctcagtcaagtttctgtcactttccactagttagcctaaagaattcaacattagacctagaagcaggcttcttaactttcaaatgctgtcctctttccaccaaaccacatcgggcattcctctgattaacccaataccacccactgtcacataacagagagcagaattaggcaggaatgggagacaatgggctgcatttcaatgggcgggggtatgtgtgcatccagtgacgtgctccggggacaagtgggaggcatgaggccatggggtaatgaaagggttacatcaaaacaaactttggctgcttccctgttttaaccctggcagtctaatgaataagaattggcgggcaggagatggggaagtacatgtgactagaagctgattcagctggatgtttcttctcgattaatgaaaaaaccttttggtctggacctggcaaaaccaaaagtcaaggcatcactgttttattgttaacctctcatgactcacctaaggcatgggaatatacaaggctacagaagagtcacagccttaatcaacaaacattatgcaaacccagtactaccgaggtggctgtgctgggccgtgtccattgatggggatcaggcaaacaattatatcactgtgatatgctaagcagactgtcttatgctttggggataacctggttgcaagcctctgagatcagttcttcattaccaggtgcaataagcaggaacagaaattgtgggcctgttcctggtgggaatcccatactaaccacatcccagggtgggatttttagcaatctgctttctcctgatttccccctcttctcaggtactgataaatttcaacaaccagctaaactaaactagggtgtgggagtagtgacttggagaggacaggagaggggttcctggagtcttggtgatgttgagttcctaaactgtgctgcttctatggagatgttcagtttgtgaaaatttattgaactatgcacctatgaatgttgtatttcctctaagtatattatgtctgaataaaaacaccacagtatgttaaatgctgttattgtaggcaattatttggcactgtggaggtcttagaaataaaattaaatggggccactgaaattatgtgataatactcttccactctaaagtggccatacagatactccacatatttatatttacttcaaaatatgtaataatcaaaatgaacatataaatgtaaaaaaaaaaaatagagttttcacaatcttccaggagcctaggatactggttgggaaagactgaagtattgttatagttcagaatcacagtgcaagttgacctcaaatccatttacatctctccacttccactgccatcactctagatcatgccactagtaactccggcctggacaggagcagtaccctccactcttgcctgatgtgtaatcctttgtctactgatatggtctggatctgtgtccccacccaaatctcacgtcaaattataatccccagtgttggaaatgggatctggtggaagatgattggatcatgggggcagtttctcatgaatgatttagcactaaccccctagtgctgatgttgtgatagagttctcatgagatctggttgttcaaagtgtgtggcacctcccactctctcttccgcctgctctggccatgtaagatgtgcctgcttaccctttgccttccgccatgattgtaagtttcctgaggcctccccagaagctgatgccaccatgcttcctgtacagcctgcaggactgtgagccaatgaaacctcttttctttataaattacccagtctcaggtatttttctttatagcagtgtgagaatgcactaagacaccaacccagtagaaaatcagaagatgatagtttttaaatatggctcaaattactctcctttcccccaggcctcccacccaagcccttcgaagacttcctgacactcttaaagtccaaatccttctccatggctcactgtgtccatccttgaccagtccccacctgcctctctgaccagctgcccaccacccttccccagctcaccagtctcagccccactggcctcttttcattctcccaacaccacatgcctgtcctagccttagggcttttacatgtatgcctctactgcctaaaatagaagtctcccagatctttggattgctggctccctctgattccttaggtcccagctcaaatatcattccctcgagtagcccctctcagccattctatgtcattgtctcactactttactttattttcttcactgtatccaaagctattatgttaatatggttgtttaccagaacataagccccataagggcaaggatgttgtctaccttgtttatggtttgtatcagtcagggtaccagcaaggcgtctcactatgttgcccaggttgtacttgaactcctgggctaaagtgatcctcccactcagcctctagagtagctgggcctgcaggcacacaccagcacacccagtgagatggcattcttaaaggagtttaactgaagggaatttgagaaaggaaccaggtacagaaacgtgggcagggttaagagaacacatgatgcggcacccagggcctaccactgtggaaagctatccccaccggtagaactgaaggggcaagagtgcagagctgtgtttggagatggtaagagcggaggctatgggagaggagctacccaccacagccatggcaacgcaggggacaagcggtgactgggtaagttgccccgcttcttcctcctcccaccttcagatttcctgccattatttcctggccaagcccaactggaagccagagagcaagagagccttacacagtccataggggtcagactctggggccccagaacagggcaggaagggtggggcacagggcaggatcggagcaaacagagcctagccaaccctacattgcttgctacataggtgctcccacatgctgattaaatgaatggttgatcgaatgaatgaataaatgaacaacaaagaaagctgaagagaaagacaaagggatatccacaggaattaacatttaggaagctcctagtgggtgccatgtgggcatcatatataaataatcttgtttaatccacacaggaatcctatgagataccttactgtccctgtatatggctgatgatcctgagaccttagaggttaccataccctattaaagagaaatcatggagccaggattccaactgaggttccaagtgtttttcccttgcattacactaaacatatattgcatgtttccatacttgcatcagcctggaacctgcatccctcccattcctgcctggaatgctctatagcctgcctaaatcccagttaacttctggttcagctcatgctcctcctcttcacagcctgccctggatcaccacagccaaaggtaatctttctctcttctggatattatagcaactgttatatatcttcacgtttcaattgccatctatttcttcataatctaattatttgagagcttctcatctcctcaactatattgaaatatcttggaattggaaatttttgtgttttcttttgtctattactttgtatccttattgcaggtaatcaataaatatttgctggtttacttacctgtcttatataactcattttcaatgtctttttttgtttaagaaaaaaaatcacttaaatgatacatttttacatatactgtataaacaacttgtatcattttctcatttaatattggatcataagtattttttattacacataatttgtaaacaatgttttgatggtagtctaatagtcaattctatggctgtaccaaaatttaaatcattttctattgtggacattcgggtggatggcatcccccatcgcctcaatatcaatgttgtcctgaagagtttggagctacatttcttttctttttttctcttttttttttgagatggagtcttgctgtgttgccccaggctggagtgcagtggcacgatctcgactcactgcaacctccacctgccaggttcaagcaatcctcctgcctcagccccccagtagctgggattacaggcatgcaccaccatgcctggctaatttttgtattttagtagagtcagggttttgccatgttggccaggctggtctcaaactcctgacctcaggtgatccacccgcctcagtctcccaaagtgctgggattacaggcatgagccaccatgcctggcctggagcgacatttattcctatggaatcaatttccttcactaagctcttttttagggaatgcttagtgaagatttgattaaacactacaattgttaactacaccagataagtttaactttgacactctattttgtaattcatcttgtaatggaagagtcaaaataacagtgtctcctggtatatgcagatagatggatacctttgggaagcccactcattcatctatccattcgtccagccatatccatctatccaagtctgcactacttgggagcccaggtgaggagagctgcagtcatgatgggaggttggtggtcttctctgaagatgtaacatttcaccatcttcagtgcaactcttgtcctttggcgaccaagagctgagcatatacgtcctcgtgactgttccaactcctagtcaagactatatagattccatgtatcattatactgatcacctatctagacatcacagtagtttttgagatacctaattgaaatgacaacttttgttagtatttaaaataccaaactgtctttctttagcatcagaaaatccccagttctgtttctgaagttgcctcaaagcacctgaggggatgttgggaagggaaattacacagactgtctatcatggatcagaagcttgtactgcaagcataatgcattgattaagagaggtgaaatctgaatccagattgcctgggtctaggttcaaatccctgccccacttcttcatgactgtatgaccagaacaaggttacttaacttctctctctcctttttttgagacagagtctcactctatcacccaggcacagtggaacaatcatagctcactgcagcctcgaacggtcaggcttaagagatcctcctgccttagtctccccagtacctgggaccacaagcacacaccatcatgcccagctaattaaaaaaaaattttttttttgtagagatggagtctcactatgctgttcaggctggtcttgaacccctggcctcaagcaatcctcccaccttggccttccaaagtgagtgctaggactataagcatgagctgccatgcccagcctacttaacacctcttatccttactttctttatctgtaacatagaggtagtaattacacctccctcataaggttgttctgagacttaaatcagttaacatatgaacaccaaagtggtgaagcgagcagaatagtgcctgacacatattaagtgtgatgtgagtacttgctattattattactgatcttattttaaactcatttaatttagttcttacaacaactcttacttagattgaggctgaaaattgtcagcctgtaggttgaacttggcctgcagatatgttttgtttggcctgcacaattttctttagtttgagccaacatttaaaactctggagttttatacaaaaatcttgatttctggctcttcttgtaaaatccttatctgacagcaacccacaggagctgagggctgctgatttctttagataaggaatgcaccttggtagtgtgccctgattctgtggggatgatgtcagtggtgagtgatagaagacccaactaatagtcgcttcaactaagaatttatatctcaattaagaggtctgaggtagggtagttccaggtttcatacagaggcacaaaagtgttgtcggagactcttgctcctttactgttaatgtcttccacctgtcctctctgacatcattggcatgtcagctatgatgctgcactcatacctactgatgcctccaaaggctcacacatgtcacatgcagatacacgaccagtgaagaagagatgtctttttactggtctcttttccttataaaggaaacctttaaaacaaaacaaaaaaaccctagctgagtgtctcctgagctcacaattggccaagactggcttctatgccaatactctggttggaagaaagcctaggaaagctggtctcacacttcctgcccttaagtgggaaggcaggatgtgcctataagagggatgaggcaaggggtagtgaacaggccaagactgccaggcacatctcactcagaaatcgctcaagcacacacacccagcttcctccacctatttacctaactgagggcaactggataatggaatctgtatgtcaagttcaggattcagccctataaacttatggaaggtttgagccatgactagtttaggtggattttttaaaataaaaaaatcactttcagttcttaaaaaaggaatccattttaggttcaaagtagcatgataactttgctgtttagagtttgaaattcaacaaggatatttactcttgcctggataacctgcagcactgatagcatttggctctttgtccccacccaagtctcatctcgaattgtaacccccaaatgtcagggaagggcctggtgggaagcaattggatcatgggggcagcttctcccaggctggtctcgtgatagtgagggagttctcacgagatctgatggtttaagtgccaagaagttttcctcctctcactcactcctttctcctgctgccatgtaagacgtgccttgcttccccttcacctgcagccatgattataagtttcctgaggcctccctagccatgtggaactgtgaatcaattaaacctctttcctttataaattacccagtctcagggaagttctttttatttatttatttattatcattattttttaatttattattattatactttacgttttagggtacatgtgcacaatgtgcaggttagttacatatgtatacatgtgccatgctggtgtgctgcaccgggaagttctttatagcagtgtgaaaacggacttacacaagcaccaaccaatatttatggtgtctctgggtgaacatgtaagatgccatttaaaatgctgtatagagacatgggcactaccctctaggtactagctgtggtctaaatgcatcctctaaaattcacaagttgacatttaatcatgaatttttttttttttgagacagggtctcgctctgctgcccacgcaggagtgcaatcgcgatctcagctcactgcaacctccgcctcccgagctcaagcgattctcctgcctcagcctcccaaatagctgggattacaggcacacaccaccatgtccagctaatttttgtatttttagtaaagacagggttttgtcttgttggcccggctggtcttgaactcctgacctcaggtgatcacccacgtcagcctcccaaagtgctgggattacaggtgtgagccaccccacccagcctgagccactgcgcctggtcttaatcacgaatattaataggtggggtctttaggaggtaattaagtcatgagagtgaaagcctcatgaatgggattagccgccttgtaaaaggtctggaggaaactagtgtttgtcccttgttatccttccatcccttccaccacatgaggacacagaggtcaaggtgccatcttgaaagcaaagactaggccctcaccagacacgaaacctgccagcgctttgactttggacttcccagcttccagaactatgaaaaatacatttctggccaagcgcagtggctcacgcctgtaatcccagcactctgggaggccaaggcgggtggatcacgaggtcaagagattgagatcatcctgaccaacatggtgaaaccttgtctctacttaaaatacaaaaaattagccaggtgtggtggcaggcacctgtagtcccagctactagggaggctgaggcaggagaatcacttgaatccgggaggcggaggttgtagtgagccgagattgcaccactgcactcagcctggcaacagagagagactccatctaaaaaaaaaaaaaaatctattatgtgttaattaccagttcttaggtgttttgttatagcagcacaaacagactaagacaatactcatcacccaagtcactctggaaggcactgttttataagagcagaacagagtgtgatacatgaatgctgcaggcatcagaaattgctggaacccattaagttgctcccattaagttgggggcagggtaaaataagtagaagtacacagtatgccactgtgtgggcaaagttgtttctgatttcatactaaagatagaaccctaaaacaagacctaacaagaggtttctttgtggaaacaatcttcttgggttaatagctaaatatagtgactaatgcttcttcctgttctttctcgactataccttatgagctacctttagaacaagcaggttgaagccctgccttttactaatcccctgagataatctttttaaaactctcagtggcaagtgaagaccccagtgttttccccatctctgagatttctttcatatccctttagcattcgcatttgctcttactggttatttcccatgctgaatcattcactgactatctggtcatctcctgggggagccaaatagttttaaacattctcagtgactcatctatcctcaccagttcttttatttatttgttgttgatgtgtcatacacacacaatctctctctgtcattaaaatgctaaaaaaagtttctatttaccgtcatagtatactccactttctcagtgcatgtcttcacttgttttgtagttttctagttcatgcaattgaaataaaggtacagttacttagtctttaaccaagtcccaggtttagccaaaattgtcaaactcaggattcagcccttcaaagcttacgaatttattgagggccgggcgcggtggctcacatttgtaatctcagcactttgggaggcccaggcgagtggatcaccagaggtcaggagtttgagaccagcctggccaacatggtgaaacccagtctctactaaaaacacaaaaattagctgggtgtggtggcacgtgcctgtaatcttagctactcgggaggctgaggcaggagaattgcttgaacctgggaggcggaggttgcaatgagctgagatcacgccactgcactccagcctgggcaacagggtgagaccatctcaaaaaaaaaaaaaaaaaaaaagagaattacttggtgaaaataattccatatcattactattttgtaaaagggaaactgctctcttagcacattgtgttgtttgctttgctaccttcagttgctctgcgtcagaaccctgtatctgaaatccctcaataatgagactaactgaggtagtggtgatactctatcttgttattttaaagcaggcctgcaaatactgggtgctcagtaaccatgagaaaaaggcctgataaaagcaacaacagaagcaattgggacccaaggtggacaccacggcaaatcctcagcgcctgggttttagacggttctgccaaaggtttggttctttccagcctgagatcattgcttagatctttctggggtgtagttaaagtaaaatgagcctctttctatttatcccacagatgccgttctctcttaacaatgtactccttgaaggcttcttaaggtaatgtctggtctctgctgaatgcagccataaatgcaatagaacgctacctttgctgaatgtgctcagtcctccccccttagcacagctcaccctactagccttatcttgctggcctccctctacccccactgcaacctcccaacaggctttaaaatccagacatacctaacgaatcacacaattaccaagcaggtcaggatactttacatcagagcctctgaacatactgttctcttcccagaatgcccttctccacctcatccacctggagaacccctacgtatccttcaagactcaactcaagctttttttgttttaacccccctacagccttcttacctttccaaatagcaccagaacttttcatccaccactgtaccttgtatgcaactgtgttacagcactctctaaaccttcatgtcatctgccttactttttgaggtttatgagaggagtgatatggtttggatgtttatcccctccaaatctcatgttgaaatgtgattcccaatgttggaggtggggcctgatgggaggcaattggatcatgagggcgtatccttcattaagcggttagcacatcttcttggtgataagtaagttcttattctgagttcacacagggtctggttgtttaaaaaagtgtggcacaacaccctcaccttgctcccacttgaccttccatcatgactgtaagcttcctgaggccctcactagaagctgagcagatgttggtgccatgcttgttgatatagtttgaatatatgtccccaccaaatctcatgttgaatggtaatctccaatgttggagatgaggtctggtgggaggtgtttgggtcatggggtggatccctcatggtttgcggctgcactggtgatagtgagttctcacaagatcaggtcatttataaatgtgtggcacctccccagtcttgctcctcctcccgccttgtgagatgcctattcccctttgctttccaccatgattgtaggcttcttgaggcctcccctgaagctgatgctggcactatgattcctgtacagcctgcagaactgtgagccaactaaacctcatttctttataaattacccagtctcaggtattcctttatagtaatgcgagaatggcctaacacaaggagggacttacattattttctgaatctcagtgcttatctcctggaaagtgtttacaaagtatttgttgaatgagtaaataattattttgaaatatttataactctctgataacataacattatatggtaatagagaatttaggaaatgcagaactatacaaagaagaactaaaaaccatctgtaatctctggttaatggtaattaaccaaagttaattattattcaataattttctctgtagatttttttctatatttttaaaataacagctttattgagatatactttacataccatacaagtcacccatttaaagtatacaattcaatgatttttagtatttcatagacttgtataaccataataataagttttataacattttcatcaccccaagaagtaacctcatatccattaggagtcattcgatttccctctaactctaacctcctcccatccctaggcaatcacttacctatttttgcctctaaagatttgcctattctggacatttcataataaatgaaaccatacaatacacagcctttcgtatctggcttctttcacttagaataatattttcaagtttcattcatattataggatgtattagttagcacttcattcctttttatggccaatagtattccatggcattaatataccacattttatttatatggtcatcagttgatggacatttgggttgtttctacctttttggctattgtgtataatgctgctatgaagatttgtgtacaagtttttatatggacatatgtgtttgtttttctcttaagtacatgcctaggaatagaatttctgggtcaaatggtaactctatgtttaaccttttggggaaacttctagacttttttctttcaaagatgctgcaccattttacattcccattaacagtgtaccagtgttattctagattctccacatccttgtccgcacttattattagctatcttttttatgtggcatctcattgtggctttgatttgcattttcttgatagacaattatgttaagtatctttccatgtatttattggccatttatgtatcttcctgggaagatcattcaagtccttggcaatttttagttgggttattagtcttttaaattattgagttgtaggcattctttatacattgtagttacaattcctttataagatatgtgatttgtaaatattatctcttattctgcgggctggctgtctttccactttcttgatggtgtactttgaagcacagaagtttttaattttggtgaagttcagtgtatctatttttccttttgttgctgtgcttttcatgttagatctaagaagccattgcttaactgaaagtcagaaagatttcacctatcttttctgagagtttcacctatcttttcttctaagagttttatagttttagctcatacatttaagatgtctttgatctagtttgatttaatttttgtagatggtgtgagataggggtcctactttattcagtaggctatccaattgttccagtaccatctgttggataaattattctcccccaactgaattgttttgacactcttgtcaaaaatcaattgactgtaagtatggtttacttctaactctgaattacatgctgttgatctatatgtctatcctggagccaataccacactatcttgattattgtagctttcttgtgagttttgtagttggcaagtatgaatcctcaacttcattcttctatttcaagattggattatttttgggactgttgaattttcatatgaattttgagattagcttgtcaacttctgcaaaaaggccagctgtgattttgaaaggaatgacattgaatttgtggatcaatctggggagtattgctagcctaacaatattaagtttttaatcaatttccatttatttaggtcattttcagtttcttttgtacgttgggctttcattttcatttgcctcaaaacattttctaatttcctttgtgattttttctctgattcatttgttatttaaaaatctgttgtttaatttccacatatttgtggatttctaatttaataccattgtggtcagagaatattctttgcataatttcaaaccttttattggataaagcaaatacggtatatatacaccatggaatactacagagccattaaaaagagaatgaaatcatgccctttgttgcagcatgaatgcaactggaggcgattatctttttttttgagatggagtctcactctgtcacccaggctggagtgcaatggcgccatctctgctctgcaacctctacctcccgggttcaagtggttctcctgcctcagcctcctgagaagctgggattataggcacgcaccactactcctggctaatttttatatttttagtagagatggggtttcaccctgttggtcaggctggtcttgaactcttgaccttgtgatctgcccacctgggcctcccaaagtgctgggattacaggcatgagccaccatgcccagccgaagccattatcttaagcaaattcacccagaaacagaaaaccaaatgctgcatgctctcatttataagtgagggctaaacattgagtacacatggacataaagacgtgaacaatagacatgagggggctactagatgggagagggaggagaggaatggggcatcagttgaaaaactacctattggatactatgctcactacctgggtgatgggattagtcagatcccaaacctcagcatcatgtaatatacccatgtaacaaacctgcacatgaatcctctgaatctaaaaaataaaagttgaaaaaaattttcaatctttttagaatttattgagatgagtagggctggccgggcaagttggcttacgcttatgttcccagaactttgggaggctgaggcggatggattacttgaggccaagagttcaagaccagcctgggcaacatggtgaaaccccgtctctactaaaaatacaaaaatcagccaggtgtggtggcacttgcctgtagtctcagctacatggaaggctgtggcaggagaattgcttgaacccgggaggcagaagttgcagtgagctgagattgtgccactgcactccaacctgggtgacagagtgagaccctgtctcaacaacaacaaaaaaagaaaaagaatagggctaataccacatcatgcatcctggaaaatgttctctgcacattagaaaacaatatgtattctgctgttgtttagtaaaatgttttataggtatctgttaagtctagttggtttatagtgttgttcaagtcttccttttttgttgttgatcttctgcctaattctattaattattgaaagtaggatattgaagtctctagctattattgttgaattgtctatttcttcatttagttctgttatttttcacatgatatgttttggaactccattgttaagtgcagagatatgtttataattgttatatctccctgattgattgaccttgttatcattgtaaaatgtccctctttatttctagaaccatttcttaaaaatctatgttgtctgaaattagtattgccacttcagctttcttatgactgctgtttgcatggtatatctttttctaccctttaactttcaacctatttgaatatttaaatctaaagtgtgtctcttatagacagcatgtaatcctgtttttagcatagtggcaatttttgccttttgactaccttgtttaattcattcacatttactgtcattattgatgtaattgcatttatatctgccattttggtttttgtgttttctgcctcttgtctttgttcctctattctcctttgctgctttctgttgcattaagtgattatttcctagcgtaacattttaattccttgaatgattttttttgcagtgcatttttgaggtgttttcttagtggttgctgtaggtgttcccatatatatcttagcttatcggaattaacttcagatttatactaaattaattatagtaacatatagaaactttattcctacatagccctattttctccttcctttttttggtgccattgttgttacatatataatatgtgtatataatagaaatccaacagtatgttattataattattacttcatatcattttatgtcttttaaagaagagaagaaaagaaagcaagtagatatttatagagtctgttatactaaccttatttaccttttctggttctcttcatttactcctttagatatgagctactctctggtgttacttacttactccaatatgattttgctaccatctacttcctttgtgttgttattgccaaatatattacattactttatgttgtgggcctaacaatacaattatatatatatattattttatacaattgcttttataaaaaagaagaaagggaaagaaatatgtgtttcaattttctcttataatcacctacataattacctttattgatgctcttcggtttttctgtgtagaatcaaagtattctctgggatcacttgcttttagtgaaaacaactttccttaatgtttctggtagagtgtgcctatattttttgcattgaatctttgtgtgtttcacataacaatccaccctgtcatttcctgtcaattcttcattcaaagcacaacttactatgtctacgtgaaatgctgtgaccagcatgtatgtaactattctcctaaggggttgtttttaacctttaatcactgcaaatgatgctatcataaacatctttgcatatacatcctttataaaactttttaaaagtatacaagtgatatggtttggctctgtatccccacccaaatctcatctctaattgtaatcctcacgtgtcgagggcggcacctggtgggaggtgattggatcatggggggcagtttgccccgtgctgttctcatgatagtaagtgagttctcatgagatctgatggttttaaaagtggcatttccccctttgctatctctctcctgccacgttgtgaagaaggtgtctgcttcctcttcaccttctgccatgattgtaagtttcctaaggcctccctagccatgcagaactgtgatgcaattaaacctcttttgttactaaattacccagtttcagcagctctttatagcagtgtgaaaatggactaatatacaaaattggtaccaggagtggggttggagaccccatacagagtccctactggggcactgcctagtggagctgtaagaagagggccactggccttcagaccccagaatggtagatccactgacagctagcaccatgtgcttgaaaaagccacaggcactcaatacctgcccttgaaagcatctgtgggggctgtaccctgcagagccacaggggcggagttgcccaaggccttgagagcccacctcttgcatcagtgtgccctgaatgtgagacatggagtcaaaggagatcattttggagctttaagatttaatgactgccctctgggttttggacttgcatagggcctgtggcccctttgttttcgtcaatttctcccatttggaatgggaacatttgcccaatgcctgtacccccattgtatctttgaagtaactaacttgttttttgttttaggctcataggtggaagagacttgccttgtctcagatgagactttggacttggacttttgggttaatgctggaatgagttaagactttgggggactgttgggaaggcatgattagctttgaaatgtgaaaaggacatgagatttgggaggggccaggggcagaatgatatggtttggctctgtgtcctcacccaaatctcatctcaaattgtaatccccacatgttgagggagggacctggtgggaggtgattgaatcatggaagtggtttcccccatgctgtccacatggtagtgagtgagttctcacaagatctgattgttttaaaagtggcacttccagctgagcacagtggctaatgcctgtaatcccagcactttgggaggctgaggcaggcggatcacttgaggttgggagttcgagaccagcctggccaacatggagaaaccccgtgtctactaaaaacacaaaattagccgggcggggtggcgggcgcctgtagtcgcagctactcaggaggcagaggcaggagaattgcttgaacccgggaggtggaggttgcggtgagccaagatcgcaccattgcactccagcctgggaaacaagagtgaaactccttctaaaaaaaataaacaaataaaaataaaaatggcacttctccctttgctctgtctcctgccaccttgcgaagaaggtgccttcttctttacagcagtgtaaaaccagactaatacaacaagtagtctgagaatatatttatatgtaaaaccattcagacaacaaaatttccctccaaatctgctcttcctggacatccccatctccttcccaaacataatcatgcttatgggcttagtgtgtgcacctttttttatgtttgtctatgcatttacacatacacagagagatgaagaggaacagggatgatatggtttgtttttctgtccccacccaaatacccaggtgttgagggagggtcctagtgggaggtgactagatcatgggggtagtttcccccatgctgttctcatgatagtgagggagttctcatgagatctgatggttttataaatggcagtttcccctgggcttctctctctctcctgctgccttgtgaagaaggtgtctgcttctccttcaccttctgccatgattataagtttcctgtggcctccccagccatgaagaactgtgagttaattaaagctctgttctttatacattactcagtgttggcagttctttacagcagtgtgagaacaggctaatacaagggagaaggttttatatttgttgtttgttttggttctggttttagttttacatcaatgggatcagcttgtacatcctctttttcaccttgttttcttcatttaacaggtctaggatatctttctaagtcataattggaactcctttttattttttagctaccacatagaattccagagtcagttaacaaatacttgttgatccttactaatgtagcaggtcctggggattcagagactatgttctcatggaggtcgactattcatcacagtatgaacgtatcaaatttaacattcttattttgatgaatgcgtaggtttttctccaaggatagatgcttagatgaggaattactgagtcagaagtctcttgacaagtagtatgaaattgctttccaggaagtagaaccagtttatattcccaagaggagtgtatgggagtgctggcttgctaatttggtagaggggaaatttcagttttgattgcatttgttatactactactgaaattgaatattttttcatgtttattaaccagttttattttctctgtgggctgttaaaaacttttttctcttgttcaacttttaataatattaatatttttgtgttttcttgtttatttgcataaacccatgtattgactgtattttcttcttttgtagtttttgttgcaaatattctttcctattgcttttttacatctcatgttttgtgactttttgatagacaaaaagatttttttaaagatttcctttttaaagtcatttttctccttttttatttcttttattatctttgtgctttcaaaatccttgcccaaattgataagataatctgtttacttagctattggtttcatttttagcatcaaactttttaacagacttgaaaaaaaaaattgtaaagagtaaagaaagatttaactttacttttattcccaaaattgtgctcacacagaatactgaatgtcccttcctttgcctattgtatctgatgccatgggattctgtcctccttcatccatgtgaggcccttctctttacttacattttttacttccatcactgatcccactcccattctatatgatctatagacacccattttagtgtatttgctctagatccttgaataatgtatgcatccttctaaaatgtacctaaaatacacattcaatggtaaaatcccacaaatcattctgtttcttacttgatgagtcttactattaatagtgttatgtctattttgttcatctttccaaataatcaatttttggtttattagtattttttatttattttctggagctatctttattatttctttccttcatatttcaccagatggattagactttttccccagtttcacaaattcagagtttagcttattttattttgatttcttgttttctaacaaatgtatttaaagctataaactattgttttggttctgctttaattgtgtttcatactgtctttttttttttgagacaggatttcactctgttgtactttctttcatgtagcatgttcaatgtggttcaattctaagcacatttaatgctgctgaatttctgctctaacccaagagttactttagtagaatatattttgattttcagacataaggaataattttaatatccttttgtcaatgacttttaattttattagaacatgattggatgttaactcgaaaataaaattattaaatttattaaaattattaaattttattttgggattaatttttataagggttctatatttggttggaaagaatgttatatttattaaagtttactttgtggtttttaaaatgagaaaattctatatttgcttggaaataattggtttatatttaactttattcattgttttttcaaatgatccatacatttgtttttgtttttatctgcttgatctatcagtttctttttttttttaactctgatatcaagaatcagtccaatgatctattggtttctgaaaataatatgtgaaatattcaacaattgtaccttctgtttcttcccatagttctcccagctttatttaatggagagatgctcatgtcattatgttttatcgaagttagtctctttttctttccttttttctttgtttcttttttgagatgtagtctcactctgtcacctaggctggagtgcagtggcgcaatctcggctcactgcaacctccgcctcctgggttcaagcaattctcctgcctcagcctcccgagtagctgggactacaggtgcacgccgccatgcccggataattttttgtatttttagtagtgacggggtttcaccatgttggtcaggctggtctcgaattcctgacctcgtgatccacccgactcggtctcccaaagtgctgggattacaggcgtgagccgccgtgctcggcctattattttattgttccgggtatgatatggcagactcccagctcagtaatttgtttctcaggtgtattccttgagatatttatcttaattactgagttattttatttcaactatcatgtcttttgtaatcaggttttccacttggttcttccttattctgttagttcttatttcattttgccaatattgtctcttatttgtttgaagatttttatgcttatttagcatttgttatttacctactacattcattctgtggcttttctttttgtcctatttccttttatagtgatgctcttcacgtgtgtgggtttttgttttgttttttctctttgggcttcgatgcccctgggaacatcagcttctatagttggcaatgtgcactggggagtgatcagtacaccagggttgtggtgcagtcaggtcctggaagggagtggggctacaaccccccaaccccaggttgttaataaagattgggccgttatctctacctggaaggagaattgttcttttgtcctcttccattagtacataactacgtattatttgatcagataaactctcttctactttgacactcagaagtgactttctggacttacctgagaggacataaagtaaatcaattttaatgtgagctcataagagcgttcagcacaaggaacagcagacctaggagtttggaattggcacctcaggtgatgtagggggcaaccttgggaggaaggattctcagagaatccctcagtttctataatcattcattctgcatcttggcagagaggataactggatattgagaagagtggtgaaaatgcttacttgactctgacacttgatagctacaaccctctgaataagcatcttatttatgatcctcagtgttctcacctggaaactggggtcataatactcaccttagaatgttgttgttagaagtttatggaatactaatagagaggctatgagtttcaagcactgtgcctggtcctcaatagatgtttaataaattctagatccttccccaaaatattccccatcattttcctttctatcgtaaagttataaacataaggcaagagaatgaatgctattacttttcagcaaatgtgaatatctttacatttcatttttttttccatttatatctcagctgtgtttctttacgttattgctagtcaggaatgcaatttgcaattacatgggttcatgagttctgaaattcaagggaaacctatcttcacacatgccttcctctttcaccccatttctgtgcacttttgtccaagcctttttctttcctgaacactgtcattttgtcatgtactctggtcctaaaggataagcagatgaattgtagaggagtcccctttgtatcgaaacatttacagcttctattccaagagttaacgtggcgaattttcacaatctgtttgttgttctcattctttcaaccttcttttgcactttttgcaaaacagctgctattgttagtttttctgagtactcttgtgaacattgggagctgttctgttgtcaaaatctttgcagctggctcctggctagtattttgtaatccattctcaaaagtttaatagctcctagtttttcatgtcagctgtgtttcttgttttagagataattgtgagtaatggtcaaggcttagttgagccatccattccctttttccacatgtctttgaaaggcagacagttcagattcctaaggctgatagaaactgactaatccttttttgtttcctactatgattttcctcaaagatattgctatttacttcacttctgagcattgattcgtccttgaaatttgtgtggtttatccttttaatatatttgggtgttttcttagttgtcttctttttttctttctttgtgaatgattcttaaagagttctgggcatttgcatgtgtaccagacttttaaatttcatggaccagtgaaaaagaaaaaaaaaaagctgaggactgatggagtgttgccaacattttatttcaccatgaatataagagagaggaaaaaaaaagaacaccatcttctatcgtcttttcacaaaaggagatttaatatcaaaactgtgaaagaagaaatcttggaataaaggacagtcttttaagtgaaaggtataagggaaacttgctacattgtccttttttgttggggaccagtgaaaacctccacaaagatatttgggaaccgccacctcacgagctgtatccacaccctcttaacagtttgcttccagcactttgttgttcactttattctgtcaaggttattcctacctggcactttcccttctcgctccagtaacatttaaagacctttcccccggcaaaggctttgctgccacactggagagctttgatcatcaattctgttaggctggttgtcaaaggagctggtggtggaaaaagcccagcagaggtggctgctgttagctctgaggaaaccgagcagctgtttgctgtcgttccagggttatctcataatttattgtgcgcaaaggtggctttactgttctccttcatccttgtcctcatcacccaggctctgacaacccagtgcctttcatctgggtgccatgactcaaggtcttcaccatttgtcttgcttttcttcagggctttctgtaagttattcgtgtcagacactggagtgtcttccaatgtcaaacacaaaatgcagccctccatagagagaggagtcctactcttttggctttgattggatttctttctgagttccaaccaaaacctctgcaaaattgtgaagaagatgaagtgtgtggtgtgcctggactttcctctttgcacccttcatttcatttctatgtaccctttctcctgagagctggtggcttcacgctgtcattctctcttcctccagactgtaagtaatctaataaaatcactcacactaagaggttaggagtttaattctgtctctcccagcggctcttgcacacaatgaagtggaaagagagcccagcattagagtttgaaggatttaattccagccatggctctacttgctgttgcaggacttacacaattcacatcatttctctgggactctgtttctccttcagcaaaatgggaatgatagtaagatctacctcacaggtttgatgtaaaagttaaatgagattgtcataatgttttatcatctgaaagtgtttttttttttttttttttgcacatcactcctttattatactgatatggaaaaaggatttagtacagttatgctcagatgaacactggacccatgtggcagggtcaagcaactagaacatgattcagaaatcagtgaaagatacacttggacaggaccaagaggcatttcactgccatgaaacaaggcaggaagggattctaatacacacaccaggaagcactcctgcccctcagaggtcaaggagctgatcctatattggtatgaggaatggcttattttctgatgaccacatgtgggactatttcaaccgccacaagaaaccccagaagggttattgttttgtattatttatatatactatacttttttaataaaagtaaattaacacataacgaaattcaggattgatcccaacctagagccagatcctctggggtcagggaggaaacagttgtcacatcaccacgcaggttacattcgtcttccactggaatgactagagcccccaggcagtaggcagtggcctgactgcagaagagcagaggacagactccgctcatggggacagacaggctctgttgcttctcctcactggtcatggcttagcatggttcctccccaaagtccttagtaaacaaagcactcgcaaaaacccaagtcactacttttaaactctgttggataaggggagcttttccatagcttagactgagaacctgtgctctagaactgctattctgactagattgtatgaagggagtgggtgcaggcgacaaaatggctaaaatgaaaatgggagccactggtccccatctgcagctacaactcaagatgtctacagatgtggtcagtgtgacatgtgcaggtgggaggggcagagggacaagacgggcagggagggtgctcctggggacagtatcctccccgccggccttcacttcttggccttgccctgggcagccacagcttccatggctttgcgcaccgtctcttcatcccccagaaactgcatgggcttgataggcttcaagttcttgtccaattcatagacaatgggaataccagtcggcaggttcagctccatgatagcctcttcagagagaccctccagatgcttgacaatgccccggaggctgttgccatgggctgcaatcagtacacgtttcccctccttgatctggggaactatttcttcattccagaagggcagagctctggcaatagtatccttcagactctcacaggagggtagctgatcttctgtgaggtctgcatacctacgatccttactgatgttgctgtagaaaggatggtcgggctccatcggaggtggtgggacatcataggagcgcctccagatcttcacctgggcctcaccatgctttgcagcagtttctgctttattgagaccggttagacccccatagtgccgctcattgaggcgccaagtcctcaccactggcagccacatctgatcaatggcatctagcactgtccagagggtccggatcgctctcttctgcactgaggtgaagcagatgtcaaactcatagccagcatctcgtagcgcctgcccgccgcgcttcgcctcctcgtggcccgccgggctcaggtcggcgtcgtaccagccgctgaagcggttctccaggttccatgcgctctcgccgtgccggatcagcaccagtttgtaggcggccatggcggcgggctggggatgcggcaccgactgtgaaagtgttttgattatttgttagtccataaatactagaaactcacttgtgctagcttgagtaaggatattggatttgaccaattaagtgtcatacagcacaagatcaagaaggaacccaagacattatctttcccgtatgtagcagatccttccagggttcacaaatatctggttctttttacctttgtaggcacaaagtgaagttaaattttctagtcttctttgcatctagatagaactgttaccaaaccaaactgggttcgtttgcctgcatgcaatggaaagcgaaacactgaagcactgcatttttgcagcaaaaaggcttattgccagtgaactggcaaggagacaggaggaaatgctcaaatctgactccccaagctgagggctgggttgggtttcataagcatagtgtagtgaggtgtgatctgattggatcttacaatgcggtggtgccaggaggcatgatctgttgggattctgccatggagttacaccagggctcaatctgattagattctggatcctaccatgaaggaatccaagacgttccaagatgtctgcttcttgattcagtccttgcccctcagtgcaagcactttggttccacttgtggttgcacgcttggttcatctgggcatgctcagattacatgaccttcaaccttggggtgggggggtggtccatgggactaaaaaataactcacaactttgttacataggagttgaaccagattgatccagggcagttacagaactatgtgattgagttctggctaatggatagtggaaggaagtgaggtatgcctattccagcatacatcacaaaatgtctcttgtgatctttcacgttctctctcttcctcccctctcctggctgggatgatatcatggggctcttgaagccataagatgatggagacatgagatagaaggagcctgggtccctgagtcaccacttggaaagagctcacaggaaagctatctaaccagcatcatcagattcgaatttttgcatgaggaagaaataaacttgtattgtcttaagctactgagatttggggctgtttcttatagtgggtagtctaccttaatacatacactgtatctcaggtctgcttctccctgccccctgcatcttgctgcacaccactttctctgccttcttattcatcatggtggaaaaaaggcctccaggaacaacaaccaagttgacttctcttctattcagggaaacaggctgattgcaactaaaaacacttcatttatttcaaattcctttgagaagactgggttaggtccagctggtattggatgttgactgaaccaatcaacttgtagtgtctatgaggataggggaaggacaataccccagaaaaatggtggttggcagccatcctaaaatgtagttgacgctgtgctccatgcttgcagttaacatttttaaaaagaaacatggggagagtgaagacatacatttctttttatataccccaaaagaatgaatctctatggatgtcttttcagtgttcagttagtgatttacattttggggctgggtagcttttcccaattgctctcaaattatatagcttgaatgcaacaatattgcccatccagtgttggaaagcacagagttaggggctgcaggctctggcctgtggggcacactggacacaagaaccatgctaaaatatgcaggtaagtaaggggtaagaatcattatccatgcattggtacttaaagtgtggtgcagcaaagtccataaagtgaccttgacgtggtgctgcaagatgtggtggacaaaaattagagttcgattctctccaaagctgattctccatgtatgctttctcctctgcctgaaacacccttttcccttcaccagcagataatcctggctgacttcaggactcagctccagcacaccttctagaaatggcccactcccacttagggttaggccacctctcctttgtgctctgttataatacccaaatgtgattcagtttttaaaaataacattttttcccttcagttgcaaagggaaaaaatgttaatgctacaaactgaaaagtccaaatgagctcaaaaaagaaaataagagtctctcattattccactctctaggggagtatacgtacacacacacacacacacacacacgtaacatgcttctaaaaatttttgcttttgtacttttatctcttaacagtatgtcatgaagattttcccactcatttacaatatgatttatgaatatgtagtagcttatggaatctcataatttcttaaccaaattcatattgttggacatttatgactgtttctaatttttcattatagtaaatgaactccattcaagtctgtcctattcaagagaacagcctgattgcaactagatagacttgtatgtaaagttttgcatattttcttagttatttcttcaagataaaaacctaggattagattgctggatcaagaggtatataaacaaggcaggaaagcagagagtattcattactgtcttgggtccctttctaagaaagaagagaatctttctaggtaccccctctccctagcagatttccctttgtgtctcatggacagaattccatcacatgctgtatcagtctgttctcacgctgctaataaaaacatacccaaaactggataatttgtaaaggaaaaaggtttaattgactcacagttccacatggctggggaggcctcacgatcatggcagaaggcaaatgaggagcaaagtcaagtcttacatggcggcaggcaagagggcttgtgcaggggaactcccatttataaaaccgtcagagctcatgagacttattcactaccatgagaacagtatgagggaaaccacccccatggttcagttgtctccacctggccctgcacttgacacatggggattattataattcaaggtgagatttgggtggagacacagccaaaccatattacatgcatatgcagaaactaggtaccagcaagggtagtgagactatgatcagtttagaccatccagatatttcctataagattcaatacctcagaatttttttttctgttaattaggaagatttgggagtagctgtggtacaggaaccaagtccttttcatacttgctacagaataataaaatgtttaaaaatctgttctaagttaataggtaacagttccttcttgtcatctttgtttatattttattgattactggtagatgtgaacagtgtttcaaatatgtattggtcattgtatttcttctgtgatttactgagtcatattatacctatgcatcctttaaaaagtgactgttttatttttgaattctacggagcagcaaattatgtcagccatatagttagcacaaagtaaaagctcatcaggtgaataaacatgtatgtgcttgcacacagtttgctgtgtgttttgtagttataaataatagtagatgggagagtggttcctagtgcaattggcctacagagactaaaaagttgtggagaacagacttaaggtagtcctgaaacagaataagacatcaggcagtcacatctaaaattcagctttctgggccaggcacagtggctcacacctgtaattccaacacctttggagaagaccaagttgggtggatcacttgagtccagtaattcgagaccagcctgggcaacacggcaagaccctgtccctacaaaaaatacaaaaattagccaggcatggtggtgcacatctgtagtcccagctacttgggaggctgaggcggtgggatcccctgagtccagggaagttgaggttgcaatgagccgtgatcatgccactgcactccagactagacgacagagtgagaccctgtctcaaaagtaaaataaaacaaaacccgactttcttttctgttagtctaatgtattttttcactggctagcttttgaatcaattttacaatgatcacgacaatgtcatctttatttaagctgaaaaatctttgttgggttcggagaaaaaaaaatctatcactcaaaggaaaaacaagaacaataacaaaaactagacattaattatggaattgttgcctggctgtaatccttttgttagtgagtccttgcataattatcacccagtttaatgagtgtgaatttgcaggtaggagaaattatcatgatatcttaaggctaaaattacagtgctctagagagcaatggcgagaaacatcagtctattgccagaaacctaatatggtgagtcatcagtttgaatcctgaggtttatggagatggaataagcaggagggactcccagaaacttcttttgacaataggaggcttggcagttggtcttacaaacccaggagcttgaagttctaaatgaggaaagtacacaattttaaaatgtcatgataaaaaatgtaaaagaaatcttttttgtttagagattaaaaaaacaagatctaccttctatggagccttaagcaagtgaataaggtcttctttaaaatgtagctaatgacatacatcagcacagcgagaaatcagcattgcatccaggtaatgaataattatgtaccctacggtctatcaataaccaattatctggttatgctaacatacccaaccgtcatgtgcaagtagttatttagattttgtaataattgattattgaattgacttttacaataatttatctaattctaactgcttatgcttatgttttattttaccttaaagaatgaatgcatcaaatcactttcttttttaaaaaaataattaaaaattgaaatgacttttgcatgaaggatatgcagaccattcaaagactgtgtaattgatcagaagattctataattgtttgcaaaagctaaaattctccatcatcttgacgggagagcaatcaatagcaatgacaagctgatgagaattacaaagcacatatgtgttgaaattcacttactcttcaggcattcaggtatgtgaagagattatagaaacatgccgataagaaagaggccatacaattctgaccagtttcctccctgccaaatccacacgagtctctgaccaggggtagcatcccctagagcagaaaccctgccctgctcattctataaaatgatcacaggtagagaattaactttggactgatgttatagactgaatgttcatgtctcccccaaattcatatgttgaagtcttaacctccaatatgatggtatttggaggtgggtcctttgggtggtaattagggttagattagaacatgagggtagggccctcatgatgggatcagagtcctcataagaagaggaagagacaccagagctctctctgtgccatgtgaagatacagagagaccgcagccatctgcaagccaggaagggagctcccaccaggaactgaatcagctgacacctcaatcttggacttcaaaggctcatgaactgtgagaaataaatttctgttccagctggatgcagtggctcatgctgttaatcctagcactttgggaggcctaggtgggcagatcacctgaggttgggagttcaagaccagcctggccaacatggtgaaaccctgcatctactaaaaatacaaaaattagccaggtgtggtgatgcacacctgtagttccagctacttgggaggcagaggcaggagaatcgcttgaacctgggaggcagaggatgcagtgagctgagatcgcatcactgcactccagcctgggcaacagagtgagattgtcttaaaaaaaaaattctgttccataagccacccagcctatggtattttgttgtggcagcctgaggatttgatcaacaactgggtttatcaggggtattgtttcatgactgtacctttcttcatatgcatttccttcctcatttttatcagcaaccatcagcacacctcatcagcaattacagaatatgtaagttggcttcattactttattgaataagtattttttaggcatataataatgcagccatcctagacttaagctttgattaggatacaaagaggaatgagcaccagtcactgcaattgagatcctaacactttacacctgagtcataaataaataaatgatgtgggccacaaaagggtactgaactgaacaggacctgtgggaacccaaggagggagatttccagaagattccagcaaggtttccaagggaggtgatatttgagttttactaagtaataaaactgcatgtaaaagttaatgtcaacactttaaatgttatagaccataaattatgaaaaaattaagcatacagaaaatatagaaaatactctaatagactttcatgtatccaaatttaatataggtaagctttattttagatatctccctgaaatagttggaatgtttctcccctccaaatctcatgctgaaacctgttccccaatgttggaattagggcctagtggaagctaggttatgggggcagatccctcatgaatagcttggtgccctccctatggtaatgaatgcgttctcactctgttagtttacaagagctggttgtttaaaagaggctggcacctctcttgctccctctctcgccatgtaacatgtcatctccccctttgccttctgccatgattggaagcttcctgaggcttccccagaaacagatgctggcaccatgcttcttgtacagcctacaaaactgtgagccaaataaacgtcttttctttattaattatccggcctgtattcttttgtagcaatgcaagatggagtaatacactccccttcatttttttttaatttttagaaataaaatgcagtagttacagctgaagttccatctttcttccctttatcttttccttgtccagaggtaataactatcctgaaatggataggtatcactacacatattttagaatgcttactgtattggtaagtaatatgtatatataatattgttatatgttttatttttatttttttgaggcagagtctagctctgttgcccaggctggagtgcagtggcatgatctcagctcactgcaacctacatctcgccggttcaagccattctcgtgcctcaggctcccaagtagctgggattacaggcatgcgccaccatgcctgtctaatttttgtaaattatatgtattttgtaaatgcacatgatagtattcctctaaaacttgcattttcatgtagccatacatttttgagatgtgttcacatgtaaataggttattccttcacttttttttggaagggctatgaattagtaatgtaatgggcatttatacctagagaatgcttctttaagagcacaagggttatatatatatatatagtaattaattactgtatatatgtttgtgtatatatgtgtgtatgtatgtgtgtcatagatcataaatcatgaacaaattaaacatacacaattaagagcacaagggacatatacacacacatatatatatatacacacacacatacacacacacatatatatacactaattaattactatatatatatatcccttgtgctcttaaagaagtattctctaggtgcctagaaatggaatttttaaaccccattttaaagaaactctgtgactgcattttaattgtttcaagaaggtgttgttcctacctaggaaattgcttcatcatttgaatgcaaattgcaataggaaccttgtcagtaacaataataaaacaacacaatcattaattattggggcttcatatatgcctggcactgttacaagtggtgttataagtggtcatgcaattaatttacatgagttaattacaagaattaatgcaaaatgtacatttaatacacaatcatgtggatagtaccactgatcctctaattttactgggttggacaggagtccatcacactcataggcagggtggctgagaacagctaaagcaatggttctcagacaccaatgtgcatcattatcacgtggaagaattgttgaaacttctttgctgagtcccactcccagactttctgactcagtaggcctatggtggagctcaagaatatttctttcttttctttctttcttttttctttctttcttttttttttttttttttttttttgagacagagtcccgctctgtcatcaggctggagtgcagtgacacgatctcggctcactgcaacctctgcttcccagattcaagcgattctcctgcctcagcctcctgagtagctgggattacaagcacacaccaccacacctggctaatttttgtatttttagtagggacggagtttcaccatattggccaggatggtctcgatctcttgacctcgtgatctgcctgcctcggcctcccaaagtcctgggattacaggcgtgagccaccatgcccagctgaagaatgttaatttctaataaattcccaggtgaagctgatgctgctgacccaaggaccacactttgagaaccattgatctaaaccattccctcaggccccagcatcaatcaccacaaatctttaggcatgagcataatgaaatcaatcaatcttccctccctccctcccgctaccctgctccttttctctctctctctctctcattttttgcaaacatttatttcatgcttactagttgcacagtaccaaactgggtgctatgaaaaaaaaaatcaaatgataaatattgagtagtacatatgaagaaaatatttagcgatgctggcaattaatgaaaagttgctggcttcaagtggatttcactttatctgagaagacagtcacatgtgaaaaattaaataacaactgtgattaaatgacaaattaaagttatagaaataactcagacacatcataataatcctggctaatgagtatacaattcaacatttataagatgctatatttgtttttcttctaataagaatatcccagtagcattttcaagtagaaatgtaataatgtgtaggttcagacactttaacaaagatcaacttaatctggtttaaaacaaaataaaactgtctctcatgtgacagcctgaaggtagtgatccagggaggtccatatttcagcttctggaaagggaaaagggaaatgcaggtcatgccccccttttttatggatttacctaagaagtttcacacatgacttctgctcacatcccattggccagagctcaatcatatgaccacatctagatgcaaaggaggctgggaagtgtatcttagcttagtggccatgtccccagccagaacttgggcgttcccttatcaaagatggaaaaggagagtggatgttggggaacaactaccatctttgcctaagaattactgtccatttttatagatgtagaaaactgaaaacagagaatgtaaatgacttgcccttaattacataatcaataactggtggacttggagttgaagttctggcttttttgtttgttcatttttgtttgcttcgttttaagtccattggcctttcccttctattaaactcttcaagtgtaaagccattctattttaaacaatccataaaagaaaatgttggtttctgtgatggttaatattagatgtcaacttgattggattgaaggatgcttagatggctggcaaattgttgtttctgggtgtgtctgtgagggtgttgccagaggagactgacatttgagtcagtggactgggaggggaagacctaccctcaacgtagttaggcaccaggtaatcagctgctagtgcagctagagcaaagcaggtggaagacagtgggacaagctggcttgctgagtgttctggcttccttctttgtcctgtgctggatgcttccttccgctcctactgcccttggacatcagactccaggttcttcagtcttcggactcttagacttacacccatggtttgccagggctcctgggcctttggccacagactgaaggctgcactgttggctttgctgcttttgaggcttttggactcggaataagccactacaaccttctctcttccccagcttacagacagcctattgtaagatttcaccttataatcatgtgagccaattctccctaataaactcatacacacacacacacacgcacacaccctacttgttctgtccctctggagaaccctaatacagtttcctacgtactttttttttttacaatactcattgttaggaatatttttctggaagtaaattaagtttccgtttactgcaatttcaatccactctattttatttaaccaacaaaatagaacataaaatattaaagattcactgtccactttctgaccagacactaagctctcacttgactcgtacagaatctaagtgttcataacctccagcagacacaagtcatccattgatatgagaccaaggagactgaatctacttccccatttcaaacccattccaaataatgctttcttgtcaatatctcagactgtgccatcatgactgagatggtgtttttttgaacgttgatggtttgcagagcactgtaatagtttatgtgtgtgaaggtgaatgtgcaacatgaccaaacaaatcaaacatcactctccttccagctaagagttttcttatggggctaataaaagccacagctggccaagattaaaaagttactcataagaaggtagtttgagaaaaaagaaatgacaaactaggaaaataaaaagttatgagcttttgtagtatgaaaatagatttaattaagaatatttaggtcaggcacagtggctcatgcctgtaatcccagcactttgggaggctgaggtgggtggatcacttgaggtcaggagtttgagaccaacctggccaatatggtgaaaccccatctctactaaaaaaaaaaaacaaaaaacaaacaaaaaaaactaggtgagcgtggtggcacatgcctgtaatcccagctacttgggaggctgaggcaggagaattgcttgaacctgggaggcgaaggttgcagtgagctgagatctgccactacactccagcctgggtgacagagcaagactctgtctagaaagaagaagaagaagaagaaaaaaagaaagaaagaatagataatctgaaattgtgttacaaccagatttgaacccaataataattttcctaacaatgttggccaggctggtcttgaattcctggcctcaagtgatctgcctacctcagcctcccaaagtgctaggattacaggtgtaagccactgcacctggccccaatgatttttaaaaatacatttgggtcatttcccaaccaataggtcaacacgagttcagatgatttggtgaaggtattgactctttcaacctttaataaaaagtgttcaatgatagtcttattaagctaccacgaatgaaaataaaacataaaaatgagaaagaaattaggaaaacagtaacataaaactaaaaaaattattgatacaattgtgtgatattcatatatagtcattcatggatatattcaacattttcctggcccatacaagaattgcaacaggattcaccttattcttatgacattttacagtttaaaaagtttttcatataattattttatttgacatgaggatgaatcagatagatagcaactcaactcaggagattatggtggaatagaggatgtgagagtaatatgcaaataacggtaatatacagtcatacatcacataagcacattttggtaaatgatatgccacaaatatgacagtgatcgcataagattataatggaactgctctatacagatgtgccattaaaaatttttatactgtatttttactgtaccttttttatgtttagatatgtttagatacacaagtacttactaccgtgctacaattacctacaatattcagtacagtaacatactgtacagtttgtagcctaggagcaataggctataccatataacctaggtgtgcaggaggctatgcttgtatgatacactctatgatggtatcacctaatgatgaaatcacctaacgatgtttttctaagaatgtatctttgtcattaagtgatgcataattgtaatagaaaaagtggtgaatatcatcagggaagttgcaaggcaattccgagaagggagcaatggtttttcgttgaggaggagggagagagtgtgtctttgatacacaagtgatacttctatctgctatactctgttccaagcatcagcacccctcagcaggatgattgcaacagccgcttaactcgtctccatacatgcccttaactttactccactcctgccctttgatgttcttttctgttttgcaagggactggaaccctgaaaactacatttcccagactcccagctgttctctggttagattctgctagtaggaagcactggctggagattagaatatgctcttatttaattatctactctgaaagctaaccattggcattaggtgaggatctctgcctttatgagcttttcctaaacaaagctggacttcttaagcaaagcttacttttactatggcagagaaaacaacaacaacaacaacaaatggttaagctgaagtttgctttcaggtccctggcattcttttttagctttatcttactcttccatcaaacctcctcagttggcaactaatgctttacttttgcctacctgaagaaaaatagctcataaacatattgagtctagtaaggcccaggaaggggcagtgctagttcattcagagtctttgcatgcagtggaaaaggctgccttcttccattaagacaaagccctaggacaggctcacagtttggcaaggggagcacaggctgtattttgacctcctcctacctgcttagtcaggtgtctttgctcagtggacaatctgcagaactgtatatagctggtcaagacaatacctcagacctactcactggagttcaccactggggactttgttcctaccactgagatcttcccttaagaccattactggtgccatttcatagatgcccaaccatccatttccctacttattcattcattaattattaaggcagggtcttgctctgttgctcatgctggagtgcagtggtgtgatcatagctcactgtaaccccaaattcctggcctcaagtgatcttcccacctcagtctccaagtagctagaactacagacaatcaccatcacgcccagctaattttttaatttttttttttagacggagttttgctcttgttgcccaggatggagtgcaatggtgccatcttggctcattgcaacatccgcccccggggttcaagcgattctgcctcagcttcccaagtagctgggattataggcatgtgccaccacgcccagctaatttttgtatttttagtagagacggggtttctccatgttggtcaggctggtctcaaactcccaacctcaggtgatcttcccacctcggcctccaaaagtgctgggattacaggcatgagccactgtgcccagccttaatttttcaattcttttatagggacaggatcttgctatgttgccccagctggactcaaactcctggcctcaagcaatcctcctgcctcggcctcctaaagtgctggaattacagtcatgagccactgtgcccggcctcattaaatattattaaatgtctgctctgcacttggttctattccagactctggaaactagaagcagaccttaagatgatgacaacacagtgaccagagttagagtcaagctttccagagaagttaaccttcacacctagcaatgttggggaaatgggttctgtgttccaatttggaatggcagttttattctttccttactggggcctccattttcctttacccttgtcttcagggcttgccgtcagctgttaatggtgactgtcttggcttgaggttccattggactgggtctggagggctgacattcagagtagggagtttaggggatgggaaggtgatcttctggccatttgaaccctggggatatgcttttaatcctgacttgatgccctctctgctaccttacttttcttttgcatgccccggggcctcatggtttgcttcgttttccaccatctacagcttctgaatggtttttctctcccttccctgccctgtgaaggaacagaacatgagcttagagcatctctcttatccttctttcacttggtaagcagtcagctcttctgacacttctgagggacacatagaaggttcaaatgcccaccttcccatctgcttttcaggacaactacagataggcacgtaggatatgggggggtcttttgtcaaaaagaaaactgagggaagagaatccacaggtaagttcccataggttatctcccataaagcctcacaataagcaggctaagatggacattctcttcatttttcagcaagtgaagaaacctgcctggacctacagagctggacttgaacctgatctaactacattaccttacactctctcccctttagaaactgaagacctaagggagaaagcttcttacacagctggcacagcacactaaatcgtcacaaccctatgaggtacatatcactattagctcattttacagatgaggaaactgaggcactaaataattactttacttgcccacagtcacagggtttttaagtggtagaggagggattccaatctaggcagtcttcaaagcctggactattcaccattgtcttctgggcaaaagaaggtgcctcagccacattcctgaagtgttcctgtacccctgtttgtcttgaagtaatgttcgcctgggtcaggagccacttctgtaaagttaccagataactctgggctcctgggaacaagagaaaaagcaggctgtggtaagatttgggctctcagttgtccctggctttgctgtacagggactattatattagtcaaggttctccagagaaacagaaccaataggagagagagagagagagagagagagagagagagagagagagagagagagattatgggaattggctcacactattacggaggccaatacatcccataatctgctacctgcaagcaggagaaccaggagagctagtgatgggcctcccagtcaagtctgaaggcctgagaaccaggaggtcctatgtccaaggacaggagaaaacagatgttctggctcaaaaagagagtaaattcagcttcctttatccttttattctatttgggccctccatggattggatgatgcccaccaacattggtgaggaccatcttctttattcagtccactgattctaatgctcatctcatccagaaacaccctcccagacacacccagacataatgtttatcagctatctgggtaccctttagcctagtcaagttgacccataaaattaatcatcacaacttttccaggcaaccacccagttgtttgatgacagtttctcttaggcacatcagatgtaaaagccaaaaggctgggtccactacattatttgtggggcttaatgtaaaataaaaatgtaggtccccttattcaaaaagtaagaaaagagtgccaataaacatattaaaatataaggccatttcctgtctttctttaaattgcttgcaaaaaccttaccaaatctctttctattgtgcaattgtaaatgctagtataagagcatttcattcatatgtggaatcacagatattacacaatttgtattttgcggcccatacatgcacatgtgtcttgttcttattacaacagtggaattgttgcacaaaattaaactaactcaactgtttttattttgcttcttgatgtgcatacttgtttttgttgttgttgttgttgcttttgagacggagtctcactctgttgcccaggctggagtgcaatggcgcgatctcagctcactgcaacctccacttcctgggttcaaacaattcttccacctcagcctcccaagtagctgggattacaggcacccgccatcatgcccggctaatttttgtatttttgtagagatggggtttcaccatgttggtaatgctggtcttgaactcctgacctcaggtgatccgcccaccttggcctcccaaagtgctgggattacaggtgtgagccactgcgcctggccgctgtgcatacttttaccaacactgtggaagctggtggcttccataattcactatcttgtactcactttgagtcttgctgacttccgacagatcgtgggtttgaaattctgtgtgaatggatggcgagaaactgtgggcacatattaatatattatgcatatctcctctgctcacactcacactccattgtcccatcggatttcaattacaaaactcaagttcaaaggtaaagttattcagaatttcaagatggtgacagcagagcattacaccaagcaggaagccctttctagcctggggcccatgaagccagtcctgccaaaggggaccgaaaagatttcactggagctcaacctttcattttggtgggaatgcccaagccagatcagaattaggtgagccttgagcctctaactgaaatgcatgacattcctaattacacaattctaaaattcagagctgaaaagggcattatttagctatgggtttgtttgtgggtatttttttgtaacgaaacctacattttgaaacctaggaaaacacataaaatactgtaataaacatcatttcactccagaaccaatcattgttaacattttgcttcttttcttcatagttcttttttttttttttttttttttttgagttggagtctctctctgtcacctgagctggagtgcagtggtgcgatcttggctcactgcagcctctgcctcctgggttcaagcgattctcctgcctcaacctcttgagtagctgggactgcaagtgcgtggcaccacacctggctaatttttgtatttttcgtagagacggggttttgccatgttggccaggctggtctcaaactcctgatctctagtgatttgcccacttcagcctcccaaagtgctgggattacaggtgtgagccaccgtgcctggcccttttttatttaaataatagaactgagacattttaggtaaaactgaagcctccttcatcttccacccctaatcagattccacagttccttcaccagaggcagccactaccatgaatttggtgtatatttttccaggtcacttaaatactataatgctttacttgaatatacagtatccataaacaagacagatatttttgaatgtaagtttgtttcttttcttttaagttacatacagtggcatcttctagtacaaattgttctgtaacttgcttttattctcatgcaacattatatttttaagatctacctatcttaatatgtaggattagtttattcctatgaaatggttatagtgcattttatgaatatgccacattttatttacccgcttagcctggtggacatgtagttgtttccagttgttcactattataaacaatgctgcaatgaactttctttttttttttttttctttgagacagggtctcattctgttgcttagcctggagggcagtggtgcaatcatagctcactgcaagcagcctcaacctcctggactcaagggatccttgtgcctcagcctccaataggtgggactataagtgtgcaccactacaccgggctaattttgtgtatatgtgtgtgtgtgtgtgtgtgtgtgtagatgacgtcttgctatgttgcccaggctggtctcaaactcctggcctcaagtgatccttccacctgagctcccaaagtgctagagttacaggtatgagccactgagcctgacctgcaacgaacatttttgtgtgggagttctagtgcacatatgagagagtttctctaggacagtacttgctgtgtgccaaattgctctccaaaaagattgtagcaatgtgcatgtccactggctgagtacgaaagttctcatttcactgcatccttgacagtgctaaataatacctatttcttttttcattcttgaccttcacgttttatagccttgagacttgggcagaaacagttctagaacccaggactcatttccagcctagggctcagcagttgattcaaatattaaactatcatgctcttttcccgctaccttccacaaaattttcagaaacattctatggtagttgccaaagttgtaggcctgggatttgggttgtgccctgacaacctaccctgtattgtatatattgtaaatgttctgtgtattttgatgttttgatatcttaagaaccctttctaggtgaggagagactgcccctcccggtgctagccaattcttacagatagcaaagagccaagataggagcatggctttggtaggcaaactaatcagtgcagagccatgccttctccattaggatgcacaacccagcagacaatattcctctctctcagtcctcccagggccaggtgccaggcagctaaagaccactctcttagagtttaagagcccactgaaattatacaaactagccaatcctaaaccattcaccctgccctatcttgcctttcttgcagaaactccaataaaggcagtggcctaatgttctcctctagctcttgtcttttgcctcctgcctaccctggcgcctttcccacctggctctgtgtggcatgctgtgtctcgaggacttgtgagtataattaactttttttttttttttgagacagggtcccactctgttacccaggctggagtgtagtggcgcgatgatggctcactgcagcctcgacctcctgtgtgcaggtgatcctcctcccacctcagcctcctgagcagctggaactataggtgtgggccaccacggctattttactttttattttttggatttttttagagatggggtttcgccatgttgtccaggctggtctcaaactcccaggctcaagcgatccacctgcctttgcctcccaaagtgctgggattacaggtatgagccactgtgccaggtcataaacttcattttcctgagcctctcctatgtcacctcttgggggtgcccctgaaaggcaatctcataaaagaataaaaataacccctaccccaagtctggcagtagaggggacctagccagtcttatcttttgtctcaaaaacctccaggaaaacatgacttcttatcttgtgttttcctatgtgcatatgaggacttgcggcaaagtatcgggtgaaatcatatacaggatataagtactgttatttggagggtctgaagcactttaagacaagactggggataaaattcaaggaatagttgaatcaaaaacagattaatcagaagaggtgcagagtattatgaatgcaatcaaggagaaagattgtttggagagaaatgctaaacaattcaagtctggaaggttgacgtgattccgctgttatgaaaatagggggtgcgcttttatagatcaacacacttctatgcaaatcatgtatcactctacagaactcattgttcaaaaataatatgaaaagaaatcctccttccttcacctttgtcccaggggacattctgttggctaaaagaataggtcttcacagaggtttatcagcacgaattaaagcttgggttttttccctgagggccatgagaactggaatttggccctgcatttatgaataatgcaaagagatgctagggaaagagcagcatggtgggaggatctctgtctatccacactcctcgattttctcctttacttaatccagaccttgtttgtttacaagcaagctaattagcctttaagacttgcaatcctcatctgaaaatgaggatgatgataattctgacttcacaggactgttgtgactactgaaacagatcatgcattcgaagtgcctagcatatagaaggcacttgataaatgccagcccttcctcttattagtttctaccctctttgaattcttaagaggcttttcattgagagcctcataatttagtagctgattgcatactgtcttatacagtttgctattgtttctcctaagttaatcttatctttcttatgcctcgtagaacttatgaaggagatactgtaagatctaaacccgctgctttacagtgtatgcaatgtgtgcacagatattcttttacatatcttttgattcctccacttgctcggcccacagctgaacatggacgaggcacactacagtccgtattaactgattgatggctctttgtcacaaaggcgaatccctccagaacttttttcaatgattgggaatcagagactttcactttgaagaaagagcacagtgcattttcaacatcctaagagaaagctctcaccttgagaattttcagtctgctagattaaatacaaaatgattatgaattcttcttcatgggagcacggtggtaaagttaaaaagcacctgtggcacactgttcttttttgaagaggaaaacacagggctgtaatggtacggcagagcccattgctaagcaacagaaccaggtctagactgcacaggagcaaaaattcttctttgttcagtataatgaagaatttttaaatggaaaatgcttaatagatttctagcagcaacaatactccttatgattttctaaagtactaatcagcagttgatatctaactttcatgggagtctctgacagtagctcactgttttgttttctaaatgaaacacttcaacaagaaggtttcagatcatcaattttataaaaggcatggatctaatgtatggattagaagtcacctgtccctgtgttttagtttaaattcaggattataaaaatccatctcaagtaatgtcaatacccgttaatgttgatgaaactatgttgtttgttggcataacttgaaatgagcagcatctgggaacctgttagaactgcagattattggcagggcatggtggctcacacctgtaatcccagcattttaggaggctgaggtgggcggatcacttgaggtcaggagttgaagaccagcccggtcaacatagtgaaaccccttctctacaaaaatacaaaaattagccggatgtcatgcctggtgcctgtaatcccagctacttgggaggctgaggcagaagaatcacttgaacctgggagatggaggttgcagtaaactaagaccatgccattgcactccaccctgaccaacaagagcaaaactcagtctcaaaaaaaaaaaaaagaaagaaatgcagattatcgagccccatccttggcctactgaatcaaacactctgaagacgggttcagtgcttggtgctttctggggctctccaggtcattcctctatagttcagagtttgagaaccactgagttaagggattgggatcactgtgtgagacacgaagaagcagagagtaacgagttaggtcctgtttggtactagtgagccctgggaatcagtggaactcccgagccatttggaactggggaagaaatctgtagtggtaactcagacagcatgcagaaaatagcatatgaaatggagatgcttcacagtagccttcacttcctgctgaaattggatctgtctgtaaacactgtctgggatggttaattttaggtgttgacttgactagctgaaggaatacctagaaactgggtaaagcattatttttgggtgtgtctgagcacatttccagaggagattagcatgtgtgtctgaatagactaagtggggaagatctgccctcaatgtgggtgggcaccatctactctactagggccctggagagaacaaaaacagagaaaagaagaacatgtccatctctctgctggggctggggtacactcttcctctcctggccttggacaacaactctgggctccctggcctttggatttcaggacttacatcagcagccccgccaggctttcaggcatttggccttggactgagagttacacaattggcttccctggttctaaggcctttggacttggactgagccatgctgtcaacatctcaggtctccagtttgtgaatggcctgtcatgggacttcttagccttcataattgcagagccaatttccctaataaatcctctgtcatatatctatatctcttattagttgtgtttctctagagaaccctaatgcacctcccaattgtctccaaacaattaaaaaagggcactattttaaatggtcatttgtctgtcgagtatttactgggtaactcctatgggccaggcatcacggtaggcattacaaacaattgtttgtaataaatatatagtgttttgccgagtcagcggtaatatgcttatgcagagttgaagaagagggatatttcttgaaaactggaaattatacagattaaaggaatagtgaataggaatataaacagctaaagatatagaaatatagttagtgaagtttctattcctgtggccagattaaagatggccacaaattctttgatgtcaaataattcctgcattgagaggtgggatatatttcccgcctccttggacctgagctgtgacttctttaacaagtagagtatgacagtttcaggcctaggcttgcaagaataccagcagcttcttccttgttcccttggagccctgagctgccaagtaaggcattagactactgtattagtctgttctcacactgctgataaagacatacccgagactaggtgatttataaagaaaaagaggtttaatggactcacagttccatgtggctggggagacttcacaatcatggtggaaggcgaaaggcgcatcttacatggtggcagacaagagagaatgagagccaagcaaacggggaaaccgcttataaaaccatcagatctcgtgagacttattcactaccacgagaacaatatgggggaaccttcccctatgattcagttatctcccactgcatccctcccacaacagatggaattatgggagctacaattcaagatgagatttgggtggggacacagtcaaaccatgtcaactaccctgctggagagggcaggtgaagtgccctgagactacatggataatgagaggagtcttgctgagctcagcctttcattgtccttgccaaaaagccaagcttgggaatgaagccagatgaaccatcagatgactaccaccaagtaacaccagtcaacaccatatcgagcagaagagtcacccagccaaaccctgaccacatttccaacctgcaaagttgtgaaatatagtaactttgttgttgtttgaagccactaaattctggggcagtttgttatgaagcaatggatagccctgcactttaaaccattgctgacagagatggaaaatgacctaacatgagtaaagccgtcagacatggactcatgtagaactacaaagtgtaagaaagaaaagcaaaaccaggacaatgcagatgaggaccagattagaacaggccactcctgagttagggtgtctcccaaaacccagtgagaagacacaagaagtcaacatcagaatcacactatttttacaactatacagcaaaattgttaagagtgcagggtatgcagtcaggccaacttggcgttagagcccagtgccaccattactggctgcatgcttagaagagaaacttgaccatgctaagatccaatttactctagggcatgtagtagtacctgtctgttgtgaagattaaatcagataatctgcatacaagtgctttatcagaatacctggctatgcaggttctaggtctgcttgaccttgaatgtatgccttgtctttcccctgacttgctctgcatgccgagtttcctgggctgtgtgttgtctgatttccagttgggttcagccaagaggaggcaacagcaaaatattggagagccaaggaagagagagaagcctagctgttataccctgaatctcttctagccttttgttgttgttcattttgtatctgttttcttctgacttttgttttcctcatcaaccttttttttctctcttttttttcctgaaggtatagttcattgcctatcctagctctatacaagatggtctccaattcagcttcccaacctccatgagtccagggctttacttccagccttcctctccccctactcccactctgctacccacttcacccactgctgctaaatttttagccctataatttgtaggtgagtatcaggtgtacaaggctcagccacctccctggactcatgcacccactctggtcatggcctcagagcaattttcttattttttgtaggcttatgcattcataaaagagtaacttttatattttatcttgcatttttaacattgtgtagcattaggttgcaggatctcttatccaccatgttgccagagatgttgaaactattttttatagtattaagcatttagtaaactctattatgtttttccaggcttttggtcattttgataaatttcttctttatttgtaaaagtttctgctatcgtttgaatatttgtgttccatcaaaattcctatgttgaaattgaatccccaatgtgatggtattaggaggtggagcctttgggaggtgattaggtcatgagggcggagccctcatggaggggattagtgtccttataaaagaagtcccagagaactagttcatcccctctaccatgtaaagacacagtaagaaggtgacatctctgagccagacagcaggccttccccagacaccaaatctgccagtgccttaatcttgaacttctcagcctctagacatgtgtgaaattaaatttttgttatttacaagtcatcaagttcatgatattttgttatagctgtccaaatgaactaagatagctccaaattaaaataaatgctttatatataattaaaaggagttatctcaagcaggcagatgcttgcagtcatttttctgttgtctggggtagctgttggaattctgggtgacatggctctttatatagaactatcccttggattacaggccatttatactaacattcttgtccactagacaccaaatgccaggagatttctctaatcattatgacaaccccccaaaaaatcttcatacatttccaaatgtcggcacttcctgttgagagtcactagggaaaaaagcacccattgacagtgtccatctgcaggacttttactgttcaaatgcgccatatgttacagttccacctgtgacaatttttgaagagatcattgatcataaatgtatagtaattttgtcttgttttgtttttcctggagacattaaggtgaaacgatgcctactgctcattatatgggcgactggtctcttcgaaaaatgttttataaaatataaggtccagaaaaaatatgtccacatcaatatcataaacttggcatcattttgaaagtttgagatcaggtgtgttaactcagttaagatgattgtaaggaccactgctgagattcagattgaaaactaaatttagggccggatgcggtggctcacgcctgtaatcccagcactttgggaggccaagacgggtggatcacttgaggtcaggagttcgagagcagtctggccaacgtggtgaaacccggtctctactaaaaaaaaaaaaaaaaaaaaaatcagccaggcgtggtggtgcatacctgtagtcccagctacttgggaggctgaggtgggagaattgcttcaaccagggaggcggaggtttcagtgagctgagattgtgccattgcattccagcctgggcaacagagcaagaatccgtctcaaacaaaaaaaaaaaaagaaagaaaattgaatttggtaaacaatgtaatttcattctataggctactagcccctcaaccacaagtcactttacctctctgtgcctcactgttccctttcataaaattaggtgccatttcttagttcttttccatttccagaattctgtgattatattatggtgcacattctatgtaatagtttgtatttttttcaaagagatatcatatatactagctcacttgatccttacaagaacccaatccttctgtatgtaaaaagaaaattttgtcaagtatcaactttggaggcctgaatcttagaaaatgtgtaataatcattgtacaggttcagcaggacactcagatatttattaattaactaactgaagaaatgctgttttggctaatgtcttgctgtgctcacagcatatgcgtcatgggaagaatgctcttgtatagccaagctttgatgtccatgtgctctcaaaggaaaccacacaaatgctgcagccttttaggggagagccatggggctctacattgaggctaagctgccctgaccttactttgctggatgagtgttctagggaatctggccaatctgaaaggaacattcatattaatatggtaataaaaagcttgggactctggaataagcctgacttttatttgaatcctggctttgccacttaactagttatagttactttataaggctgtacaaggatggaattaaattcagtgagctaatatgtgaaaaaatgtccagtttctggcatgtaataaatgttcaatgattgttaactaaaaaatattagggtgggagctgtcaaaggaaattggataatttaaatttagtctcaatgaatctattacttacataaaaactgtgttgttctgcattctgctcatctttcacgttcaaatacacattaggcttattcactaattgattcattaatttcttaattcaatgactatttattgagcacctattatgtgtcaaactctattataaataaacactggaaatgcagaagcaaacaagacattaagagtccctactcttatggacgtgcattttaatggggagtgacagaaaatatcctccttcccaataaaaaaacaaacaaataagaaaattaactggtaatgataaatgctaagaaaaacatgaaattaggcaatgtgatagactctggggagcaattttagattgggtgttcaaggaaggcctctctatggatgaaaagatgaagcaaagttccggggtccaagcaagatatgatgtagaagagagtagaggtggttaggatggagagaggcgaatgggttaggggatgatgtagaggaagagcaatagtacttattgatgggtcggacagtaggtgtgagggacagagaggaattaaggaggagccctgaagtctttgacttgagtggatggtggtaccatttacagaagtggagcaggctgagtagagtaaattgggagtgagaggatcaggagtctggtttgggaaagattaagtttgaagtgcctattgaactccagtggaggtgtcaagtagacaactggatacacaaggtcatagcgaaacatttgggggatttttgcctttagataatatttaatggagtgggcgggatgagaatggttaggggaaagagcacactctcacttctcgacaatgggagttaaaaaagagaagaggttcctggtatattcttacattttcaggtatctatgactcataacaaaagcttacagtaataaaatacagtcctcatagaattacccacatggaaataaattgataggaaattctggccttttcacattctttagtatacatgaatgggaatcagaaataagtcggattgtaatacactagtcattctttgacccacatttttgactgcctactgctaggcactgtatgtaaaaggaaatcaatagcacagtcatgttgttggtcaaacatttactgagcacatgctgtgtgcatagtaccagatgagtcgggtagagactaaaaaatggaaaattaattttctgccccaagaaaaagcggtctaaattagggatggagtacaaaccactcaaaagtttaaagaagagtatgtttccttttccttccacatatctgatgttcttaggccactaggagttcttgcactgctataaagaaacacctgagactgggtaacgcataaagaaaagaggtttaattggctcacagttgcacaggctgctaaggaagcatgatgctggcatctgctcagcttctggggaggcctcaggaaacttacaatcatggcagaaggcgaaggggaaagaggcacatcttatgtggcctgagcagaagcaaggggtgtggggtaggtgccacacacttttaaacaaccaaatctcgtgataactcactcactatcatgagaacagcagcatgggggaattccacccccatgatccaatcacttcccaacaggccccacctccaacactgggtattacagtttgacatgagatttgggcagggacacagatctaagccatatcaggcagtatgtttccttccacatatctgatgttcttaggccactaggagaaacccgtttgtgccgaatggatttggtgaggtaggccacagtccataactccttctgtcttttcccctcccttccacttcttgacaatgggtgggcttctctgagtaaagagaagtgtatttcagcccatattttattgctagccaactagtactctaggcaacccagcattcatattcccattattagagaagaaggtacattgacatttttaatgggttgattttttttgcctgttaaattaaacacagtctccactttcacattaatatccactatttgggccggatgtggtgactcacatctgtaatcctagcactttgggaggcgaaggtgggaggatcgcttgagcccaggagttcaaggtgagaccctgtctctaagaaaagaaaagaaaaaaaaaatccactatttgttcaacatgctacgcttcctgtctagctagtatgtagattggatgcatgcccacttatcagcaaaaatgggagggaagggaagaacccttttctaggccaatggttgtatttgcctcattaagatgcagcagaggccaggtgcagtagctcacgcctgtaatcccagcactttgggaggccgaggtgggcagatcacctgaggtcaggagttcgagaccagcctgaccaatatgatgaaactccgtctctattaaaaatacaaaaattagccgggcgtagtggcatgcatctgtaatcccagccacttgggaggctgagacaggagaatttcttgaacccgggaggcagaggttgcagtgagctgagatcatgccattgcactctagcctgggcaacaagagtgaaactccatctcaaaaaaaaaaaaaaaaaaaaaagagatacagcagaggcttttgatggcttattgtcagaaagaacagccagcattaattatgtggaaacaaaaatcattacatttagcagtcatttagtttttaaatgaaatttattaagtaaccccagataaaagctttcttccttcaactacttgggacatttactgataaatcatcctggcagaccaatggtgaggtaattctgattggaaagaaattctcagtagggtccacggtgaagttcttttgtggtcaatatggccaaataaaatactcagggatttttttggggggaggatgtcaaaataacttctttatgcttggtgatgtcaagttctgtgatctccaaatacttggccatcttctgaaacaggttcaaactctttttgttgtacattgagaaacatcttggccctcttccctggtaccagtgcagcctgcttctatgtcaatttgcttgaacgagaatggaaggttagctattaaattgtttgccacaaaatgttaaatcagtccccttcatgtctgctatctgaaccgtatgtatttctcttccatcaatgatatgcaatgtcagcccagtagatattcagcagagatttttagctattaaattttgctattcagaatactgaagttcagggttgttacttagtacctgagagaatctaagtggcattcatttactagtttctttcagtccctgcatgtagttatatcaccagaaagtcactacctggactgcattatcttgtggtttatattgggttacgatcagaaatgtcatttgaagaacattttagtatcttatgcaaaataacacgagaaaatggcagtttattaacttatctgatattccttatagaaagaatcatatgataaattgctgcttgaaaccagtgccagagaaatattagtccctttaggtgactcagtatattttctttctttgagagatgagaactctacagtaatatgaatgatgttgtctttttactgtgagtgccaggaaactaagaagttattttaacatgtcctcatacctttttgtgtcctaataccttaaattcttgatttttgttttttttttaatccagctgttatttatttatttatttatttacttatttgagacagagtttctctctgttgcccaggctggagtccagtggcatgctctcagctcattgcaacctccacctcccaggttgaagtgattctcctgcctcagcctcccgagtagctgggattacaatcgcgtgccatcatggtggggtaatttttgtatttttagtagagacgggatttggctatgttggccatggctggtctcaaactcctgacctcaactgatttgcctgcctcggcctcccaaagtgctgggattacaggcgtaagccactatgcccggacatcttttaaacgtgtgtagtacagttttataactcctgccaagtctttggaagaaaactaggagaaaggtcatctcctcagagaggctttctccgaagactgaattagaatcagctcccatctcccagcccctgaaccagtttatcttattaaagcacctttccttcattgcacttatagtaatttgtaattattacttttgttttgtttccttgttaaagtttgttttctccacgggattctaagttccatgaagactaagaccatctctgtctttcagtgggttatccctagctgaccatagcatgtaatcaatgctcaatagaaacttcttgttgtcaattattaataaattataatagtcctagtattaccaccactaaagtcttatggtgtaatgcttcaaatttctagaattgttggagtattaaattagtacatgatactctgcataataatgtatttggctcttttaaaaggtttttgtaaatagtctcaggatttttacaacaaacagtaattaagatgaaaattagatagcaaagaattgaatgaatcattggaattcataacttagtaaaataataatttattagtgcagatgatattatctacagcatatcttaatcaaaagttatacagaaagaggcaacacttgcatatttcaagtgagttttttttttttttaaggatttacagttacagggatagatgtctgtatttcttttgacaaattcttatttcatctctttttggggagcgttggtccaggaaatagagaccatatgaaattctatgctgcatgtcaagaaaatagctaagataaaatggggactaggaatttggtcccagaagttttcatttctccctgactatgagcaagtcctttatggagttccttttctccttctttctcttctgatcctccctctcttgctccttccctgcctcaagttgtcacacctccttgtcttcttcaatctgtaacaatttctcagtctttcatgaccttgacacttttgaaagtacttgtcagatattttgtagtggcaaaaaccacaattagttttgcaacaacctaacagaatatctctcagtttgagtttgtctgatgttttcttacaaaaacactgaggttctgaattttaaaggagaatattgcaaaggagatatgcctttcttgtcacatcgtattggagcacatgatatctccatgactaattactggggaggtttaaccttgatcacttggttaaggcgatgtttgccaggtttctctactatcacgtttttctttttctttctttctttctatgttttattagttatacaggtgtgacttttttttaaacccaagggtttaagaattgttttatttagtttccaaatttatgggatttatggaagctatccttttgtcaaaatatctaattttattgtataattatagagtacatagtttgtatgctagtgattttcaggaatttattaatgcttctttgtgacctgatttatgatctattttaataaatgtttcaagtatgcttgaaaagactctggttttccccatgacttaatttctacatcaatgaaacaggaagaaccaaaacatccaattccttttatttattttttgaaggctgcaaaaccaaagaccaaaccgaaagagaaaaatactgcatttgttctttttgactctttattttgcaaactcacaatagggatatcttgacacaagtaaacatactaggggagagagaaaaatgaaaatatctgtccttcctgtggattcgttaccactgggtaacaggtgcttaatcctccgtgggggcacaatttcagattacagagggtctggccagagcggaggagtaaccacctgtgataatgattctgatctgtgttccattccttagaagccctctggccttagctaatctgtctaagtaaagttgggtctttggtgtactgccatgaagtatcgctgtatgctgaggtggggtggctgatggcagtgggctagtcgttcagcctagttgcttaagagacagcatggatcctcatctgtatttgccatgggaagaggcattcgatgattaaagacttcacgctgcagatttaagtcagatctttaatggccaccctttcaggttgtttaccataggacgccatgcccctcggctgctgccctgacactctcctgctgtctctggctgcttctcttctgtgaaccctcacggatcctattgttggttccccacctcctcctgggcatcatcatcaaggctcaccttctagcttctaggagatctcaagcctttccaaatatgatgagtcatcaagaaatatgaaactttatatgggcgtttattgcgctatttgtttcaactttcctatatgtttgaaatttatcgaagttcacagttagaaaaaaatccacttgcttttcctctctaaaaaagttagtataggttgatgatcccttacccaacatgcttgggaccagaagtgttttggattttggattttttgggattttggaatatttgcatatacataatgaggtaacttggggatgggacccaagtttaagcacaaaacttatgtttcatatatactttttatacacatagcctgaaagtaactttatacaatattttaaataattttgcacatgaaacaaaggtttgtgttttgactgagacccatcacataaggtcaggtgtggaattttccacttgtggcgtcatgttgacacccaaaaagcttcaggttttggagcatttctttttctttctttttttttttttttctgagacagggtctctctctgtcgcccaggccggagtgcagtggcatgatcttgtttcactgcaaactccacctcccgggttcaattgattctccacctcagcctcctgagaagctgggactacaggcgtacacaagcatggctggctaattttttgtattttttgtagagatgggatttccctatgttgcccaggctggccctgaactcctgggctcaaacgatctgcctgccttggcttcccaaaatgctgagattacaggtgtcagccaccactctcaggcaggttttggaggattctggatttcaaatttttgtattagggatgtttaacctgtaaacttcaacgcttggcagtgttgcaagtggtctgcactttatctggatgaagacaaagaatggtgctaacatttgtctatgaacagatgggaaatcttgctgaggaaaggacaatgattctcaagcaaaaggggaaaagggagagagaaaagagagcacctggaactcaagagtatcaagaatgggaggtggcaacaggatgatttgcaaataatatttggctatcattagaacaataaactcttcactatacaaggttgtatggtgtattggaaagagcatgaaatcagagaaacttcattagacttcaagttttgctctatattagctgtgagattttgcctaagacaattgaccattctgattccacagtctttatacatgcaaatgctaaaacagttgtaacagtggagatacattgtgaaaaatgtgtcattgtgcaaacaaaataggatgtacttatgcaaacctagatggtatagcctactacatacttaggccatatagcatagcctattgctctgaccaccatcatatatgcagtctgtcattgacccaaatattgttatgcaatgcatgactgtaataataataatacttgccacataggtaaaaatactgtcattaacggtgtagtaaaatggtaactggcatagtaatgctgtaaattgaatacaatttttagaaggttttgaggagggaggttcagaactgttctccattgatttgcttaacaaagatattttcattttccaccaaagggtttggctgtgaaaacctttgcagaaataatattttaggagttttttccccctgtactgtcaactgatttttagtaagcatatgactttctgtatgtatcatccaattgatttaaaaatgaatcaatgaatgtatttattgatcgcctgcctcgcttcacaaaggaatgtgaggaaggacacccaatttggcattgctgtgtttctctgtatttgggtcatgcattttttcttgctttccacattgaaaatgtggtggatgcagtagattggctttaagtgtcaggccttccctcatttactatacctttttgtgtttcacaagctggaaagctaccaactacatgctctagacatccttgctgctaatattctgcatgtcagattggtctcaccaatggcacgcagcaaagcaagatttgcaggtgctgttttcttgctgctggcaaatgcagccgtggagaccaccgttttttgcagcactgttccagtgtcctgttaattgttctgtcggtgttgagaggaggttggggaccaggcatggcaacttcctgacgccatcttcctgattgtgggcagcagccacaatcagcaatcttatctaggtagtcatccatggatgttcagctcagcccttctccagcctttccaatgatttcgaatgtccccaattccccctaacgaatccctttctgactaggagtaactagctgagtgctgcaatgaaatcctgactgacagatttgtaaactctttgcgggcaggaacccttgatataaataaatgaccttgcattttaatggagggaagcagaaggataaacaaatgaataagtgaaaagttttaataagatggtgatgcgtaaaaaataaagctggttaatggggagtgcaggaaatgagcgcagctgtcttgccgttttaatcagataggtcagagaaggcttctctactagggtggcttttgacctgcctctctgttaggtcaattgtgtgcgaggccctgatggagttactgtgttaaaatgcaatgattcaattactccattacttagataccctttaagtgacactacggttgtccatctccccgctattgaattgtttacccacagtaagcatggcgggaagagcttcgatccgacccttgaacgctcaataaaaatggcgacagcacttcctgtacttgccctcaacaaagatggtgtcaacacttcctgtttagggttttcgccattaacaaagatggtgcttatggggcaggttccctaacagtcaggattccggttgcagtttttctcccccgccccaaagatacgtggttgcagacgtaagtaacaggaatccatctttctttgaaagtcctgcattgtagcgtctgcgacctgggccctgcgggggcttccccgccccgctaacttgctccgcatttccgatccgggccaaggctgggtggctgcggcagtgccggaggcccgctctccccttggtccgctctttagttcattcccagcactccctctttagcgggtcaagttgccgcagaaaccgcccgtagtcttcctgtttgatacaagggtttcagcggccgaagcagagcctttttaaatagttcccaatgggcgctcacggccaaacgtgaacacctcccctcctcacctgtcacctcctgaactttacagggttgcgagggggagtgtgggatcgggtgtcgcctagccgtggtcgtactgcccgggtgtgtctgaagccccatctgtcatccctgcctgccttcccggtcacttaaccttcactgccttacacacaaccaagccacagcacactggtgcaggggtggtggaactgcaccttcaaatcgtgcctggctactgaccagtgctggggtgtgtgctttttttgaaagaaaaaaatcccataaaatgtcccatgcatgtgcggccacgacagtgttgtgctggagattcggaattcttagtgggaaggaatggagtctgtgactgtatattgtgtaaagtttattgtagactgggcacaaacaacaattttcttaaaggtgatcgtgtagaggacttttagcgaaaagagccttaaattctgaacctgctgatttctgtcctgcactcctattactgatcaggttttgcaaatacttgtgatcaaaaaaaggggacctgcgtccaccttggcagtttctgccttggtggtggtggtgcaggtctgatgagggcaatgtgaaaataaaaccaccatttcttctccagcgtgttaaaattagtgctgctctgtaatcttcagataaaaattgcttgttcagaagggtctctgacccactttttttttttctttttccaaatttctttattgaacgaggaattgagctgggaccccattgtgtgaaaagcagaaacagaaaagatgattcatcttcattgttgttcattatgttaggaaacattcaaaattaacctggcttggcttaatcagtgaattaaataccatgacctggcagtctgctatggtttaaagatgtgcttgacctgaaggaacttacattgcagtgacactgtctttagggccacatcaacatgtctgtaatttgagctgtgattttggctctttccagggagaaatggaggccagagacaaacaagtactccgctcacttcgcctggagctgggtgcagaggtattggtggagggactggttcttcagtacctctaccaggaaggaatcttgacggaaaaccatattcaagaaatcaatgctcaaaccacaggcctccggaaaacaatgctcctgctggatatcctaccttccaggggccctaaagcatttgatacattcctagattccctacaggagtttccctgggtcagggagaagctgaagaaggcaagggaagaggccatgaccgacctgcctgcaggtaggcctcagaaagatcactttgaaccagctccaaaatgttgtaactatgctctttgcttttttgtttatttgtttgtttgtttttgagacagagtcttgctctgttgcccaggctggagtgcaatggtgtgatctcggctcactgcaacctctgcttcctgggttcaagcaattcacttgcttcagcctcccgagttgctgggaatacaggcatttgccaccatgccctgctaagttttgtatttttagtagagatggggtttcatcatgttggccaggctggtctcgaactccgtacctcaggtgatccacccacctccgcctcccaaagtgctgggattacagacgtgagccaccacacctagccagaactatgccctttggatttgaagttgggatgtaaggcaggacaagggtcaatggttgatgaaagtgggtaaggatttgggactgaagggacatgacgttggaggaataggatcaggaggtggcattaggaagtgcagggaaggaagaatgaaccgtgactgggaggtgagggagggagctcagagaatgcatttagaaatgcttccaggaaacctggcatgtcacttgggaagcatgttctcatcagagagccaggtcatatctcagccgttggcatcaggagccatttggaaagtgcagatgggaaagcaggcattcggcctactgacaactgatttgtgaggtgccagagctaccagctggaaaaggtcagattcatggaggaggagacagcctctaggaaggcatgccctgcacctgtcccctgggctgtcctgtgtggccaaaggggattattttgaaggctgacttagtttgtttttaaaggttattcgtttaaagtgtcctttttagtttagctttgttcagacactggagtatttaattttgcaaagagcaatagtttggggagggtctcagtttaatttgaaggagaattggaagctggagaagagagaaacagttctggttctgttagcctggcttgtagcaggaagaagatgtgatatggaaacacttgctttttcttaacctcccttgactctgtttcacaaagatagaggggcagagaactgaactggcaaaaattaaaaattgaaaaaaaaaagtaattgaaagttggcttgcaaatttttaacaaagttagagaatcaaggttctctggggtttctgataagagtgatagaactattccggttcagtgggccccagacttcgtggttgctattttttaaatactggttaaaaaaaatgaatactgataataagaccacttttactatttttgctccatggacctcatattttgacatatgtctgaatacctgatcagcatgacatagccagctaactttaggaagacctggtaagatcccagtggaaaaagcaaaagtattttcattcctagtctgggctcgttacagttaaatgtatctttaggctttttgaaatattagacatagctggcttttgaggaccactggaattcactgcttggattgtccttacaaaattaaatactccacatgtctgaacaaaatgtatctagatgtttttatgactttattgaaagcagaatagataacatagagttggagaaatgttaaaaaattattggtgttttcctgatatttgacttagaggtttctgctggcatcatatagttggaaacaacaaaacaggtgaactgaaagcctttcactatcaaaatactgaatttaattttatggtcattttgggtgatacagatcatgctgttgtatgtcattcgtagaggtataataccatttttttttttttgagacggagtttcactcttgttgcccaggctggagtgcaatggcgcgatctcggctctctgcaacctctgcctcccgggtttaagcaattcttctgcctcagcctcccgagtagctgggattacaggcatgtgccaccatgctcggctaattttgtatttttagtagagatggggtttctccatgttggtcaggctggtcttaaactcccgacctcaggtgatccgcccacctcggcctcccaaagtgctgggattacaggcgtgagccaccatgctcggccataaccccattatttcttcagattcattcagagagttagaaagaattaaggcattttttacaaaatgatgagagttacagagaagctgaggaaaaatagctttttaaaaaagcaaacagaatgaagcagtacataatgggaaaaaaattgagcatatctgtgtagaagtttagaaaaataaggtttttctcaagatttgttaattctgtagaaggttggctctggaacaaattcgtacagtcatcttaattgttttactttttactgagtaacactgctattgaaaaaaacattctgaagtgagggtttgatttatatatgtctttgaataccttccacggtgacaatcacataaactcttttaaaaaagacttgtatttattaaatattgactattttaaataatattacaaaatataagtaagatatggagaataatggtacagcgaacacccgtctcctcatcactcagtttaagaaaaataatattacgattgcctttaaaaaccccgggcactccttcccaatcttgtctcattcccaacccccacgcagtgaaaagccctgaattgggggtttatcattcattcacttcttcactttatagtttcctatctcctaaaaatcacttttaaaatcttcatatgtttttgaaaatcctgtataccgtaagttctagaggtgtgtgtgtgtgtatatgtatatatgtatatagagagagatatatatgttttttgtgtgtgtgggaaggaaagggtggaagtaatggaagaaattatgcatttaaacttgatagttaacaccttctcttgtttcagaacttaaaatattttttacatgtttaaagtaatttaattggtggcaatattttaattctaaaattaaattgggatttactgaattggaaacctaggttttgttattttgtaaatcctgggaagagtatcagagttgaaatcccttcaatttaacgtccctataaaaaagaaatccagaacctactgcctaagacctcggtgcttctccagtgttgtaattgagtaattttagtaagatttaaaatagtccacttaaatttttgtaaagatatctttgagttttgaggatctagactataggagaatgtgtgtacacattaacctcttaatgtatgtacacattaaactcttcctaccttttcctcattttgatcatacttattaattaatttgtatggattcagtagtctcttgggaggccttgagaacaaatgggaaggaatggccttcttttttagccaagacgttgatccttctctaagaatgaactgattttatcttattaaggttttcttgtgttggtcttcccagagatgcttggtttcccctttattggtttgttgttttaattttcgttgtttcacttgtaaattttgagctgtctcagaggctttattttggtgattgttcctggttagttgctttttacttatgtgctggatgtaatttgtttagagaattgagctgtatcttgttcttctctactcttctgaacgccacccccatcaaatctcaaaacatacaaaaacaccctaaaccttttgattctctcagaatctgcctctgtgactagtctcccaatctctgttaggaaaaaaaaaaaggtttaagttgttaaagttgttaatggatcattggttttgtgtttttctcaccctgtaaggactcttaccttttaaaagaggaattctggtgataaaatgacttaatccaccttggcaccgtggagagaacacttcatggtttgtctctctggccaaggtcacatactagacattagatcagctggaaatcctctctgggctcctgtcaggtcatttaggagatagggacagtgccgtgtctgggtgaaggcagcctgtgcctgcctgcctggcttctcactgctcatggggcctgtcggcactgacaggctccctccagtgcctgagctaatctggatctggaaaggaggttgatggcagcccagcctccccatctggtgggactcagcgtaaatcacggtgggagtgactcctgggccacaggaccccctccctgttccactgtgttggccctggctgtgggtctgggtgtctgccatgattctctgccttttgccccagtcttcctttaagcttgggagtgtttttgtttttctctcctccgttggtttgattcatgctttatgtattcttagccatggcgagagtgaagaacagagctctgggaacacagctcggtgcctccggcatcagcattggatgtctcaactcttgagcctgttggaatggctgtccctaagctgacacttgcttcaaccttctctgggcttgatcttgtcctccccatagactctgtgccctggactccctggctgctcttacaacagcagtgcgcaggactggctagtccatttcccctctacctgtgggctcaagggctctgcctgccccttgtggcgccagccttgagtgacaacacagaaccacacctgccgccctcctgagatacattctagctctgagttgcatacttggatgcatctaaagtcactgagctcttaatggcagatattttagatattgtgatgggtttattagagaggtttctagcttgggattcttttcataggttcctccaatcataccacgtaattgaccttgctctgcatgtaagttcagtgttggtctcagtgtatctagcttgcagtctatccatgtgcttccactgtgactgagtagtgtttgcctagtggcgtcctgtgtgctagagtgagaacagtgggtcagtatccatagcaagacccttccctcggtaaagggagagtctgcagagggcccaggtttctgtgtatacccagcccgattttcatatacttcctaaggacctactgaatgccaggtactgggtatataaagacaaatggaggatctccagatcagttgagggcattcatgcgttcatccagcaaatatttgctgagtcttgaccatgtgctaaaccagaggtccccagcctttttggcgtcagagactggttttgtggaagacaatttttcaaccaacgggagagttggggggaatgatggtttcgggatgaaactgttccaccttagattattaccaggcattagattctcataaggagtgcgcgacctcgatctctggcatgtgcagttcacaataggttcatgctcctatgagagtctaatgccactgctgatccaataggaggaggagctcaggtggtaatcctcgcttgcctgccacttacctcctgctctgcgatccggttcctaataggccacggaccggtatgggagttggggacccctgtgcaagacagtaggtgctggagatataacagtaaacaaaacaaagcccttattttcatggagttcaatgtattctagtagagggaggggataagggcagggacagataataagcaaatgaataaataacatttggtggtgaagagcgctatgaagagaagcggtatgtgtggtggtgggggtggtcagggaaagcctctctgatgaggggacactgagcagagaactgagtttggctgcagagttgatacagggaggagagctttcagatagaggggaccacaaatacacaggaagtcaagtgggagccacaggtgacaatgtggctaataagacaccttcctccctgggatgaatcacattccacatcagcagaggctcagtggctaccttttgttttgctctcaacatgtgagatgtgtgtgcagccgtgatcttgtgtggctcgtagcatgactttagttgatacgtggatgtgggattaagtaatattgaattacatgatgagaaagttatttcctttctatttctgtttcagttcggtaagaatgataggaggtcctcatgcttaaagccttctgtgggcaacagtatttagctagaatctagttgtattgctttttttgtgtcaacttaatgggttccttccatttatggcaagcaaaacttttctatttacgaagttccttttaaaaatacatgacttttagagactagaattgtggttattagggactgggaagggtatgagggaggcagggatggggaggttggttaatggatacaaaattacagctagatgggtggaataagttctaatgtcctagcactgtagggtgaatatggttaacaggaatttattatgtgttttcaaaatgctagaagagaggattttgaatattcccagcacaaagaaagaataaatgtttgacatgatggatatactgattgcccttatttgatcattacacattgtatgcatgtattgaaatgttaccctgtatcccataaatatatacaatttttatgtatcaaccaaaaataaaaagaaaaatgttcataggaatattgaataggaaataagattgaaagtataccaaattatttaggaaaaaaccattacttacatttaagtagaaatgtgtcaacataaaggagactataaaaaaataggccaggcacagtggctcactcctgtgatcccagcattttgggaggccgaggcgggcagatcacctgaggtcaggagtttgagaccagcctggccaacatggtgaaacccccatctctacttaaaatacaaaaattagccaggcgtggtggcaggcgcctggaatcccagctacttgggaggctgaggcaggagaatcgcttgaacctggcaggtggaggttgtagtgagctgagatcgcgccattgcactccagcctgggggacaagagcgaaacttcgtctaaaaaacaaaaccaacggaaataatggttgggtgtagtggctcatgcctgtaatccctacactttgggaggctgaggcgggtgaatcacttgaggtcaggagtttgagaccagcctggccaacatggtgaaaccccatttttactaaaaatacaaaaaattaaccgggtgtggtggcaggcacctgtaatcctagctagtcaggaggctgaggcaggagaattgcttgaactcaggaggtggaggttgcagtgagccgagattgtgccactgcactccagcctgggcaacagagtgagactccatcccccccaaaaaaaaaaaaaaaaaaaaagaaaagaaaataataatggtgtgaggatgtggccaaaagttgcttttcatcatatatttttttaatttaaaaagaaagacaggcatttgggggaggagccatcacctggctggcatagttaaagcaggaaggctccagttctagtatagatagtagatagagctgttttcatgatgcttcacagttttgctctttcaatttatgcccagtgataggaattagttaaattaactagaatttcaaaattcgtaagttctctaaattttaaacacatttacttgctagtgaaacaaagtcagcaagatggagccatatcctggtattatgaattttagaactgggtgggactcacaggtcatctaatttttctctgagaaaacagaggcctagggagattaagtcaacttgcccatgatcacacagctagttaatgtaatttattactgggactagaatccaggctttgcaactcttgatttaggactttttctgctgcgcaatcttggcttcccactgagtttgaaatggaattgtattatgctgcagtgttaataattgaaagaggctttttaaaaattgtactaatgcatttttttttttttcattttaagaggagaatttccaagggcctttagaggtatgctggaatgagatttcactaaaatattttatttttatgaatgctaattttaatcatttaaaaggaaatgatgatcgttcagtactgcattttgtcacaagatttttttcttcctacctctgcaaggctgacataaaggaaaagcggaagactttcatcgagtatttatgggactgatgaaataatgcatctgttggcagctaattgcaggtctttctaggaatagcaaacatgtgacaggtcttgccccagcggagatgcctccatttcactttaaaacatggatttggtattcttttcacttagaaattctggctatgcctttttttctcccttctgtggatgtatagaccgttcggctgcatcagacactgtattgaacatcagggttgatttaactcattgttgctcagctgtggctatgctttggaatcacctggggagcttttacaaaactactgatgcccaggctctactccaggtgaatccattacacaatctctggagggtgggttctgggcaatgggatgttaaaggcacacacgggcatgcccatgtgtaagtcaggcacacgtacaaatgcttcgtgaggtcatcttaaattgcagccggggttgagaaccttgagctctgaccagctggttaggagcgtgcctccttcctcactcactgcttccaagtcgtggcttcccaaagctgtgtacttgcttgaagcattgttcttattttcaggtagcaccagatggaagggtggtaggaatcagggtgtagagggatattagtttgcaaatccttttattccttgaatttcctgagcattgttgctcaagaatgttccagaatctcagaccccatacagggggtgatgctgctaccaacattaaaatccattagggctctatggggatatataggctacacacatgaggcaacaattggaggagtttgaattgctagtgaatttgaatttgggaattatttttattgctattcacattgtttggtacagtcattacaaactacatgcagtaccttgtgctctgtagatcaggttatgtccaaatggagacagagtctcctgctgaagaacgagttggatgctcctctcagttaaaaagtgagctgaagatggctcgaggatggaagagagaaggagagacaaatggctagttgggaagagtgggactggcttagtctgtcagactggctgtctgtctgctcatggtctttattcataattaaaaatgaatttcaggccaggtgcattggctcacgcctgttaattccaacagtttgggagaccaaggtgggaggatcacatgaggtcaggagttcaagaccagcctgggcaacatggcaaaaccccgtttctactaaaaatacaaaaagtagctgggcatggtggcacacacctgtcatcccagcttcttgggtggctgaggcacaagaatcacttgaacccaggaggcagaggttgcaatgagtcgagagcacactccatcctgggtgacagagtgagaccctgtctcaaaaaaaaaaaaaaaagcaaaagcagtcttttgtgtctcacaaagaacttcagataacatcagtaaaataatcataatagctagtggggacttactgtctgccagctatattctaagtcctttgtgtttattaattcatttaatcctgacaataacttgatgagggaggtggtattattacccttttgaacagatgcgaaaatgtaagcacagagatagatgttaaataacttacttaaagtcacacaacataaagtcaaatttcacttcaaggcctactgattcatatcttataaaaccactttctcggcattcagttttctcctcttcctaattctgataacctgtggctgctccagagcccatcaccctaattcttcttcagaaactcccctacttccagtttcttccagacacacagcctcaggaggctttctctttcttgcctcttgtcctaaggctgattcctggttggtatctctctcgtatctctcattttatacttttttggttgggggaaggctagggtctaatggaagaccatacggtggggaggggtcatggaacagagcccctgaatctctcccatttcaacttgctactttgagagtaaaaaaaagactaaatctccttggctgtgatcaggagatagtgtgttggctcccctgatactggaatccagtcccacttttgcagctcttaaatcttgctatctaaagccctcagttccaataaccagcttttctggtggtgcagcttcagagtttcaccaaatgcttagcaaggtagtgttctctttttatgggtgtagttcaaacttgtaggctgctgttatagctagctgtgggaatgtttgctttacataatgttaataggcagctgtgtttatgcttgttcctcagtttaagcagtaaggagtgtatacatatgattctttgagggcatttcccccagactaaaaaaaagaaaaaaaggtatgttgtgttttttccaacagtaaattttaattgaaaaggaatgtagtttctagaagaagtttggggcaggttttactcctaggctttattttgttaatgttatgaaagaaactttaactccttctaagaagtgccaagttgacaattcctggaaatgttcatgttctatttatgctcagcaccatagcagacagggtggcaataccattaccaaaataataccgccgagatgtactaagtgacaaatgagaggcttctggttttataacctaaatacaagactttaaaagcatctcccaattctaccatttgttgataaggtctgtgggtgctgagtagtaatggtgaagttgctgtggagaattatagatcaagtagagcgtatctgcagtgacttgtcctgttgctagaactatagaaggttagagttggaagggatcttagaaacactttatagatgaggaaacgaagggatatccaagtctaacagcatgcatatgggttcttctgttcaaatagtagaacttcatgtaacataaaaataggaatttctctgaaatatattgggtagttcacaactttgaaggaatgataaaggtttcagggcttaataagggcaggaatgaggcaacagtgggggatctcaggccatcagatggtcatcttcaatcaagtttctacactgtaccttccttccagattcagactattggccaaacttgggtcctgagcccttcctctaggacaccagaatcacctgaagtggggaaaggaagttccaaaagaaagagtgaaagctgattgaagcaagagttgtctactgtgccatccttcttctttttggattgaataggtctcacgcccatgggcctggaaaacaaatgatagccctttaagggaggaggttgctttacctcttcttcatacagcaaggcccaggttgagggccaaaggtggtagataaaacgctggagagcagttttggagcagcataggtctccttaaacttttccaaaatcagaatgtattgggggagaaaaatggattgagaatgtagatgtaaagaggaggtttagaaagagaatttgaattgggtactggcctaagggctttagatatataaactcactttattatcataatagccctttgaggtaggcactactgttatcatttgcatttcacagatgaggagactaaggtgttagataaattgctcaaggtcacacagtttggcagtagcagagctgaggttcaaacactgacagtctggctcacagtctgtgcttctaatcactagggtcctgtctctatcggtctactaccagttcttagatctgattggagtcacatggcttagatgacctgacctgggctagctgcagcttctttattttctgacccttgcttgcctcaggtctcacacatagccggcattttcattatgtgtatgtcagtctcttttttaacagttaccaaattttaaaaaatacaaaagaaaatgaaagatgttttctaagaaatatgattaggtaaaataaaggttttgaatgtgattgatgtggacatttttgttcatttagtttttaaacatatctcttccctttcaatctctttattattaattagttatgtgctacgggcaaatgtgacttttcaggcctttcatatttgtttgagcccttttattccatcatgtgccagtcacaattcattcaggagacagaaaccacacagtaatttaaatagggaaaacttaatataaagaattttcttttgttttctttttttttttttttgagacagagttttactctcgtcgcccaggctggggtgcaatggcgcgatcctggctcactgcaacctccgcctcccgggttcaagcaattctcctgcctcagccttccgagtagctgggattacaggtgcccgccaccatgcctggctaatttttgtattgttagtagagacagggtttcaccatgttggccaggctggtctcgaactcctgacctcaggtgatctgcccgccttggcctcccaaagtgctgggattacaggcatgagccaccgtgcctggccaatataaagaatttttaactggtgaaaagcaaaccatggttaaccactaaatggggtaaaagaggtctctaagtaatacaggaatggcagaagctactttttctgaggttgaaaggtagtgcaggatacagtcactaagaatgtggaagagggccctccccacctctaaggctgagattcagacttcggtggagttgaagtgactgtcacactagctggtctgtaagagcagcctacctggtagctaacttcaagaaaatccagagaaataattgcatgaagtcagaaaagtaataaatgaccaaaatgagaaattttgaaattatttaaaaaaatcaaatagaaattctggagctgaattaggaaaaataactaatgcatgtgggcttaatacctaggtgatgggttgataggtgcagcaaaccatcatggcacacatttacctatgtaacaaacctgtatatcctgcacatgtagtccaggacttaaagtaaaaattaaaattaaattctggagccgaaataaaaattaatggactgaaaaatgcaatagagagtatcaacagcagaattaatcaagcagaagaaagaatctgtaaacttgaagacattatttaaaattacagttggaggagaaaaagaatgaaaaggaatgaagaaagctcatgggatttatgagacagcatcaaaagaacaaacatttgaataataggagttaaggcagaggaagagagataaagtggtagaaagctgttttaaagaaatattagcagaaaactttccaaatctggggaaagatataatatccaggtacaggaaggtcaaagtctctaattagattcaatccaaacaagactacactaagccttattataattaaactgtcaaaaaacaaagacaaagagaagaccctgacagcagcaagagaaaagaagcaaataacatataagacaatttcaataagcctagtagtacatttctcagcagaaactttataggccaggagagagtaggatgatatgttcaaaatgttgatggaaaaaaaaaattgctaacaatgaatagtgtagccggcaaaaccgttctttagaagtgaaggagagaatgatactttcccagataaagctgagaaagtttatcaccaccacacctgtttttacaagaaaggctagtggagtcttcaagtggaaagaaatggaaggttaataataacatggaaacgtacgaaagtataaaacttacatagtcaaatttggaatctccaatactgtaatggttgtatgtaaatcatttacatctttagtttgaaggttaaaagatgaaactattaaaatggatataacaacttataaagtatatacaaaacaaaaagacataaattgtgccatcaaaaactaaaatatgggggtgatggtggagtaaagtgtagaatttttgtatgtgatcaaaattgagttgttatcagcttaaaataactggctgtttataaaatgtttttgtaagcttcatggtaaccataaaacaaaaacctatggtatatacacaaaaaataaaaggtaagggaccaaaggatatcactagagaaaattacctaatcacactggaagacagccagaggaaggaaagaacaaagcatctacaaagcaaccaggaaacagttaacgaaatggcagaagcaagaccttatcattaattaccttgaatgtaaatggattaaattctccagttaaaagacagggtgtctgaatgggttttataaaaagcacaagacccaactatatgccatccacaaaagattcacttcctttttaagaacacatatagagtgaaaattaacgggtagaaaaatattttccatgcaaatggaaaccaaaagagagtaggagtggctatacttatgtcagaccaagtagattttaagtcaaaaattgtcaaaagagacaaagagggtcattatgtaataataagggggtcaattcattaagaaggtataatagccataaatatatatgcaccaatcactggagcacctaaatatataaatcaaatattaatagatctgaagggggagacagactagaatatagtaatagtagagaactttaataccccactttcagtaatggacaggttacccagataaaaaaagtaataaagaaacagtggatttagactacactttagaccaaatggacctaacagacatttacagaacattccatccaatggtatcaagaatacatattttgattagcttagtaatgtataaggatattgagtcagtaatacaaattctcccattaatgaaaagcccagaacctgatggcttcattgctgaattctgccaaacattcaaagaacaaataccaatctttctcaaactcttctacaaaattgaagaagaggaaatacttccaagcttattttgtaaggccagaatttactttgatatcaaagctagataaggatacaagaatagaaaattacagaccaatattctattcttgatcaacataggtgcaaaaattgtcaacaaaatactagcaaactgaatttaacagcacagtaaaagaatcattcactgtgatcaaaggatgcaaggatggtttaacatacacaaatcaataaatatgacataccacattaacagaatgaaggacaaaaactatatgatcatctcaatagttgcagaaaaagctttcgacaaatgtcaacatcccttcattataaaatctctcaacaaattaggtatagaaggaatatacttcaacacaaaaaaggttatatgggacagactcgtagctaacttcatactcaacagtggaaaactgaaagctttttcttttaagatcaggaacaagagaaggatgcccactctcaccactcttactcaacataatactggaggttctagccagaataattaggcaagataaagaaataaaaggtatctagattagaaagaaagaagttaaattatccctgtttgcaggtgacatgatcttaaatataggaaaccctaaagactctaccaaaaaactattagaactaataaatttagtaaagttgcagtatacaaaattaacataaaaatcagtagtgtttctgtacacaaacagcaaactatttgaaaaagagatcaaggaaacaatcccattttcaatagctaccaaaagaaaaatacttaggaatacttaaccaaggatgtgaaaaacctgtataatgaaaactgttaaaacattgatgaaagaaactgaagaagacacaaataaatgggaggaaacctcatgttcatggattgaaagaattaatactgttaaaatgtccatactacccaaagtgatttatagattcagtgcaatcactatcaaaattctagtgacatattttatagaaatagaaaaaacaattctgaaatttatatggaaccacaaaagaccctgaattgccaaagcagtcttgagcaaagaagaacagaactggaggcatcatactaccttctctgacttcaaaatgtgctacaaagctatactagtcagaacagcatggtgttggcataaaaacagacacatagaccaatggaacagaatagatagtccagaaatgaattcacacatttatggtcagttgattttcaacaaaggtgccaataagacacactggagaaaggacagtcttttcaataaatggtgttggaacaactggatatgcagaagaatttagaccctcatctcacaccatgtataaaaataaactcaaaatggattaaagacttaaacataagaccaaaattatgaaactactagaagaaaacctaggggaaatgctctatgacattggtctgggcaatggattttttggatatgaccccaaaagcacaagcaacaaatacaatagacaaatgggataaacaaaagcttctgcacaggaaacaacagagtaaagaagtaacctatggaatgggagaaattatttgcaaaccatatatatgataaggaattaatgtccaaaatacaccaggaactgtaaaaactcaatagcaagaaaacaacccaattaaaaaatgggcggccagcgcagtggttcatgcgtgtaatcccagcactttgggaggccgaggtgggtggcttgtctgaggtcaagagttcaagagcagcctggccaacatggtgaaaccctgtctctactaataatacaaaaattagtggtggcactcgcctgtattcccagctacttgggaggctgaggcaggagaatcacttgaaaccaggaggcggaagttgcagtgagccaagattgagattgtgccactgcactccagccttggtaacaagagcaaaactccgtctcaaaataaataaataaatgggcaaaggatgggaacagacatttctcaaaagacatacaaatggccaacaggtatatgaaaaaatgatcaacatcgcaaatcaccagggaaatggaaattaaaattataatgagatataacctcatacctattagaattctaggtgcttattaaaaatatgaaaggtaacaagtactggcatggatgtggagaaagtggaacctttgcatacttggtgagaatgtgaatcagtatagtcattatggaaaacagtatggaggttcctcaaaaaatttaaaatagaactctgtgtcttagcaatcccactactgggtatatatccagaagaagtggagtcagtatatcaaagagatagctacactttcatgttcactgcagcattatttacaatagccaagatacagaatcaacctgagtgtccatcaacagatgaatggataaagaaaatatagcatatatacataatgaaatactattcagtttttaaaaagaaataccgtcatttgtgacaacatggatgaacctaggtgatattatgcaaagtgaagtgaaacaaggcacaaaaggacagataccatataatctcacttatatgtagaatctaaaaaagttgaactcatggaagcagagagtagaatggtagataccagaggctggaggagatgtgattggggagatgttggtcacagaatgcaaaggttagttagacaggagaaataagttcaagagatctattgtgcaacatgatgactatagataattaacaacctacagttggccctttgtatctatggattcaaccaaccacaaatagaaaatatttgaaaaaaaaaaccacaataaaaaataacaattcagcaataaaaaagaatacaagtgaaaatatagtaggacaaccatttacatagcacttaccttgtattaggtattataagtaatctagagattatttaaaatatatgggaggatgtatgcaggttatatggaaatattattatcattttatatcagggacttgagcatccatggattttggtatcttgggtggtagtgggggcctgtagtccccctgcagatactgacaaatgactgtagactgtattgcattcttgaaaatcacctgagtaaatctgacatgttttcttcacaaaaagtgataagtgtatgagataatgcatattttaatcatctctatttagccatcctgcaatgaccatcctgctatggtcccaatgtctcccagaattcaacttaatccccattgtggtggtattaaggggtggtaatagggggtggtattaaggggtgaagtaattaagtcataggggctttaccctcatgaatagattagtgcctgactaaagggctggagggaactcgcttaggctcttgttgccctttggcattctgctgcgggaggacacagtgttaacctcttctgccacgtgaagatgcagcaagactgccctcaccagacaccaaatgcttgatcttgcacctttatcttggacttccagcctccagaactgtgagaagtaaatttctattgtttataaattacccaatctgtgatattttgttatagcagcaaaaatggactgccagttttcgtatttcaaaacatcatgttatacacgataaacgtgtacaatttttatttgtcagttaaaataataagttaaataagttaatttaaaaaagagatagccagtgtttataataaatgaatcatcttaacatttgagtttttgctgtaggggaggaaaaatctcttttcctcattcattctaggttcatgactgaggcccttataccaaaggacagataaacaagagcaagcatagaaatttatttaatataaattttacatgacacaggaacttttataagggagtgaagacccaaagagatggttaaacttgtgtatttttatgctaggtttgatggcatgtggatggttgtggggaaatgggattggaaaaagaatatgagctctaatgataatgaactagggtaaactttgctagggctaggtgttcctgttctctctgtgatctgcatcttccgaaataaggatgctcctttcctctggggatagggaaggcattgcacatgagagtcaccttacctgtttcaggggaaggtcagaaaatcctttctagggtttacaacctgctttaagggagaatcgggagaattgtgggagctgaggggaggtcagagtgacctgcctgcttatgctgtcttctcagattccaagtgccatatcttgggccagtgtgtcttgaatcccatcattactgttggaaattccgtttcagaagcccactctttgctaaactccagttacttctagaactggacactgctgctgaaatctggaatttcttatgtgatgccaaaaaaaggagaaaatttagaagattacgagtatgtgtgtgtttaacaaagtatatatacttttttcttcagagagtaaaacctctgaatcaacttgaagtagtcttttcaaattgttatcaaggcatgctgctatttcaactattagagagatagcaccggacttaaaagaccttctctaaatgactcttcaggaactaggaagagcatttttcactctgctgtttaaagtattttgtttgtctttctatgagtatactgtttcaaagtgtttcactagattataacctgatttttttcagtgtcttctgtttgtatgcttttaagtttctaaatcttttctcttcattgtttttccccaaattgttggactctgagtaagcttctgccagtgtcattttaaaatatatttatatccttcagatgctaaaaatagtttgtgcacttttaaatggttgaaaaagaaaagaagattacatgatgtttgaaaatcacatgaaatgcaaatttcagtgtctataaataaagttttattggaacacagccatgcttatttgttaacacgttgtctctggctgctttcacaatacaccagcagggcagagtcaggtagctgcaacagagaccttatggtccacaaaacctaaaatgtttactatctggccctttacagaaaaagcctaccacccctggtatagagtgagaaaggccagaaaccagaaaaaaaacctgtggcttttcccaaaaaagctttggtttttttcttatgaccggaatcagctttatttgcctttctttacttggtgcctaactgagtgctggattaaagcaaatgcttagttctaaaattgttttgagagtcaaaactggggaggcctttcttcagggtaaacttttcctatgaatatatatcattatctttgccattttttgagttagattttgccagaagagatttgtcataccagggccattgaagcttttctttcatttctaaaattgtacataagagaaaaagaattagataaaccaaacagataaaacccttttgtgctctgcacattcacacgaggatttagtttcagcttatcctgtgtatttactcatggtttagtctcaagatttttaagtattggcatgatgagataatgttagcatttgaatactaaccacagaaagcattaagcaaggtctgcagtcatgaagcatttgccttttgttcccatccattaggtatttaatgtattttttacatccccccaccttgtctttgttttcacctcctttgaaggaaatcttttgtcattgagactcaaacgttctgatgagtaatgctacgccagggtatgaatttcttcccattccctgagatagccattgtactattaatatttctgtctgttgtttagaagtgtagcctgtattaggttctcaatcccctaaggaatataacattttaagtgctcgtagagtgctgtgggctctaaaaggtatcaaaagcattccatcagaaatagaagctagagagcccttgtccttcaaggagtttgaagtctgtatggtaagagaggggtaacatgcatacgaattctgaacatgtactagcagcctacaaagtgaatggaatttcagcagagcatgcagcatgaaggagcgatctcagcggggaagggaataaagtagggagtgcttcgaaggtgaatctgggttttatggaaggtagagtcattggttccaggggaagaagccagtccagatggaggagacgccaagtacttccctgacatctcaggatgccttgctagaacattaaacccagcatgttgcagatggaatgagtttttctcactaaatctaggtcctgctcctgccctcagtatttccgtcaatgtcatggttttctgagttatgcacctgccacttactttaggcttttattgcttctccaaactactttgtaactggtttgcctgtacagagaagctgccagatttgtcttccaaagctttcttcctatcactgtgacccctgcacaccattccagcatccattgtgccattctctggagagctgctcttctgcatactagccaaatttgtcttccttcagtaattttttttttcttttgagatggagtctggctctgtcacccaggctggagtgcagtggcttgatctctgctcagtacaagctctgcctcctgggttcacgccattctcctgcctcagcctcccgagtagctggaacgacaggcgcccaccaccatgcccggctaattttttgtatttttagtagagacggggtttcaccttgttagccaggctggtctcgatctcctgacctcgtgatctgcccgccttggtctcccaaagtgcttggattacaggtgtgagccaccgcatccggtccagtttgttttttaatgtgctgtgctgttgggttttgtttgtttgatttttgttttgcctgagtgtctttgcctatagtgtgaatgtttttacttctctctttgccacgttaactccagttcctcctttgggctttagcttaggtgttttttcaggaagccttcccataccttctatgttggattaagtcctctctcatgcgcttctgagcatcttgcacctcctatttggtgtgcttctctataataggttgtaacttccagagggcagggacctagtgctattggacaaatggcaagtgctcaaataaaagatgttgtttttttcttaaaatatatttaaattttcctcattgtctacaaaattaatttcagacatttttaaattcatttcagaccttctgtaatatggcccgaccttatctatattaattattgaattagatttggcaacatttaacagaaaacccaaatgacagtgattttaacaagatggaaggtttatttttcccttctcctcctcttcctcctgtttctcctccatatccttctctctctctctctgtgacacacacacacacacacacacacacacacacacacaatctgtaagtagtctccagggctgtgggctggtgtgactgctccacagttaccagaggccaaggcttcttctctctttatgctttgccatccttggcacgtgatttccactctcaagattccctcatggtcctaactggctgctggagccccaggccatcttgtcccttgtgggaatagtgctagcagagtagaagggagactcagagagaggaagacaaaaaggaagctaacatgaaaaagacattttcgtcaaatgctagttctttgaacttctgggaagaaaagagtttctaggagaccacaactttttactgctttgaagattccaaattcctgagaatatgattcagttagtgagtaacattctctatgctggcaaaggaggaaattacctggatctggacctatctttggaggatgagagaggagctgttatctctcccccactgatacaatgatgttgtaatgtcttttcagtaggcatttgcctgagctcttttttttggactataatttccccccaccccactttctctaatctctgcttctcaaaatcttatctattcttcagagcctaattcctttcttttcccagaagcttttccacattctcctcatctgggatttttttttttctttgaacctccacagatttttgtgatgatctttctccatgttttaacatagataccggtaaacttatctaacgcttccctagctccctctcaccatcgaatgccatccccttgagttaagtcagggactatgccttgttcacatctgctgcagccatcacagaacctttaaaaaagtaggttcttaaatcttaaatgagtgcatgctgtgagggaaggaaagcaaatagactttttggctcaaataaagaattgatgtgtttagaagacaggtaaagagaaaagggacgagttgttggatgatcttgatatctaggctttgaatctgggcttggcagggtaggtgcatgagccctgaatataagggagctggcctagggagagaaaaaaaaccatcacttcaactcctgtcttccagggtgttgacatcattaactgccccacatccaccagatttccccagatcttagttgacatagagacattcattctgtttctcaccttaagaaaatccatcctgagttagcttcagttggtgctgctgctaggctttatggtgataggctttgggaggaactgagaatcccaaatgctaggtggtatctgaatgtggcattacgagatataatgctctaaactctgcaatttctcttgtaagacggaaacaattcaacctgttctttgactccttttctgggttttcttggctccaggcttcttagaacactgatcacactgttccaccacccccaatctttacctccattctctctaccctcccagcccccaccaaaacacaattcttttcaggcaagtgcaccatacaggtgctctggtggtcccgtaactgaggatgtagttgccagccttttagcaatatcaagagttctctggaggctcttgagagctgtggccttggttaaattggacagaatcacctttttggtaaattcccttccgattcatttcacaaatggcttaaatcatttatgttgttttgttcaatccagtcaggaaatgaaagcattgccattttaattgttttagaacagcattttacacctaatatagactcccaaagccagccaaatgcagattttggctcctagatcgctgactgcatgctgactgtgttcttgagtgtggaagaaaacagatccagccaaagactgattaccttccaaaggtcacaaaagaagtttctctttatctaagaaagaaagtaggtgccattaggtgttgattttttttaaaaagtccttttaatttaaacaatatttgaataaaaattatggtatagtcaaccacaaatcagttgatgaagtctcaaattttggcagtctcccttggttctgtgttcttgggcaagtttactttctttttctttttcttttttttttttttttgagacagggtctggttctgttgcccaggcttgagtgcagcagcgtgatcttggctcactgcaacctctgcctcaagcattgctcaagcaaccctcccacttcaacctcccagttagctgggactacaggcgcatgccaccacacctggctaatttttgtatttttttgtagagacgaggttttaccatgttgtccaggctggtgtagaacttctgagctcaagcgatctgcccacctcagcctcccaaagtgctgggattacaggcaggaaccaccatacccagcctctttttttaaaaaataattttttactttgaaataatttaagacaagaagttgcaaaaatagtactgagagatcccaggtacctttcactcagcttcccccaatgataatatcttacatgatcatagcacattgttaaaagcaggaaattgacattggtgcaatactagtaattcaagaacagaccttattggaataggttttacatgcaatctgtttttagtgtgtgtagttctgtgaaattttattacctttgtagattcatacatgcttttgatttttaatgctcacttaccgtcaaattatttggagcctttcttttttttttttttttttttttgtagagatgggggttccaccatgttacccaggctggtcttgaactcctgagctcaagggatctgcctgccttggcctcccaaagtgctggaattacaggtgtgagccaccacacctggcctatttggagcctttgtgtgaataattaataatagcaaaactggaaattatttaatctggaaatctcaatttaatactcttaacaaaaagactactggattagaaagtagaaagtcaggttctaattccagctcttcaactaggcagttaaacttctttggttaagtcatttacatatttggtacatcatgtactcatctctgaaatgagtgagctaaatgaaacaaatcttgatttccactttcccttctctaaacatccttctgtgtactgtattttaaaaggcaccatctgtattttaccacattgttctagccaaaaacttaggcatcatccttgtttccttctttgctgtacctaccctctttccttctgtatattccattagcaagtcttctacaacattccccaaatctgtctacttgagtccatcccttgcctggattactgcagtagcctccacatgtactttcccgtaaaacgttttccacatggcaatcagagccatcttttaaaaatagaaatcagactttgttattcctctgcttaaaacctcctcctaggactttacattgcactgagaatcagagctcctcaccagggcccaaaagggacaccgtgacctggggactcctgctggcttcttcagtcacatctaccattccctgccttctccctgtagcccagcacaggcctcctctgtcactccagtcggccaagtcagtgcccacctcgaggcctttgttccagcctagccgttctctgtgcctggtgtgccctgctcccagttttgctctaataagtggctccctctggtaatttaggtgtcaggcctccttgatgaggcctgcctgatcaaattagccacctcccaagtcactttctgcaacattatcctgttttgtttcttgcacagcatttaacactatctggaattatcctccgcacttgattggacttgttacttgacaagcgaatttcccttctctagactgtaagctctttcagaagtagggcagctttaactgcctggtttatcctgcatccccagaccccaggacagtgcctgtcccatcaataattatgtgttgagcagatgcatttatggaccagatcatcacagaggattttgaaattgaaaaaattacttaattaaatgaaatgtttaaaattaattttttgggattctgaagggaacttttatgattaaatttctgtgtactacaggttgcctattgtgtagtcatgttttagtaaaagttcttttcctgaggcaggaccatttcagatgggaaagataagttttctgtgctctagggacagtctcctgtctgccttgaacacattagacagatgaccttaatgatcggaagagatgcattggaaatacattcctttccctcatcagcagtgcttttgcattagcattgagcagggtttgactttcttggtgatacagaaggtgcaagaagcttagtatcatgtggtttgacatttaatcagacttgctttccttgttaacctaaaggccttcctcttctttggaatttaatgtgtcagtaatggctcctagagctggaacagatggagctgttgatgttctcacttaaacgaaaaaaaacatgatttatatcctcagcttcatttcttaaattcttgttgaactttcatttgattgtcagagccacataaccagaatgtcactaaatttgctttcgcggcattaccatctacttttgctttttaagcagttttggaaatgtgatgtagtataggaacatgagtacatgtttttaaacatgtattattcggagttaatgattcactgctgctgaaggagtagtttctgtgtgaaggcaatggttatttttttcattaaatattctcatcagaagttaatatgtttttcttctcttattctggacttgtcttataaaaaatacatgtactcgtatagctgccaatgagacaagtgttgacattttggtttcttttgttatggttttattgttgttattgctaatgaatgatttttgaagcaaatatgtactttcaagcaaatatgtgcaaatatgaagttggaagatgatattttctcttaaaagcattttaccattttcacattgccatgcccttagctttcagggtgttttcttgagtcattattttcttttgttgattctttaaaatgtaccaatggtgagtgtgaattcatagtatgaaaaatgtgggtgatagactatgattagacatagttcaagataatagtttatatgaaaaattgatgctctaaagcatttgctaccaaaatttgtttttttgtgtgtgtgttacctttactcttctccctgggtccacttaatggttctgtatttttttggagagccaaatatgtcttgaaggtagtcggggagagggaggaggagcaacatgaaatgagtgtgctgttttatcagaagccacttattcacagggcctgaagtgatagctgttgggagaagtgatattcatactgatgggggtaaaactgcctactcattttggggagcttttgttttcataataaaaattgtttgtacaaataaaggatgttctaaaggagaggactatttgcaattgagtgttttctattctggcagcatccgattgaaaatcatttcagaaattcttagtattgcatgcaatcattgtttagtagctagatctttttaactttatgatagaattgtgcatttcatttctgttttaagtcctatccatgtatttaagtagtgtaataaattattttcttgccagcagggtgacttgagtgaaaaaatatgtataatttggccaatagcctaattctgtgacctctacaatccaaatggatgccgtggcttttactttggttacatttcaaatgactttaattggcctgaaattctattagtatgattgattcaggatacccattcaaagtcatctcatttgtctgtgtcatttgtcatggatcaaatctctgggcaaagcagtcattgaaccttggttaaacctcagactgtgtccgtctgtcaattttataaatgattgggaggaaggcactcttgtgagttctggatcagtagtgatataattctgtttctgttttttgcttttttaaatctactgctacataataaaccactccaaaacttggtgccttaaaataaccattttaccttggtcatgattttgtgggttaggaattaagaaagggctcagctgggcagtttgtctctgatccacatggtgtcagctgaggaatctggggataggggatccacttttgagatctcagactcagatgtctggtgccttgactggggtgcgtggctctgggcagggggcttagctggggcccagcatgtggtctctccatgtggcttaggtttctttcagcatgggagctgggtttcccaaaatgtgaggatggaagcttcaaggctgaaggtttctcaggatgtagactcataagtcccagaacaccagttctcctgcttattggtcaagtaagtcactaaattcaacccagacttggggtcaggagggggtcagggaggggagtagcattatccttcacttttcattgggagaagaaacaaaggatttgaggccatcattaatggctagtgatgagatcacatcagaatagcatttatttaatagcaatttattactctcctgaggttcaggtggcttaaagtgcaaatattagtaggtagttccatgtaagggaatcccattccaagtggcacagccttcatttagacaaaactctgatgtaattcattctagtcatttgatggatggagactctaaaagtggcatgaatataatctcaaaatatctagaaagatgtcagtcctctgagtcattgtgcaaactagtttgttgagagagttcaaaggcatcatggatcttaacagctagaaaagattctaagagattacatcatcattatcaccttctggaaagatttattgagcatctgttaggtgccaggccctgggaatacagaagagaatatgactgattcttgccgttgagacatagttgaggacatagaattgatacacaagagatgaatagaaatccatggaatatagactaactggtaaataaaagtacaggtgataagagcacaagaaggagaagtaatcaatagaggcttagctaggggctgggaaaggctgtagggactttccgtcactccgaaaacatgaagtccaaagtggtggccattacctacaagtccctttgagatctggatccctgtatcctctctgatcccctttgctacctctcttttcctcactcactggccttcttccatggaagtataggcatttgaggatctttgccacttgctcattcctctgcctggaatgctctttttccagatattcccatagtttgctttctcacttccatcagatctctggtcaactgtgctctccaccagccttctctgaccactctatctacttcctgttcatcaacacatttatctccatgaagccagggcattgtctgccttattaattattgtatcctgagcacctagagtagtgcctggcatcattggtgcccaacaaaatatggttgaatgtatgaatgagtaaatgaatgcagaatcttgaaacagggtgtgctttttgggctgatagaacaaagtagtgtaaactgggtagcttataaacaatagaaatttaattcccacagttctagaagctgggaagtccaagatcaaggcaccagcagattaggtgtctggtgagggcccatttcctggttcatagacggtaccttgttgtgtcttcacatggtaggagggtcaagatagctctctcgggcttcttttatatgggtaccaatcttgttcatgaaggctctgccaaaggtaagatttagcaaagtggagaatagatgatattgctggatgcctgcaaggcagagtgaaagagaagcagaaagttacataatatattcatagatcatgtgcatcagctctctgacaccaggggtccttattttacaactctgagtcctgcaaaccattttgcgaatatgtaagcattgtaatagggcttgcacaggaagtgatttatttttttctttatttttaacttttattataggtttggcaatacatatgaaggtttgttaggtaggtaaacatgtgtcacagaggtttgttgtacagattatttcatcacccaggtattaagcccagtacccagtagttatcttttctgctcctctccctcttcctaccctctcccctcaagtagacccgagtatctattgtttccttctttgtattcatatgttcttaccattcagctcccactaaaaagtgagaacatgcagtatttggttttctgttcctgagttagtctgctaagggtaattagccttcagctctatccatattcccacaaaagacatgatcttattcttttttatggctgtgtagtattccatggtgcatatgtaccacattttttaaatccagtttgtcattgatgggcgtttaagttgattccatgtctttgctgttgtgaatagtgcttcggtgaacattcatgtgtgtgtgtctttatggttggatgatttatattcgtctggctatatacccagtaatgggattgctgggtcgaatggtagttctgcttttaggtctttgagccatagtactttccacaagtggttcattttaactagaatagctggttcatgactggtggcagttattggagaacttgcctttcttgaaaaatattctgtactataccatttctttgtcttttctcctgctcatatttctgtctggaatatccagctttttgtattgacctgttgaaattccacatgaatgttccaaaatatagtgacttaaaaccacagtttattatttctcacaatttggtgtgttggctgggttcagctgagtggttttctgttccatgtggtggtgtctgctagcatcactaatacagcagatgttttcagtttcagaacttggctggactagaatgcccaagaaagctttactctcatgtttcctgttggctgtgcactagagttccttagttttcctccataatatctcatttcccctggtatctagaccagccaccttacagcatggtggctgggttccaagtgtgagaataaggaagcttttacttcattttccttttccttttttttttttttttttgagacggagtcttgctctgttgcccaggctggagtgcagtggcacaatcttggctcactgcaacctctgcctcctgggttcaagcgattctccttcctcagcctccctagtagctgagattacaggtgcacaccaccacactggctaaattctgtatttttagtagagatggggtttcaccatgttggccaggctggtctcgaactcttgacctcaggtgatccacccaccttggcctcccaaagggctgggattacaggcgtgaaccaccatgcctggccagcttctatttctcttgaagcctagatctagaactggcacatcagtttcatcacatcctattggtcaaaatgagtcacaaggccagcccaaattcaaagggaggggaagtaaatgccccttcttgatgggatagttgggatgcgcagacagggataggaagaatgattagtggtgaagtttgctgacagtcctcctcagtatgcttagatatttgttagcattatcttttcagtaaaagataggtattattagtgaagtccaaggcctttgagtattatttgaaccctttggttttgagctatgaattgtttatagagtgaattgcttgaacattttgggctttattgagccacagctgaagatgatcattgattgactgcccccctccaccccaccctcccacccccgcctttttttttttttttttttgctttacttgccattcatattgtgttgtacatgttcctctgggtatattagaggttgaaatcaaaagccaaaggaatctgaagggggtcctcagctcttctctgggtcttactgtaacctagagcaagtgactccatcagcaggacaagtaaactcaggaaaagaagcaaaaaggaaacaagccagttgctctgggctgagataatgttaaatggcagagggaagcttgagttactcaactgctgcttggcttccatcttcactgtccttgtttctctgattcaattcttgcttcctacagttgatttcccacataggcaagcagagggatcttttaaaaatgtaagtcagatcatgttattctccagcttaaaaacccgaggggggatttcattgtacttgtaataaaatccagactcctcatcataaattagctcccactcttgcctctttacctcttctcttactcttctcccctccctctttatcagccacattttatttctttctgttccttgagcccttgaggttcattctgccaaattcatcccattttaggggttttgtacttgctgttccctctctctggaacactctgaccctagatctttgtgtggctggttcttcattcaagcctcagcccagaggacctcataaaaaccttttgtaccctcctagactcttttttttttttttctggagacagagtctcactctgtcccccaggttggagtgcagtggcacaatctcagctcactgcaacctccacctccccagttcaagtgattcttgtgcctcagcctcctgagtagttgggattacaggcgtgagccaccactcctggctaatttttgtatttttagtagaattggggtttcaccatgttggccaagctgctcttgaactcctgacctcaggtgatctgcccacctcggtctcccaaagtgctgggattacaggcatgagccaccacacctggtctcctagactcttaacagtgcactagacactcgccctctcacagttcctatgttctgtttttttctagcactgactgttctttttctctattttctcatgtataaaggtggggttaatgaaagaggtacatacttcgtagagttgttaagaggattaaactagttactatttagaagagtatctggagcatgatattgctctcaaatatagctttattgttatatcattctttactacctgaaattgtcctgcttagttatatgctagtttattgtctttcacttattgctagtgtcagccttttgcaagcaaggacagcatttacatatcttttttacagctcatccgtattcctagtgtgttgtcatacacagtaggtccttgacaagtactcgtaaagtcaataaatgaaaggcaggaatatttattttgaacaggccagaaaaaacattagtaacattaaattaaagcttgcgaaagttgaatggattgtaaaagattgtttagttgttcaaaatgggttttggatttttgatccagaagcattctgttccaggacactgaaagaacccagggataattcattgttaatttttatttttatggaattttgaagagtgagaaattgttggaattatgaagacaggtaaatgacattctgattttcgagagtgaggaatgtgggcttaaaaactgtagactaggagctttatgctacttgtgggcagaattctagaatgggttattaaaaggatgatttgtgaatgcttaggacagtgttgtttagtgggaaagtggagcacccttagagaaaagaggcctggagaaatgaattgattttttttttcaggtgactactgagcttggtggcagaattgagaataaagactccctgacttcagaccagtgttctctctgttccagtagtgttttcaatctgggaccatagagctgctcaaattcaagcaaaatagaatcttttttgtgtgtgtctttattttgaagatcgtttttttttaaagccattttcaaaaacagtttttcagttggggtacattgacctctgaaagttctaggacacagtctcaggagcccatgagatttagttctccttcccaccacttcaaaagaggtctgtgcggtactctaggttcagaaacttggcaccatgatattttgccagtttatcttattaactgaatgctgtctgtagtgactctgcagaaaacagtgttatgttcttctgtcagacttgtgctgttcaatatggttgcacgtagctatgtgtggccattgagcgtgaaaatgtgactcctgtaagttgattatagactaccatgtaatatagtcacccctcagtgtccgaggggtattggttccaggaccccctgcacataccaaaatccacagatgctcaagttcctcatataaaaatggcatcgtatttttatgtgatctacatacagcctcctgtatactttaaatcatctctggataatttataatacctaatacaatataaatgctttgtaaatagttgttatattgtttgtttgttttcttaacgttttttttaatggttgtattgttattgtttatttaaaaaatattttcaattcaaggttggctgaatctgcatatacagaacctggggatacagagggctgactatatcatacacattagatttcaaagacttagtatgaaaaaataatgtaaatatctcatgatttattttgaatatctgttgaaatgatatttttgatatattgggttacataaaatatattaaaattaatttcatctggcttttcctttttaaaacgtggctactagacaatttaaaattatatatgtgactggcattcattagaacttgacacctctctcaggaggaaaggtggaaggaactggtggatatcactgtgcagatgaggtgatatgacagctgccttcagctctttggatggctctcattcgtaaaagagattctttctgttctgtgtttctcaaaaggtcgaacgaagacatagaaaaagcaagttaatgtaagatagacccttctaaaatagttgtccaaagaaaatataggctccttctagagataatgaattccttgtcactatacataattcaagaagaggctaaatagctgcttaatgaggttgtttagagggagatcaggtggttaaaagtaatgcctttccaatcctgagaatttgtgacttgatgaaattgggcaaagggctgattttacagctacatgaaataaatggattccgtgggcaggagaagaaagcattttatttcactccctgtgcttttcctttaaactttcacatgagtattttccagttgaggagcttttgcattcttggttacagaaagatgtttgattgtctaatcccagggaatctggtgaacagtgtatcagttaggaatgtgcttggcaacaagtaaacaaacaaacaaaccaaagtgacaatggcaaataagtagagatttattttaatcctgtaacaagaactctggaggtcagctgcttctggcattgattcattggctcaaaggcatcagagcgagtgtctctgctattctcttggccttccttttcctcgtagtagcaaggcagtcacagctaccaacagcacatccgtaaggctggaagaggcacggaagttgctcagcccctactgcgtctgtcactttttcttgggaaaagaagtagtctttccagaaatcctcaacacaattcctcttctgattcattgggcagaattgtctcatggccactccttggtacaagggaggctgcaaagtgaatgtttgctcttctagactctacgattgagacaagacaggaggagaaggaggttgggaatggcatttgtgtcagccaaaaagaacagggtctgccgcagatagttttaggtgtgactgagggcaccactcccaagtcaaacatcaagtgcttgggagttgagacatcatccaatgtcctttttttattaaaaaaaaaattctttcactaagtggttttagctgccattgatgattgtagccttggatgagttttattaaacaattctttctttttagagaagaaaaaattgaggacccgagaagttaacgcctttgatttctattgaaattactcatagggtaagagtgagagttcttgctttgccctttccaccttcctgacttcatcagcaaagaagagaatcttggttttatttttcattatctgcaaatgatatgtccataacagtagttatttgtcacaaaaatacttcacaagaacattggtaaacacatacaaatgttagcagttctgaacaggcatttattgtagaggaacctgtttatgatgagaaatatgaaagaattgagacagtgggcctctaccatagaggagggaagaaactagttgggtgaaatttagtgttaggatgttttgtcaaaaaactatttttgggaggctgaggcaggaggatggtttgagcccaggagttccagaccagcctggacaacatggcaagattccatatctacaaaaataaataaatagaaatttaaaaaaatttttttcatctttagcattaatggcaaatatttagagctatatttaatggaagtatatgtgaattggtggtataaacagatttttccaaactctttttacttgtaatttctgtggctgtaacaacttttactagcctcttaggagtttcttaaatcctttttccccattttctttggtctatgataaagaagtaatctgaagtagaaaaaaattatttaggctgggcacagtggctcatgcctgtaatcccagcactttgagaggctgaggcggggggatcgcttgaggtcaggagttcgagattagcttggccaacatggtgaaatacaaaaatacaaaaattagccaggcgtagtggcagatgcctgtaatccaagctactcgggaggctgaggcatgagaatcgcttgaatccaggaggcggaggttgcagtgagctgagattgtgccactgcactctagcctgtgtgacagagcaagactccacctcaaaaaaaaaaaaaaggaaaaaaattacttagatgagctaatttttgaagatggtcttataaagtttattttttattaatacactttattttttagagcagttttagattcccagcaatattgggtggaaagtatgaagaattgctatatactcccttcccctgcagatgcacagctcctcccactgtctacagttcccaggagaggtgtgacatttgttatcattgatgaacttatattgacacatcgttattacccaaagtccatagtttaccttagggttcattcttgatattgtacatcctatgggttgggacaaatatataacgacatgtatccacatttatggaatcatacagagtattttcactgccctaaaaattctctgtgctcttgattgttcatccctccttccacacaacccctagaaaccactgattgttttactatcgccatagttttgcgtttctagactactatatcgttggaatcatgtagtgtgtggcctttgcagattggcttcttttacttggcaatatgcattgaagttccccccatgttttttcatgacttaatagctcgtttccttttagtgctgaataatatcccattgtctggatatcaccgtttatttatccattcacctactgaaggatatcttgaatgctccaagttttggcaattatgaataaagctgcttataaacatctatgtgcaggttcctgtgtggacatgcattttcagttcatttaggtaaatatcaagaagcatgactgctggatcatattttaagaatatgtttagttttgtgaagaattaccaaactgtcttccaaagtggctataccattttgtgttcctaccagcaataaatgagagttcctgttgcatcacactataccagcatttggtgttgtcagagttttggattgtgaccgtctaatgggtgtatagtggtatctcattgtgttttaatttgtgtttccttaatgatatatgatgttgaacatcttttcacatacttacttgccatctgtatatcttctttggtgagatatctgtacaggtctttggccattttttaaatcaagttgttcattttcttgttgaattttaagagttctttgtctatttttggtaacagccctttatcatatgtgtcctctgcaaatattttttctagtctaactcatcttctcattctcttgacagtgcctttcacagagcacactttttaattttaatgaaatctagcttatcaattatttctttcatggatttctgcctttggtgttatacctaaaaagtcatcaccatacccataataacctagattttctcctatgttatcttccaggaattttaaagttttgtgttttacatttaggtctgtgatctatttttaatttttttagagtttcgctctgttgcctaggctggagtgcagtggcatgatcttggcttactacaacctccgcctcctggggtttaagcaattctcctgcctcagcctctcaagtagctgggactacaggcatgcaccaccacatctgggtaatttttgtatttttagtagagatgggatttcaccatgttggccaggcaggtctcaaactcctgacctcaagtgatccacccaccttgggctccccaagtgttaggattacaggtatgagccgccgcacccttcctgtgatctattttgagttaacttttatgaagggtctaacatctgtgcctggattctttttgtttttttgcacgtggatgttcagttgttccagcaccatttgttgaacggactgtctttgccccattgtattgcttttgctccattgtcaaagatcacttaactttgtttatgtgagtttagttttgggttctctgttctattccattcatctatttgtctgttcttctaccgatatcacactctcttgatgactgtagctgtacattaagccgtaaagtcaggtagtggcagtccttaaactttgtcctttaacattgagttggctgttctgggtcttttgcctctatatataaactttagaatcagtttgccagtatccacaaaatagtgtgctgggatttttgttgggattgcattgaatctatgaagttgagaatagctgacattttgacagtgttgagtccatgaacatgggatatctgtttattcaattcttctttggtttctttcaccagttttgtggttttcctcatatagatcttgtacgtattttattagatttatacctaagcattttgatctttgggggggtgctaatgtaaatggtaatgtgtttttaatttttaatttcacttggtcattgctggtatatggggaggtaattgacttttgtatattaaacttttattctgaatcttcttataattgcttattagttccaggaatttcttgtttattcttttggaattttctacatagacaatcatgtcatctgtgaagaagacagttttgtgtcttccttcttaatctacataccttttgtttctttttcttgtcttattgcaccagttatgacttccaatttgatcttgaaaagcagtggtaataacggacatccttgcctggttcctggtcttagtgggaaagtctcaattttctctctttttttttttttgagacacggtctggctctgtcacccaggctggagtgcagtggtgtgaacatggctcactgcagccttgatctcatgggctgaagtaatcctgccacttcagtcttccaagtagcttgaaatacagatgtgcaccaccatgcctgactaatttttgtattttttgtagagatggggttttgtcatgttgcccaggctggtcttgaactcctaggctctagcaatcttcttgcctcagcctcccaaagtgctgggattacaggtgtgggtcactgtgcctggctgactttctcactgttaagtatgatgttagctgcagggtttttaaaaatatgttttttatcaagttgaggagattcccttctattcctagtttgatgaaagtttttattatgaataggtggtgagttttgtcaaatgatatgatcatgtgatttttctaattaagtctgttgatgtgatggattagattacatttattgattttgtatgttgaaccagccttgcataattgggataaatcccacttggtcatggtgtataattctttttatacatttttagatttgatttgctaatacttttttgaggatttttgcgtttatgttcaagagagacattggtccatagttttcttttcttgtaatgtctttggtgttggtattagggtgatgctgacttcatagaatgagttaggaagtatttccactgcttctagtttctgaaagatattgcagagaattgttacaatttcttccttaaatgtttgatagaatttatcagtgaactcacctgggcttggtactttctattttaaaggttattaaatattgattcaaatgtttaatagatgcaggccaacttagattgtttatttttgtgtgtgagtattggcagattgtgtttttcaatgaattgttccttttcaggtatgttatcaaatttgtgggcataaagttgtttataaaacttctttatccttttaatgttcatgggatctgtaatgatgttctctttttcatttctgatattagtaatttgtattctgtctccttttttcttagcctgtctagatgcttactgatttcatctatcttttcaaagagcaaacattgctttattgattttttccattgatttcttgtgttctctttcgttaatttctgctctaatttttatacttttttttgcttttgcttactttggatttaatttgcttttctttttctagtttctaaaggggaaaacttgggttgttgatcttaggtctttcttctttcctaatttttgcatccaaatcctatgcatttccctttgctttagctagaaactacaaattttgataagttgtttccatttttatttagttcaaaatatttttttaaattatcttgagaattctcttacccctatgttacttagaagtgtattgttttatctccaagtactttggaattttccagctatgtttttgttattaattttttatttaagtccattgtgatctgacagcagattttatatggtttctatatttttaaatttattagagtgtgttttatggcctaaaatgtggtctatcatggtgaatagtccacatgagcttgagaaaaatgtgtaatctgctgttgtttgatggaatagtctatagatgtcatttacatacaattgattgatgttgagtttatgtccttcctgattttttgcctgctagatatgcctatttctgagggatgctaagcctccaaatgtaatagtggattcacctcttttttcttacagttctatcagttttacctcatgtattttaatgctctgttgttaggcacatacacactaatgattgttacgtattcttggaatattgacccctttatcattttgtaacgcctctctctatctctgataacctttcttgctctgtagtttgctatgtctgaaattactgtagctactcccacttgcttttgattattgttagtgtggtatagctttctccaaccatttaaatctacatatgtctttatatttaaagtggactttttgtagaccacatatgattgggttttgttttttgatctaccttgacaattcctgtttttcaattagtgtgtttagaccattggcatttgaggtgattgttagttgggtatatagttggatacctaccatatttgttattgtgttttatttgttgcccttgttttttgtttctatttttatcttccacacttttttgccttttatggtttattatttagtattaaatcattttacattattccattttctcttttgtaacatataaagtatacttgtttttaaaaattatttgtagaaatgaagtctcaactgtgttgcccaggcaggtctcaaactcatgggctcaaacagtcttcccatcttggcctcccaaagtgctgggattaacagatgtgagccaccatgctcctttttttgtttttttaaacttttttaaagtggtttccctagaagtttgctgtatatatttacaactcatccaagaccaatttcaaataactctgtactaatacatgggcagtgtatttcattataataatgaaatattcctaatttctccctcctgtcttatgctgtcattcatttcacttatacgttagtgtatataactatatgtgtatgcacatacacaaacacacacacatatatatatacacacacagccctccatatatgtgggctttgcctccatggagtcaaccaactgtggatcagaatatttgaaaaataagggataattgcatctgtactgcacatgtacagatgtttttctcttgtcattattttctaaacaatacagtataacaactatttgcatagtattaggtattataagtaatctagagatgatttaaagtacataagatgatgtatgtagattaaaagcaaataatgcatcattttatataagggacttgagcattcatggattttggtatccactgggggtggggccctgaagccaatctcccatggataataagggactactgtacacataagcatacataaccaaatacattgttgccattattattttgaacaaactttgatctgttagatcaattaaaaaaataaacatttttgttttacctccacttactccttcttgatgctcttgttttctttatgtagatcttatttctgacctaacattattttccttctctcaaaagaacttcttttaacatttcttgtaaggcaggtctactgccaacaaactctgtcaatttttgttagtctgagaaagtcgttatttctccatcagttttgaaggatagtttcacaaggtacaagaattctaagttggtgggttttttcttttcctctccacactaaatagttcactccactttgttcttgattatgtgatttctgagaaggcagatataatttttatctttgtttctctatagccaatttactttttttctctgatttctttcaggaatttttctttatcttttactttttgtagtttgaaacgatagcctaggtatagtttttgttggcatttatgctgcttggtattctctaagcttcctggatctgtggtttggtgtctggcattaatttgggggcaattctcagcctatattgtttcgtatattttttctgtttctttctttttctccatctagtatttccactatacctatgttaaaccttgtatacttgtcccacagttcttggatattctgtttttcagtctttcttctctttgcttatcagttttggaggtttctattgatacattcttaagctcagatattctctccttagctatgtccagtctactaataagcctaccaaagacgttcttcatttctgttacagtgtttttgatccttaacatttttttttcttaagatttctatttctttggttacattgcctatgtgtccttgcatgctgactatctattagagcccttaacaaattaaccatagttgttttaaattccctatctgataattccaacatccttgtcatgtctgtttctgatgcttggtctgtctcttcaaactgtgttgttttgccttttagtatgccttgtaattttttcttgatagctgggcatgaatatggggtaaagggatcactcttaagtaggcctttagtaatgtagtgatagaagtgtgggaggagaggaagtgaaaccatctttgcaaaaattatgaccatgagaaaaattttggcataggaaagttatggcagtgaaagaaatctaacctaactgactccatgttgcttctcacctccaagctgttcctattcattcctgggcataggccaaacaaaatataggaggaatttactttatagtttaattttgaagcaaagatgataacagccccttcctgagacaaaccccctctttgcttagggattagaccatctttgtaaaactgaaacgttagccacaagattagaaattctggctcaggagtcatgtagccagaggccacaagattcctaaacttcccaattgctcctatagataacatcactattgtaaaacctaagattggtgtttgaggtatttttctgaccctgcattctgatgaaccaaccagctggtgccacccagactggtaaactggctcatctggtcttttggcccgcacccaggaactgactcagtacaagaagacaaacttcgactccctatgatttcaacccaaccaatcagcattccctattcccgaccctgctgcctccaaattatccttgaagaaccatagcctctggatttttggaaaggcatatttgagtaataataagctcctgtcctcttgcttagctgcctctgggtttattaaactctttctctattgcaaaaacctgctgttcagtgcatcggctttgctgggcagtgggaatgatgaaactgcctggtgaatacagaagtgttctcttgtcctatgagtaggtctcagtctttgagtaagcctgtgcctctggactgtgaacttcacagtgtttctcaggttttatttcctcttaggtgggacagggtcgctagactcggctggaattatatgtttctgttcatcacatggaaggcttgagtgggctagagctgagaatttctcttccctccaggcccgttaggctgtgggaaaatccactgtcagatgaggctctggttaggtagcttctcctgaggacaggccttgttaggaagaccccagtgctctggcatatttcaaaatggttccttttccttctcctcctgctggaaagggatttttcttggggaagtttctgctccaggccgggtgcagtggctcacacctgtaatcccagcacttactttgggaggccgaggtgggtagattatttgagcccaggaattcgaggccagcctggataacatagagaaacccagtctctcctaaaaatacaaaaactagctgggtgtgtggtgcatgcctgtagtcccagctacttgggaggctgaggcgagaggatcccttgaacctaggaggtcaaggctgcagagagccctgatcgtgccactgcactccagcctgggtgacagagccagaccctgtctcaaaaaaaaaaaaaaaaaatttctgctccagtatgttgtgattctctgtatctgcctgtctgttgcttcaatttcagaggcatcagtttaccttgtgatctcacttttcttacagaactaagaagacttgttgatttttcagtttgttcagcctttttacttgttaggatggagtggcgacttttcagctccttaaatacagagctggaaaccagaagcctcttgacttttcattttttgcctttgaaaaaagtcaggtagttaatacttctctttcagggtgctgtttgaaaattctgttatgcaaaaacataatgtagataatttgtattcccaataaatgataaggcacattggatataattgttactgttttgtattttttagcatagttttagatgttttattttgctacaaaggaattttgagcagaagattgtgacatatatctgtaaagaacagacttattattattattattatcattattattattattttgagatggagtctcgctctgttgcccaggctggagtgcagtggcgcgatctcggctcactgcaagctccgcctcccgggttcacgccattctcctgcctcagcctcgcaagtagctgggacttcaggcacccgccaccacgcttggctaattttttgtatttttagtagaggcggggtttcatcgtgttagccaggatggtctcgatctcctgacctcgtgattcgcctgccttggcctcccaaagtgctgggattacaggcgtgagccaccacgcccggcccagacttattattttttatgttcatccccctgttaattatctttcactcacaatattccctttgcttttcctttttaccagtggtccagtatgggtatcagtggaacaatatatgtcttaagaataaagcaattttaaaccaccatgactagtagcagtgtttagctgagttctgttgcccagttgtcaccaactactgcatatactccctagatatacagttgcatgttctcacactgtcctgttttgaagaaaaaaatgtttttaaaaagtagaaattgaaccaaatgccattactgtctttattgacttgaaaggccctcattccacccaatcctgccctactcctcttaccccaattcctttgtgaactactttgggaaatgctgctggtggtggtgtgtgatgatatttgtaagagcatgaaaataaaaagctgggaatatataagagattcagattttgctgaagcagagaatttgacttgtggagtattgtaatgcaaaatttggtgcactgttaatggaaagcatttgctatattaaacagtaagggtctattgtaggttgagaagctggggagatttattttaccatttagcatgtagagaatttgaataggaaagtaggtgtgtatagagtgcctgtttgtcccattcattgttggggtttatatatacctttctctcttaatcctcaaaactccctgcctgtaatgtaggtattttccccattttgcagataaggaagctcagacacatgaacttttccaaggtctcaaagctagtacatcgtggggctgtattcaaacccagggctgacttcaagacctattattcttctactgaattaacctgaatgcttgcaaagtctgtggctctaattgtttctgtggctaattaatgttcatgaactggtgaagagtaaatagtttagttttttttttttttttttttttttcttgagatggagtttcacttttgtcaccctggctgagtgcaatggtgcaatctcgactttctgcaaccttcgcctcccaggttcaagcgattctcctgtctcagcctgccaagtagctgggattacaggcacccaccaccatgcccagctaatttttgtattttgattagagatggagtttcaccatatgggccaggctggcctcgaactcctgacctcaggtgatccacctgccttggcctcccaaagtgctgggattataggcataagccccagcacctggccaatagtttagttttttaatgactccctcaactttgttaggtctgtttatttgagagcatgtatttatttggggccataaatgtatttttacatttacctattttatttatctcaggtcttgctttttacattagagaaggaagctttactagtactctacttggaggggtacatctctttatcaggaaaggatcttattcagatatatacatacatacattgtatttatttataaatacaataataacactgaagtataaagaaccacaatttattacttttttcctcattttttttttctgctgtggagcttaccagctagaattctggttttggtagcaggaaagaacaagtggcaactttgtgaattgtggcatttgagattagacggatatacaagatggtgtactacagcactctaacagaagggaatagcactgttgtcaaagacattggaaggtctcttgtaactgaaagagccctctttggcatttggccgtctcagtttcacgataacaagacgaagcaggaaccttgaaattgctcctctttgtattccattcctggataattaccatctatactcagatttcgaaaggtccttttattttatgattgcatctttcagcaacaactattattatcctattatgcaatttgccttatttatgatgctcaggtgggaaaacgttcagactccacaattgaaaagatcgccctgattgagcattttgtggtgcttttgcttgttttgctgttgaacaaacaagagttcaagacaggtgaattttttccagatgtgcatttgaataattggacagatccctgtggtctcttcagtaataacacaagtgactgcttattgtcgccttcttcctccatgcctggcttcctgtggtcactctgcaaagggctctgtagttgcaagatgactccacagttaatattgagctcatgaggagtaaatagttcatccaagctgggaatctctgagcttcattaggtctgcttatttgggtaccagaacctgtcactatccaggagacacacagcagatcagctttcacttgctttgttaccattttaggcatgaaatagaacgattttctcccagaacatgatgtccctgtgaagtaataagtgatagcactttatgggctttaaggaatctagagccaggccagttagcaactgaagctgtagtaactcagctggacactgatgtccttttcctgaagttatatgagcagaggcatgtaagggaaatgtggctcggtgacccacagtgctcagtgcccagttcagtgacaggcagccaggagagctgagccatggagaggccagcaagccaaagggatttgctgccatgctgtgacatggaaggcagggtgcactcagcactgtattgatgacgttcttaagtctgaaggacttaatgcagtttctggatgtgcctcctcatcaccacacctgttcaagggggaaactgggacccaccccaagagtcagctctatagaagtttttcctgacaatactctctactcctggaggtagactgtgtttttctcctgtactctcctctaacacagaacttgcgtgttactatatgcaacttgtttatctgccccctggactgtgaacccttgaggacagggatattgtcttatcactctttgaattctcagtgctgggtacatattacgtgttcaatacatgtttgttaaataaatgaaacagtcacgtttggctcctttcttccacaaggcattctacccttccacggaaacaattatagcagcatggaaacaattacagcagctatctataattgataatcagaactaatgaaatatggtagcacaggcatgaatagagttgaaattatcagagtgattataaaatacataggaataaacttaacagaaattgggcaagacctttatgaagaactcttccaaacttaactaaggcacataaaagaacacttgaataaatagagaaacatgttcattggtgaaacgagtcaatgtagtaaatacgtcaatatcactttttgtccatattaacctaaaatttaatacagttccagcataagctgtaatgttatttttattctatgaaatttgataaaatacggtaaagttcagaaaaacattgcctgagactagtgaagaatgaaaaagaggggaaaattttatctcatcaagtattaaaacataaaatatagtaaatataaacaaaatggtagacaaactaagaaattggaagccagtataatctggataccaaaacttgacaaaggcactacaagaaaaagttatagccttaagcatagatgcaaaaatcatcaacaatatattaacaaatggaatccagcaaaacagaaaaaggataatatatcattaccaaatgggatttatcctggaaatacaagggtttagcatttgaaaatcaatgtaatttattgcatttattgaaataaaagagaaaataagagcatagctacaacaggaagtctagaagcaggcttgagtatacatggaaacctagtacaggttcacagtcctttatctgaaatgtttggggccagttatatttcaaaatttagggtttttagcagtatctcataatcaaattcatgtaaatttccacagcagaacagattaatacggacactaaatgggatgataaagaccagaaatagcctcacattagctcaggtcaagttttgccaccaaatgaatttaagcaccaaaccgcaaaaaacaaaagactctgttttcagagctttatgatttcagaatttcaggttaggaattatcaactctttaatgccagggtggcacatcaagtcagtgatgagatttgtaaaaggcattgggattacatactagtcatttagaggaagaaaaggataaagttaaattcctacttaatagcaatattgtttatgtttaaagattttatgttaaaaaactaaagaatctataaaagcacaaaatatatacttaatctttatttataatcttgtggtagcagagatctttgtaagcatgataccaatagcagaaactaaataaattttaaaaagagatcttacagccagccacggtggctcatgcctgtaattgcagcactttgggaggccaaggcgggcagatcacctgaggttggagtttgagaccagcctgaccaacatggagaaaccccatctctactaaaaatacagaattaccctggcgtggtggtgcatgtctgaaatcccagctactcgggaggctgaggcaggagaattgcttgaacctgggaggcagagattgcagtgagccgagattgcgccagtgcacttcagcctgggcaacaagagagagactccgtctcaaaaaaaaaaaaaaaaaatcttagattactaagcaaaaattacaaagaacaccataatattaaaaactaatgtcaatgtggagaaaatgttggctatatatatagtggccaaagggttattgcccatagtttataaagagctcttacaggttaataaataagagatgcattctccacgacaaaatcagaccaaagatatgaaaaggtaatttgcaagagaagaaatacaaatggccgctgaattctttactactactatatcactatcactactactagcaggtaccatttactgtttattgtctgccaagcactgggctagtatcatatcttgcttaagaaaatactatgagacaggtgcaattatttacattgtgcaatgaggacagtccaatttagggagctaaagcagcttgtcctagatcacacatttagcaaaactgttgcagcccagggctgtctgcctctgaaattcttgctcttcagtataacacggacctactgctcctatatatcagtatttgtataaaaagaaaattcagtgaaagcaaccagaagttaccatttgttttgcctattagattggcaacaattgaaaaggaatattcatagccagggaagatcagagtgtgaagcctgcactctcatatattgctgctggtagtgtcaactggcatgatttttctggaaggcactttggcaatatgtattgaaagctacattctttgatacagtctttctacttctaagaatttgtctgaaaggactaatttgataagtgcttatatgtaaacagtgttcatttcagtattgtttataaaagcaaaatgttgaaagaaacttgtccatcagtgaaagatgggttaaatgagttatgagagaattgaagatgtagagctatatttattatttaaacattgaccttcatttacttttttttttttttttttaatggagctttgccctgtcactctggctggagtgcagtggcacaatctcggctcactgcaacctccacctcccgggttcaagctattctcccacctcagcctcccaagtagctggaattacaggcacatgccaccacatctggctaatttttatatttttagtagagacggggtttcaccatgttggccaggctggtctccaactcctgacctctcaactgatctgcctgccttggcctcccaaagtgctgggattataggtgtgagccactgcacccggctgaccctcatttgctattggatggaaaaataaaataaaacaaagcatgttgcaaaacagttttgtggtgcaactttatatttgaaaaactccaagtcatatacacatatgccaagaaaaaagtctggggaggctgtgaaacacagtattgacagtggtataattattagtgttttatttttttcttcatatttttctgcagtatttattggtttatttttgctctatacatagactccagttgaaaaaagtatttaaaaatatatactataattttctcagactgatagaacatctcaacttgaagattaagcacagaatttggggatgttcatccagatctgtatatttactttgcttttgttagggagtatgtaggtacttcctgtacttatattttactttttgaaagttggcacaggcatgtgctcacacatacattatttcccacatgttagtccaagaattgccaggcttctatttcaatgactgtgtttaaagtaatagtttgccagcgacttggtttacatatccaatcagtgtgaaagttatgtatccttctccatagatacaaggaagtcctctttgcccaatcagtagatcaagaaggcgaacaccttcttaattacaaatgaggttttaaaaagttggcttaacaaatatagctatgtttgcttaacaaatatagccatatagcttaacgagtatagctaaggagacctacctgaggattcttctggtttagaaaagaattatttctgatagggagacaatcatgttgggtgtattttaaaatgcttgatataatcttcaaaatttattatgaaacagtgaaatctggccgagtgtggtggctcacgcctgtaatcccagcactttgggaggctgaggcaggcagatcacctgaggtcgggagttcgagaccagattgaccaacatggagaaactccatctctactaaaaatataaaattagccaggcatggtgatgggtgcctgtaatcccagctacttgggaggctgaggcaggagaatcgcttgaacgcaggaggtggaggttgcggtgagccgagatggcaccattgcactccagcctgggcgacaagagtgaaattccgtctcaagaaaaaaaaaaaaaagaaagaaagaaacagtgaaatctagtattttatatgacatgagcaatttgcacagtgactttgaacattatcctgaccatcaaagaacattatttaataagaattgtggactaagtaactttagtgtgcattttcagtgtctctaaagatttgggcgcagagttatgagctccatttggttgaactggtagttttagaaacagatttttaaattacttaccaaatgtaaaaggaaaacacttgtattgaaaacactggttgcagatcgttctaaaggccatttgggacaacagaacaaggcaacatctcagagaaaatggttagtaatgggctcttagagatggtgtcttaatgcagtagttattttgaattatctttaaaatggttttttgaccctgttcttctgttttgacattctcctttgaaggcatacaagttatactgatgatatttgaatagtggaactcttgtgtagcagttaagagggtgcattttagagtcagacagacctgggttaaaatccaggctctaccacttagtcgttttttgagctttggcaagtcactctagtctctctaagctttagtttcttcatttcaaaagtacagacctgacagagttgttgagaggattaaatgacataatttttgtaaagagcataactgcctggcagattaaatgttcagtaagtggttgctcttttttcataagtagtccaatttcttttagaagattttcataataatatgtagtgtaatggaaagaatgcacactgtcttgtctaatagacccagatttgaacactggttctgcccttaacaacctcctaaccttgggcaaatcattctgctctgtgcctcaattttcttccccaagaaatggagtcataatgctgacctttttaggggttgtaaggatttgaagtgatataggctaagtgtcaaactctatgcctggaggaaagtcagtattcaatgaatggttactatcattattgttataaagctaataaatatcaaagaacatgttaaggcttttaatatttttcctcttctcttttttatctttagttgtaattctttaagaaattgggtacacatagctaagactgtgcagtataagaaaagtgttaataagttatataaaaatgtattctaatactacatttggtaaacaaagaataagaatctgtaggtagggattatatgagtggagaaggatgtgtacttagggcttggctttggggtgcgtgtcagagactagtgtatgaggaagaagaagcaggaaaaggcagtgtttcatttctcacaatcgcccctctcaccagccacactgaagaggtgatgtcatgggcctctgatgctgtgcttgcccccatcacccagccgtctggaatagctgctggaggtgcccagtgtgccagcactgaaggaaggcctggctgcttggcaagcattggtgatgctgtgacattgagttcctggggaggctgcctgctcaggtggactgccacatgctgtatgtcttgcttcatatttgcacaatatggtgcttgatgtgattcattcatccattcatccatcctttgtttttttttttttttgaggcagcatctcactctgtcacccaggctagactgcagtggtgatcaaggcccactgcagcctcaatctcctaggctcaatcgatcctacaccacagccttctgagaagctgttactacaggcatgcgctaccacaccctgctaaatttttatattttttgaggagacagggttttgccatgttgcccaggctggtctcaaactcctgggctcaggccatctgtctacctcagcctcccaaggtgctcggattacaggcgtgagccacctgcctggcctgtccatccttttttcccttcctccctccttcccttcctttctttttttcccttcttgtcttcctccctcactttcttttatccagccatccgtctgttcatcagtccatccatctgtccatccatcccatccatccgtccatccatccatccatccgtccatccatcttctaggtcctaggtatagtagtaaaatagtcaaagtcccttccctcaaggagcttacattttagagattcaaagcattttcaaatgtattatttcatttgctttttaaaacaagtatgtgaattttgaattttttagtattttcatttgctagatgaggaaacaaaaatattttgagattaaatgacttacttgggataataatgctatgaataaaacccattattttttatttagaactcttttatctataccacttttgtattctaaacaagtttttcattaatgaaacatgttttcacactgtgtttttctcaatacttcaatcataggtagccaagggaattttaaagaacattaagtgcactcaactgagctgctttaacctttcaatatgttcccgctgctcttagaatgagatttgaaatccagaacaccactgcatcatcaggccagtgcttccttcccagctctgtctccggaccccgtccctcgtattgcctgtcttctgcaaatgctagccttctttcctgacctcagaggtattgtgttctttccagcttcagccctttgtatgcactgttccctcagcttggaatcctcttctctgtttccctccttgtccgtcttccccctatcttcaccaagctaatcccactcaactcacagatctcagctttcatgccacttcctaggggaggccttcctcatccccctgccaaggttaggtccctgtaccatatgtgctttctcatagcaccctgtgattttccttaatgactcacctatcacaatccaggattttgttgactgtctgcctccccttcctgtaaaggttagagggtaagctccatgggggcagaacactagttatgtcattttcaccgctgtttccctggctagcactgggcctcctgtaggccctccaaaatatgcaaataaatgaatgaacaaacaccctggcagcatggaaacccagagcggcacaagcgagttcaaatgcttatggtttgttccatctcacttccctctaggatgtgattttagcagtgtaggcagcttacgaaatggggcaggtttcttgtgttttactaatgtgtaaataaagatagagtaactcttaagatatggaaagtttgtaaagtggcagcaaaaagtgacaaggtgtggggatccaaatacagagcctagggaaaatagaataaaccaagttgtttttatgtctcttttccattagactgtgagcaagctgaagtcgagtcccagaacttatttatgtttatatcctcaaagagactatagtgcctggttcatcgtagctgtggaataaatgttgaatgaatgaatgatacacctcttacctttgaagctgacttcttgtgttcttcatgctgacattagaaataggaaaagtcagtcgagtacagtagttcaagcctgtaatcccagcactttgggagaccaaggcgagaagatcgcttgaagccaagagtttgagcccagcctgggtgacaaagtgagaccccatctctacaaaaagaaagaaaagaaagaaattggaaccgtattatttgtagaaaaaatactagatctagaaccagagacacctaggttaaaactgatttaaaatgagaataattattcctaccaagtggagttgttgggagggtggtatacatatagatggtgtatataaagtgcatagcaagctggttgtggtggctcaggcctgtatttccatctagtaggaggccgaggtgggatgatcccttgaaccctggaggcggaggttgcagtgagctgagatcacgccactgcactccagcctgggcaatagagggagactctgtctcaaaaagaagtgcatagcaagcaccaggcacatctaacagctcctcagaacatttaagctcccctttttttgcttctttccctttggtataattttagaaagacttttggggagcatgacatataaatcattaaaaaagagagagcctcaaagcagaatcatggcaattgagctagatttgtatttatcaaagcaagcatgatgctgggatgcttaaataacagtacagtacattgcaaaggaactagggaataatgttcctattatttttgtccatggtcagcctattactagaaaagagtgaccacattgatttctaaagtccttatattcaaaactttctgtgctgaccaccatcatttatgtttttcccatctctacttaaaaacgtcaactagccccaacttttcctctagttatttcttttattagatttattctgttctccacaataaaatctatcttctgttcccatccatgacaattcaagtagttataatgggtggatatagggtatgataaatgttggtaaatccactgagttccttgagttccacattgatgtcttttaggatgtgactaggggtaggctaaatattttctagtttctcagatcctacccctggtctaattatgatatagaggccagattagtgtcaccagtttttctttctcttctgaatgtagagcaagagcaaatgattgcagataacagcatgagaaacttaggatcaaccaccagcatctaagtgagtcttgtactaggctcattccagttaaaagctgtaaatcatttcatagccacatcagtttagttctcttttatagaactcattatgtgatacaaaatatgcaaggcactggagatacaaatacaattatttcctcaaggaactttgagttgagcaaacatggtactgtctggtgagaccagacatatgagcaaacatagtacttctctggtgagaccacatagagaaatgtacaaggggtagaggaggcagtgatgactactggtctgggatagttgagggaaggtggcataggctgcctattgaagaataaattagagtttgctatgtgaacaaggttgcagagggaatagtatatggaaaaacagggagatgtggacccatatattttgtgcagagatgtccaagtacttagatattactatattgcaagtatgaagaaagctttttttgagatctgacaatgccaaggtaggttatggactctctttggagtccccaaaataaaaataaaacattcacatctgctaaagatagcttgaatggtatttttgctaaaggcagagtcatatactgtatgtgccagataaaagtcaatgtctattatgtaaacattgagattacattaattaatttaaaagaaaggattcaaacttagtactaatctgcatctggagaactaatctggtatgtgttattttcaagtcacccaactaaagcagtctgttgtatggaactctgctccctcttagtcaaacaaatgcaaccataaaaagcagtgcaaattcagtgtcaccttttctccatgggattgggtggtttcttttggagcagagagagtttccagagaatcaatatagtagccagaagaaaagtggagggtggccttaccttgtccactccgtgctgcctgagggtgaaatggaacctcggatgttgtacacctttaaattgtccatgttgcctgtttcatagccttcccgggccagggagctgtgtagtcagtttatagttctaagaaccagagcaggactgctgtgcttgtaattgcatgctttttatggaacaggcaatgttgtttagggaatttgggcagctggaacctgccacattagcaatttggactgaggaagaatttcagggtgataaaataaagctcattatataaattcacttgggtatttaggaggctgagaagggagaggatgagagtattccaaaggcaagcaggagagtttcataaacaggtccctttctattcgtttttactgtaagtgttgaattgagctaggaggatcacatggcccattttgcaaagggcagtcatgttctgctgtttcttagctgttttgtcagttggaacaaaacaacagcgctgctcattttttgcagggttagaggaaaaaggaaggactggccgaagaatggggtggggagctggagaagagaagggccaaaagtgtcagactgtggggatgaggacctgaaggaggcccatgagacctcaggcatgggccctggaactctgcctttttgaagcctgttgacaatctcaccctaatttaaccctttgtggaattcttccatgagatgcagttgccatcatcaggcttcctagagaattgagcctgcccactctgttatgaagtctacccagaagagctggcagagtaggccccttcactgggactgcagcaacactgaccaaagcaaatccttctcttggaagaaacaaactcattcctcacacctgcctcaccccgctcccaccgccaccccctgcaccacacgccagcccttaataaaaactaaaactgatgtcattgtaacctttggttattcttttttgtgcgtaaagtgtcaacctcctgttttattctcataaataatggaaatcttaacttcatttcagaaaatcacaaaagataacagggaccctattcaaacagaataaaaataattagtaagtcacaaactctgactagaaagaaaaagagaagagagagagggaaggagaaagaaagaaggaaagagagggagagagagaaacgaggaaaggaaggaaggaagaaagtgaaagaagaaagtcctcttgttggtgttaaaatgtgtctttaaggggaaacttatcatttaggttactaatggtttctttcttcatcattttaatttccattaataaaatgtgactttgaaaggatgcagggagtttgggaatagagagttttatttttatttgtttattttttttccccttctcccagcaaaatacacaggtatctgactatgtagagacacgaagccacctatcctgaccaaacttggcagtggtcaggggataggaggaagtgtagtgccatgggatgggcaccagccctgatgaactcgactttctttccatttctctcctgcatccaaatgttgaggagactttgagtagtagtgtagcctcttttccttttaaaaatctgcaccctgcttatttccaatacagatatgaggttggtacccactaatcttaacaggatatatatatatatatctaaagtatataacatattatttaaaaactaatgtattatttaggttttattaaattatcctgtttttaggctatgctgatgggctaaatttgcctaaactcctgagatttagattctcatttattggcattagaggagttcctaaaaaaaaaaagctattaagattaaatatcataaaaatctttctaggaaaatataatcaaaagcatcaaggctgtctcctacagttagtggtttctattattttggttctcagagctatgacaatgtcactggatttcaagaattcagaaagacaaaaagaaaactcataattttgaaatggggaaagggaaagatcttggacatagtcttctgtttttaaaatagtcattctcattttaaaataggaaaaaaattatttttcatttaacaaagcaaaaaacccagtctgtacttttaaattaatgcaaacatcaatattttatagggagaacattaataatcattgtggagcccattaatcacaattctgcttttgatttattgtaaatatgcctcccattttcctcctcattaccaatcaccttctttaattataagagggctttcattaaaacttttgaatcatttattttggagcacctaactttagaagacatttattgatttttatagcataaaatacaaatgtttttattttagaaaacatcataaactaaaactttattggaggagtttggctaaagattcaaaaatatatagaagtaaaaatatatttaaaactgcacagtttttacaacagcatgtatggcatttggattcagaattttaactagcagtaacctcatctgtttagtaatgaattttaaaatagaaaaaaaatctgccaaaacagaccagttgtttattagctatttaactttgatgagctgaaatgagatagtgaagcagaataattagaacaactttttttctcaacatctaaatatttctctttttcattaacatttcagttaagtttgaagaaattccaaaaatgagattctcattaactaaaaggaattctaagggttataagccatctacattttttctatgacctgaagactttttttcgaaaaccaattttgggggaggattgtcagatttacctaaggttttggtttttaatttaaaaaaatttaaagaaactatcttagtgatttttgtcatcatttttatttgttgccatgattaatatatggaaataagataaattggattctatttctgtgaaagccatattcttaacatcaatgcctacctaaaaaatatacgagtcacacttgatcattcagaatcattttgaaattctctggtaatcttttaaaaagccagcgttgactagtattatgtggctagttatatttattacagcagtctagttattgtttgtgtaactatagtttttttctaatagaaataaaatgtctatttgcaggataaaaagaagtatgtatatttgatgattttgttgtagaaaatacttaataccttttaaaagctgtttgactttcggttttaaaacagctgtgtagcttggtgagtcctgcagattccggctttctctgtggcctttgagccaagtaattttttgcaacattttcctttgctttcttataaacactcaaaaattatacttgcttttcctgaaggccagctattaagttagaaagcaccaaaggtgttatgaaattgccctttattttttcgtacatcagggaggaatgatagattttgtgtatctcttgtgtgtcattagaacagaaatatttagggctgctaactcccggagttgtgtacttacccttattacagatgcaatgattttgtctgactgcattgctttaagatgagttttattgctttcatgcttaggcaaggatatttaattttatttgtgtttagagtatcttgttgtaatatacttctcccccatcttgtgctcctaaatttgggataagcatagaatccttttaagaatgtaggttattttccagtttactagaaagcatgacacatataaattagcgactaaggattatagcgtcctttcctaaaggttatcatgaaaaaaagttaaaatgtcaaagaagatcctactccagtaaaaacaatttactctgtaaaatcctgatacctcataggaagctttggatcttgttctcagctaccaaaattctttaaatatgaaagttaacatgacaggaaagtggaatacactctgtgctgaagacccactgttcaaggtgtgtggttattaatctgggtttgaatttacaaattatatggtctgattaatttgtagataggggtcggtggaggttagacgatgggctttagaacaaagaggctgataaaatactactcacaagcctttctgcttgtttgtgactctctggaaatgccattagatagttctcatagctatggtcaaaataagtaggcttagaaataaaagacattttctcccctgtaaaaggaggcggctggcctgtgctctttctaggctcttcccagagacagcaacctcggcttctgaacccttagtgctcattctatgctccaccgcgtctcctctacacgccatgatctttgttatctgatttgctagccattgttatggaaagttctcgactgtaatgcaaaaagctcagccttgggtccttgctaatgtcagcaacccaaaggcgcccctcaaaccacctcgaaaagaaaaatcctttaaaagatgtcaaactctcctttcatgttagcccaaaatgaagttcccgagcagcatctggcagagcagggtaattcaatctattttaatgcaaagattttccaagaaggcaggaagccgtcaaggagaaggctttgaggcatctgctgttttgtttccagatcccttgtgttaatttaatgtttctagggaacccggctctttcttttttctcggaatccctgctctaggaactggtgagtgcgggggcgctgtgggagctgcagataagccagcgcttggccgggcacccgcgggccgcgcagcggggcagggaggcgcgcggccccagccgccctagggcgccggctgcctctgcgggccccggctgcccagcccagcgcggggaggcggcgccgactgccggggggcgcctgcaagacctgtttatttgcatttgtccaatttggctcaagtgaaaggtaaatacggagcgatcagcttgtcctcactccagcaaaaccagggaaactcagctccatctccaggaaacaaacccaacccaaacctgagtgaaacgtaaatcttgcataaacaaacacgttcttttgcttctgggaaggaacaccggagaaatgggcattccttccgactgcccgcctcccactgtcggtaaaaatgagccgtcacaggttgccggcaatttcttgttgtgtcccgagccattccgcggatcttgttttgaaggggcgagtcaggtgtttgtgcggctccagatcctgaacaggttatgcgctgggtccttccttatcaggaggggggtcaggctgccctcccattctcatcttccgccccagaccagaggctacaccaaagttcacttttgaaaagaaatcctgcagaattaaaaataaatgtctgccctttaaaatagtttcgttttagtattatgcatatttctgtttaggaacttgtaatgctaataatttatgttgctatgacaattgtcctgcatacctaatattaaatttaatgaattaatgtggcgtatagagtaatagtaacttaactagtactccgataatgccagtattccctgtgttactaagttaatggaatcagaattttggagttacaatatagaggttttttaggccaatttttctatgggattctagggatctttttataacatttctgcttttcgaagcagtctataccattgctggagagccgtaattactaggatgctatttctttttgtttgtttgtttgagacagggtcttgctctgtcatccaggccggagtgcagtgggtccaactcagttcactgcaaccaccacctcctaggcttaagcgatcctcccacttcagcctccccagcacctgggaccacaggccctcgtcaccgtctggttaagttttgtattttttagtaaagatttggtttcgccatgttgcccaggctggtctcgaatagaacattattccttatagtaagctgaattccctgtgtaattattcttactgtcccttcaataataaaagcctaaaattattcttactcatatattttagtgagggtggtgcatgcttgaagaccgtgatgagtgttctcttcttatattcagggcaactatgatcacatattgggctccagatccttgctttatgcatcttcttttgaattgtttagaaacaatggcaaaatttccaatttcaaggtagtgcttgaaattatgcaataaaatgttatgttagcaacatttttttttattttaaaaattcctttgattatttcacacttatatcctgttctctgttatggtagttttgttttctattttatttttagtttctatgtaatttattgtgctttagctgaaatcactaaataaagataaatgagtttaacagactcttatgtgctcatttttggttcttttttgctttaccccttgtattcgttttctattacgggcataacagattaccacaaatgtagtggcttaccatatccatttattttctcatcatttctgtgggtcagaagcttggcacaggatggctctcctggcttctgtgcccagggccttcacaaggctgaagtaaagggagcagcaggcctggacttgtacctgtaggccttccaggggagaatccacttccaggctcactggcagaatttagttccatgtggtagttgtactgggggcccagttgcctttcttggagagcactaactgctggctgttaccaagggtcttctagaggttgcccatctacatcttcaaaggcagccacagtgtgcagaatttgctttagatttccctgccttcccctaatgtgtttctcttctacttttaaagggcatgtgattacagtggcccaactggataatccaggctaatctcgctagtcaacttattagtaaccttaatcacacttgcagtgtcccttcatagcagtacctagttaagtgcatgattgaataactgggtaatgggacttctcgggagagatctttgacattctgcttaccatacccctctgggtaccactttgttgtgatggtaacctcataagcagccatttaaaagagattttaagcatcttaattttgaaaattttgcaaggtaaaattaaaataaatccaagtaacatcaaatattacttatacataattctagaggtttaataaaaacaataaacattcaccataagtagttgttgcttttaaaacccaaagtttttctaccttgcaaaatcttccttgattttcttgttttgttttggtatcacaatagatcagtttctagtaccaccactatataaaataaaaataataattgcattttaaaaagaatggttttcctctgcactctgattttaaccatggaaagtttttggtatattcaaatataattctattagattccaattttgaataagaaactgggttccctgacctagctgccacttactcatatctaaaatgtacttgaatttgcagcttccaagttgggcacatgtaaaccccctcttcacttcttatagagctgcataattcttaaagcttgtggtgacgggagggcacacttgcttatacgtccaaatttactgtttatggatctcgattactgttttctacttaaattctaatttttctcattcattaattttaactggacaactattcagaagtatgaattacatatgggcaaattctagtgctttgaaattactggaaaaaaaataaatggatgatcaacagatgcaaggaacagaaaatgtttggcttttaggggagttttatgaatactcttttggacttccccacttccttttagtaactccaatgtcttccagtaactctagcaaggaggaggcccagggagagaaatggggatctcacagtctcatactaggaagctgtgctatggggaagtgactggtggtctggagatgtgaggtagaggcataggcagcaggtatgttgacacttgaaaccagtacctcctcagcccttgcgggaaatgtgataatccaatcttagccatatatctcaggtgactctatatctgaaacgtgcaatgtaggtaaggtacttctgttgtttctcctaatttgtgactattttcatataatgaatgatggtcgtgggcattttggtatagaaggttttaattatggctcagtatttgtgtaattaaccaagtggaatgatttagagttctgatattactgaagtctttacagctggaagtcaatggatccatgccagtacattattaagtatacaattacttatttgcctatttatcccttctccaccttattacaaaaagatattgaggaaacttacacacatacacacactattaccaccaccacctaaaatgaatagatgaaattaaggtaaagggaaaataaggctaggagaaaaataaccatgctaggatgaatagggttagggcaaagaacatgtaatataaaattctatatggggctagagctaggctgtaaatttggctctggattttctagcagccaaaacaaaaagagagaaaattaatgagctacaggattcaccatattcataaaatgattaaagaagattgggattttcccttgaacccatcttgtttgaagtgggggcatttgatgctttctttctgctagaaaggttaactctgagttgcaataaaaatcataaaaacacaactttggcagaaacataaatgaacagtatgacagaatggaagcagttcacaggatttctaatattacctctcttttcctcggtccacattctaatattccaatatgctcctcagcacacagagtggtccaagaagattggccattctttccggaagttggacttccctgaagattatgtgggaatgggacgtggaacctgataattttttttgcagaatgaaaacttttatcatgaagaatttttctttattgcatacttttatacagttaggccccaacccgggaattagtggtattccaaaagttcctttttaagttgcttgtttgaaattaagaatgtatttccctccaaaaatgatgttggctacaatctaatttcagacttgcgatgaacccaaggttcaaagaggttaaatctgaataaatacagttctacaattctgtattcaaagccattgagaccagattttgctgaatttggatttttttttttttttgaagaaggaaagaaggataatattgtgcatgtaccagtcatatagcagtgtggtctggagcaggatcctataatcaagcacattaatatttctgcagtgaaactgatgaatattcacacgcagtggataaataaaaactataaatagcctcatgtcagttcaggtcaggtttgtcaccaaatgaattcaggccaaatgagttcaggtcaggtcaggttttgctgccaaatgaattataaaaaaaaaagaatggttttcaccacttttggggtttcagattagtggatctttattacactttttttaaaataaaaaggcactagtattataaactttaaccacaatgtaatgttattttatggaaaaacgtattgaattcctattaaggaagccaataagtcattgctgtattgcggccctgtagcaaaaatggagtgtttccatcaggctggagtcagagcagaaaaggacctcctctgtaacccaggagagagagggctcttgtcaggcaggtactggtgatagtattgggagacctagggctgggaactggggaggggcatgagacagggagacgggaaagcaagggtgagtattattcttttccttctcccttattcatttccctactttttctctttttttccttcctcttaatttttcttcttcttttttttttttcagatgtagtcttgctctgttgcccaggctggagtgcagtggtgcgatctcagctcaccacaacctccacctccccgcctcccaggttcaagtgattctcctgcctcagcctcccaagtagctgggcctacaggcatgcgccacagtgctggctaatttttgtatttttagtagagacagggtttcactatgttggccaggctggtctcgaactcctgacctcgtgatctgcctgccttggccttccaaggtgctaggattacaggcgtgagccaccactcctggcctaatttttccttcccttttaatgctagggcaaggagcatggcagtggtgtcaggtggccttacacttccctcttctcccactctttccttcagactacctgtaaagacactggagggtgctgaaataacaccgcttttaaaggtagttagaccacagtctcagtcttggctctgccctctggctgtgggaccttaagtggtttgctcagcttgtaaagtggagaaaaaaatatatatatatatgaaatactttatgtaatattatatatcatatggtaagtatacgtttatataaattggagctatgcatatatctttgagtggcatcccagaatggtagagaagattcagtgcagtgttaggtgatagtccctaccacagaatgcgagttcagtagatggtaatatccttcatcattgtttgttgtcccctctcgcaccttccagaaatcctttccttgtctccctgaactctggctgagaagcagggagccacagtgcagctgtgaaggggaggaaacaggcttcttctttttttggttttgttttattttatttgagatggagtttcactcttgttgcccaggctggagcgcaatggtgcaatctcagctcacggcaacctccgcctcctgggttcaggcgattcccccctgcttcagcctcctgagtaactgggattacaggcatgcaccaccacaccaggctaattttgtatttttagtagagacggggtttctctgtgttggtcaggctggtctcgaactcccaacctcggatgatcctcccgcctcggcctccctaagtgttgggattacaggcatgacccactgcgcccagccaggaacaagattcttaagcgttgagtatggcaaggcatactggggaagtgatctgcaaaagcatgaaagccccaaagtgtgggtgtttgtatctggtctgactgagggatccagtcccccttcgggacctgcttttggctttggtaaatcctaagacttagaggtttctggaagaaagactaatctgcagtctcttctgggagttgattggaaacaggtatctttggggcttacccagagctgttcacagatgtgagggctgatagtgccttgccttatcccatggccagggcctagcaggagtagcagtaagccctccaagaagccactagaaattgcacagctattctaggattgacatgggccctggctggtggtactatagctcttcatattaactgcatgcaacctttcaataatattaagtgcgtaacatctgccaggcactattctggggacatgatggttaatgacctagacaagatccctgctgtcatggaaacaaatgagggaactatgttggagaatagcaagatgagggtggatgggtgagtgagggctgtcagaggaagtgacactgaagctggcacctaaaggatgagcaagaattagccatgccagtagcctcctagctagagaggccagcaagttcaaagggccaagatggggaggagcttggtgtgttctgggacctgccagaaagtcatattgttggagcttcatgagcaaaggggagaggatccaggattgagccagaccttgctgagccttataagtcctggacaggagaatggattttattcaaacaagaagcccctgaaggtttttaggacagggacatagtttgcacagaagagtccactttgcctctctagtggatgtcatgctatattaaaaactggcagagtgctgggcttcttcagtgatactccagcctttcccttgtttttaactcacttataaataattttaagtcacttttcctctttattttttaggttttctcttcaaatccaattaactatcatcattaattaaagaatatgtgagcagtcatgtctgtagtattgagcaattctcctgttatctgttttttgctttctattatgggttttatctatttatctcccaacacgcccatcatttgctgccagcactggcatgctttctcttttaagcttttctcttttcctccctgtttcagatttgtgatagactctttttgtgtttgtccatttatttcaagtccgttaggggcattttctcttgtctgtgctgatttgctttatagaacttggttcagtacaacaaacctaaaacagctccttgtacatagtaggtactcaggacatgtttgttacatgaatgaataaacctttaggggcaagatctcctgggcttttgtgaagaacatgcagactaatacattatgttcctgcccttaagcagactactgttttagcagggctacttcagaacctaaagccaatgtttgcaatagaagcctaataaaggaagaatgtagaagtgtgcaatgtagaaaggaacttcgggcatataaatctgactccagaacctcagatccagcctctattctggctttttagtaggcgagttcttcaagggagagggaagtgtggttatcatggacaactgaatcggggctttattcacactaggagaaatgacccggaacttggtaataagatgaaagaatgatctttcagagtcgtagtagagcgttgtctaacaagacctaaggctcatctgattctgtagaggatgtgacttcattttagatgttaacttagagaaaactgatatgatgcaaataatttctggcaggtagaaaagataactctaaaggttttgttttattgtcctatagaatattcacatactacataaaaaaataacaaaaaatacatacaaaaaattctaaattacatacaaaaaaacctacattttgtatgtaatttagaatcttattccagtatttttttttctaaaaccgactatatgtatcaatttcttagccaatttactgttttcattaatgaggtatatgtgtctttgccatgctcactatatatttgcatgtggattatacttttaacattttgaaaattatattttgacattcatattcagtaaagtctttagacatgaatgtacatgtcattatccaagttacctaattatatcataccatgtaacttttaaatggacacatcgcagatgtcacaataagggaaattatagtatgatagagaggtaaacattttacttacagaaaacctgaactttaattttaagaggttctcagagggactctgtctttgtagaagttcgatagaaacaatcttagttaattttaggccagcctcagggaatgctctcactgaactgacctggtaacttgcctgtgtctactatactctttcttgtattgtggaaaaaataaaaactgtaaacttgagagacattccacaaatacaaatcttgcttcttttgcttaaaaaaattatgaacataattatagaaaaaagtagattctggttgtttaccataaagaattactactagaccaatagcaaaggaagttacaaagcacagatcacaaaaatctctccaatcacgtcaggaagttcagccctggatggtgtttgtttacctacagtgagggcagtctgtcaccagctgatgccctgttgagagcctcttgatctaaacaggaggttcagtcaatcactattaactgaaacctacattaatatgtattattcctcattaaacactgttaagaaaatgaagattaatacatgctgtattttgaacagatgacacataaagacaaaaactaaggaagcaaaacatagtacctgttggtaaaaacttcccaatcactgcttaaacaaatcctagtactgacctcaatcagggttttaaatacttgactctaaatcctttatcttgggccaggcgtggtggctcatgcctgtaatcccagcactttggaaggcggaggcaggcggatcacttgaggtcagaagttcgaaacctgcctggccaacatggcaaaaccccgtctctactaaaaatacaaaaattagccagggtggtggtgtgtgcctgtagtcccagctactcgggagactgaggccagggaatcacttgaacccaggagaaggcgctgtagtgagccaggatcgtgccactgcattccagcctgggagacagagcaagactctgtttcaaaaacacaaacaaaaaatcctttatctttactttgctcctttcaggatagctctggaatttgaatctgctttccagagctttattctcaactgccagcctcatttttcatactgtagttacttaagggtggaggtagtcgggccggcaagtaactacctgcagtgtacttgagaacctttgaaagcatctgtacttgccaagggtggggcatgtatgcttgagagccctttaaagcgtctttacttgctaagggcgctatgaccattcccattcctgggacttcattcccgctgggacctcattccccagtggagggtaaagcatggcttttgctgacggtttccaggtagccttccaaagtatgttagcataaaggactggagatgctgaccatctggctaactcatgattcagaagccctttggatccacttataaggccattctatttaggcctgctaaggatgtctgccatgctaatgtcaaaagcagggattttaggttatgttagtgatcagtgaggaattttaatatgttgttttgtcaactactgaggctataggcccttttaggtcttcaggagaagtagaccagtaaaataaacactgtgtgtttaagctatgagagctcaggatccctgtggttagcagttatgaggcacttggacacatatttatactaagagttgtagcttttacttatcttgggtaaaagaaatactccaaacagttagaacaaaaaaatatatctgatggtaaaatggataatgtattagtccattttcatagtgctatgaagaaatactccagattgggtaatttataaagaaaaagagatttaatggactcacagttccacatggcagggggggcctcataatcatggcagaaggtgaaggaagagtgtattagtctgttttcatgctgctgataaagatatacctgaaactgggcaatttacaaaaggaagaggtttattggacttacagttttacatggctggggaggcctcacaatcacagtcgaaggtgaaaggcacatctcacatggtggcagacaagagaagagagcttgtgcagggaaactcccctttgtaaaaccatcagatcttgtgagactgatccactatcatgagaacagcgcaggaaagacccgcccccgtaattcaaccacctcccactgggttcttcccacgacatgtgggaattgtgggagttacaattcaagatgacatttgggtggggacacagccaaaccatatcaaggagcaaagtcacgtcttacatggtggcaggcgagagagtgtgtgtaggtgaactaccctttatgaaaccatcagatcttgtgagacttattcacactatcaagagaatagcacaggaaaaacccacctccatgattcaattacctcccactgggtccctcccattacatgtgaggattataggagctaaaattcaagatgagacttgtgtgcggacacagccaaaccatatcattccacccctggcccctccaaatctcacgtcttcacatttcaaaaccaatcctgccttcccaacagtcccccaaggtcttagctcatttcagtgttaacccaaaagtccacagtccaaagtctcatctgagacaaggcaagtcccttccgcttatgagcctgtaaaatcaaaagtaagttagttacttcctacatacaatggggtacaggcattcagtaaatacactcatcccaaatgggagaaattggcccaaacaaaggggctacaggctccatgcaagtttgaaatccagtagggcagtaattaaatcttaaagctctgaaataatctcctttgactccatgtctcacatccaggtcctgctggatgtaagaggtggtctcccacaactttgggcagctctgcctctgtggctttgcagggtatagcccccctcccagctgctttcactgctggagttgagtgtctatggcttttccaggtgcatggttcaagctatcagtggatctaccattctggggtctggagggcgtggccctcttctcacagctctactaggaagtgccccagtgggaactctgtgaggggctccaaccccacattttccttctgcactgtcctagcataggttctccatgagcgctccgcccctgcagcatacctctgcctggacatccaggcattgccatacattctctgaaatctaagtggaggttcccaaacctcaattcttgttttctgtgcacctgcaggaccaacaccatgtggaaactgccaaggcttggggcttacacccattgaggccatgacccaagctctaccttggccctttttagccatggctgggacacagggcaccaagtcctaggttcacacagcaggagtccctggacctggtccatgaaaccattttttcctgctaggcctctgggcctgtgatgggagagactacctcaaagatgcctgacatgccctggagacattttccccattgtcttggcaattaacatttggctccttgttacttatgcaagtttctgcagctgacttgaatttctcccaagaataggggttttcttttctgttgtatcatcagcctgcaaatttttcacacttttatgctctgcttcctcttgaatgctttgctgtttagaaatttcttcctccagatatcctaaatcatctctctcaagttcaaagttccatagatctttagggcaggggcaaatgccaccagtctctttgctaaagcatagcaagagtcacctttgctgcagttcccaacaagttccttatctccatctgagaccacctcagcctggactttattgtctatgtcactatcagcatttttgtcaaagccattcaaaaaatctctagaaagttccaaactttctcacatcttcctgtcttctgaggaagacattttcctatcttcttcttagccctccaaactgttccaacctctgcctgttacccagttccaaagtcgcttccacatttttgggtatctttatagcagcacctcattcccagtaccagtttactgtatcagtccattttcatactgctatgaagaaatacttgagactgggtaattcattaaaaaaaaaaaagggtttagtggattcacagttccacatggctggggaggccttacaatcatggcagaaggtgaaggaggagcaaaggcacatcttacagggtggcaggcaagagagcatgtgaaggggaatggccctttataaaaccatcagatctcttgagacttattcactaccatgagaacagcatgggaaaaacccttccctatgatttcattacctcccaccaggtccctcccatgacatgtgggtattatgggagctacaattcaagatgatatttgggtggggacacagccaaaccatatcagatacagttcccaaatattgccttatccctcacaaaggagtggtgggcttagaaggccacatgtcagcagagtcctgcatctcctctgcataggtttatatcaccttctaatttggaaaattttttaaatctctgttctagctttgtcatatgccctacatgacagtggaactaactaccctatgattttcacctcagccaggcttagtcttcaggttccaggtgttggttgtttaacagcatcacaaaacctagggctcccaacatatgaatacacaaacttacaaataagacaggcatttcagagcagaacatctggtgtttgtctgccccacaggcgtacctcctttaggtgtaattcattggaatcccagtcagccgatttaggagcctaagtgcattagctcatggccagtgcactgtagccacatactgtagtttcttcaggttgagtgatgcttattgatctgttagtttgctccgcagagcccctctctgccccaggtaacttactttctgatggtaatattttgatagaaagtaaataactttgtttcaataaaagaaaaagtagcatatgattattttaaagattaaggtacagattggatatttttggaaaatttgctgctttttaggcagatgaactgttaggtgggtgtgggccatgttctaagcccaactaaatccatctttagaacaattctaaagaaagcagaaaagataaagatatcaagtcataaatgtatacttgtttattgagcatggtttaaaattttaatcagcctacaatcagccctggcatccttgattccccttactttgttgcactttttaaaaaagcactaataattatctaaaacactaaaaaatttatttatgttcattacttactgagtatttgccccttcatcctccaagtgagtggcacaggtcaggcatctttctcttttttgttcaccaatatatctgaaatgtgtgttacagtgcaaataataaatgttcaataaatacttgttagtgaatgttgggaatgactcaccataagttcagcgatattaagattagttaagccatgatccagtgaatatgtccatttttaggaaagcaccctcactaaaaggaataaaattttgttgtaagacttaggcccattactctggccctggtgaactggaccagaccacttgtaagccacacagggacctgccacaaagagagaggagataagacagagcctggatctctaaggtctagagcggagctggtttaagctgttttattccagggccttccttgttcactgctgcatcctcagcatccagaactgggcctgctgtgtagtagatgctcaataaatattttttgaatgaagaaaggcaaagtccttctaagcagtaggaagcctttctgtataggagtagaagaaggaggaacaatccaaagaggaaatgggtccagtgataagagcttacaagaacatgccatgtaggcacaaaaccttaacttcttggcacatcaggtatcagggaacttccaggcagtgcaggacacacaacctcctagccttcatccacactggaaggtatctctcattctcctggcacacctacaggtgggaagtcttgagcactgtcttgaggctgaacccgccactgacagaaatgattcagtttaacagaaaatcagttaatttatttgccagtctatttgttcacttgattaccattgtcatggctgagtgaaattttcatttaagggatgaatgaattgtaaccttttaagcaccatcacttaaaactatccaaccacttttgttggaaaatttactaaaacatacgtatatttccccatcttcttaataaagcattagaagattttcgtattatctcaagatcatttgggaaacattgtgctgttatatagtagtacacttagagtctactccaggtagagttttcattatgccgaagaccatatattgtattttttgaattctcatgcctgtttttcttggttttactgtcttctctctctggtaggttatgtgttcattttctagtgctgcctatgtggctgccccaagagtctccaatctcccaaaacatactgtccctggttatctgtagaaaaatagatggccaagtttattagattcatctaaaatacaaaggaagtttaatgtatggactttgtgatacccacaagcctcctgtttcatctctcccatctctagttcttctcagcagtgctctggaaaattgggctcatcagacatgtggcttctggagaaatgaggttttaataacttgtcgtttttctgttccaaattttgagagtagcagtatatcactgcttaaaatgtgctaatttttgagataacttttcttagcctggttctcattagagcttaagaaggagacaatagcaataggacattgtttgctcagcctctccatttctgtaggaaaagaattgttaggaggaggaagggtagggaaaaaaaagtgcaggggagtgtcatcatctggtagatagtttaaaaaaattcctctggctttggagtaggaaaattgattgtagaggatccaggaggaatcagagaggctgttgaagaggctatggtagctgtccatgtgagggacaatggcttggacaagggtggcagtggtgcagatagaaaagggtggttggactcagcatacattggaagaagagggcacaggaccctgtgtcagatattttggtatattcctcctatcattagagtttagtcatgtgtattcacaccccacatttgtttcttctaagaaatgaagtctatccgttaaggaaatgtcagttaatcctcattgctgctgttatcatggttggatttgctccaaaaggtatgttaccatatatagaattaaaaccagtctctaccctgtggggaagtaatgcagatgttttgagattagagtttagaatctattccaaagatctgccagaacacatgtttaacaatgagcatgagagttttccccattgctattcttactatgttgtttatcaaacaaagataatttgggggcttgtgtagaaactccacaatatttaagaaaataaacacaaatctctgagtcaataactaaatgtttctgatggtatactaagaaatataacttattttattaatggttattaatataaccatgacttttaaattaatattaatattaactgatattaatattaatgtaaccatgacttatattaatggttattaatataattatgacttttaattcttttaattaaaatatttgtggttctttatagttcaccacagctttgaataaaacaaaattgttttcatgttttaaatgcagtggaaggttttatgtttggtgttattcaattggtaaggcaaattgctttgttattagcttgatttacgtgaaaatttagatttaattttagatttggtagattttaatctgataccattttatattggtttatatctgaatgcttcattaagatcctgggtatacacagtttaacctcaagcatatagtcttattatattattttattataagaaacagaagtatggaaacttgaggctgggactgttcagagctaaatcttatgaaatgaaataagttcttgtaatcattttgcagccattatttgttgtgcttttgtggtattttgtctcttttgagctatcctcacaggtttccaggaattcaaggcctaagaaacattctactaagaacttgaaataccaaggcatttaatttttggaagtgtagaatgttttattacttttgaagttttgaggaccagcaaaatagagaagtgtattgtgttacacaatttgctatgttataaatgtttacttttagtggacatgatgtaactagaatggaaaaaaacacagaaatagtaattgttgatataatcttgccttggaggtagcgatgggtgggggaatggggagtgggaacatagcatgagaggagaaaaaaatctgttaccaatttatggtaaaattattacagttaaaaagagttgcatatatgaataataataaaaccttcacccagctttcttgaaagtttacaaacttcctttctttgcttagaactagctcgagaaaggaaaaaaaaaatcttctcttagattctttgcataaaaaactaattcctttatttttctcaccggttctcttcatctttcattttggtccccagagaatactgtttgactattttgaaatcatttctcttctccactttgttgcactttgccctctgggatcgtttccccagctcactcttcttcctttgtcctactgctccctttacccccacctctctttctatagccaagaaagaaacttgttaaccatgactttttcttttaggaaccaattcaaaaatccctttggtacacaggtttacaggcaccctatctcagtctgattccagaaaaaaaagcaccaggaaatacaggaaaatatgtagctattaataaattccacagataggcagaagttgccaaaggaaaatgggagaacaacaaggactgttcattggacttccaggaatagaaattgttgggagtctactcttttcaaaataaactgacatggggctgaccaccttgtcagttactcccatctgatggtggggtgtggcaaacaagggcaaaggtattgtttggttttcaaggtcaggctgctaattgtataattggattaacccagcccgcagagacatggagactaccagtcacttgttagcctgggtcccaaggtagaagcagcacaaaagtatggggaggatgttcagctgaaatggaaggaagaaagtaaagaggatagagaaaaaaatacagaaatgttagccaaaggagttataattaggagaaaaccattatcttattaatctctgtgtgattaattaattataaatgagttttctcttggaaaagagcgaagctacttagtatgacttgtggggagagtgtgtgtgaggagaagaaagtgtactttttctgcccaattatggaaggtcttaaacatcagccatgtttttaggagtttgactaataaatccagaaggcttattatttattttatccaggcatgttttatttactatgagagatcttcttagttcttgcttttgttttgtaagaaaaatgagctaggttagcagtgtccgttttctgtttttagaaaataagatgtctgagatgttagaatcttcacatataatttgtcctaccccacagtcagcaatttcatatctactgctcacagtatgcccaatcagagcacagacaggtgtgtgatggtggcttctcagtaggaatttacatttaagggcgcttgtcttcattggtttgtttgccattcattcattcattcattcattcattcaacaagcacccactgcataccagcactgttgtagggatgtttatcctgggtgagtgtgagaatcgccttactcttcaggtgcctccacagttctctgctgatttctttagtgatgatttgctgacactatgcacagtggtagaggtggctttagcagatattggaagggtgccccagaagaagtgagtgacatttgagccaaaacctaagtgatgatcaaggggaagactggttcaagcagaggggcctgtaaagccagggctgtaaggtgggcatgtgagatagggagaggaagccgctgaggtaggagtctagcgaacagggtgagaaggggtaggagatgagactgggcaggctggcagtgtcttcaactctggctgcactttgcagccattgaggtggctcaggccatatcacagaccaattcaatcagaatctctgtggacccagacatcagcattttaaaaaaattctccaggtgactctaatgtgagtttagatttggtctgattacactgggaagctttggaagagaatgatagactcagcttttcattctttaaaaggttgctttgaggctgtgtgtagtgtgaagggtacacgggggagaaggggaaagggtgtcttcaggaggaccagttaggaggctctagtggtggtttgagtgagagatgatgatggtggcttaaacaaggctggcagtgaggacaactgggagaagtggtcactttcaggaagtgaggaatgagattaagagagaaatcaaggatgactcgttgtttggggaccagaacaattgggtgggtggagtggccatttatagaattagggacgacgaaaggaaggtggtacaggtgggaggaggatctgcagacctgggatgtcatctcattcccattatcctgggctcctagaagacacagctcacacttcctacaactctttaagttcatacctctattatagcactagtaggctgcacattgcctaatatggactctctgccttattttcagcaaaattcactgtgtgaccaaattggtattatgagcactagtttcatttcatgacaaataggaatagagagaaaattctcaataattttcccagctttaattctctgttgctcagcatgctttgagccctgatggatttctttcgatttttcagaagaatcctgcctatgctttaatataaaggaggatgaatacggcagattcagaaaattgtggtgtcaaaggatgagctttgctttcctgccatcttctgtgctttgtttccttccaaccttaaaggaaatactaccctacttcaataaaaaactaaaacaaagattcaactcagcagaaggaagagcccaataagcttaaaataaatttgcaaaggctaataactggaaaccttttttaagctaaataaaagccttgtgtttaaagtgatagtctgccttttctggtctgcatcatgatagcttctaaataaagaaaacgggccgatgttgtgagtaattgcagctgctactctgggggttacatcaggcaagtgatttgtcaataagaatttattgtcttcatttctgggatgaggctgagggcaataaggaattcagaaggctgcttccttgtctttaaggggtttgtagtccattggagagatatgtctggctttcttgaaccagttaacaaacagttacattagatgtaattggaagctaacttatagagatgagggcagtagacattaaaagaaaggagaggtcaggcaggaaaagccatgaggtcagtaaaggcctcatgggcaatagggcttgcctggcaaatatttggctgaggcaagttggaagttgagctggaccttaaatgatatagagacctttatttaccgttatgtgctaatagttaaaatttacttatttgggactgctaacatatgctcaagttaaaaatgccaaaggtctcctttctattcctgcccccagtccctcagtttccctttccagaagcagtgctatgactcctttcctacaaacccttccagatacagtatcaaactttttttttttacatatatagcatttcttatttttttatttgtaaaatttgtccttttccaagtgctaaaacagtaaagaacaggtaagctaaataaaacaaaaacaagtcaacttccctgtggggaggctagaacagtgctggtctcattgactagtggggagcagtacatgaatgaggtttgcttttcctaagatatttgccttctcattgattggagtattggtggctaaaacgtaagcaactctgaaccctctagcacttacagaatggtgataatattgtgttgagtgctatactatgctagaacttcacatctgttttctcacatctctgtaaggtgagcctttccctcccttgacagatgacgaggctggaactcaggctaagttagcctgttgtaggccagacagcaaataggaggtagagctgacttctgacctgaccttttcctaccatattatgctacccctctggatctaaagctcttggttctgtatttctagtatcattgttgctgttttcttttatggctttacatactgagtccttggtatgaacttggggtgacccaagagaaaaaagtgagtggaaactaacttcctctctattaaaaaaaaatctgctcaaaggagaagggcaaattcacagctcagtttcagggggctgcaagtcaagtcaatattttcttctttttttttttcatgtggataaactgcctccctcattttgagttttcgaatctgaaataatgagagtctaatgaataacaaatatatacctctttttcttcttttaattcttattagcattttggattcaagtctagaaattcctcttcatttttttttcttttttgtctaacatttcttttgaataaagagtattacctacttttaaatgcaaaaaatggaaaattgggaagacattgtcttcttgctttttgcagaggcaacatttttattagtgtgcatatgtgtaagtttggccccaggctgtgctcacaatccccaagcccctggcagaaggggactccagggtccccccatctcagggatgacatgtgggtcagtatagtgtcaggatggtgatgatccactggctctgaaaccacagaaatgttcatcagtgtctgctgccgcctacctgtggccttcttgttaaatgagagaaataaacccgatttcttttggttgttctatcattcctgcagcccagaaacaaagagagggtatgactggttcagggaattttattcagtctggtgggcagacagaatgtgaagagccagccagggtcccaagatgatgctggagccattagcacggcttacattttcaaaggtcttgtaaatcacattatggttttaggatgtttttcctgggcagttattttaatcaggggatcagacatgatcaacttttttttttttttttttgcttaagaacgatcactctggctgctctgtgagcagtgaattggaagtgacaagactaggggcagggagacctgtttggaggctatcgcactaaccctggtgagaggtggccatggcagagttgctggagggaagggggagaattctagaaatgtttagggatacaagagaacagggcttgatgtgggagatgagagagaaggaggactttagggtaacttcaacatttcttgtttgtgcagctggttggttggtggcgctttttggttgacaaagggtatacagaggatgatttcttagtcctcttattgatagattttaatacaataaagtcatctcgaagtttcagatacatttcttcatgctctttctaggtttttctttcttttacatgtttcatgggtgggggagggtttaagagtctcaattgctctggaaattgaccttcctgctagggaagagatggtggtatccttatgacagttttcttccaaattgtggaacgctttgtggtatttagtaatcatatttttggttttttttttttgtctacagggagtggaattactttcatagaaatatataaaaattcattttttctctcctaatttttttttgtgatacatttttctgtaaggaggaattataggacttaactttctatgagtgtggtaaagaggataaatacctctgtatcctctttatataaatgaaaggcatctatccagttttgaattatttggggaaaaaaatcccatggaggaatgaactcgagataattaaatttctccaattcagaaactctgaattttttttttttcttattaggaaagtggttgagatatggctgaatggaaatttaaaatcttgagcatggttatacatcagaaacgtaacatgtagtctaggtccattccagagagcaaaaaagactcaatatttttgacattattaatgaatagattgatgcatttgttatgcctgcagagaaacattattttatcacgagttgcctgcagctcagagagtaaagggcttttggaagagttattcagagagaggtcaagggggagttactggttttttgtttttacaaggaagttttagtaaatcatattaatagtaataataataatgatgatggtgtacatttgcatagcacttggcagtttacactgctctttagagtgcgggatccacgcagctctctgtgaagtaagcattttataggtgccaaaacagattcacaaagtgtacctgaggtcatctgtttcctggagctgtaatttttcccaataatcagtaatattccccatgcattacaatggtatccacaatgcagctgtgtggggagaaggtaagcctctttattgagggtgagagggcatgaaccggctcctgggtgcgccctcctaggattgagttagagtttgcaatattaaaagcacaactccagtcacacctgtggatggtaacaagatgctagactgagcacgataggctatttctcatttttttttcctagtaaaatttatttgttctttgttctcatgtcttctgttagcattctttggaaaggcattagttagtgccacaggttttagaaaaaaactaagggaaaaatactaaagctgagaatgttttattaagtttttttttttctgtgaattagtaaaagactgtcatgtatgattttagcagaataccttgatccagattgaggaactccaaccagtaatcctgggaggcataatttaagaaccgctaacagaagcattttgaaagtgattgaaattgacattccttaaaaaggtagtttattgccttctgaggaacatttgtttagctctttaaattattcatatttgaagggaaagcattctacaagaaatcttatttttgagatatagctggtaaatatggaaaactcaaaacgcctgcctgttctacttgtcatcgttcatcctctgacagcttacaccagtcaagttactaagtctctggttatttttgagactctttctccccaagcgttccttagtgaatcttaagattctgggatttagcttagcagacaggctgtgccaccatgcagtgtcttctttggccctccctgccccattgcaatgtcttttactacaccttatttagccaaaaatgtgcagtcctttagtgatgagaatgtaataatggaatacttaaagtaattaaagatactgctttttctgattgaaacaaaagctaatagacttccaattgtcacctgtcacagtgtacttttttggagttgccctttgagctgtgttatctgatttgaacttttcaagcttcctctggccacactgggatttttctctggctatgccctgcagtccctttactgaattggcagtgctcctaatgcttttctctagctttcatttgaccttcagtagaggttaaaattaacttcaaggtgaaactggtcctcgtgattggtcgattgcttctctttcttgagcactgcacccatttcagaagacagatggttttagtattaatggcatcaaccatcctttgctggaagataaagagtcagactttctatttggaatgtaagctccttgagggcactgagcttgtttattcaaccttctattcctagtgcctagaacagtgcccagaacactgtagaagaagatgtgttgattaaaggaatgaaactttcctatagggactctcaagagatagctggcctaacttagaatagaaatgtgtgtgccaaggactcgtggtttcaagaaacagatactcaagtgggtgtggacacatttccaggatgttctccctctcacatgtacccaaccagaccctcgggccttgtcctttctgtctggttctagggaaaaagcccattgcctgtgctttctaaaataataaatctcacattcacaaaggatctggtttctgcatgtttttctgcatgttccaagctccagccatgtgcaagtgatattaacaaatttatttatgatttgttcgtatcctcctccttccagagattggttgaaatattaaactgttcatttctattcttcacttcctttaagccttaattggagccacttcttctattggataaacgccttccctggttggcctcgtttctctcaggtcccttgtttcactttgtgtttcctcagttgccagtaggctgtgctgtgatgctttgcatttatttggttatatcatgtatacatttattctgtgtcctctattagatactcttgtcgttttttaagctaacattcattgaggtttattgtgtgtcaggtcctgtgtttagggctttggatcctaaattatcacattaattttcacagcaactgtttgcagtaggtggcattatccccattttacagatgagaaacctaagttttagaggagagacacacccaaggatgtacacctagtaaatggcagagctggggtttgaatctttatgcatttaatttaaaagcctgaatcatcacatttcacaccctcttagaggaaggcagggttcatgccatctgcttcctccaaccaccaccactcttcagcagtataccacagaatgctgtaagcttcttatgacctgaaaagatgtattttaaatgcaatcaatacaagtcttctgaagaaatacacacaagcaaattcaattcaacaccaccaaaaactccttcaattaagataaaccagtattgacattttggagtatatctttccttgtttcttttgcaaagaattaagtatatacattggaaacactcttaaggcttaatgcattctgctaataaatttctccttcttagaaccaaagttgtgtgctcactaagagccatttgtttttttcttagtactgtttatgccaatcgaacttactgtaattctgtaatctaattagatattacgtaaaccaatgaaatatgagtataaaaatagagttgttgccactaaaattaggttgaatgctttagcaaaatgtgataaaaacaaatctctaaaacaattgctctagaattcagagtaggtggaacaactgaaagatttgaaaataaatgttaaaagtcacaaaggattcaacattcatattgcttcacaagtgtatttaaatttttgtttcatgttaaagaaattgaaactgaaaatagagaagaagatggattatggatatgatttatgcaggaaagattatgtggaattctagccagcaaatactcaagtcctcagtgttaaagttaaaataaaatgttttaggcagcaggtggtttttttttttttatgaatcctcactttcactagcttttgaaattaagcaattaacttctgatcctaaatgtgttagataagaatgcttctactctatatatctcaaaaaagaataacataatttgctaagcagcttttttcatgtaatatatcatgaacatgttttcaagccaataaatatggattaaaacattttctggcaatataacgtacatgcagaaaagtacacagatcctaagtgtacaactcagtttatgatcacaaagtgaacacatccatttactgccctctacttaggtcaagcaacaatattcccagtacccccagaagcctcccatggcctcctcctccccaccagagataatagctactttgaatctaacattataatgtttgttttggaactttacgtaaatgaaatgtctgtagtttttgatttttttacttactttactcaatatttgtttgtgagattcatccatgtttttcacatgtattatttgtttattcattctcattgcagtttattatttcatgtgaaagaagataccataatatttactcattctgttgtttttgttatatactttatttatttttttttttggagacagggtcttactctgttgccaaagctggagtgcagtggcacaatctcagctcactgcaatcccacctcccaggttcaagtgatcctcccccaagttagccgcctgagtagctgggactacaggtatgcgtcaccatgcctggctattatttttgcattttttgtagaggtggggtttctccacgttgcccaggctagtttcgaacttctgggctcaagtgatccactcgccccgccctcccaaaatgctgagattaaaggcatgagccaccactcttggcccaccattctattgttgatggccattggggttgtttccagttgcgggctattatgaaaaatgttgctatgaacattcttgtacatgtcttttggcatacgtgtgcagttttaaagttgttcatttgtttatatgccttaggaatggaattggcaggtgataggatatgtgtatgttcagctttagggaatactgtgaaagtggttgcacaaatctacaatcccatcatcaatttatgtgagttactgttgttccttatctttggcaacacttggtttggtctgtcttaactggttttatccaaactggtaggcttgttatagtctcttgtgattttaatttgcattttcctgttggctaatgagcacattttcatatgtttattgaccatttggatgtcttttgggtgggcatgttgaagtatttgtttagtatttgtctcttgcctacttttccatagaactgtcagacattttctcatttatttgtacttatatattctagatgtaagttcctttgttggttatatgtgtcagcaatgtcttcttccactctgtggcttgcctttattgctctcttagtagggttaatggagcttcccaattttaatgttgtccaacttaccaatctttctctttgttgttagtactttttgaggcttgttcaagaatcttcacttatgccgaaggtcatgaagatatcctcctatgttatctttttttttttttttttgagacggagtctcgctctgtggcccaggtgggagtgcagtggcgcaatctcggctcactgcaagctccgcctcccgggttcacgccattctcctgcctcagcctcccgagtagctgggactacaggcgcccgccatcacgcccggctaattttttttgtatttttagtagagacggggtttcaccgtgttagccaggatggtctcgatctcctgacctcgtgatccgcccgcctcggcctcccaaagtgctgggattacaagcgtgagccaccgcgcccggccccctcctatgttatcttttatcaactttattcttttacctttcacatttagatctacaatccacatggaattaatttttgtgtatgttgaaaagttagggttaagtttcattttatgctacattaatatccagttgctcaaacagcacttaccaaaaagaccatccattccccattgctctgccatacagcctgttccataacataaatcaaatatccatatatgaatgggtccagctgtggactccttattctcttccactggtgtatttcccttgagctaataacacatactttgattactgtagcttagtagactgaggactacatcttcttcttttcaccagttcctggagattcttggttattcttgatccttcacatttccaaatgaaaagattagaacagcttagaacagcttgtcaatttccacaaatacacacagagacacactcagatttgcagagatttttaatgagattgttttaaatctatagatcaattgcttttacaatcaaatctctaagagaattgatgtctttgcaatattgaatcttcctctttgtacatagagtatctttccatttatttgtgttttctataattcattgaaagttttatgttttagttatttatcttcaacataattctttccaatggctatagaatattttttggttaacataaaaatttattaattaatctccttgtgttgtaaacctaggttgtttctgttttgtttcattgttgtaaataatgtgattatgaacattcacaagtatacatattttagtgcctttctgtctccttggaattgactcctgaaactggaatttctggaacatacagcttgcaccttcatattccccagtgagttctatcattttaaactctctcccagagttataataggttccactcttgtgaacctggagaataactcactgtattttccatttgaattttttaattactattgacagtgaactagttttcatctggccatttgtagttcttttgtgaatagccttttcatggcttttgctcagtgtttttatattttcctattacttaataattgctctttctataccacatataaccccttgtcacgtgtatttacaaaatatgtctgtgtgataaatgaattaaccagtatacgtttgttactggagtggaactttacagaagagcacaaaaagaaaaccttgttaagcctgttggaaatgtgattattccctgaatgtttatgtcctttgcacatttaggaatatcatagcaataatgaacttagtagtagggacaatcagcaactaaatgaagtagaagacagataatataattgcatgggaagaacatagaaattagatccagaaaactgggttctagacatgacctcactgctctttacctccatgatcttgattaaaccatatattctctctgagtcttaatatcttcatctgtatagtgggtgcacttatacttatttatcttccaggtctaagatgagatcatatatgaaaagcaatagtgcaaacagtgaaagttataccatagaaattataatgccaacaaatatagtgtaagtgtggcaagttgaatgtatgctttatttaaattatcgtcttttgaggtaacctaatttataaaatattcagcctaatggccatcattctgagtctgtggtttgtgagtttgtactaatttgcatgactccttttaaaaagaaatggtttgttgtttgaaaaaatcaagttgacatcctttgtgactgttcagagtgtgtttgtggtttattggcttctagggcattaggtttctgtctcccatattgacagtctttatgagctcgttagccactgttctggtaaaagccattttgatctgtgatgagggcactacattaaaagagtattgaagttggaaatctatattttggttctttcattagaatgtgccctttacaaaagaggcaatatgaatttgcattgcaaaggattgcttatttctttttagaactcttgaagtcaggtaatttaattatgtctatgccatagccttttatcttcctctgcaaagaaactctctcttctgacacctcatattggaagccggtcttcttatccccagaattaattaacatgcaaatacttgtctagagatatgggaacagtgctttttcaattagcatttaaatatcactcttaatgatgttagattgactcttttaagggaaaattaaaatagtatagtcatctctggattatttcctagagcatattattgatatttctgaagatatgggcttagtaggagcttttatcttctactgttcacagactgattgagtcagatccagggttggactggacagcaaagcctggttctggccttcctttgcctctggtttcctagctaggcctgctgatcgtgccctgcactgcttctcagtagcaagtgtatttatgtaggagcggcacctgcaggaactgtttgcaactgggaagggtacccagaagcaaggagggaagtatagaggagctttggtagcaatcatctcccaaaaaataaagaagatgaactttggagttagagatgcataggttcaaatgttgcctgtgccactttgaagcagtatgatgttgagcaagttacttcccttcactgagactcaatttcctcatctgtaaaatataaatagtaatatttaccagtcaggttgttaagagggttaaacatgacagtatatatgcaatatgtcttacgtaagtcagagtaggctctctgctgtaacaaagaactccaaatctcagtggtttaacttaggttatgatgtggtttgactgtgtccccactcacatctcatcttgaattcccacatgttgtgggagggacccagtgggaggtagttgaatcatgggggcaggcctttcctgtgctgttctggtggtgacgaatgagtctcacgggatctgatgattatataagggggagtttccctgcacaagctctcatctggtctgctgccatgtgaggtgtgcctttcaccttctgccatgattgtgaagcctccccaccacatggaacggtaagtccattaaatgtcttttgtaaacttcccagtcttgggtatgtctgtatcagcagtgtgaaacagactaatacaggttatttcctgctggaagaaagaggagggctttgcttcatgcagacattcagggacccagatatctttcatctagtggccttgtcattttctaaggccttggaaccctcattgaatcatctgtctctggctggcaggagacgggagagagtgaacatggattgtgcagaaggccaggctggaggtagggcacattgcttccactcagattacattggctagaactcatagccatacctactttgtgagttttttttttttttttttttttgagacagggtcttgttctgttgtccaggctctagtgcagtggtgtggttgtccaggctctagtgcaatggtgtgatcaggcttgaccacctgggctcaatcgatcctccttcctcagcctcccaagtagctgggactacaggtgtgcaccactccacctggctaattttttttttttttttgtagagatggggtttcaccttgttgcccaggctggtcttgaactcctgggctcaagtgatccacccacctcagcctcctgaagtgctaggattacaggcatgagccactgtttctggccaccatagctactttcaagtgaacctgggaaatttgtgcttaagagaaaaccaaaatggatttgtttaataaacacatagtccatcactatgtagttcaccacaaacatatagtaatacttgttgaataaatgaaaggaagaaaaatgaaatgaattttcttcttcatagattcctagagtattagagctgatgggggccttggaagtgatagagattttaccccttcttttatagatgaggagcctgagggcttgaggaatttagtggccaatgcaagatcatccagctgtttagtggcaggaccagaacttgaacccactttccccaaatgctgctgtttattctgcatttaattatttaaaatatcattgttttctgccatagggttgcccttgccttttggaatgtgaagatgggttaggaggtgggaggggggttaaggatgttattctgatcatgatagctagacttcagttttctttggggaagaagaggtttggtattttagggtagatataccctcagggctggaggctctacagcttctcagtaatttgtactgagagtgaaaattaatcttcactcactcactcatgtgtttaaatagcttttctttagtcccctcctatgtgtaacaaatcatccaaggtgatatggatgcaatgatgagcaagatgttcacagcctaaggaaggtgtcaaatatttacacaataattactaaatgaaatgaggagcaaggaagcaacaaggtggaagggaccagctgctagggtggggagggagagggcataaggaaagctttatggaggcagggtcttgaagaatggatcacagttttttgggaatttgatctgtcctgaaatacacacacttgtgtttgtgtagttggtgcaaatcaccttggccagttgtggatgtgcattgagaaaaatgaaagaaagaaactgacaaaaacccaaaatgatgatcaatgctcctgtgagcatttggtgctcacatttaccattcatcgataattttgtcaagtttttaccagtaaatgattaataaaataaccttccagatacagctcaaacatcaataagcaatattttatcacatgccagcaagttttagatccaatgtgcccagcaatttttggttaggtacagacccttagaatttgtaggggcaggggtaagatgcatgaaataacagtaaactaagtaccagtatgaagaggaagacacacacccgtgtagaggatgtgcaaacacgtatataggtttgcattaggaggcctggttttcagaaaggtttctgtgagatgtactatttagagctgagttttggagggctgatggacatgcttaggagttggcatctcaagtatagttactaaatagtggtgaaagagcacgggttactctatagtctggtgtagaggatttttggagaagggggatcgaatggaagttttatagttagtaagtggcagagcttggcttagtaccccaggcttgtctgacacctgtccttctcccatagcaccatagtgctttgctgagaatgtgggtaggagtcagaatcctatgatgctttccgtttggaggttagagtcagggttgccaggggtcgattatgaaacaggtgatgttcattttcagcatcattagctcctctttggtgtgtctcttctctccttggcattcattttctcacacccttcccagctgattcacagtagggtttcagaggactctaggacgtatttgtattattttaaaatatacattttaaattctaaagtatccttatagtaacaattcaagttgtacaaaaaggagataaaatgcaaagtgattttctctttctctaaaacctttaatcctcatctttaaaaaagtatcttttcagaaattttatatggacattcaagcacacacaatatatcctcttttatctgagagaacccatttaatatatgcattttctgtaatttgatatctttaattaatatatggaacagtctttcatacaattatatagttctactttattttattttaatcaacagaatagtggtccactgtactgcttttctgtgattcttatcgaacagtatttaaatttattttcttaatgtctgcatttattatgcactgtgttgcagagaacatccttatagcgatctgcaaacttgtaaaggggttatttgtaggggacttgcaatggaatttctaggttgaagagtgtgtgtatttaaaatttttttgaagactgtgtgtatttaaaattttgatagatattggggaattgtcctccagaaaggcagtaccattttcattgtatccgcagggtatgtgaatgcctgtttcctaaggctttttctttttaaagaggacttgaagccagagaagaggagacaaagagcagagtgggtactaaaagtaagtggcggccaagagaaacagaaacacaggttcacacaaaaacttgtgcatagcagcattatttatagcagccaaacagtggaaacagcccactgttcatccagtactgaatggataaacaaaatggggcatatacatacaatggagtattattcagtaataaagactacagtgtggataacctttgaaagcatgctgctaagtgaagtaagccagtcataagataccatgcatacttatgtgaaatatccatgtaggcaaatccatagagacagaaagaagatagtggttgcttagagcgggaggtggggatgatttgggaaatgactcctgatacgtaaagggtttctttctggcatgatgggaatgttctaaaattagattgtggtgatggttgcacaactctgaatatattaaaaaccactgaattgcatactttaaatgggtgaattttacaatatgtgaattttatgtcattaaaactatttaaaaaataagtggtggcagaatgcatggtataggatggaaaggatgaggatatggtcattctcacgggcctgtgggttgggcaggaagacagtgccatagccagcgagccaggcaaggtgggggaaggtgttctgccaggctatgctgagccaggtattcaggtggctgatgacaatcagctctaggggtggatggtggagttttttcccctaacagaatagagacaagaggcagttgatgccatgccctaggcagggtcagaactgaggttagtacactgaatttcttactcgttgttcttgttcagtccttcgaatacacagaagatactgttctcctggaaggcagtaatagtttcctttgctgacctagaaatgcctgctgtgctccagcatttggaaaaggaaggtcagagagaggaagctgagctcagctgctgagtcaaggaaaagagaaggaagacctaggggtcaccaacgaagatgaggccctcatttgtgaataagtgtagtcagttttaaatttagcaattaagctctttctatatagtggaagtgactgttcttttggaatgtgtttgctagtaaatatcataagaatgtttaaaaggaagttatgattttaagtgacctctgagttgtgctgatggataaaatttagctcaacggaatgagggttaatctcacggtatactcggaaagttaaagggaaatcaacacactttttcaccaaagcccgtttttcctggtgcttgcggctgtttgaacttgctctttgcttctcattccccatcatcgtggctccgtggcatacattaaatcaaaccatgacctccatacattaaatcaaaccatgacctccgaatcttcttagttattttcaggtacaaggttttcagcttcagaaaggacagaggtctccatggttccattttgaagatttttgggtggctactgcttgtttaccagcagtttggtatagaagcccaagacagtccatgtgtggttcagtattgacctaatagcagaataaatttggaccaaacagaagtccttttctttgtcactgtgtttgattaactatcctggatatgctttattctctaaaaacttcatttttgaaaataccatggttattaaacaactagtctttgtgcgtgattaggacataaacaggaatctcacccacttttaaacctttccaagaaataacttttccactgattttattttgaattgttaaaaaacttttagcagggagagaaaatttggttgatgattcagagcgcgagggaaaggaagcaagggattctggcacatgcgcacgagttgaatgacaactggtggatatttttatatttattgctattcttagcctaaggcctggagctgagtagggagtaactaagcttagccatacttattagacttagagattttactttgtttatgtcaatgtcaaggcctttgggaaaactttggtatgcttagctgatttcttgaaatacaatctttctctcatgcaatttcctctcattcagtacgtgaagaataaaatgttgacaggttaaactgcaagacaatctaagttgctgtttatttttgtctgttagccaaatcttaactcactattcatagccacacagggtgtttttttttggttggtttttttttttttttggtttcagtttgtttctcctaaatacattttaaagataattagttattgcctgtattagaatttctttttgtgttcttgtgttaggattctggaagtagcaatgaattcacaggagaactcaacaatgtaagagcaagatgtttccaccacttactgagttgagggtataagattttatcctttgccagcccctttagaaattgtgactgtgaactgccatgatttaacttcaaaacacagcctgttctcttgtcagtggagccaaagcgttatgcctgaacaacgattataggttagtatagacaagtgaaaaagagttttattttgctggattctgatactacacatacttaggttcagctaaatatcaaaatcgccacagccaagatgtagtcattgatgaggactttaattctacccaatgtctgatcaatgtttcattccatagaaacatagatgtttcaatccagaaaagcctttctattttttaaaccacagattgaggaggcaatgagatggaaatactaccctgaacttagttctaactatctagaaaaattttttattgaagtagaattgactaaaaccttgggcgggagtaaccatgatagtattgtttggtaacttcaaaagaaagaaaagttggacataaccaaatagtagtggtgattttaggaaaatatatttcaaaggaaaaaaacatagatttttcaatatatagagggatttttcaacatatagagacttgaaaagagtacaaaaaaataaaaagaagaaaggaaatagagaaataaaaagaaagtttctgacagcaaaatcatcttttgagggaatgaggaaaaagaaagaaccttttttttttttttttgagacagagtctcactctgtcacccaggctggagtgcagtggtgcaatctcggcccactgcaacctccacctcctgggttcaagcgattctcctggcttagcctctggagtagctgggactacaggtgcccaccaccatgtctggctaatttttgtattttttggtagagagagtttcaccatgttggccaggctggtctcgaactcctgacctcaggtgatctgcccgccttagtctcccaaagtgctgggattacaggcatgagccaccgcgcctggcccaggaaccattttaagatcaaggaatttttgatgggcttggatattaagagaacatgtatagaagattgaaagacaagcacatgatcagggacaaattcagaagagtggcgtaaaccggtaagaaaatatctgcaaagcacaagttcatactgagctgaagctgaagagaatgttaaagacaacaagaaagctctctttaaagctatgttcataacaagaaaaacaagtaaaggctaagctcgttgcttggggcagatggaataatgttaaaatatgacgaaaaacagacctactcaactatttggcttctctttctctattaaagacaatgatgttcaaactggaatgtgtaacataaacatagttaaggataaactgaagcatgcacgatagataatgataataatagttgtgactacaatttcctgagtttctattcaggactgagtactgtaaaagagaatttagttgctttttaaagtacttactggcaggcgtgcgcggtagatattactgttatcaatcccatttacagatgagaaaaccgaggcacaggaagatttaatgacaaacctgaagttacacagtcggtaaatgatgggctgggattcagatcaaggtctgactaacttcaaagcctggctcttttcactggactccctgattcccatgcctgtcacatctagtgttttcaacaggattgcatttttttggtttaaattatattgtaaggcacataaacaaacacatgccagtagatgttattgaagagccacagtgtgtaattgctgtgaaacaaggaaaatggaatatcaaaatgataaacaacacataaagacgttcttgattaccttttttttttttttgagacagagtctcttccttctgttgcccaggctggagtgcagtggtgtgatcttggctcactgcaacccctgcctcctaggttcaagtgattctcatatctcagcctcagcctcctgcatagctgggattacaggcacatgccaccatgcccagctatttttttttttttttgtatttttagtagagacacggttttgctatattggccaggctggtctcgaactcctgacttcaagtaatccacccgcctcagcctcccaaagtgctgggattacaagtgtgagccaccgtgcccagcctcttggttacttttttttaaaggttctctttgaaccatctagagcaaagccatcaaagagactgctgggatcatgtcagaatgattcagaagccaacctgaggggatcccccagagggcaaagatgagacagtttgagcatcaaaaggattgaaatatataaaaatatataaaagtccatgagtttatgacaaaattctaaagacacaagacaataagacaaaaaaatcccgcatttgtcacttctgagattgttagggcaccaagtcattgttctgaaaatggatttaaaaaggagatctcacatccacccctgctttcctatttactttatagagaattacagctaataaatgcagaagggtgctagaaaagttttaaaaacctacagttttgtagcatctaatgaagtaatggagctaagcaacaaccattaatgaatgataaaatcaggtaaaattggtgctttctaacagagaatcaggctgacaacacttgaacccacggatcagtctccatatcactaaaagtggaacagccgaacgttagttatgctcctccaatgtgatctgatagaaaagaaacagcaccacctgtgaagtattcttacccacatcccctccctcaacgaggctgaaccagaagctcatcaaacatgcacatctaactattaataccaggttataggaaatacgggagacagaggaacatgctaaacaccactacaagggtacagatcagccaatgcctgaatgtaggaagttctacaaaacaaatgacccatttttgttttcagtatataaatgctacgagaaaaaagtagagatggggaactgttaagtactgtaaactagttcaaccattgtggaaatcagtgtggcgattcctcagggatctagaactagaaataccatttgacccagccatcccattactgggtatatacccaaaggattataaatcatgctgctataaagacacatgcacacgtatgtttatagcggcactattcacaatagcaaagacttggaaccaacccaaatatccaacaatgatagactggattaagaaaatgtggcacatatacaccatggaatactatgcagccataaaaatgatgagttcatgtcctttgtagggacatggatgaaactggaaaccagcattctcagcaaactatcgcaaggacaaaaaaccaaacactgcatgttctcactcataggtgggaattgaacaatgagaacacatggacacaggaaggggaacatcacacaccggggactgttgtggggttgggggaggggggagggatagcattaggagatacacttaatgctaaatgaggagttaatgggtgcagcacaccaacatggcacatgtaaacatatgtaacaaacctgcacattgtgcacatgtaccttaaaacttaaagtataattaaaaaaaacaaaaagacttaagggtgggagatggagcctgcagtgagctgagatcacgccactgcactccaacctgggcaacagcgagactccgtctcaggaaaaaaaaaaaaaaaagacttaagggacctgtaaaccaaatgcaggtatgaatcttgtttggaacttgatttgaacaactgactaactaaaaaaatgcctttttttttaaacaggcaaaaataaaacatactctgtttattacatgttactaaggaattactggtaattttattgagttggtggtattgtgagttttaaaagtccttatctatttagaagcacttattaatgaattaatatgaggcctaagactctttaaaaaatactccttcaaaagaaaaaaagtatgtgtatagggaaatacgtgaaatcagaatggtaaaatataataattgttgaagcttggtgataggtttttgggggttctttacactttcctctactttgttatgtatggaaaattcacataataaaaacagtcaagtgttctatttgagaggcagaattttggcagaaggcctgggttataacccaatttgtatagcctggggagagtcactgctactccctccttttttgcctctttcctttcctttttactttccttctatttcttaagaaatcatttgctgggccacattttcccccagggactgtcctggtaccatcagccttccaagttacaggtataggtattattattattattattattattattattattattattattattttacagatgaggaaatcaaagcagagaagggactaagtttctcacccacaaatccaggtctgcctgtgtccaaaatctgagctcttttgttttattttatgctggctcccaggagtagtcctctgattttataatttttaagtttttttatttttaattttgtttatggataaattttaaacaatgagtaaattaagatagatcaagtggagtagcatttgtgttttttgcatgtgagaaagatgcaaggtatggttgttactgtaacaattacaaagatttcatcaaaggcaagcagtgataaaagcaaaatgtgtggcaactttcttcatattcagaaaagagtaaaagcctataaattgtaactttaagccataaaataacatttatttatgcttgttcttcaaaagcttatatttgataatcttttttgttagaagtcgaagcctgagaaaaatggctaatttcatttttcatgtgtttgtaaaatatttttaggactatcacaagaaattccctaaaaatgtcaaagcaaatgaacaagtgaaattctgcacatcccttgtgccactattttgtttacttactgaaaaaatgacattggcttttgtaaaacctgggtgtgctggtgggcatgtgcagatgtgtcgctgtcatctgtcatgtgtcatgctctggatgtcagaaccagacatcagtcagggaagagagtgagtagcaagccacctcgccaaactcttgctgcagggtgcacggggttcacatcctctgcttagatttagtgcgactttccaaaacacctgcagtgcggtacttcatggctggtcccacgtaacaatttatgccctagagatgtctgactagatcttaggaaattatactaatggttctgacgttgtttccttcaagaatcgaggcgctaaatatagtcaagctgaatgacaaaattttactcacactcagggcatgtcagtgagggcatcaaaaatggaaaaataataaatactgctgatatttactaagttttatggtatgacaggcactgcactaagtcttttgaatatctaatcatgtttaactctcaatgtcccattttatagctgaggtggccgcagcacagagaggttaagtgagttgcccaaggttgcacggttaataaatggcagagctgggctctaaacccaggccgtctgacccctgagcctttcctcttctaaccactgtgcagtctccaagcaccagcagaatgaagtgagcacgtgctaatccacagctgtcatggtttggccctctgtgggctttcagagcaccttaaaaccctttgttctgtgtcagagctgtttttcagctttgcagatgtctgaagtcaagcagaagagatggagagtctgataaagcacacgtggcaaatctctggccgagttgatattagaacacagagtcccagagtgatttactgtccagggggaaagccagttggcctggctaccttgcaagacggttaaaggacataagaatagatattcattcaagactgtcagaaagaaagtaggtcagcaatgaaataaaaacaaatgtcaaagaaacaccactttggtataaataaaaagtcgattcttcttaataaagagctgtctgttcttcattaattagaaaagtacagagcctgcttactttgagattccaaaacctcttcaggcacaactcgttattaatttgatcactttcctcaaaagaatgatattttgacaaatacagtttctggcttcagtcacatatagaaacattggaataagtacaatgttgtgttttgcttttttttttaaaataggaactatgtttgataatgcatatactccaaacacctctaaaaataattttcaattggcaagctattttttggtgtattttcctagtctgggagaggaagttttatcatttaatttgataaacttagtacctttgagagaaaggaggagaaaattttaccatcttatgtggttgaaatatgctttagtatttacataattgaaaatgattcaaactgatttcctctgacgaacatccgaaatgaaaataaaaattgtgtctactccaaagggtagtggcttgagtcacccactggtatgtgtgacctatgagtcactcactggtatgcgtcttcccgatcccctggcctatgggttagaagtcaaagatgctccactggggcttcctttgtagcttcttttccccttcagtattcaaccacagctactgctggcagctcctggcagaacaggaatgggagaccaaggagaggatatgtggaagctgagtgatttatttataggggacttttggcaaatgaaagaaaatagatgtgaagtcttagcagttccagcatgttcatcagaaatgcaagctcatgatagtcatttcaaagggaattgtggaagaatggtgttaccctacttcacaggccattaaatcatatatatgtttggttgccagtgagaatctgagtagcagagcagacaagaataaggacgtatgggatcgaggcctgtagcttgtgaccatgaacaagtcacgtgaccctttggccttaaattcaccataaagtcgtgtacttgatctcagtgattgtatcttacttcatcaaaatggtatgattctaaattcctgtgggatatacaggtaagacaggactggtggagcattaggtttggtttttcctttaaaagaaagtgttggggaggcagcagggaatagcaaaggtcacagactcaaaagcattaactgccgggcctatgaagacacgaatgatgtaggtttgatataatggaggtacaaatccatgttttatgcaaaacctcatatttctaaactttggcaattcattcatgtttatcaaatcactgttttaggccccctttggctggccagtgggccctctgctttagacttctggaataaactccacagttgagagatgaaggacagacctggattctaacagacctaaatttgaaccttagctctgccctctaaggaatgtgtaaacgtatacatctgtatttaacttctcaaagcttcaagtttctttatctgtagaaatgagaatgataatacctcttttgtaggatttcctgaagactgcgggtactatgtattaagtatacatagtaggcacatcctcaaagggaattccattaccttttctatggaggtagatcctgtataatttttaaatttttgtcttgatggccagttgctcacagtttttaaaagtgtagtagatgccagcgcttctttatagattctgaaatcccttcaatttacattttagttgttttaaaataaagatttctttaagagacaacattcagagggataagttttctacttgccagtagaggtagaaggcagtaaaaccaaatagatctgtcagttactgtcttgaggtagagcccctaaagcaataaaacccacctttgacaatgaggaaacacgagacatcattttctccttaggacaaaagtctagtgagtaatggcccttctgtgactaatggtaattctgtactttattcccatagaaaatctaattttgaaaacatttgctgcatgccctactatgtactaggcactatgccaggggaataatgtaaagatgaccaaaacataatggaattgttgcctacaagtatgtttcggctatttaaggatttatattgcagtttgtgcaaattgtgtatgagtccactttgagaggttatacatatcttccaataatgttgctattgctcaaaatatctttgaagtctctctttggaatttacttttagagcccttagcacattctgctgaagattttttttttttttttttttttttaccctagtggtatttattcttagaaggtggatttgatgtcagggactggccaagagttgttcatcactaagtcagcctcatgggtggtggttaaactggctagagtaatttttcgttaaaaacgagccaggactgtaaagtagtatgacagggtttttttttttttttttttttttttaatatcacatcaactgattgtagagaaaaagatagttccaaaaaggcattctgcacattttttgccccaaaccagtatcactggaatatatttgtagctccctaacaggctaactttgaaataagtggtgctcacatgtgcatgtgttgtagtacgtctgctgaaccttgtacttaacctcttagcaaactcagtgtctttgttttttcctttgaaatgttgttttttcaagttcagggatagattttctccaagaaaatgaaacaaataagatccactctcaaaggaccttaatggaaagaaatacatgcttataccaagttctttaaaactatccaaactggaaaggattgcctcatagctgactgtgattattctgccatgatttagggacagataatttcctatcagcatgtttaacatgagaattaaagagttctgtagtgtggcctattgacctcatttgttcattccacaaacatcttttggagtccactgtatggcaggcattatcacttaccatggtgaggatggtgaggccatgagcatgcttcacctaaggaagcctgatcttcaagaatgcaaactcactcaacaagaaacttgagagtaattaatagtagtgttggtaattatcctgtcttttccttgtaggattatttggaggttgtgaagtggtaagtctctttattgcatttgaaatatggctcatctcatgaccattggaatgtgtgtacgctctggaggaaacccatctctgccatgtcacctgtattagtctgttcttatgctgctatgaagaaatacccaacactgggtaatttctaaaggaaagagatttaattgactcacagtttctcaggctggggaggcctcgggaattatggtggaaggcacctcttcacaaggtggcaggagagagaatgagtacccagcgaagggagaaacctcttataaaaccatcagatctcgtgagaactcactcactattacgagaacaggatggaggaaaccatcctcatgattcagttatctccaccttgtccctctcatgacacgtggggattatgggagctacaattcaagatgagatttgggtggggacacagccaacccgtatcaacacctgaccacagtgtgtgtggtctctgaggcccagtggtggctctcagagcacctccttagcaaatgtaccactggacccttgttagaatgatgttcttgattttttaaaatttatttttgtctcttgactattcttgattcaggaatgttcttgattttaaagggagggtgtgaggtagttgttgtctagttgtctagatatcctccacctgagaacgctgtctggtgtcatagaaacagcaatggcattgggatcaaaagacaaactttccagccccagctctgcctctctttagcagtctcctgacctatacaaggttcagttttcccaccatttaagggaaaccaataccactgttttattcacagcactcttgtgggaatcacaggagacagggcacgggagagcctttggggaactgtggatgttagtccctgtcgtcatcagcctttccatagtggagcctgggctactctgaaatagaagcacctctccttcctttggacccctggagcactgtgttctacagttcttagctctttttctgtgtgcattatttgtatgtcttatccttggtggtcaaccacttcaaggtgagagactggggtggtggttccttttttttattttttaatctcccctgccccatctttctctttcccacttcctatgttgactgacaaaatcttcgtatttcccagagtaccagagtttttctgtgagaggctaggtcagtgtttctccccaagcagaggctaagaagtacctgatgcagtcatttattttcagaatgtgtgtagcttgcctccagcggattgcctgggaagctggagatgtgcttcaggggaaaggtggtccatccacttttcctgaacaggctgtgcatgcagccttgacatagccaactctgcaggagcatgaaagaactgaagatacagtattcgacttccagtatttctaatcactttagagacaggatgacgattggtttagaagagccaggggatgactaaggagcacatgtaaaacaataatgttcagtatagactttagtttctgatttgaaacattttctaaaaaatcatgtatctttaaaaaattggaagcagctcagtgtttgctggagatgaggcatagagtgtggtggaagggagggatgacaaaggggcaggcagagactttgagggatgaggggtgtgcacatcaccttgctggtggggactgtttcatggttggatacatgtgtgaaagcatatcaaattgcatgctttaaatatgtgcagtttcctgtgtatcaagtatacctcaataaagtagttaaaaatggtatacctttattatgctgaaagaagggaaaatttggaaaggagatgtttttctgtagaagatagcttctagaaaggaaaatcaaacacagtctaagttattctctgttttgttctcctccctccacagatgtcttgttgttttgggtcctcttatctaaaatttcacaatatgtgaaagtagcctgaactctaaaggtagtagttgtggttttgggaaactgtgtgttcgtactgcctctgtaaatggaacacaagcctctcctaccctctggggagcttgtcacttagtacagttttttaggaactcctaagaagtttaagttctggccacaggtcccagagttaaggatgttgtcaactctgctactcatttgaaaaatgtcttgtggaacctatagccgcagaaagagctttgtttctctgggtgaaaacaacatacattatcatttctaataactttaatggatgctgctgctttcttctttttggcccccaagatactcagagataaacttgaaactcaactataggtggggggagggggaagggatagctttaggaaatatacctaatgctaaatgacgagttaatgggtgtagcacaccagcatggcacatgtatacatatgtaactaacctgcacattgtgcacatgtaccctaaaacttaaagtattatgataataataaaaaaaaaagaaactcaactaaagcatggtctgcatacttgtgtgtatattttcgctggtctcaaatttctatttatttatagttttctggcttacagtctatatttgtgtaatatttatatggttttatatggttcttgatggaaatcccctaaaatccttttcgtagcgagtcagagaatgaaatctgtggtttaatccactggcttttctttaggcaagagacagctgtgctagaagaatggaggattataataaatttgaaaaaccagaacagttcttcaggtaagcatgatctgtactcctgaccttaggaattgactctaggtcccagattttgaatttcttatgagcataatcatctacttaaaaaaatcacttaattaacagtgattattgagtatctgcatctcctccaagaaataaaatgccatatacatgacacacacacacacacacacacacacactcttgatagtcctacagatgactaatcactccccaccccccgacttcctgccttttcattcatacattggggttgggatctctgctaccacaggagctgttgcagagaaaaagatttttaaaatactatattatgtaaattagtacaaccattatggaaaacagtatggaatttcttcaaaaaactaaaaatggaactatcgtatgatcaagcaatctcactactgagtatatatccaaagaaattgaaattggtatatcgaagagatagctgcactgccatgttcattgcagcatcattcataatagccaagatagagaatcaacccaagtgtccattaatggatgaagggataaagaaaatgtggtgcatatacacacaatggaatactattcagccttgaaaaaaaggaaggaaaccctgtcatttgagacaacatgggcaaacctggcagatgttacgttaagttaaataagccaataacagaaggacaaatactgtgtgatttcacttgcacgtggaatctaaaagagttaaactcatagaaacagagagtagaatggtggttaccagggctgggggttggggtggagggcaggtggaggtgaagttagtcaaatgtacaaaatctcagagaggagaaataagttttgagatctattgtacagcatggcaactgtagtagttaataataatgtttacttcaaaattgctgagtaaatccaaatgttcacaccacaaaaatataagtacacgaggtgatggatatgttagttagttgagttagctagctaactaaccataggtataagcataggtataagcatataaaaataccacattttatcccctaaatagatacaattattatttatcagtaagaaataataatataacataaatactatattgtttcaaaatagagggaagaaaacatgcaaatagtcctaatggattttttttttttttttttttagtctccaggctggcttccagacaaggctgtatggtggcccagactggttgaattttttcacttaactttttgttgatctgccttaatttccaataactagagattctgataagaactttaagaataggaatacttctgagaatcttaagatgttattagccatatataagtaaccatacattttataaaagcatttttctcttcacaatagctggaagtggaacatcctagagaataactcatttttgaaaaatagaatgtcttaggggagaactggcctgctaagtattacaggggaggactcaggacaaaatcaagttatcagatacctggggcttagaaagcaaggagttagaaggtagaagaggcttacagaaaggaggaaagaagatgctggagaccctctttcatctattatagaacattttctatggctggcctgtattcagagaaggatacctatcttgctgctttctgcaccaaatagttccaagatccaaaattcaagctagtgctcttagtgaatagtttggttatattacgggttaaatgggttttcctataaagctagccaccatttatggtatttagatctaccacttaggaagatttcagtcatattcatgattttcaggttgtcctctctcagaaccctggtgtcataaactgtaatagttgtaggaattgttgtagtggatatagcagtaatattttctatggaaaaatatagaagttaatatatgccaggtactgtttcagttatggacactcatttaaatatatgaagtagatgctattataatccccaattacagacgaggaaactgagagacagaaaagttagataacctcccaaggtcatgtagctactaagtagcaaagccttgatttgaacctgcactctctagatcccatttaggctcttaactgctatactgtcttaactggattgaggttttccataaaattaaagtttcccctgaatccacagaaaatgttaacaatatatagaattttctggatttaatttttttctgtctcaaatctttgtatctaggatcacagataactgaagattgaacaagttgcaaatttcttaatagtcacatatgtatcattatatactcagagtttagccagataacccaccataaattgctaatgaagcttaataatttatagtgaaaaaacaaaaatagaattgcaaaccataagcaactcaagacgtgcacgggggattatgcatccttcccccagtttacagaaattgcaaccatcagcatatgcgttccacatcagtgccaggcattgtgtggcaatcagacttcttatctagaaactctagaaatgtactacttttagtaatcctaaataacttacttaataagctatattacttaagctatattatgcacaaatataaagctagaaaacaaaaggtgaacttggacttcctctatcctttataaaaatggaaggacctgtgctttgctggattggtttgctgttcaggtggaaacccctcgtggtccattcagtgggctgtgggcgatagtttgagaatcctgctttaaaggaagaatacagttcatacattttattaaagacagtctgctaaagtgatggagctggaattttctcagtgagagcactgtataacagggttttctgttttccttttttcataacaaatagtacttctcacttaaaaacaattgttccttacaatgatgtctgggatttgcttcaaaataatcctgtgggtaaagagttgggaatgagttggggaataggtggaagaagtgggatgaggggcagataattgtcaaagcaagtgacatggggcttcatgatactgttttctctacttttctatatctttgaaaataaaaagttaacagcaacaacaaaaaccttccttgactactatcctacctacttcatttctctgctcttgttcacagcagagcttctaaaaggaactctctgtatatctcatttgtacatcctcatcctccattatttaagcaacccattcacttggctgtcctccccaccagccaactgaaattacctttttaagggtccccaccaatcaccatcttgccatatggggtggttaattctctcttatgttacttgactttcagcagcatttgatgcaataggtcactttttgtttcttggagcattttcttttattggctcatgtgcacccacatgttctcatttcttctgcatcttgctggtttccaacagctgacctctagctgttggaaagcctccaatgcttcatccttgggtttctctgtactctttctgagtaatctcattgggtcccattgctttaaataccttctggttgctaacttaacatctgtagccctgacttccagacttgaatctgagaggcatctcaaatttaatgtatccaaatcataactcttaatcccagccttactttcttcctttcttcctcacctcttggtacccccatctcagtaaataacactgttatatatctggctgctagagccccgaaccttaggcatcacccttgattgctctttttccctcatatcccacatccagcctatcactatgacctattgtcatatctccaaatttacctgaattcatctactttcctctcctctcctgctaccatcccagtccgaacctctgacatctctcactggacttccatatcacctcctaatccatctctgcctctgtgtttgcccctggcagtccatggagagaccagccagagtggtctctttaaactgaagtgccactcccccacttaaactcacccattggcatcccatagcacttagaaggaaagccgaactcctttgtgatgtacctgctgcctatgtctgccccaccctgccaggactcactactgctgtcacacagatcccttttctgttcttcaaatataccaagtgggagtcttacctcaaagcctttgcagttctcttctctctccctgctatacagatcaccataaggctggcttcctcttactacctaggtttcgtcttaagtcacctccctagagaggtttgacctgaccaccctatgtaaagtattcatataaccccaggccacactctatctcatagcccattttattttaatttatgtaaagcatttgtgtttatgtattatttttttgcccctacctataaagtccagaagagcagctaccttgtttgtcttgttcagtgctgtatccctggcacctagaacaatgtctggaacatatagaaggttaatgtttattgcatgaataaacaaatgaattactttgtttgtgatttaggatcaaggaacttttccccaaaggcgaatctgtgcagttttatcccacgcttcttccccatccctaagttcctgctcatctggactgtgtgcttgcaaactgtgtaaagacttgttcaacattcttaaataggttaaagaagtactgcactttgggctctttgtcattttcaagtcacattctatcctgggcaccatccggaggggtcttgtccagtttcctagtttctcagaaaggaatatttcatggctgctcgcacgtcctcttcccttacagtatttggactttacaccactcattggcagagccaaggcctaccccatctgagcaaagagcaacagagatctgttggctccattcactcctttgctctaagactcacttgtttcttcttatcttttcccaactatttttagttgtcaaattgctcctttctttccctttcccatctatttttcttttcctgtggaaaacaacccatatatttctagtttagtcagattagctgctaggaaggccctttctcaagcttatttatataacgaaaagctatacccaaatcctaatttcatgtgacaattgagcagcctcttgtaaaatagctagaacaagggcaaggatattaatttggctcttggactgagacacactagggatgtcccagggatttgaacaatttctaatcttctcagaggagggcataaggaaattcctaaccaaggtgaaatcttttgtcacatcctagagtagataagtacttcaagaatcttctagactggggataagttggaactgctaaatattatctacttatctaatgcatgtaataatagctatctatgtctattttatcaagtagctgggaggataagtttggtttttttttcaaggacttttgagctttttcttcaggtaatatatcttaagggaacactttatataaagctaagccattgggaaattttttctgccatagccaacagttttgtaattaacattcctttgcatggtataaatacaaatctgttcttttgtcaggatcattctttatgaactaccatataaaagtcatctgggctgggcacgatggctcacacctgtaaacccagcaatttgggaggccaaggcaggtggatcacttgaggtcaggaattcaagaccagcctgggcaacatggtgaaaccctatctctactaaaaatacaaaaattggcagggcatggtggtgggcacttgtaatcccagctacttgagaggctgaggcaggagaatcacttgaacccaggaggcagagggtgcagtgagccgagatcacgccactgtactccagcagggtgacgagcaaaacggtgtcaaaaaaaaaaaaaaaagccatctggataatacatattctttattagtattaagtatttacttttagatcaatgaaaacatttctatggggctagacttttccttgtcaagattataatttttcttatgagtttttacctgaaacccctattttctaagaccccatggttaatgagtctctttgacattaatcatttcaattttgctggttctgatgaccctgtgctatctattagagctctaaccctttgcaaacctctcttctgcccttgtcagtgtctcacgtgctcacgtgcatcttaggctggatatcacgtggcacatcctggtaccacctctgctgctttcactggccactgttgcatctgtttggtgcagctgcttcctccactgggaccaacccctcctcttccttacaaatattcggaggtggggaaaatggaaatgctatcattagaacatctggcatcagaatttgctttatgaagaaaataatcttgggggaaaacactttgatgagtgcttgcggaagaaaaggaaaccccaaaggcctgggtattgggagagctgctttgtgtaagccaagggcaagcatttactggttgctttgagagtgaggggaacacatgagagaaagaaagagaggggagggtggaagaatggcaggcatcaactaaatggcataaaattgtggggagggtcttgatgcacctgttcctcatggtctccagacttttctgtgaagtacagcatgtagtgtggagtggatttcagggggtgaacttggagatgcgttcattcacatcacagtcagtgcaggtagtgtagagacaacagtcatgggaaagggagcccaggaatgaaggaggccctgagaacatcatccctcaccaaaatgttaagacgggttttgggtttccagaagctatagagttggtggcagtttgagccaattttttcctacatcttgaagggcaataagaatcccacataatgtctgggccacatcttggtggtacctggtataactttgccaaaagaattttaaaaccaccgcaataggtaactcaactgctggtactgtattttatgtgtgcttggtatgtttatatgtctttaattctattacaatttttttattgcacaaagaacattataacaatgcataattatatatcaatagcaatattaaaaataaagacaaaaggacacattcagccaaatgtgccttcagtgtctggcaggcaagtatggcgtagaaagggcaataagaggcagttcctgcctttagggggcttccaggatcgagcctgcagtcccagcaccctattgaatcaactgtttctgtttttccattttagttgtgtcactcaggctttgggtgatttattaagagaaccaataagattttgctcaagattggaaacaatctctttccacatcatttaagcctcagttgaagcttcattttcctccttcagcttcacctgagactccttctggcaaaatcccgctgctcctccttgatcctgtagttttctctgttttaacccttggaacatgatttataattcgtgggatgactttttcttttttcccaggaaatgatacctttcttgaaggcaggaaactgtgttttgtctgtattttgtgaatccccacaaatatttgctggatgaatgttcttggggacactgccctagatatagtagaagcagaagtatttctcggtttttgtgtttttttctggaatgaagggtaaggtgaagggttatagacagaaataagactgattgagtcataattgcacctttgtcagtcactcttgtaagaattttacatatgttacacttcactcagtccttataacaaccctatgagatagcaattatcagctcctccctcctctccattttaatcatgacctctcagaaacagagaggtcaagtgacttactcaaagtcacagctagtaggtggcagttagatctgaactcaaataggctccagagactgggctcttgaccattattcttcctttccaaggttggaagagactgagagacctcagctcctgaacacctggaactgccaagccacagctgttactattactgtactgttactaaagagccaaaccaaaccacatggctggctcctttggcaagaacttcccctccagatgtgcctctacttagcactctgatagtgagcacaggtgagtccgaggaaagcaggccaagaagtgctgatgagtttctctctgaggcccagggatacccagccatgccaacaaccagccctcccatgccagtccacgccctgtagcctggctctcttactgctttaggagccctgggctctcttacacctgtgtggaagagggagggactcccaggaacataattaggagtgggggaagggaggagaagaagggagggaagagggggaggggagaaaggacatgcatttctaccagggtaactttggtttccttatattaatataagggacttgaactgtgttattctttctcaaattgggatttaaggccccaaggaatccaaaaattctatgagaactaggtatttttatgtaaatgattaactaaaacaacgaatgtaaccttattctggatcatcttccaatggagtcctgcctcttgattttactttctgaggttatgtttgtgactgtgatgcatgcaaatctcagtcacctacagtggccacattcagacaatttgaaatgcattttatattgtaacccagcacacacacacatgtaaatagaaatgcaccaggagtttcctaaagtattgctcaccctttctgcatagggagtaccctcttgtcacctctcttctattcccaggtagtcatgacccactatcagattacaaccttcaataaaaagatcatagcatgtaactgtaagcatgatcagtctgccgttttcttttgcagtggaaatgttccattgaaagacattttatagaatacatctttaccaccctaagttgtttaacaaactgaatctttgacttgagatcatgagaacaaaataaagatatgaaataatgactgttttattctgaattgctgaaaaaatacccagatagtttaaagctgtaaatcagaacagggcaaatcagagtctcattgctgtaggggtatagacagaaataagactgatagagtagtaattgcagctatacaattattttcatcaaaacaacctatatcaaagtagccgtgttatttactttgtaagcagatatagtgcatggatctcatctctgaatatgccagcttaaaattcattagcagaaaatgtggtaagtgtaccatgatgacttactttttcattaacttaacatttgggatacactgtattagggttctccagaggaacagacttgatagtagatagatgatatgatattaatagatagattgacacagagagagtaacagataggtagataaatatagatatgaaatttattgtaggtattggctcacataattttcgaggctgagaagttgtgtacaagatgcagaatcaggaaagctggtggtgtaattcagtatgtgtgtgtgtcggggtagggactgggggtgtatagggtggatatagtatacgtcccagtcagtgttggaatgtccaagaagagtgctgttgcccaaatgcaggagaggatggatgttccagctcaagaagagagaaaattcacccttccttgcttttttgttctatttgggccctctacagactggatggtacccacctacattggcaagtgatatggtttgattctgtgtctccatccaaatctcatctcgaattgtaatccccatgtgttagggagggacctggtgggagatgactggatcatggggacggttcccccatgttgttcttgtgataatgagtgagttctcacaagatctgatggtttaaaagtatggcacttactcctgctctctctctctctctctctggccactatggaagatctgccccttgcttcccctttgccttctgccatgattgtaagtttcctgacatgcatactgtgagtcaattaaacctcttttcttcataacttacccagtctcaggtagtatctttatagctgtgtgagaatggactaatacagtgagggtgatctttactcaatctgttgattcaaatgctactctcttatgaaaatacccttacagacacatccgaaaataatgtttcgccagctatctgggcaccccttaagcccagtcaagttgacacacaaaattaaccatcacatacactattaaagtggctgaatcatttattctggattagggtgattttatcattgtggtggtagttaatacacttttctgtttgctatatttcctgtaagctagtcgttgaatctagaggcttgattagattcaggttaaatatttcaggcaagaatatcttttattggtggtgctgtagactttcaaccataccacatcaggaggtacataaagcctgtcagtcccatgtgtaatgatcatagattgattggaggttttgacattttcaccttgatctttccattataaagttccttatcaacctttcacaatggtttaatgtttattgataactgccaaattccagtacttcatgaggtggaagcaaaatggtagtttcctaattcctacattcttctgcatttattagctggtattgatctctgaagaactttccctccttaactatttgattggccttagatgtagttcttaggccctattttattttatttttatctatttttttgagacgcagtctcactgtgttgcccaggctggagtgcagtggtatgatctcagctcactgcaacctccacctcctgggttcaagtgattctccagcgtcagcctcctgagtagctgggattacaagcacccgccactatgcctggctaatttttgtatttttagtagaaatggagtttcactatgttggccaggctggtcttgaactcctgacctcaggtgatccgcctgcctcagcctcccaaagtgctgggattccaggcatgagccacagtgcctggcctttaaaaaatgtttatttaaatagttttgggggtacaggtggtttttggttacatggataagttctttagtggtgatttctgagattttagtgcacccgtcacttgagcagggtacactgtatccagtatgttgtcttttatacctcaccccctcccatccggccacaacaagtccccaaagtccattacatcattcttctgaatcctcatagcttagctcccacttataagtgagaacatacaatatttgttttccattcttgagttacttcacttagaataatggcctccagctccatccaagttgccacaaaagacattatttcattcctttttatggctgagtggtattccatggcatatatacaccgtgttttctttatccattcgttggttgatggccacttaggctggttccctatctttgcacttgtgaattgtgctgctgtaaacatgcatgtgcatgtgtctttttcatatgacttcttttcctctgggtaggaacccagtagtgggattgctggattgaatggtacttctacttttagttctttaaggaatctctatacgttttccatagtggttttactaatttacattcccaccagcagggtaaaagtgtttccttttaaccacatccatgcccacatctattgttttttgacgttataattatgtcttaggctgtattttaaatcagggctctctgagcttgatctcatgtcagccatcatcatatcagtgtgaaaacagactagaaccaggtatcagtgatgcagcagccaggagaatttctgggccaggggccaggccacaagctgcatatcccaatggccaactggtcatggctacttcctttttctcatctagtgcaagctcaagaggtgtgggatgggacaatattccactgttctgcaggtaaatgtatctttgtggggcctctgaatgtcctcttcggtctgctagtctcctgacaaggggggaaaacactatccagaccttttctctgggaggccatttgttttcctgtaatctgtagaagaaaccaaggtacttttgtgggtgcagcatctcagttactgggggagcttctcagtgtgagctctgaatgcttcaggatgtcttccaatagccagcctttcctctgtgtaaaaggtttctctggagtaatggagatagcatgtgtgcaagtaggcaggagctccccttagtgtcagcttgagagcaaggaagggagaggagagctatgcctctgaaacaataccattttgcccccaatgccagttttatttcagagataaaatgccatgcttcagagccatcaatgataattgtttgagattgatgacctttggaagctgacagaatactaacttctgggagaagactagagtagatcaggatgatttcttggtatactctcagctgtttcccaccatgtgtttcctcttctttctgatatacagccaaaatacatttcccagtctgccttgcagttaagggaaactgaggtctcgtcaatggaatatgaatagagaaatgtgtaccacttccaggcctggcccatgaaaacctcccatatgctctctctctttcatcttccttttcccttcaggctggctggaggggaggcagctcctgggagagatttggaagttggcagagctgctattaagctgggttcctgaatgatggcaagaaagaggcccactcctctatcgtattcacctgccaagtattgtttgtgagcaagaaaaaaaatatctactgtagttgaggccatcttaaatacagtttctcttttaaagccattccacgtccaccatttggcattaagcgtctttaaaaaaaactgtgagtgccctgccttgccagtaagctgttagcaagtcttaactcgggagatctgtctctcctggcattctgagaagcagaagtctcaaattacttccagctgaaatggaaaagaaacaaaacaaaacagaaactcatctgtggtaggcagactaatgtccctcccaccgagatgttcatgcctgagtccttagaacctgcaaatatgttacctccatggcaaaggggactttgcaggtgtgattaagggtactgatcttgagattgggagattattctggattatctagatgggcccaacctaatcacaagaaaacattggaaaagggaggaaaagagtggatcagaccgatgcgatgtgatgatttgacccactgttgctgtctttgaagatggtggcaaggccttggagctaaggaatacagtctctagaagctggaataaacaaggcaatgcaatccccttagagcctccaaaagggagcacaggtctcagaactgttaagataataaatttgtactgtttgaagtcattaacatttgtggccatttgtcatggcagtagtagaaaactaatacaccatcccatacaaaacacttaaatgaaaaaaaaaatacatacatctgtagagtaggcacatctgtaggttcttaatgcctgtcatccttatctggaaacttgggtgtttaatgcattttggcaagagtgatgccagtgaggatgttccttggtagcttaaatatatccaggctattgcaatgatgcctgacattgaagggaaaatgcacacatttagtcagtcacatgtatgatttcaaatatctggattttggaattgtataaccaggtatataccagctacatctgaggggaaattttccgttttcatccagatgctctggtaagtgctgacatacccagactatgagagatttggatcaaactaaagaagtccccaagtctcaggagaacaatgaaatgtagtgcggggtgtctgccggagtcatggtgtactcatcagaatgagctgctgaacactgtggtcaggcccttggctagtgacaccattaagattttgtttccttctaaatcaccacccctcctctactgttgaaatgtggctgtttcatctctccattagagtccttccaatttacaccaagcaaaacagttggaaaataaaacttcatggccaggcagtgggtaggagtgagagggaggaggaaaggatgtagacacataattcagaatcaaacattgaatgaaggactcctcgattcagaccccatctcactttgcccatggactcagtgtctgaccttgcattaccctccctgatcttaacttcccagaactctgacagatgattaataatacctgctatacaaagggggtgagaactaataaatggtagttaaggatgatgagtaagccgagtataatagctactgctttcaagatttctcagaatccattagagtttctattgttttaatgactgtgatgagttcagtaagtcatttctgagttaggcaccacttatctttgtgtactgaatattcttaaagccacagttacttccttgctggggttataaagcaattctgaagaccaaatcatgttgcctttgtacatatccattgaggtttctctctcttactctacatggaaatcctgtaatacagatttcagccttacaccgagaaaatatatatttctgagtctttttttcttaatatatatgtgagaaaactctaaagtaagaataaatggaaaatcattagaagaagtatagaaattactttgaaagggtatatacagtctaattcatttatttttattttagaaatttgaatgaattatttcaataaatgtatataaaagattttacattacgttatactcagtttttctttttctttatttttttgagccagtcctccgagcctgtttcctcaactgcccttttctcctacccagtacatcgagctgttcagtgaaaaagaacagtgttttgtgtgtataaataaataaataaataaataaaaataaaaataaacagctaactaacgtaggaaaccctccttctccttccccaacaagttgcctgaagaaatatgtattagcaagactgctggaaatccacatttgttacatgaaattaggacattaaaactgtatcctgctgcttagtgcccagaccttgtaccccatgcagcagcctgcttgtcggccatggaacaatgtgtagcaaatgccttggtgatgacatatctgtcagagggaaagaaggagggcattgattatcataatgcggcatagagctcatttccttctgaaattacccagagatgcttggctgggcaaagtacagcaagtccctgaagggggctgtaatttctcaggcctgttgaaggaaagaagaacaatatgtgtgtgagttgctaagtctttagacgttggcagtggcagcaggctggtaatgagcagattaggtatttcaatatgtttctttgcctcgggaaatttaacaggtacacctgttttctttcagtggctgaaaatgtcagttaccatgagcctggtgtagttggcctttttgaaaaaacaagagaggtggccgggcgcagtggctcatgcctgtaatcccagcactttgggaggccgaggtgggcggatcaaaagatcaggagttcgagaccagcctggccaatatggtgaaacctgtctgtactaaaaatacaaaaaattagctgggcttggtggcgcatgcctgtagtcccagctactcaggaggctgaggcaggagaatcacttgaacccgggaggcagaggttgcagtgagctgagactgtgccactgtactctggcctaggcgacagagcgagactccatctcaaaaaaaaaaaaaaaaaaaaacaaaaaaaagaaaaaaaaggatggactgacacgtggtcagtctttgttcttctggtggcttggacattaacaaagtgttccctacccacttaagcttctcatctgcatctgcacatcagtggtcttcaaactttttttgttatatgccattgaaagaatgttttaaaaactgtgtaccatctcactgtttaaatctgacatctaaatatttccatcattttaaaaataaggagtagaagacattacatgtttcataaggtaaagattgatggtgtgtggaataaatattttgtgacatgatttgatgaactaggttttaatgaccttattgaataacatgttaaattggaaggaaatcagtaaaaagcttatatgtagactttatccagcacatcttgaaagatctgatgacttcagaaaacactgtggttatttaaagataatccacatcacttatatgtactactttgtcctgaactcagaactacccaggactggccaaccctactcttacagacttgcttgcaggacagggagagacagaaagtgctaaggcttcccccaaccagtatttggaatcatttagtgtagcacaccatattaagatttgagatatgagtggtgtgactttcttttgtagagtgggtgaaagaatattgttgatgcccaaaggctctcaggcagtttcagaattagtacatatggaaattgaggatgtagaaactcatttttgtgaaactgtccctgctctagtacctttgggaagtccatttgaagactgctggaatagatcatggactcaataaataccttttcataggagcacagagggatgaacaaggcagactgaaggagagaataggaatgctccccatgtcaggtgtgtggagggtgcaccaaggctcattctggtagaggtagaggagcttctcccaaagtagcaaactcagatcactcatggtctcagtccccttaattctttcaagctgctggatcaagaacgaggcagccagccctccagctgatgaccagagacatttattatctaccatgtgctaggcactgtcctaggtaccagagacatcctggtaatcaagacaaagttccacgtttgtgaagttggggatcagggaggtggagagacagagaaaataaacaaatctatgagaatctatgagaggtagagataaatgctatgatgcagatcacctgagtgatatgactggaatggcacctccagcttggctggtcagaagtggcttctcaaaggaagtagcagctaagctgagacctaaagccatccaaataaaaaccaatgagtacatccatcagtcagcaagtatttatcgggtgcctgctatgtgctaggcactgtttaggtacttggtttacattggaaaacaggcctggggatcttacattctaactgggtgagaaggggtctgacaggcaataagcattataaataagtaaattacctggtatgttagaagatggtaagtgttatgcaaaaaaaaaaaaaaaaaaaagtatagagcaggctaaggaacagaggtagcatgggggtagtgtgtgattttaattagggtgggtggggaggcccccattcagtgggtgtcctgggagtgaagacttgaatgaggtggaggagtgagctgtgtagaaggagctgtgtgaagggagagctcaggctttcgctctagctctccctcacacagcctgttctcatgctgctaataaagacatacctgagactggctaatttataaaggagaggtttaattgacttcacagttccacatggctggggaggcctcacaatcatggcagaaggcgaatgaggaacaaagtcatgttttaattgctggcaggcaaggagagcctgtgcaggggaactcccatttataaaaccattagatctctcgagacttattcactaccatgagaacagtatgggggaaaccgcccccatgattcagtgatctccaccgtggggattattacaattcaaggtgagatttgggtagggacacagcaacaccacatcagttctcattttattatcccatgagaacatccagctcccctttattgcagcactgtgcccacccagtttctcaaggaagccaatgagactagcagacattgtcaggtcacagtattttggagtgctctgcattgcctcttatcagtccagctctttgtggcttcagttgatacatttcagtccccaatcacctctgagtgagccaatgccgttgagtagctgcatgcactgagtactgcattgcttgcccaggtcacctctgaagatcccctgccttcctcagactgaccatgttcctaggaggtcggggaaagtagaccacagtggctcatctcaagcatagaatctttgtgaaggcttctttttattataaacatttttgtgaaatttgacttctttttttcttttttttgagattgagtttcactcttgttgctcaggctggagtgcaatggcgccttcttggctcacttcagcctccttctcccaggttcaagcgattctcctgcctcagccttctgagtagctgggattacaggcacacaccaccacacccagataattttgtatttttaatggaaacagagtttcaccttgttgaccaggctggtctcaaactcctgacctcaggtgatccacctgccttgctctcccaaagtgctgggattacaggtgtgagccactgtgcccagcctgaattttgacttctattcataatatattcatatgtgttttaatataaaatgtttatcatttaaatggattctccaggaaaatacaccaggtttattcttttgctgtgcatataattgtgctcagagagtagttctgcctcagtttgaggaacatcggtgttctggaagaaatcctggattgggggtaaagatatggggttctggccccatctttgccataaattagctgtgtgaccttgggcagatcatttaaacccattggtctccattttctttgatgtgaattgggtggcagtgactgatcagattagatcacaaaatcccttccttctgtcatgctataatgacatagagtcttgaatgccaggaccatgcctccccagtgcctgagtggttgtgcttcctagaccccaaggtccagtgtgtgccagtatggccttaccctctttactgcctcagagtcacagtaaggacttttctttataattgaatgaacacggaatgaatgggcatcttggcatagctggtttacacattattcttgtttcccttttctacatatatgaaaatgtgaactaaatccatagccctcccttggtggataaagacatgggcataatagttccatgaatttagcctctttttgtattcaacagtctcatcccttcccctcaacttgtgttctccttgatagaaatctaaccacttctacaagtggcagctaaagcattagtcttatataaccttctcgctcaacaactgaaaagttgtacaaaccttttaaagaatttaccatcagcaagggctgtgcttctaggcttgtccaaattgcgtgtaaagtacactctctaaattaaccagaccatattaactctgaaaacaagactcactcttcttaagctatgtctccagactgtaccaaattgtactttctcttgaagtaggacattctgtgccctgtttgaaagctggcgtgactaatgtagctggaattgctgatgagagaagacaggaagagaaagaaccgatgtgccttaagaatagggaatttcggctgggcacggtggctcacgcctgtaatcccagcactttgggagaccgaggcgggcggatcacctgaggtcgggagttcgagaccagcctgaccaacatggagaagccccatctctactaaaaatataaaaaaattagctgggcatggtggcgcatgcctgtaatctcagctacttgggaggctgaggcaggagaatcgcttgaaccctggaggcagaggttccggtgagccaagattgtaccattgcactccagcctgggcaacaagagcgcaaatcagtctcaaaaaaaaaaaaaaaaaaaaaaaaaaaaaaaaaaaaaaaagaatagggaatttcactaggccctttgcagaatgcagtatggctgatgtgtgtattatgacatggtaaatattactcctagcctccttgtgaaacgggctccatgtcatgcctcaaggccctactaagtcattgctagggctgagcctcaagcccagccccaacagtaggttcaacctggccttccctcccagcactatcactgcctgtctttcaacctatgctatacattgtgacaatcagttaactgaggtacaagtgtatttggatttatgccagactgagaatgagaaatattcagatcacacctggaaaatgcaatgcaaaactcccttgtcttgagctaaaaatctagaagcatttgcaagtgactaagtcccttagtttataggtatgagcctgtgataagttatctttagttgtttctggcttaaggggatgtcagtgacttttcccttagccccccctcctggaacagccggctgctggtggtctagttttttgaaagaagccctgaattctgaaacctcatgctggggttttgggttagtgtttgcattactgactgtggtttcatggcatgataatgcaaagtttaataagagcaggctgtctttgcctacagctagagttgcattgaggcatgactacttctagtgcctgctctgtgccagattcacagtgccttacagcccctccccagaactggggcagaggaggaagaaaaaagtgactctgtggttcaggggaaggagtaaagtttccaggctgtgtgataggacatttccctgatgcttggctttaggctcaggatggggacgttaatacattcagcagaggctggctacctatactggcaccattgaaggactctgccctggctcagtgctggttttgcttggtgatgcagtgtagtgtagcaggatgatcaccagctttaaagccagatcaacccaaatttgaatctcagcattagtcctcactctgctttgagacgtcgggcaagtgatttaatctcttgaaatctcagtttgttcatctgagtaacaggtggtaaaatacatacattgaaacgctgctaaaagattaagcaatgagaaggcaaaatggtacagcaactttgggagacagtttggcagtttcttatacaactaaacatactcttaccatatgatccagcaatccatctccttggtttttacccaaaggaattgaaaacttatgtccacacaaaaacctgcgcacacaaatgtttgtagcagctttattcataattgccaagactgggaagcaaccaagatgcccttcagtaactgagtggataaactgtggtatgtccatctgtatcttttattcagtgataaaagaaatgagctgtcaagccatgaaaagacatggaggaacattaaatacacgttgataagtgaaagaagccagtccaaaaggcggtatactgtatgacatctggaaaaggcaaaactatagagaaagtaaaaaagatcagtgattgccaggccttcggggaagggagtaagggatgagttgatgaagcataggggacttttagggcagtgaaactcttctatagtatctagaatactatattactctatcaatcatagaatgatactagagaacatactgtagtgatggacacatgtcgttgtgtatttgacaaacccttctttgtgttgtacacgaagaaggaaccctaatgtcagctatggactttagttagtaagtcttctaaaaagcttaaacaaggcaatgtgtataaactaactgactaactggcataaataaatagtggacttcaaaaaaaattcataatcctagcactttgggaggccgaggtgggtggatcaactgaggtcagaagttcaagaccagcctggccaacttggcaaaaccccatctctactaaaaaaatacaaaaaaaaaaaaaaattgtattctaagttccaggaatgtcatttagacatagtttcttttggggctagatgtatcaattttcattaaaggtgatattattatttaaaaatccagctggttgctaaatgagaattagctaccctttataaccagggattgtttcaaagaaatgtagttattttctcccctgtggcctatcttgtgcaaagttagtaatagtttgttgccaaatccaaggaaagcaaactctggctcaggcatgagatttatttttctcaccatgatttacaactggtgtaaaattcaggtctggacttggttagttataatgctatcgcaatataccgcatcttgagttgattttgccatatcctgtattgttatgtaaaatgctaactttaattgagaattgccccagtagaatatccttatttgtcctgcatgaagtttctcctcttttgtatcaattttttgtatggttcaaattagtgcgggaagaaaaggcaggaaatacaaatttaagggatatgtgttatatcataaaagaattgtatcacaaagcattaagacaatgcacagaaaactttgccaatagctgatagagcagaagggattgtataattaaataagaactaacacctattttgtaactggaaattgcattgtcagagtccctttccttttatcactagatgctaagaatctagccatgtaaaaactcccaaaacatccaaattcaaaaaaactggaatctaacgtggtaatgcagttgtcaagaacacgcaatagtctttgggcttttacaaagcactgaaaactaaatgttgcatttgtgcccttatcttccacaacttctttcttggcagcttttcttggctcacttcagacacacagaatttcaagtaatcagggaaagttgggacagaaacttcctctgtctttccatggccttttctttttcctttacggatctgtgatcctatgctttctctcacattcacattatatgtgtcagttggagaaatcttgatgcccagtttcatttgtttcttctgtcccacctgtaactaatttaggttgagttctccggctcatgtatcagagtgtgtatgacaaattatctcaaagcccagagggcctcggtggtccaagtcccagcaacaagggacacctgctgtcatgacatgggcttgacctgggttctgtggacattaaggaaccactgtcctgagaggggggtatggagctaagctaggggagggagcaggatgagcttagagctgccgaggaaacggaaagagtctataggctttaaaaaagaggagagaaagaaagaagaataaaagatgtttctggagactctgagaatagttaagagtccagggccagccagaatcaccctttcccccagctaccgagagtgccacagagcagaaattgacttggaagatattgctcctagaccaaaagtccaaattaaggggtataggcagttaagggcaagtgagggcagtagagatggttgtccgagtccagtggccatgagaggtttctcagctgcctgccaattctcttctgggacaatgccagccataaagtacaagccatgctttggtgtgggctgtagacatattgttttcccataactactgtcattcaaacaggatctagtttcttggcatgagcaaattgttcccgctgaatacacacactatgtccgctatggggcaaggcaaagcgaatcctccaaggaactggatggatttttcattctgagataagcagtttttttgtgggggcgggggaggtggagaggagccagcttcactctctgttcatgcgagttttgaatgaaatgagtaaagttcatgttccccccagagtacacaaggttcaagtgggattacccagtgggaatccagcccgattgtaatttaacttgttcgagggatctaaatatttaatctgccttcatcacgaatcctagaatcctatgtaagcagcaaaggccgagggtctgaaagtaaacactgcagttagaatcagaagtgttgcaactagcacaactgctgctgtgacgtcctacaaactttggagagtgccagaggaagctagcctgagagcacagaactggcagtcacgaggcctgcattctccagcttcgcctgccaccaactctctgagcctccaggcctcctttgtcaagtaaggacacaagcaaagcatctcagaagacaagtcattttcataactggaaatgagacagagccaacaaggatgcgtgaaaccagccacataaattgtgaaacctatgtgatcatgtatatgtacaatgttttcttaaaaaaaattaccattcctagatctaatatcaattttttgtatgattttgccccacattttgctcaaattatgcagtgtttgaaagagattctctgcagaggttggaatcacccccttgggtgctggtagcaatctgtgaaggtagctttttagatgtcacaatgattgggggtggggtgctggtgacattggatgggcaggtgcagaactgctaaacaatgctctgggcaatcccacaaagcgaccacctggcccatatctggcatgactttcatgtcccgccggacattcaaggaatccgactatgttttctatataaacatatagtatttttcacatctgaaaatatacactgaattttccaggactgtgtataaatagaggtaagattgtactttattttgctcagaactttaccaagagttattaataatctccaaaaaatcaaattatagcaaacactaatgatgtttgagtcactaagcaacacacctatatctgtctgcattgtgatatcacattcgtggttattctacaggtacaagaatctgagcctcccttgtcctttagtgcaatcaagcagagtatccacatactgaaatacacaacattttctgtaagctattttcttttcatttctcctttgtattacagttttcatgttatattaatttaaaaacatgggcaggttatatgatctatggattttataccagattagtagagtactataaaatgtttgttataaaaagtgtgttttatttgattgggttgaaaacttctgggccaggtaatcctaaagtctcttagcttttaaattttgtgagcctgtgagattatttagccaaatgccttcatttttactggtgagtaaactgaagcccattcagtctttcatgcattgtattgcattcagaaattgctgtgatcattgggaggggagaatgaaactaccaagcaaaagaatatgattttagtttattctctcctttcttttccaggattacaaaggcccaggaatagctagttagcttgccctggtgtcactgctcactcctgtgaagaataaggataaaccatgaggatagtagtggtaatggtgaaacagaaagaacacagaaagctgattctagagtagggctatctaatagaaatatcatgcaagccaccaattggagccacatatgtggtttacatttggaagtagctacattttaaaaagtaaaaagaatatgtaacattaatttgaatgatatattttatttaacccagtatattcaaagtattattatttcaacatgaaaggaatagattattattttttaaaggcttaattttatttatttatttacttatttacttattttttgagatggagtcttgctctgtcgcccaggctggagtgcagtggtgcgatctcagctcactgcagcctccgcctctgtggttcaagcaattctcctgcctcagcctcccaagtagctgggattacaggcgtgtgccgtgatgcctggctaatttttttttttttttggatttttggtagaggcagggtttcaccatgttcgtcaggctggtctcaaactcctgacctcaagtcatctgcctgcctcagcctcccaaagtgctggaattacaggcgtgagccaccataccctgccagaaaacaattattaatgagatattttatgcttcttttatactaagccttcaaaatctggtgtgcacttcacatttagagcacacttcaattcagacacagatcatttcaagtgctcagtagccacacatgtctagtggctgccatattgggtagtgcggctctagtgcaatggctttcagcagttcttctgtttctacccagttcacctgtctaggcaggagacttcccatccctgtagaatgacaatggatggggaacgggggtgcagcaggtggagtttaccatcacctactccctgcactcgtctgtgcactagagtcataggcttaaaaaatgtgagacggtttctgctaagacttacttgcaaggtcatgcgacgacgtagcagggttcaagccttggaagagaggactagtgatctgaaatcagaggtctgcctttggagaagtggttgcttgccaggaattagagggcttagtcctgtagaactttactgaataattttacaaatatagtatttttaaagtaatacctttttttttctcattgtatcttaatctcatttggctcattcatggtgcacaaatataaaaggtattagaccagatgattgtttaagtctctcctagtcgctgtcactgtctcctaatttggaaggaggtccatcggagactcagatctggtccttcaagagactgtgacttccagccaggtctctccccaagtggctctgaggtttttgaagtgtgttttcaatgcccaagagctgtctatgttcagctgtgtgtgtgcttgtgttgtggagtcgggttcgggacagggaacgtggagcttaaccaggcaaagtgctttacgtctatgaccctgttgaatcagtggaacaaccatttgaggtcgatgctgtcgttattctcattttccacaaaaggaaacagaggcaacagaggttaagcaactcctccaaggtcacagtggctgtcgccatttcattctttatggttggcgggctgaattttctttcttggtggaaacctgcctgccccttcttagtcatccttcttttcctcttcttcatgacatatttttcccttttcttcccctactcctcaaccacaaacacgcatcagatgaggagcacctcatcataaagcaggttggggccttcgaatccactctcggtggcccttagatttctcaactggttttccatttgatggctcacattccttcttcaggaagctcaggctgggaatgcatgacactctcctcgcacttggtcattctacagccagtcagggatcctgttggcctgccttctcttggggacccagaatatgggagctgttgctactactgttgcaaccttaacctgtcataagaagaaaagctgctttccaagaccagaggaaggctgctggccgtgcagcggtgccttgtggatgggcagggctctgccagggttccccccgccaggtctggtcctcagcttcgcaaaccaagggattcccagacccagagcagatcaggctcggaaaagagataggagaaacagattcatgaaccgatgtataaatcagaacacctgtttgttaatgggttaagataaaaattcctcctacaaggacacgaacatgcatgcttgcaggtcagcatatttttctctctgtggaaaaccttgtgtgaagagccagactattatctgaaggttatttaatgcacttggaaacagagctaggagacttagattattgctgaaaatctaagtatttatatttgaagaagatgggatacaaaaaggtacctagtgaaaaggcagcctctccttcacacctccccactccccactccctagccccttcccaggggcaacccttaggaccaatgtcttctgtaagttcagttgcctgaggcctccatttccttggcagggatggagctgctgtgcaggccaggtgacctgtgtcttctggttaggctcccttcctagacgggttttgtcttgacatactagcgggtgggaggtggggaggaacaaaaaccgtgggagtgatagaggccagttggcagaggaggcatgcaggggtttatgagttagaaatatctgcagagggggcaaggggtggggcgaggagtgacccagtgacaacagaaaggagtgtccccagacccctggcagggagcagacagtggctgttctctgacacttatcagcccctaaggaacaggacaggaaggaaaaccacagggtgagagaactggggagactctgtccctgagaaatcctcccaaagagacagagcatgatccaaaacctcgtgagaggcggcctggccccacagcattcgtgccatagcataggtcagtcctgtcatagagtgcaaccaggtaaggtgccttccagcttcaatgctgtgatctagagaccgcactggcgaagatcagcagcaagaaagaacaattagccaattcattatgttgacatttctagctacaaggccagtattttacaaaataaggccttttcccttaattaaggttgtgacagataaaagtatattcccagctgactcatgtcacccatgtgggcaggcctattatccctacttggcccgccctgtccgcctatgagggcttgctctgtgtgcgtactcttggcagctttataaaggattcagaaggaataaacacagggcctggttcctgcccttcatccagaagagaagactcattcatacacatggtccaagccagcaaactttagttgctcaagagcaggaaaataaggctaatgaaggaggggaacatctagaaaccagctcaagcaaggagcaggggtatttaatgtggaagagtgagaactaaaagtagccttgaataccatttctgacgtttgaagaggcagcaaagcttaatgtgtggtggttaaaggcatgactcagaagccagattacttggttcaaattctgattaaacatctctggcctgttcacacaaggcaagttacttcatctctctgtgcctcagtttcctcatttaagaaagtgaatataaagaaaatctaaaaaaagaaagtgaatatgatagctatccttcagggcaattgtgagaggtaagcaggctaacacatggtaaatactcagaacaatgcctgttagggcaaacactatagaagtacttgttacttggtgtgcgtaagagggcagggagctgactgtgggttgcaccacataaccgaaggagaatcagtgaaaaatcttcttcagtatatagactaactgtttcttttcatattagagttagccaacagaagacttcaaaaataacgagcaaagaatactccagatttcgaagggattgattctctaactcagacccatgtgggttctgcaaatctagtcattgacttgacgtttttcactctcatatcactcaggcatctcatgcttcacatgttcaaaagtcatctctgcttcccatgtctacctgctcctccttcagtcttttccataccagccacccagtcattcaaggtagaaactggaccatcagccccctttgatgcttccctctgtcttgcccctgtatttaatcagtcacaaacagatgtccattctacctcctcaatatctttggagcctgtcttttttttcctccacagccactgcctccatctgagttcaagaatcatcatcatccctcccctgtaggaactttctagcttgccatcttggtttacccctgccccatggctagaaaacctgcagggcaccttgatatagaaaaagcatgctccccaaggtcaggagatagagaccatcctggctaacacggtgaaaccccatctctactaaaaaagaaaaaatacaaaaaattagctgggcacggtggttggcacctgtagtcccagctacttgggaggctgaggcaggagaatggcgtgaactcagaaggcggagcttgcagtgagccgagatcataccactgcactccaggctgggcaacagagcgagactctgtctcaaaaaaaaaaaaaagaaaaaaaagcatgctcccctctgagaagacgcatcactgggccaggactttatgcagcccaggggccagatttccccatcgcttgccacttagctggtgctcatgtgtttgccacactggcttgaccaagtatagtggttcttcttttcagttcattcttcccacagcagtcgggatggatttgtgaaaatgtaaattggatcatgccccatttctctcagatatcacccccatgcccagtccctcttggtttcccgttgcccctgagctccagatcaaatcccagctctgtcctgtcacctgcagtcccacgctgtgtcatttctggctgcattatcaaatagccattcatcaggaaggagattttgctgtaaaaacatgctctagagtagatcataggatgttagctcttaaagagagcttagagacactgcctgatgcagaggccaaagactgtgcccctgagggctgtagccagcttgcagacacattttgcatggctcacagcatttaaaaatcgttttaattagttgacactattaaaacagagattttacctaaaatatagacccatggctgctcctcaaagattagcagatgtgaagacattggacccttctttcagggcgacagttggttgcttctgagctgccactgtcccctgagatggggcatgcctgccccagttctccccagcccgcatagctctgtgttctatactcatttatattccctaccaggcccctgtagacattggcattttcagctcctaagctcgttcaacctcttcattttacaggtttggaaggtgagaccagagagctggcacatcggtctctaggtcatgtactggatcatgaaacatctgatggcttctgactcccagtcccctagtccctctgttgaaccatagctacctctcagtggaaaactaaaaagaaacacaccatgtaacttgattaattatccttcctgctgtgactgctagccaacgtgccttttagttgttttgcttatatctgttgccacatgaaaattggaacatatggtctggagggccaagatggtattctaagaatatctcataccctgcatgaaactagaccaaagaagaaaggtagagaaacagagaggattgacaatgacagggaaaagaaaatctggacagcttttgagaggggcacagcctcttccttgtggtgttgcaggacggtagggagtcagttgggtttccactctttaagggatgtgaacatcaagatgtagacagcaggccaggtgtggtggctcatgcctgtaatcccagcactttgcgaggccaaggcaggtggatcatttgaggccaagagttcgagaccagccttgccaacatggtgaaaccccatctctactaaaaatacaaaaattagccaggtgtggtggtgggcgcctgcaatcccagctatttgggaggttgaggcacgagaattgcttgagcctgggaggcagaggctgcagtgagccgagattgcgccactgcactccagcctgggtgacagaggaagactcagtctcaaaaaaaaaaaagatgtagacagcaatgagtcagtggcacaaaaagaattgaaaggccttttcttctttaggcttgatgccccatcctaccctgccactcccttagaattactgtggacagccagagcactgcaaaaaagggaaatttgtcatttgccttggggaacaatggctttcaccaatcaagaggcaaaatcaaccacagtctcagagcctggagtaagatggaaaaatcttcctgttgtctttagaggaggaggttacatcatttcttacagaaatgagccttgacaacccccacatcccgatactgcatcctctttgtaccacagtgaattgttgccatgaagctgagacaaggcttggtatgggcaactccaggcatgggcaactccagacctcatcctagtggtgatcctgggctccttcttcataagcaatagagaagcagactgtttgggaggaggaaaaagtagtgatgggacaagttcccaaaaagaggccatgggagggagttcagtgttacatgcagtcaccttttgggttttgtctctattggattattctgttttttgtttctcattggagtctagaaatgtttaatgatacttgatggtacttcctttatccatgtaaaagtatatctaagaacttctgcatatattaacactctgtaatgattaagccaatgtaattagagtattgtatcagcaagagaaatatttttctctagacatagataaatcaaattttttctttcaaatctctgtgcaattgctccaaaatggaaatcagttttatgatttcatggattgtcatctccttacaacagcagactaatgaacatgatgatttatgcaaacaaaatatactcatttaagaatatgctcgcattggccgggcacggtggctcatgcctgtaatcccagcactttgggaggccaaggcaggaggatcaccaggtcaggagttcgagactagcctggtcaacatggtgaaaccatgtctctactgaaaatacaaaattagcctggcgtggtggcaggtgcctgtaatcctagctactcaggaggctgaaacaggagaatcgcttgaacccaggaggtggaagttgcagtgagccaagattgtgccagtgcattgcagcctaggaaacaagagcgaaactctgtctcaaaaacaaaaaaaaaaaaaaagaagaggaagaagaatatgctagcattgttgatttggtttatagactcccaaaggcctgttcctctgaccctcttaatgaatacaccaaaagagtgattaatggattaataagttagctccatcccctttcacttcctacccttagactaaaacaattttttcaaattacttctactaatgttgtactttcattaattggttggatcaacagggtagaaagctgttttctttttcttttaagaattctctgccactaagttcttccagccaaagaatgttcattcactataatacctcttcagttcaggcatttatttacttgaagtgtgaatccattgctgttctcatcgtgtctaactttgtctttttagaagtaaggtatttttccttgcctgtggttcacgcagaagtggagataatgattgtgttgagaattcagggagagcctgcaagtaggtaatagaggtgggaagtggagtgagtaatagtcagaagagaaagaagcaaggctgttggaatggagaagtctaaagagactgtactagaaggaactcgaatcattaaaacctagctgcacaggccgggaaattgtcaaatatcagagagtctacagttgaagcagcttgggaacaactctctgcagtaaaaatgctgagttgtggagaacacagtgacccaaactgacaaaataatgaaatacatggcgtttccccagtgaatggaaagctgctttttaccgtgttccaaaacactggctccgtttggtgtgtgttttgtttttatttgtaataccctactttgatgtttcctggaaactctcctttgagtctgtgagttttggtgtaagctcagtggcaatgttaccctcacctctaggctgctgtaggacacaccccggtctcattttcagtgtctcagcatactttccaatgcttccagtaatggattgtgcaaaacacaaagccaaaagcagatgggacatatgtagataagctgtttcatttttcatccctataatttcctaggtttgatagcacttcaattttctaaccataaaagctgcttctgtgctctttggaaaacacacacacactcatacacacacatacacacacacacacacacactaccaggaagcaggctaaaagaatattacatggggtttttgtgttgttttgcttatttctttccttttaaaagaagtaccttgctgctggaaaagaagtcaaaaaattgctttgaagagtatatttactagagttcagtttacttagggaactgtcgtgttaacaccgaagaatgcattagaatgcatcattctatgatacattatccgagctgaagctgaaacctagccttctgccgagtggtattcctgaagccagtcactcttagaagtgataatgtttatttaccagaactttaaatgctgattgtggtgtctgtgtctcctgcccagggggaatggcccttctgtccatggaatgtgatagcccagcaggaggtaaaagctgcccctggacagagtgaagcatgcagagggaggcggagtgaattacagctgtctctttggaccacccgtctttttgccaattaaatgtttacattatctttttgctcagatagttttcacaagtatatattcattaatacatggggcttgttccaaatcgatcatgaaaataagtttttgctgttggtattttttgttaaagtacatctaaccccaaaactatttgatgagggcagtttccctcaggctgtaaaatgaattaagggagcactcttctctgtagtcattttcttcccgcgttggttctaggctcaatcatttagatgtctctggtatctgcatagtctgggaattatacttgaactagcccgaaattactgcccagtaatcctctttctcactcaagagatttgtcaacattcatctaaccagagacttagcaagacatagagaatcatctagaagagcactgactctggagccagaaagacctggagccagacaggctctgtcacttactagtctgagtgatttggggcaagttattcagcttctccaaatattagtgaccccttgggagaagatgatggtgatacctatcttgtggcgatggctttaagagtaaaagtgtttcctttgttttcctttctccttgttttaaaatgataggaggagggagcacacttatttcaaaactctctgaactggaaggggctgtgttggaaactgtttctaagcttggaatggagcatgtgtcatatttgtcatacagcggagagggaaatgacttctcttatttctcttctctgttatccacccaatagctaggagataaaacatagggctggctaagcctaggagaagcacagcagtattaggctatgagaacctattttgcttaacctctttccggcaaaaggtggagccactgacaccaaaaaagggcaagcaggatgtccagtacctctctccctaacttttcagaccctttgatgccacagaggaagacaggcatatcggcaacatggcctcctccttccatctccctgatggttttgtcttccccattaatacaagcacagttccttttaaatgaacaaaaagtgagacaaatacatccctagaatctgacaagtatttttggaattctgtgcttttattttctcttctacctataaagtacatgaatggcagggctgaactgtcttcaggaaaatctgaaagcccggaacttattaacatgcttgacacctgcctctatgagggacttctgaagccagagatattctttgtaactgaggtccatctgttgcacagatttttaattcagatattcttccttctcaagccaaggctgagagagcagccaattttgtggaaagatttctttaataagaaatgaataaaactatcaatgctaaataaaatagaccgctgtgaaacttgggttaaatcccacagggaagagtatgtgagattaactgcattatataacaaaaccgcctttaatagctggcacgattctttttgttgttccaagggagaagcagccaagactagaaccaaagcacatgatattattttaaagtgctgcagcctctggaatttttcctcggagagatgtcaggatcccaagtcttcctgtgatttatagttgttttaaacgtttaatactttttacattttcaaagctatatcctctgcttccagcagcctaggggtgtgtttctgttgctttgaaagatgatttccaaatgggaagttttaaaactgtgcaaaaaggaggtcttacagtaccgggtgtttgagtgatttttaaatggatgaaagggagaaggctgtaaggcagggcccacggagtctttttctcagctccttatgataacccaacagagaagtggctggagagaactttcagagtatcaccatcttcacacagcaaacatcgctgaaccagacactcccagacctcagcgagctcactgtcaggtatggctggcaagcaagtgttaggttgagccatgtgaaactgccattgttgtagaccagaaatggtagaatattggcaatttcaaatgactcaacctaataattagatgaaaactatccacagtgatcaagactgtgatggccatcctgcagtattctgggagagtctagggaacaggacctaacccagtgaagtggggccagggacaagaaggggacaaaataaacccaaaaaaacccccagctttattgaggtataattgacatacagtaaactgcacaagttcttagtatgtaatttgatgtttccacacacttatacacccatgaaaccattgccacagtcagaatgatgaacctatccaacactcctaaaagttttctcatgtccctctataattccttcttcccatcacccccatctccaggcaaacacggatctgccttctgtcattatgtgttggtttcatttcctagaatttcacataaatggagttctacagcattctcttttgtctggcaacttgcactccgcataattatttttagatttgtccatgttgaagtgcatattaatactttgtccctttttaatgtaggacagtatttcattttgcagatatgccatagtttgtttatgcattcacttgtcgacagacatttgtttcgtcggctattacaaataaagctgccgggaacattcatttacaagtctttgcatggacatgggctttcttttctctttattaaacacctagaagtgaaatggctagactatatggtagatgtatgtttaacgtgttaagtgactaccaaatcattttccaaagtgtttgtcccattttatgattctatcagcagtgtatgagagttccgtttcttccatatctatgccaacattgtcttcagtcttctttattttaaccaattttattgtggtaagaacacttaacatgagatctacacaatacagtattgttaagtataggtacaatgttacagatccctagaaattactcatcttgcataaatgaaagcatacctgttgaacagcaactcctcatttcccccttcccccagtagtggttccctcctggcaaccactattctccgtttctatgagtttgactatattagatacctcaaataagtggaatcatgtagtatttgtctttctgtgactggcaagcattctaatttgagtagagtggtattgcattgtgattttaatttacatttctctagtgagtgatgttgagtgtctttttaagtatttatttgccatccatgtatcttcttagctgaagtgtctgtccaaatctttgcccatttaaaaaattgggttatttttgttaagctttgagaattatttgtatatatatatgtatacaagtcctttacaagatatgatttgcaaatattttttcctagtcagtggtttgtcttttaattttctaaacagtgtctttcaaatagcagaagttttaaattttgatgacatccagcttatcaatttattcttttatggatcatgcttttagtatggtgccattttaaagaagtctttgcctaagctaagcaaataattcatctatgttttcttccagacgttccatagttttaggttttccatttgggtctatgatccatgttgaattaatttttgtgtatgatatggggtatgccttaaattcttgtgtatgtctgcatgtgtgtatgcacatgtgtgcttgtgcgtatggagagtcagttgttttagcatcacttgttgaagaaactatcctttctccattgaactgcctttgcacctttgtcaaaaggtttccacatgggtgtaaatctatttctgaactttctcctgttttattgatctatttgtctaccttttcactaatacccactgtcaatttctatagctttaggatgtcttaaaatcagggagtgtaattattccagctgcattctttttcaaaattattttggctcttctaaggtcttcacatttctttataaattttagaatcagcttgtcaatttctatttttaaaaatatgtttggattttgattggaagtcattttgatcgggagtgattgagctttccagggggatgtgttcatgggaggaaacacatttttatatgtgaacaactggcattttaagacccatacagcatttaaaaaattttccacagccttgctccgaagtttattgaaaacccatctgtgaaaaatagtgttatttgatgccaaaggatacaaggaaaaataaaatgttctaattctggtccttatttcctatgatttcaccttttttttttttttcaatgtcattccagagagaggaaagacagttatctcaggcagtcttttacccctgggaaaagaccacagacacatgggagggtttgtgctgccttgagtgaaaagagtctgttttgttatgctctccttcccccagctggctggaggctcatccaccaagctttagactattatgctgtgtaggattttctaccattatctggtacaggaggcagaaatcaaacccctataaggcttgcaagttcctggacccgggagatcagctcagtgactgggctttctcatgcgtggtaggagagtggatgctgggggtagccaggatgaggatggctctggtgagctgacaagcaaagctacaaatctggaattttgtgaaacctctcaatttttaaatgctctttctgtagttttttgaactggacaggccaaatgaaacacatctacgggccaaattcagtccattgctaccactgtgcagcctctgatggatgggctcttttatttgcttttagggtcagctctttcatcagctccctaaagttttggttttttgttgttgttgttgttgtttgagatggagcctcgctgtgtcacccaggctggagtgcaatggcatgatcttggctcactgcaatgtctgcctcccaggttcaagcaattctcatgcctcaggctcctgagtagctgggattacaggtgcccgccaccacacctggctgattttttgtattttagtagagaggggttttcaccatgttggcagggtggtcctgaactcctgacctcaggcaatccgcccacctcggcctcccaaagtgctaggattacaggcatcagccaccacgcccggcggttatttcaacagttgcttatggagcactcctgatgtgccaggaaatgctgggtgcacaggaaattgaccagtggtggggagagcctgccacgggttctagaggctcctgcttcaatgtggagctcaggcgtggcagagagaggcatcccagtgccaccacctactctcacctgaatctgccccttcctcgaatcttcgctgtcacttatttcaggccctccaagaagaggatggctgatttacgcttggaaggctcccagaaagcttcttcgaagagatgacatgtgagctaattattgaatgtagagtaagaattagccagctgaatctgctctagaacagtgttggtcaaaccttgctacctgttagtggaacatgaaatcaatttaaaataaaagaaggtagcaggtagtgaaggtaagtattttttgttttgttaaactttttttcagtctctctcacacacacatgcacctgcttcttttaaaggaaacttttaaaagaaaattttggttaaacatatataaaaacagaatctggaaaactgtttgattttgagaatgttaacaaggagattaaaagaatatttattaaggataagcctatgttatttctgcagtcctttataaatatgccccttcacctgcttatttgcaacactaagtaggtactgaactaagtaggtactgaatacttgctaggataatcatctgcaaatcactctattactgactgagctccacagtaatcatgagactaagcaagtgactttaattctcttgactttatctccttcattgaaataagtgagttggtctagaaaaggtcgtgttgaagcctaagtttcacagagatgctttagacaatctccaaacaatttacagaaatagctaaatttgcccatttctgtatcgttagcacctaaaatgtacttggcaatatagcaggcctcaattaatatttgctaaatcaatatgtctgtcttcagggtgccattgtattttatgtgagattgggcatatttgaattcactaataaaattcttcactgaattctcactttaggcacaaaatttgaaacattgccaggcacattaacctgtgcctggagtcccagctaatcaggaggctgaggcaggagggtcacctgagtctaggacttctgggctgtagtgcactatgcagatgggtgtctgcactaagttcggcatcaatatggtgacctcctgggagcagggtccaccaggttgcctaaggaggagtggaccaccccaggccagaaaaggagcaggtcaaaactcctgtgctgatcagtagtgggattgtacctgtgaacagccactgcactctggcctgggcaacatagcaagaccatgtctctgaagaatgaaattttttaataattttttttatttgaaatattgcaaatcctagaaaattaaaaacatatcaagaatcacacaatttcaaagccaaatgggattcccatctgtgaatctgcatggcagcacctcctgtgcttcgtcaggttagttttgcattatgtgcagctgcacggggaatgcagctgctacccaaaatgcaactgctccacaagtgttttaaattactctcttaaacgatacttcttgggatctgcttcctaccagacattgtgctaggggctagctgtgaacaagaaagatacagctctcatcttcctttaactcttagttcactgcggtatatgccacatgctttcatgctgagttaatacctgcttgcaggttagcgtctttgggtagaccctgtgatcaggctttgcctgcatctgtctgtatcacatgcagtcaggtcactgatttggaagtggtctgtttgattgatgtggattctgtgagacagtcatcttccttgttcctgattccaaacttgtgtgttaatggaaccaagtttgctgtcaagtttttggttggttttgggttttttgctagggtgatagtgtatttgcagtcagtgaaaacatctgaacctttccttctgaacagcattatagccaggttgaaaacattgtatacatttatgattgatttttttaacttgatgatatcacatttatcccatgacaaatcttgttaggatcattccatcaatctaatgaagttattttgattcttaatatgtcaatcaccatatcactgccccttacagctttgggaagacagcaaatttaaaagcctgccttctctctctcttcctaggatgctaataagagaactgaaagtttcatttataagattgttgttgagtcacagctttgaaggattttgcttggtaaatttgcgtgacatccatacttttttcatttctttggtcttactgccaagccactcaacacagctgaactccatgaaagaaatatgcttttgatgcctgaagtcagctgccttcttagcgttactgataatcttacccttcttctaggcaggtttggcattaataaggaaaacataagtccatcagaattgttattttatagtttataatatgcaattgaagcttcttaatctttctctatactctttattacttagtaaacagcagcaaagataatatcaaggaaccataggccaccttgttttcttcagctttaatatctgtttacatatttatatatttgatattgaagatgaaactaaagttataagtatttttaaacaattttgaaaattttggagaacaatcatcagtaggaaataattacgtgattaaggagttcattttccctatttagaaaagggggaagactgaagaatgcaaaatattatgttcacatatacgacttctatataaaggaatcttaaatgtcttttgctaataacctgtgaagaagcagtgttgtcattaatgttgaacttacaatagttatctgagcattttggtaaacagacaaggcacttggaattttgtctctcaacatctgtactctgcttttaacttcaaaaggtagttttgaagtacatgtaatttttgccatctgccactgaatttgtgatttagaaatattagaagcagggccacattatgactttcttgggctgcaggctcttttgcctttgtggcaaaacttctcatgactttattgtgttacacaaatgctaagtgttcattataaggaatccaagggatgtagaaaagtaaaaagaaacaaatcataaattctatcatttaaaaataagcctcattaatattaaagaaacgttgtgttagataccaccctaagcatgtttgcagatgggaagatagatggatggagagatagatatgctttcaaagaagagtgatcatatgatacaggctaagtttttatttatatttatttttttgaggtagggtctccctgtgtcactcaggctggagtgcagtggcactctcacagctcactgcagcctccacctctcaggcccaagcaatccttccaccctggcctcccaagtagctgagaccacaggcatgcactaccatgcctggctaattttttatttttatttttgtacagattgaggggtgtccctatgttgcccaggctagtcttgaactcctgaactcaagcgaccctccccccttggccttccaaagtgtataggcatgagccactgcctcagctatacacactaatttttaaatgtaaaaaccattacacttaattttacctgattttaactggagaaaactaagtgagaattaaggaattactgaactttgaacaaacattttttcacataaaaatgttattttttccccctctatggttaagtaaagagataagaacttgctggttttcattttgtgtttttttttccaattatgtttttgtggtaggcactgttgctgttcacccagttttcttcctcttctgggatataggagaatcatatttgctcagtctcttcaagttagatgtgaccttgtggcttgctttagtcacacaacatgagcagaaacgaccattatggatgaatgcatttaattaccgggtctccagtctcaccctttcttctatcaccttggtgagcctgggtgctcatgttaatgtggtgggcgcataagatcaacacagcacagagtgcagagccggcacgtgaaaggcacagcccttacccccatgggcctgcagtgcagggagtatgagcatgaaatgaactcttgatcggttaggtcactgagacttgggacttgtttttaaccatagattacttaggttatcctgatgctatcattttcatactagacagtatggacttcctttctgccatgataaataaggtcattaagaactttcactctttttccttccttccttccctttagattttagttagttacattgctgttttcacatagtcaagtatataatatttacattctattctataatctagctttgattttgattagttatgttattttcatatagttgaagtatataatgttatgttcagttgtttaaaattagtttggtttttttcttttttgagacggagtttcgcttttgttacccaggctggactgcagtggcacaatcttagctcaccacaacctctacctcccaggttcaagtgattctcctgcttcagcctcccaagtagctgggactacaggcctgcgccaccacatccggctaattttgtattttcagtagagacggggtttctccatgttggtcaggctagtctcaagctgcccacctcaggtgatccacctgcctcggcctcccaaagtgctgggattacaggcgtgagccaccatgcccagcctaaaattagttttatatttaaatgaattcagtgcccagtactaatctttttcctatggctttcctggtactgatattgaggaacagatcaaggggcttagtggagactgcctggcagaggggaggggtattttatcatttgcattgtttagaattgcctgcacatggtgatgtgaaaaacagacagacttttaatggttttgttactaatttaaaattctctataaacactgcatcctttattgcctgcatctgaagcaaaccattttcactggcccccccattggtatgcactgctgatagctttattttatgcattgcactgactagattgtcaagacttttcaaggagggctcctgaacgatgaattttttagttttttttcatgttcaagaatatctgatgattaccttacctttatacttcaatatcatccctaggagtaatatttatgcactatactttattccccttagaattttggaggaattgtttctttatcttttgcatttaaaatacttttgaaaacaatgactgactttcccctcattgtaggcaacttggcttgttctgcttgaagaattatttcttggaactggaaatttaattattgaaccagggtacatgtttcagttaattgtttcatattcattttttgtaaaaacgaagtatgctcttttgacttagagctctgttgcttgctcattttagggatattttcttgtattggatctttaaacactttggcctgggttctctacttcaggaatactcattaatctttctgatggattatattttttctcctctatgtctatcatttttctctgtaagttttgccttttatcttgatgacctgaaggcttcctaggatataaataattttgagccatgttaattctattccttggtgtttctcacttattagtttattccttggagattgtagatttttggttttggcccattttcttccacataatgctctatttttaattcatgtgttactctgatatgttactcacttgccatgctgtttcattccatcttgcatatgtttgggtgactgtggcctttggggctctgatccactggggtgatttctccttgacacccttctgacccctgtgtattaccccttgaggaccaggtatttcctgtcctgttcacttttcttcaggctataggcacatgtaagcaaaagagcagggcaggaaagtgagctcaccaagttgtttacgcgtaggccaccctataatgcctgtgctgtgcaatctctcctgagaacatgcagaatgtcttctcattctgccagggacagttagttctcgttgtccacattttttatctcctgtcgcttcatgtagcagttaccatctccactctgctgaaattagaggagaaaaaaatgtaagaaacccacttaattttttcctctttagatttggggatagtagagtgaatctcttagagttgagtttgggtgaataattgatagagcttcaggaaggtaggaattggaaagtggctctgccatcttttttgatgggcttcatttttattttattaccttttcttcattcccttaggtgttaggggatggagactctggggtcaggcctcactctgccatatttacccagaagccttcttggggcttgcctgtctttctcttttcaaatgaaacatggatgtgggaaaggggagttcattgtagcccagtttggcataaaaagaggtaacagcccacatctaaccttgacaatattttaccattatggagtttcctctctttttaattttctgttcaccctcagattatgcaatgtaatttctctggttttaaatacaaagtaaattaaaagtagaagcacttggtaatactgtagctatagagaataaagctaagtgagtatgttatcattgtaatgaatcattccttttcattcattcactcatccagcaaatatgtagtgagtgcctactatgtgcaaggcactaccctgggtgcctggagtacatcactgagcaggatggacaaagctcccctgcctgcgagacacttacattccagcaggcatgagtgtgtagggttgggggcaggcagcgacagtaaatacagcacatctataaaatatatcacacgttacaaggtgatttatggacaaagggaatgacagtggaatgggagttgcagtttggaatagggcagtcagggcagctgccctgagaagttatatttggtgaaggggtcagtgaaagagtgtcccagggaaagggaacagctcgtgcaaggctctctggttcgcagctggctgctgtgttcaaggaaccggatgaatgacaaattggtggagctgtgtctggtccatgtgagagaaatgaatggcccagcaaactgtaacattaattgtttttactgttttgaaaatttactgtaccagatattcatttcacgtttttgtttgtttgtttgtttgtttgtttttgtttttttttttagagggagtctcgctgtgtcgcgcagactggagtgcagtggtgcgatctgcacactgcaacctccacctcctgagatcaagcaattctcctgcctcaacctcacgggtagctgggattacagacgtgcatcaccacgcccagctaatttttgtatttttaatagagacaggttttcaccatgttggccaggttggtctcaaactcccgacctcaggtgatccacccgcctcggcctcccaaagtgctgggattacaggcatgagccaccgggcggtttccatgtgtgatctttaaaaggcagaaacaaataagcaaaaatcattactaaaggcccacgagggttgtttctatcttagaaaatgtgtaaagaaaagtgatacaacaataaatggtttgatttaatgagaagtcaaaaatcataagatctgttgaaaataacaaaatcacttctaaaaaagataatatgttttattgaaataaagccttagaagtcatctggttttaccttttacaaagaagaaagcagtctaagagaggccaaatgacttatcccaagctatacggctaggtagtagcagattcaaatttatactacccaggcttcctaattcttagcccagagctgtgtccaccctaccacccaccttttaattcagtgcgagctcaattattgctaacagttttattgttgaccttccatggactcgatagtcaaatcaagtcttccattacaataaatgggatttatttgtattttgcaacataaccttgttctttggagtgggtttcacttaatcatcctggaaatcggttttagaaagactaaacatgatttctccatctctctgtgaggaccaaattgttctctgtgattatctatcagaacaagcagaacaaggggttctaattagttttccttttgaggtttttttttttttttttttctttttccaggcagtcagtctctcagccaaagggatttttctgcagagcctttgtactcagggaccagggttaattcatgagtcctgggaggtggctgatcaggttagtttttccagcctggaacagccccgccctacccctgacctcctccactccaccactctactcactccactcactccactcacattagctacagagaaactggatgttgtcagccccaggggtaccgtgagacagctgggttcagagtgactcttgaccttccctctctcactctctccctccctccttccttcccttcctcccttgcttctctctttctctctcttttttttttttttcctttgcgctcatcagtttatggtctacttcactaattggtctgtgaaaagcttcttccttttccattcatatactcactcttgttccccctccctctcatagataaggataactattctgactgatatgtattcctttatttgtgtgtgtttttgtaagtggtgttttggacatacattcttttttgttttttgagacagagtctggctctttcacccaagctgaagttcgatcagtgacacaatcagggttcactgcagccttgacctccctggctcaggtgatcttcccacctcagcctccccaccgagcacctgggactacaggtgtgcaccaccacacctggctaattttttgtattaatttttttttttgtagagatggagttttgccacatttcccaggctagccttgaactcctgagctcaaacgatccacccgcctcgacctcccaaagtgttgggattacaggcgtgatccatgggtgcccggcctggacatatattcttaatttgcatttgtatagacctgattcttttccttacattttttgctctccactgcatttagtccatcccctctaactctgccagtattccctatgtgctgttttgtatttctatatctcttcccccagcaatgagcttttagattgcttccaactcctttcttccgacagtattacctcatataaacaacctcatagtgacccctcatggatctgtgtaggaattttcctgagatggagatatctatacctatatctatatctcccaaaagagggtttctggattataagatatacgtgtatttgctagcacaaataacgaagctttacacaaacaacctaatacatgtcccttacaggtcttttttagaacttttcttgggtacgtctaacagaacaagattggaaagtacattcaattttacccacactgccaacttgctggccagtacgactgtccgatctttatttccattggcggtgaacaacgttctctacatcacgtcccagcctaagcttggtattgtctagatttctatacatataaagtgctttatcattgttgtttacatttgtttcttaaatttctgcatttgagcatctctttatgtgctcgcttttgtgtttcctctaattcgaatcacctgttcatacctttgttctgtttcctgtggaggttcttacctttgctgttggttttcagaaacaccttacccagcctagatagtgtttcccttattggtcttagacattagccttggtcttagacatcagcttggatcacgtctccttcattgagcagaaatccgtaattttgatataaaaaatttacctttgggagattaattttaaaaaccacttctgaccacaggccataaagatactcctgccttattttccatgaactttatagttttaccttttacctttgggactttatctccatgggatccaccactgttcatggtgtgatgctctaggccagttttcttttcctctgtaattagctagttctcctcagtttggggaaagcctcttctttccccattatggaattttaattgtcacaataggaattggcatctttatattataacaatgtcatcccatctagcacaacagggactctccttttagtcagatcttgctttatgtcttttaataaaggcttaaaattttccccatgaaggtcttatacagtctttattaacttcatagatcctttatccttctcattgcttattgtatttttattatgttttgtatttgattattgtaagagtgttgaaatgctgctttgtagttttttgctttaagttgatcttgtatctggcaattttgctcagtcctcttactctaatagattatctgctaatcctgatatttttctatgtattaggtcatattgtctgaaaataatgttagttttatctcttccctagaaatgcttattatttataactaactaatttcttttttttttttcttctttttttgagatggagtttcactcttgttgcccaggctggagtgcaatggctcaatctcggctcaccacaacctctgcttcctgggtccaagcgattctccagcctcagcctcccgagtagctgggattacaggcatgtgccaccacgcctggctaattttgtaattttagtggagacgggggtttctccatgttggtcaggctggtctcgaactcccgacctaaggtgatctgcctgcctcggcctcccaaaactaatttcttttctttatagcactggtcaggacgtccaatactgtattccacagtattggatcttatacagtccagacaagtgtgcatccttgtctttttaaagagaatacatttaaagtttcttcaccaaatcaaatgcttttacaatcttaaccaaattaagaaagtttcccatattttgaatttttaaagaaatatttttttcaaattatagttatgtgtcaaactttatcaaatttttttctgcatctattaagataataatgactttcctctttggtggattgatatattgagttaagtggtagattttatgatgttgaaatttattgcaaacgtaggatacattctacttgttcatgatatgttactttcaattttttgattcaattacttaatattttatttataatttttgcttctaaaatcgtaactgaaacaagcctataatttttcctcttcttgtattcttaccctgtttggaataaaaactgtagtatcctcataaaatcagctagatagcttttgtccttttttgattttctggaacaacttacatatgataggaaattaagtgtttcatgagctttttctttttccccctttaacttgtccaaggtccacaggatccatgaacatttgatggagcttacctgtaaagccatctgggcctagggctctttgtcaagggagggctttgtttgctatttcagtgtatttcatactttggtctgttcaagtttctgttttttcctgcaccaatatccaacacttctgagtgtttagaggtcattgttcagcaaactttcactcctcctaccccgtgggaagatttaattccctttcctgttggtgttgggcttggccacatatcttgctttgatcaatggagcattagtggacttgacatgggcagaggacttaaatgtcctcacagcaggatttagccctgtcttctaaaaagcggctgtgctggaacgggacagtctcttcgctcagcttttttttctagtcccgcacacctgcagcatatgacacttacatcagtaacagtggttcactgcagccgtgagctggggtgactggtatattaccagaccctccggaggaatgtatatagtttttaaaagtgctaccccatgaccaacccagtcaccgtcgtaaataaaaaaaaatacctgcttacaacatctcctctcatatcacaaaataactgaagttgagaaaggaatttcatagttaaaaaacttttttgactcttccagcagctatttgtgtgtctgctgcacctcttcttagccgttggtcttcagcttctcaactgtgcttttgaaccctggagagttcccattctcagattacctgtaaggtgatcacatcattgaatgcaaggtgaaaacaggaggttgaccagacaggaccctgggcctgtggactgtccttcactcacagaacccacatccaaccagttattccagtgaaagcaataaggaataggtaggaagtactgctgcacagagattcgttagaagacatggctttttttctggaacagatgaagtcaaacagacagctagtggagatggtgagtcgggaacttgacttggagggcttttttgctttaagatgatcatcagctcctggaaaggtgtacgttgagttcccttttgtgctaggcaaagggctaaagactgaggggaaggaggtcacagaagtagaagagctggtctctgcccataaggagcttcggagtcagcaatgtcatatacaaaacctggaaaaattatgtgagaaactttcacaaaatgcaatagggattagagaggagatttttagttttgaggccaaaacagtgattgataggcatggctgagggaggaggaggtagctggagaaggagggagaatgctatgttgttttcattcacgtagtgaccacagaaatgagggatggaggggcgagagaataagttaagtcagggcgggggtgggggagagtagggggaggtgtttccattttcctttaagtggatccttggcttcattgcagtaaatggggttgtcagtatatattgccccttttgaaaccgacgagtttcactgagaatgggattaaaagattgcatgaaaaatttaggatctgtataagggagaacattttatacagccctgtatgagggccgtctaaaaggagttaaattcccatttgggattttttaaaccaggatgaacattctataccacaatgtctggtggttttaaccagagatagtactgcctcaccccagggtatgtgaacatgtgtgtttgtggtaaggtaggggtatcactagcaattagaaggtgcaagccagggatgctgatgaccccgtcatgtactggagaagctctgtacagcacattgcctgcctagaatgctaagggcacacttgtggagaaataatgcacttcctaagcttcagtcatttggggtccccttgtttaatttttgcggtatctaggtaccatttctaccactaatttaatgctttttttcttttttgtctttttattcttttttttttttttttgagacagtcttgctctgttgtccaggttggagtgcagtggcgtgatctcgctcactgcaacctccgcctcccagagtcaaacaattctcctgccttagcctcccaagtagctgggaatacaggtgcccgccaccaagcccagctaatttttgtatttttagcagagatgaagtttcagcatgtatgccaggctggtctcgaactcctgagctccagtcatctgcctgcctcagcctcccaaagggctgggattacaggcgtgagccaccgtgcccagcctaatttaatgcttttctttaaatttatttttatttatgtatttatttatttatttatttgagagggagtctctctctgttgcccaggctggagtgcagtgatgcgatctcagctcactgcaacctctgcctcccgagttcaagtggtcctcctgccacagcctcccaagtagctggaattacaggcgtacaccaccatacctggctaatttttttgtatgttagtagagacgaggtttcaccatcttggccaggctggtctggaactcctgacctcaagtgattcacccaccttgtcttcccaaagtgctgggattacagacatgagccaccgcacctggccctttaaatttatttttaactgacttttaagtttttagttgtcattctatatctgcattttaatttacttattgtgatccttgcaatcatgagtttgaaatgctattgatatttttctaatcatattaaaatagatgactattgcaatacagaatgttcatcttgcactccgctagtggcatgcatgctagctttgagaagtagtagccagatggtcgcagtggattaatttatggcttgacctgattttatgtagtatatccttgagagttgacatccttgggactctcatttttaagtaaccttgtgttcagcagaattcacgaactgaacgggtctcatgaggatactgtccctgatagaggtcagacagcacaaacagctgtgattgcctctctatatgtgcaaagatgtccatttggaaaggcttgatctgcttggtggggtggtgcttatgtgccaattacctttgctccggcctgtgtccacagactgctggccatctcccagttatgtggccctatttacaagggctaagtgaccctgaaagtgtggaagaatcagagcaaactctgtccttacttccaaataattggctcgaagcatatgttgcattcatgttggccaagaatgagagagaaggatgacagagtatagcagaaacacagacactcccttcccaacacccaaccaacagaacgaaaatgcagttagaaacaaaatcaaacccagccccacaggctcttgcagcaagcaaacaaacaaaaaacaattacagctttatttcaaccactttgaaaagtggcaggcaaggaagggtgcaccccaccgtagcccctcagaagcagtactggaaaaggaaggcgagaggaccagttcctgagggttcctcctaatacagatcaatatgggaagcagctggttgaggaggtgagtggatagacttggtaaaagttaaaaaaacaaaaaacaaaaaacaaaacccttggcagagttaggaaggcacctggggaggccatctcctagtctctgtgttgagttacaggaaagagaccataggagtgagtctgccctggtttggcagagtgggccctggtctaagacatttaactcccctccaaaagaggacagagtatagagcccccaaggacaggcctcatgactcctgcctctcctccatggcagaagtgttcatggaaagcagcagccaacctaaagttgtagctcagaggtagaacgacacctggttccctataaagtgaggagagtgtcaaaagatacatcagcttgctctgggagagcaaagagcagttctggacagagatgttcacgttataagtatgaacaagatggcagtgagtgtcatgactgttctgtgaaatgctgcagcagaggaatgcaagagaggagcacagcttgttggctgagcacagtggttcacacctgtaatcccaaaactttgggaggctgggtcacgaggatcagttgaggccaggagtttgagaccagcctgggcaacacagcaagaccctgtctctattaaatatatatatatatatttttaataaagaaaagaaaggaacacagcttgcaaaaataaacatacaaccaatctggtctataagaaaacccagtcctagaaaactcaacctcacaagtattttatgctatagaaagactcagcatcaattgagtagaaacaaaaactcaagatgtcatcatgataaaacaacaatgggattcttttaatttttatttttaattgtggtaaaatgtacataacatagaatttgccattgtaaccatttttaaatgtacaattcagttgtgttaagtaccttcacattgttttataaccaatctccaaaagtcttcatctttcaaaactggaactctgtacccattaaacaataattccccatttctccctcccccaccccctggcaaccagcattctgctttctgtatctgaattcgacaactccaagtacctcatatgaatagaatcagaaagtatttgtccttttgtgactggcttattttacttagtgtaatgtcctcaagattcatccatgttggatcatgtgtcagaatttccatcctttttaaggctgaataatattctattgtatgtctctgacattttgcgtatccattcatccagtggatactcagtttgcttccacctttggctattgtgaataacgctgctatgaacataggtgtacgaatttctctttgagtccctgcattcaattcttttgagtatatacccagaagtgggattgctggatcatatgctaattctatttttaaatttttgaggaactgccatactgttttccacagcacctgcaccattttccattcccaccaatagtgcacaagggttccaatttctccacacccttgccaacatttgggacttactgttttttgttttgttttgttttgttttgatagtagctctcctaatgagtgtgaagtggaatggattttttaaaagatagagccaagaaaagaaataaagaacaaaaacacaatacaacgttaaaaccagaacacacacacacacacacacacacacacacacacacacacacacgatggacatagctgaaaatcaaagagtgagataatcccaaggaggggattaaagcaataaggacaatataacagccatggaggagaggcacagccatccagcatatggagcaagaaaagaatgcaaccatgtgacccaggaagattttcccaaaaggaagaaacaactgaatctttggttagaaggttatgccagccaggcacagtggctcacgcctgtagtcccagcactctgggaggctgaggcaggcggatcacaaggtcaggagatcgagaccatcctggctaacacagtgaaaccccatctctactaaaaatacaaaaaaaaattagccaggcatggtagtaggcacctgtagtcccagctgctccggagactgaggcagaagaatggcatgaacccaggaggcagagcttgcagtgagctgagatcacgccactgcactccagcctggatgacagagcgagactccgtctcagaaaaaaagaaggttatgccacatatctgaaagtgcagatgtagaatggataacatataccctggtctaaagtttcagtatttagacctcagacaggaaaagcaagttacacaaaatactggatgactaagttggtatcagaattctccacatcagcaacccctaccataaagtacgaacaaggtctacaaacttttaagggaaataacattatttaaataatataatttaaaattatgaatataattttatattatactgttaagaatataaaaagataaaaataatataaaattgttctctaaatattaagttattattccagtgaaggcaataagcaggatgccttgacctgaaagaagtcaagagactatggcagtcatgagcattgcttgaaaaaaaaaaaaaaaaaaaaaaacctccctgtgatgaaattgacccaaatgactcaaatcagaagaacagacccaggagtagaaaagccacagatgaagaacagtaacaacagcaacaacaacaaaacactggtgagcattcaaccattacaatgccaccttaggactaaacaatggggcaagggggcatggatgattgttaaagaaatgtataactattaggcatctggcaaaataaaaattatgtaagtgaaaaaaaatcaagtgtgaggaagtggagaggaaatgtaaagtaattatagagtatttctataaaaacatgcagttaacccttgagttttcgtaacttttttctgtgcattaaattgtgtgtgtgtatgttttcaagtatgttaacttgtaaccgctggtcagaatgtcattttgtttcacttctgctttttcttctgttacatccaaacaaaattacatagctcttactggaaagaaaaggtcatatgttatcattttaaatgaacccattaccctctatctagccttctaccagtgtatgtgcatacagagatatccagaatgatggtcaccaactgtaaacacaatagcgggatattggatgatttcttttcttctttgcgctgttttctgttgctttattttttttttaatgagcctatgtttttatacaagccgtaaaatcattgctgttaatctcaactattgatcagtagtgtcatcagtattctaattgcgtcatagtcattgttttttaaattgtagtgttgacaaacaccagaaagagcccttgacaatatttttgcaactcatctctaaggtgctggccgctgcccagaggccaaagacatgggctgtggaaaacatcagctcttgtaataaggtgcctttgccttcttattgaatcataaatcaaaacacaatagtggactgatgagcatgaagtagactgacctgaatccctgtgatgctgatggatgggagtatagtgtactgtgctgtcaaacaaatgtctgaacctagcaaatgactttggatgtttggagtccgtctcaatctctgcacttggctgctgtgagtgcctttcacttcctccattgcgattctcctgcctctgggcctttgcacatgcaattctctcttctcgagatgcgccacgccctgttcctccttcatcacccagctcctcctcctagtgttcagggcttagctttagcctccttcccctggaaggccttccctaatgaagttaggagctcctctgtataaccaaaggcactgctcactggttttgctgggcacatttataaccattcactcaatgtcatgcttcttagcagactggcctcaggcaaataagaatctagttcaggaagtgtaaggtcagatttcctcgttgccccgtctcatacttcctgttcctcttctgggctctgccagaacggtaactccactcttgtggcctctgctatgaacaaaccccgctctcttcccttcctgctaccctatggcctcttaggtttattttgttctcagcagccctcttggctctggcttctgttagcagctacacgttttctcggtaatatttcaagttcaacctcatcggcgagggtagctgtttggtttagcctttgtcctctagcacgtgcctttcctgcagggaggggcattcccagccttggaacaggccccatcactaaggccacagacagtgccagagggagctggggtctgtgcagccattcttgaattcccccagaatgccttgcctggccttgagtaaaagggatagaagtgaaaaaagcctgttacaaagcagcatgtacgaggtaacccttcatgtgtgttttatatatcaaagaaaatagactagttattatcaatgagtttttctggtgggatttctagttatttttattttgttgctttcaaagtttctgtaacaggcagggtgctgtggctcacgcctgtaatcctagcactttgggaggccaaggcaggtggatcacctgaggtcaggagttcaagaccagcctggccaacatggtgaaaccctgtctctgctaaaaatacaaaaattagctgggcatggtggcagttgcctgtaatcccagctacttgggaggctgaaacaggagaatcacttcaacccaggaggtggagtttgtagtgagccaacatcatgccattgctctccagcctgggtgacagagtgaaacaccgtctcaaaaaaaaaaaaaaaaaaagtttctgtaaaaacattttcacagatacttaacagcattgaagccctgaatcatggcgttgtacagagcagcccccaggaagaagacaagagccaattggctctgccatttggaagcattgccttcttctccccacgattctcatttctgcccccaaatgatgtgtttgttgccttgctcatttcaccggggtgtctttttcctcctcaggtgacagattgactgggatcccctcgcacatcctcaacagctccccatcagaccggcagattaaccagctggcccagaggctgggccctgagtgggagcccatggtgctgtctctgggactgtcccagacggatatctaccgctgtaaggccaaccacccccacaacgtgcagtcgcaggtggtggaggccttcatccgttggcggcagcgcttcgggaagcaggccaccttccagagcctgcacaacgggctgcgggctgtggaggtggacccctcgctgctcctgcacatgttggagtgatggtgcctccagcaaccgctggggagtgtgtccctgagtcatgtgggctgaatcctgactttcactcagagcaggtggttttttgtgtaggtttgttttttatttttgatgatcttcagatggaaggagaaaacagggtttccactagacattacttgaaaggccagattactcagcagatctcccatgttggctcaacaattctttgtttttaattgcttgaagattgcattgttgtaattgttcagtttttaaatgtgtaatggcattttaatagactagtaaatcacagtggttcaaaatatatatccatatatatatatatccatatatatatctcatgtcatcacattacaggcaggtgtctcatatgtaaaacatttacctgaatgttgtctgaggactgaactgtggactttactattcataatgataaaataataaaatgcgaattactatatataatgtgcctcactcatgagaaagtaccgtgttgggtttttttttttctttctcattcctgtgttgcatagattaagggtgtaaaattacaatagtcttttttttctttttggaacagaattaatagtaacagtgaaatggttactttcccaagtcaggataaatagctcaggcaggatgtctgtattaaatattgtaagacactaaagctccctgcaaagaccagttcaaggaccagcatgcatacccgagcccttcatctttaaaagatcgctcgagaaaatcctgtgctgtttattgaaagcattaagtcaggggacgagagggggtgtggtctttccattgaagccagaatgactgaagtgttgtgctcctaaggagtatgatttagtcttctgtccttttatcaatagcacatggtgtttatagaatgctttactgttttcacggcttttcctgtatgtgatctcatttggacctctcagcaatgctgtggggcagtgggcaaggtggttcacctccttctgtacagagattgagtgattggcccagggtgaatgaggttgggtgccggctcctgagcctttccaactgctccacagggctcctccccttctctcttgcatgctcattgaagaagcttgaatcctgctccccgcctactaggtgtatggccttggacaagttacttaccctctctacacctcagtttcctcattggcagaatggggaaatgattgtactcacctctgaggtctttgtgatgattaaagcaataatgtccgccaacagcacatccagatgcagctcattgtcagctttcaggaaatggtagctgttaatttgccgccactgtggctgaaggtatggttagaccacaggcaaagctgaatagtggctgaaagctgagggcactgtgggaggagctactattgccacatttcttactaagctttaaaatgggatttgattttataaactttacaatggggccagtctgtgatctatccttcttaataattacggaatctgtttcctaattctaacataactcaggatttttcaaaagggagaaaaaaatcatgttttttatttctctccattccaagaataaatttatggaatggtagaattgagcacgaagtgggtacttaaaaagatgacaatagtgtgtggataacatcctttcaggcatcttgtaaccatattcctgttactaaaaaagagctgctatgccacagtttattcttccagtgaattcggttcaaaaggatagtctactggccttatcagttcaaatttttcattttgtagcccagccaataattcattatcttataaaattctcatgcttttggccatatcactgtgcccagtgatagactgtactgctgtggcatcttcagtgaatcacttgtcattttgaacctgggacttattacattgctgtcttccccctgggtttcctaatagagagttgctttggcttttgttctcacagctcagagtcacattcatggatgagtgagtagagctgggctctgctgcgtctgactagatggcattttagaagcaggtctgatgattagctgggtcatctttccgccattcaccatttgcaaggaatctgtcacgcataaagacactcgtgggctctgtcagcagtgagagacaattagtgaagaacaagcccacgatgggccagacagacagggccgagggggcccttagagacctctgacttgttgcccttcacaagcagagtgtcttcaccaccaaatggcggcagcccctccctggcctgctcacgtgcttgcagaagatttgcagagtggaagaacagagcagctgaatccctatcttggtactacctctggccatgaagaataatgctacatagcagctgcctacctcctaacagaactggggaggtgaagagcctgcagggatttcctgtgtttgtatgggagaagattctacaatttcagagactgtttatccccaagaaaactgaatgaatgcagcgaggtggcaagagcatttgccggcactgacagaaagtatatgaatatatagtcttgcaccactttgggttgggttggagtgtgtgtgtgtgtgtgtgtgtgtgtgtgcatatgcatgcatgagtgtggcccttcatgtttttaaaactataacttttattaattttttcaacatgaagtacatgtttattatggcagtttgaaaaaaaacacaataagatgaagaaaaataagaattacccctactcccatctaagcactgtacatcccaatttttatccctgtcctccaattagttttctctgcctgcatatccttttcataaaaagaataggattttctctgcatttccttataaaaagtgttatattttccaactgataatacacttatttttttttgtcgatgtgggactatttagagagactaaactgtgtaattaaaatgatgcatctttttaatattcctcaatggcatactccaaatgatctttatattcatggcttaaaattaactaaattaagttttcaattttattacaagaatgggattatattgtacctgctgctttacaagtggcatcttttatataacatcaaactgtctttctgtgtcattatttctctgtgccaatgatttcaatatcctttgtgttcacaacacactttcgagtcctataatttttgtggcatgtttgaagagataaaaggacacttagctactaaaaagatgacaataagtatagcaatgtctttcactctcaaaaccattgtcccactttttgctccatccccgtttggaaccatgttccaagcagtagagctgtttacggctcccctctatgcactcttatatcctcaaaaagcaaagtttagcacagtctgggctttattctgagattttatctcttcctaacagcaagatggcctctacactgcctgatgatccaatcagcttcgtgttccatttccacaagagtacgtgttctgggagggcaaatgaattttacctgttgatccaaatgtgatggcacgcttatgaagggttgatagtctacgtgttgccactattcgctgccgtcattttcaatgatgcacagctttccagtgtgtggatgcgccgtcatgtcttaaccacttccctgcgtggatctttaggtcggttttgccttttcattgttataaacagtgatgcaaggaagggagtgtttgtggttaaatctttacattcatcatatgttacaatgaactggatccctggtttgtttagcgccaaacatattttaattttgttctcaattagcttttttatatagcaaactacccccaagatgtaatggcttaaaacaacaaatgtattggcttaaaatttagcccacaattctgtgagctggctgggcttgctcttccgatctgggccagctcagctgatttctgctgggctctctcgtgtatctgtggtcagctggtgggttggctgaggcaggatgctctagggcggcctcactcatgtgtctggaaagtagtaggctatttcctggggcaatgggtcgtttgtgtctaggtcacacgccttttatctgtcaggttaccctgccttctttacttggtagtagtggcaggggttccccagacagcaagaaggcaagccgccatgtggaaacacctttcaagcctctgtttgcatcccttttgctgacatttctggccaaagccagtcatgtgccagctcagagtcagtgcgggagggctctaccaaaaggcatggagagaggagcggaataatttgggtccgtttcgtgcaatccaccacagccaatatttttaaattgagatttctgggccctattgaaaaacaatctttggctactctggatccctgtccttgaatcacagtaacaggcaagcctttcctagcatgccatggtccttcccatcccccaccccacagaatgcacatcctttgcccagctccttccacctgctcactacctgctcagccacatacgtttatggcctccagacatacagccatgatgatgcttagcataatctcctagaagtggaatcgccgggcttaaagtattaataacatatttttaaaaactattttgactttttaatactttttaaaaacttttaaaaaatattttagggatggatgtggtggctcacgcctataatcccagcgctttgggaggctgaggcgggcggatcacttgagctccaggagttcgagaccagcctggggaacattgtgaaaccccgtctctactaaaaatataaaaattaaccagatgtgatggccagtgcctgtaatttcagctactcgggaggctgaggcaggagaattgcttgaacccaggagatggaggttgcagcgagccaagatcgcgccacttcactcgagtctcggagacagcaaaactccgtcttaaaaaaaaaattaacttccgtggcccactgtgaaagttgctgttggacacacagacacacacacacacaggcctgaggcagcaggatgaatctgtcttcatccctttctctggggagttctccaggtgtggcagctttggacagagcctcacctcattcagctattcagcaaactctcaagcagaggctactgcacaccagtcactccgctaagcagggaggcgaaaagattactaataaatacacagttcctcttctccaggaactcactgtttgaccaatgagacagacatgaagctctaattacaacacaatgcaatcaggcctgcgcctgagtatcgagtctatgggaatgcagaggagaaatgatccatttgcctggcttcttgggaagtgagaggtatgggaaataataacactgtatctaaggctctgtcacttgggcaagttactccacctctgggtgccagtttccccacatgtaaaatgcaaacaaataacagtacccacctatggtcacagtgaggattccatgagatgaaaggtataacatgcttagaacagtgcctggcaaagatgttttgttaaaccattgagttgaattcttttggctatcagagtttttctttttctttttcttttttgagacggagtcttgctctgtcgccaggctggagtgctgtggcatgatcttggctcactgcaatctccacctccctggttcaagcgattctcctgcctcagcctcccgactacaggtgggtgccaccacgcccagctaatttttgcatttgtagtagagacggggtttcgccatactggccaggatggtctcaatctcttgacctcgtgatccacctgcctcagcctcccaaagtgctgggattacaggcgtgagccactgcgcccggcccagtttttctaatcttcttcaccctcccagggctctgagaagtgtgagggtagaatcacctcctgcagatgtttgtggtatagaaatagaaactgcatagtccctcaatatctttatcaggactctaaagataagtggctatgaactgtggcacacttcagagcatactcagagttggggtggattctgatctaacagttgtctaccattaaatgaataactacagtctttgagcaaattcttgctgattacaaaacactatgcaagttaccagagatacaaagatgaataagccatagtctctgctctcaggatctcagcctgctggggagacagctataaccaccagcaactatggcaagcacagagggagcaattaagttggccacagaggaggtaatacttcaactgagcttttgtaagtcctgcccaagttagcatgttggtctctttgggaggccttaatgtgtatgggcagcagaatcccatttaatttattttacatccagtttgacaaatggctctccttgccatggatatgcaagataaatatgcctccaaaatgtgatctcagagcaatttagaaactaagtggcaaatatcctatacatcaagatgacagtgacattgagaaacatgtggtttgttaatccacagtgggatcaagatcaggcttcaagttttaggtattaggcatattttggggttcttttttatgacatccctatcccttttcctctaaaactcccacatattcaaattagatgttgctggcatacaggggaagtttttaaatgtaataactgcctgtttacttcttggaactataaacaaagcttagaagaacagggatgtctatcttgttggcatttagtgttcttacaggaaaattaaagtctcacaaagacacagttcagtgagccaattaagccttgtctattaaacttatgcaaaatatatggcaataattctgatagctattgttaattcaaagcataggctatgaaatccaggtttgagcacttaaaaagtaaaaaaaaaaaaacccaacatcttggcaatactcataatgtttccatttcattttcatattctatctctaagcagggctgtttttgatgtcaaattacattcttaatggagaatatttggaggaaatataaaacggattggatttgatcaagtagttactagtctttcttctggtgacgtataacctcctacttgtcagcttctagaagatgaatcaattttgtgaggacttggccaatatcaaggtcttcagcacgactcatcagcctgttgctaattcaaggacaacaaatgcctacaaatgctttaagtaagcccagttacagactgctgatgaatttggtgctcctggtgtgtgccctggccaagaatgagggtgtctgtctaggaatatttctttgaatataaatagtaggtagtggtttatctttgtccatttagtgttgctacatgggaatacctgaggctgggtaatttataaagacaaagggtttatttggctcacgattctgctgactaaagactgggcatgtggtggaagccttgggctacttccacttatgacggaagaaggcaaaggggagctccctgttcggagatcacatggcaagagggggagcaagagcttgtagacaagtgatgtatgacagtctccatcttccagggacttctgcctccacatcatctctttacaaccagagcccccagacagaggaggactgagtcttttgtggctagcacattggagatagttgatttaatggacaaattatataaagtgacatttattttttatgctgggaaattacttccaacaatatatttttgtccaaccatctgcttgaatcaagtttctgtcagcctctggaagtaataattattccctgctctgaaactgagcttcatgctggttttctgctgagggagcagaccctttggctgtctgttatctattgtcaagagctcttttgtcactcattattgtcagctgctgatttcccaacagacactttaaggctataaataaaccctcccaacacaaatcccctccttatgaaagtgtgaaagacaaaatacaccagtaaattaggatatgatttttattcaggctgttgccataggaggacattcattagtaagaaatatctcaaagaaaagaatgagcctggcttttatggagacaaagagagtcttatgggagcatgacgaaggacggaggtgggtcttacttcagagtatgcaaagcctgtgtggtccttggcaattagccagttcctacaacccaaaagggcagaagatttcttaacatctctactttttagagtacaagacttagattaagttcaacattgtcagtcctcccttttgttgaaaatgaacatcattgccactgttgggactcagaaaacaataccccaaaatgaaagcctccaaagcagcctcagaagcaaagtctctctctgaccttctgctgcccgctctgtctctcacccctcattctccccggagataagccatagaaactgtaatccctcttccccaagatgggtcatagaaactagaactccttttccccaaagccagccataaaacctagaaatattattctaaccttccaccattcttctgtgtaacacttggccattaagaaactaagaccctcatcccagaggggtcctaccccatacctgggaggaaggaatgctgcatggagaggccaagaaggatctgaacagccaggccttgtaggtttccccacgcagtctatttccattagatcatagccttttttgtccaatcacatttccacatgactgtccctgcttcatcaaacctaagcataaaatcagagagcttctcctgagtctctgggtcttcgttctgaaggctcacctgtcatgtaaaactatgatcaaataggctgttcattgtttgaagcaataaagtgcaaatgaaacctgtctttacatgcacagtggggcatatgcttccataaatgcctgattgtgtgtgcagatgagtgtttaacacacccagttacctgtttgctatatttatatttttagggttaatgtaagtgctttcattttttaaaatgaaattgttttaaattgttttttaaaaagctataatcaaatacatttgttactttttttctggttaacttgtcttttgttatagggtgttggccatgatccttatgatggggaggaagggaatcaccaattttctaccccatcccactgagcaacttagagatgacctaaggcctcgttacctgtgtggagtaactgggaattggaaggtgaggtccaattatatccaagtcttggcatcaaactgtgaaagacaaaatgcactggacaattaaggatatgattttattcatgcccttgcaatagggagaacatttattaatgaagaataactcaaaggaaaggaaggggtcctggtctcccatgaatcctcatgggagccttgaggaaggatgaaggtgggtcttatcacagaatattccagggctgggttgtcctttgtggggatggctgtttcttttgaaacacaaaagggtgggagatttctttgtctctctctttttttttaagagacagggtctcactctgtctccccagctggagtgcagtggtgtaatcacggctcactgcaacctcagcctctcgggctctagtgatctacctcagcctctcaagtagctgagactacagaactacaggcgcaccaccccgaccagctaatttttttttttttttatatagagatggggtctccccgtgttgcccaggctgatctcgagctcctgggctcaagccatcctcctgccttggtctcccatagtactggtattacagacattggccactgtatttggctcatgtagggggtttgttaaccatcactgcttttagggaacaaaagccttggaggaagtttaacagtgtgaaaattcttcaacttttaagaggccaacgcaaatttgaaaaaaaaaaaagtttttataaggtttaggtataagatatcagaattctgacatcttaactgtttgcttgttcaataagaggtacttaagctaactccatatttaatttgagtaaagaaaaacaaatggcctgtctgaccaaagctaaacaacaggaaaggaaacacagctccttttactttcctagagaatcatggaccaattttcaatttggaccaatcatggaacctttttctgtagcttatagaaattcattcaaagtgtactttttgagcacctgccatgtgccaggcatgaatataggtggtagggatatagcagtcaatgtgacagtctgtaatttctccccttgagccccttgctatggagaaagagaatgcagcaaagggcaggaagagccaggcaaaggagtagtactgttgccaaaaggtcagccagagaagacccccacaagaaggtgacaggagtaaaaacccgagggagggagccgtgctgaggcctgaaagaacattttgggcagagggaacagtaaaatgggaaaaccctgagatgggaactgttaaaataattaatcaggaggacatttacatgagtcaccttcagcacctttggttgctacctaagcaaatggaaaaccaactcaatgtaaacagtaaaatgaaaccagcgtaaccaatcagaaactgccagctaacttctaactagagactttaccaatcagaaactgacctctcaccagggactttctgctttaaccaaatattttctttgtcttgcttccatgagcaccttataaaagccccctcctctcctcccctcggagcgccaggctgcttgtggtctggtgctgcccgattcctgaatcatttaaagctcaaataaactcatgacattttaatatgcatacatttatcttttaacagaacttggccaagattttcaaagaacggcgaggagttcagagtctctagagtgccgttgtaaagaggggaagggtagtggctgaggcctgagagctgagggagcagaggctgcagggtggtacagacaactgtgatgactttggatgttactcaggttgaggcaggaaagtactgacatgatggctttgagcagaggtgggacaccatctaacatattttcaaaggattaccctagcttgtgtgataagaggattgaagcaggcagaccagtgaggagctgttgcactgctcttgagaagagaggggctccaatcaagatggccatagtgaagtgtggtggaggatgcttaggtctccttcaggaattaaacatttattcctccagcagccaggaagctccagctaatggcctttggctgtcagccctcttcaagtattgcctctgctaaagacagttgtcttgcccagtgacacttcccctgcctggaggcttgttagtgagggctacaaaggcctggccctgcacctcaactcaggacaactcctaagggtcaccccagttcagagctcctcaaggagtccgctcaggccttccttgtgactacgtcacagcccagcttcttcctttccacaggcattgattccaagagtaccccctaataaactccccacccactcagctccatcccagactcagcctccaggggaacatagcttgtgcattgaggtggtgagcagtggtcaggttctgaatatattttatttcattttctttcttttttgaagacagggtgatatggtttggctgtgtcccgacccaaatctcaccttgaattgtaataatccccaggtgtcgagggcaaggccaggtagagatccctgaatcatggggtcggtttcccccatacttttctcgtggtagtgagtaagtttcatgagatctgatggttgcattaatgggagttctcctgcacaagctctcttacctgccaccatgtaagagaacctttgtttctcctttgccttccaccatgcctttgtgaggcctcctcagccatgtggaactgtgagtacattaaacctctttccttctccacagagaatctaagtggtcttacaaaggaacaaagctagccatcagcacgtccaccaggaaatgtttccagcagtatttttttctacaaggcccatggtgcaataatagactcccatgagaagttgaaaataggcaaactgcttacaaactacctttatcatacaccccgaggataattccaaggcaacattgaagtaatcaaagcgacatgacaccaccttgtatagatacagtttcacagtagaaagaaagttcgctgtagggaataggagttaaggagatgaatcttgagctggggcttgacgggagtgtggagtaagtggaaagcctgggaaaggtgtgctagaggaaggggaaggtgagagagggcccagaagtgaagatggttaggatgcctaggaggagcctttgttgtgagtctgcctctcatgaaaattacatctgttaagtaaggtggggtgagtcagctaatttttaaaaccaggccaagagtttgggtttcaccctttagactaccaagaaaacaaaagaaatctcaacacttttaaagtgccagtgtgaactgtgaatctccaaatcagaaatgtgtggtatttcccaaacttatttgacattgaaaacctctcttccatgacaccacctattaacatctttggaaagatttatcccacagacacattgaggtagagaacactcaaccttggggtgtaatgggaaaactagtgggtcaaaggagccagtaataaccaagatttttaaaaaggtatgaacagtatcttgagtggtatgcaaaaaacattgatttattctcctcctccaacaattcatgtttactgttagcagcatattatggggcacatggaaagagacccgtggttttctggaaccttcttttccttctttaatgattaataaatctgtcacattttttattatatgacttgtatccttgcaaaatatcccctggcttgatatcatgctgcatttctgttcaagcagtggttgtattgcctgttcctcaagaggcagtgggcattgtctctggtcgttgtcagatgccaggtggcacctgtaagacaagcaggaaggaactggtcttgccctataacagcagccccgagccaggaaagttctgtctatagccccaggcctctgcggtctgtccccacgcttgccaggacttctcatccctttgctatcttctcatttcggttctcatttgcttactgtggtgcctccccaactaagctgcttggtaattgaacttgagttttatcttcccttcattctacttcaaaaatacccgaacgtagcttgtttgtttttccagtggggcatctgacaagtctttagcttctgtttagcaatagttcccagtcagaggtgatactaaatccccccaggcctctactatgtggcctttgaaaatgtgtggaggcatttgtgtgtgtgtgtgtgtgtgtgtgtgtgtgtgtgtgtgtgtgtgtgtgaagctgtcatcatacattggcgggggttagggttagcattactgccatgtgatgggcaggggctggggataatcctacagaatgaagagttgccccacccaaaataccagtaacacccccaataagcactgctgtatgcttcacatgagtaccactttgctaattttcaatatctaaagcaccacctatgccattattagtttaatatatttctttgaattaattcacttaaattttttttatttattccaaacagcagtatactagaaatgatgggtcaatgttatttatatattttacagtacccataaaaataaatgcctaacacctaatacaaactattcttaattaatgatacacacatgaagtcgggaaacactgcagctatggccacatgcccagttagattttatttatgtatttatttactgttatatagagacaaggtgttgctctgttccccaggcaggcacagtcatagcttactatagcctcgaagtcccaggctcaagcaatcctcccacttcacctcccaagtgtcaaggattacaggtgtgtgtcaccacgcctggctcatttttatattttttgtagagatgagatttcactatactgcttaggctgatcttgaactcctggccttaagggatcctccatcctcagcctcctgaagtgctgggattacagacatgagccaccgtgcccaagctcctgttggattttgatgggaatattagccccacacacattttctcttctgaaccaggaatgtctgtgcaagtacaccacatagactccttagcatgagccatataagggcaaaggtcacatgtttaatgtcccataaacatcatttattttgtttaaagtagtctatcccaatgacaatgacagcattcttgacctgagtcaattctctttgctggatccaaagtcaaggataaaagtgagggtcacttggcatttgcctccttgaaatgtagctctctgagggcccacctgtgtcttgtgtcctcttctttcctaatgaagtgtctggcacacgaagtcatgattaacgaaggtctcagtgaatgaaggaaacacaaaaacgtatgtgtacccctcagtacggggaaagtgatggagaactgtaaatgctactgtcattgagtcaaaaaatcttacacatgtttcttatgcaagttatgtaacttctctgtgcttcactctccttacctctgaaagacagataatcatagaaccaacctcataacaccgttataaggaggcaatgagagagtatttgttgagtgcttagaacagtgtcaggcacggaataaatatagaaatatttgatgatgaataaacaaatgaatgaggggtgcctggcttttactcaggtttgcaatgtttgctgaaagagtgaatcaacaaatcctagaccagaacgttccaacactcacatccttggtgctcagctgttcccaggagtagtagtagatgctaaagtaaaacatcccaagctccggtgaggaggtcttgctatgggcagcacagaaaagcttttcataacagatagcctagggtgatgccccatgtatcaccttccccactcccccaacccctgcctagttacaggctgcacaggaactgcatactggtacagtcctcccttggtatccatggcagacttgttccaagacctctgcagaaagcaatacctatggatgctcaagtccctggtataaaatgatgtagtattggcatataacctaccacatcctcttgtatactttatttatttattttgagacaggatctcactctgatgcccaagctagagtatagtggagtgatctgggggtcactgtagcctcaacctcctcggctcaggggatccttctgcctcagcctccctagtagctaggactacaggcacatgccaccatgcctggctgatttttaaaaattttttgtagagatgactatgttgcccaggctagtcttgaactcaagcaatcctcccatctgggcctctgaaagtgctggaattatgtgagttaccatgccaggctatcctcctgtatactttaaatcttctctaggttacttacagtacctaatacaatgtttgctatgtaaacagttgttatactgtcttgttttttctttgtattattgttattgttgtattgttatttttttcagtatatttttgattcacagttggttgaatctgggcatgtggaacccacagatgtttgagagcttatatgtctggaaaagactttattttatttgatagcttggctgggtataaaattctataaaattcatttttctgcagaattacttctcgtttctagcattattgagaagattaatggtcattctgattttttattagagtctaaccaatttttccctctctagaagctttagaattttttctttgattccaatgttcttaaatttcacaatgatatgttttgactaatatgttttattcattttgctggacacttgataggaacttttatctcacaatgactttcagtttgaaattttcttaaattattttttgatgatttcatttaccctgttttctttttatctctttctatgactcatagtgtttggatattggacttcctggcttgatccttaaatttccttaccctttctctcttattttttgtcattttgttgtcttttgaaaggtttaatcaaatttcacttccaaccttcttactggatttttaatttataacataatgtttttaattgctaagactcttttgttgtatgaatgtgccatttgaaaatagcatcctattgcttcatgtttacaatatattctcttaactctctgatagtttttgtcttcttatctaatttctgttttctctaagttactttaatctctttgtttttagtctctgcctttcatgttagaggctttctttaaaaggtgatcattggctgttcatttatatttaaaattggggccctaaaaagctgaatgagactctgtattgtgggtggggcttcaagaccattagctcacttgtaggattatcaggctgagctgtttgttggataatcctaatatcagcatctttagatcttttcttttggcttgtcagatgttttcagagaagaatcttctaagatcctgcacagttttctgggaacctagtgatggaagagggccatgagctgtggcagagggcttcaacatttagtatgtagtcctcatgctttcaaaatgattgctgccttcaactgtgccatgtatcccacacttcagagaccttctgtttttgctgtctctaaaccacaaatttctgctgagggaaagaggggttaattttctgatcacacaaagtaagcattagaatttgggctggggagcagggaggatttgtatttgtgtctgtctgactcctagacttttgtcttcccctttactcccaaatcataaacccctgctacttctaattcttgaggctttgtggttctattttagaaaatgggctactacttagcttgctcacttaggacatagctgtcctagacctgctaggtcagttgtctttcctctttctgttttctaactcacaacattttacggctttcattttccctccaattctcctttcctccttcggtttccttcctgtatgttagttagtggggatccataaaaagtacaggaaaacatgtgtgtttaatatctgctatcttcaagttgtatttgacatatatatatatatattttttaaacttggaagtccaagatcaatatatatattttactgataaaatgttccaatatgtaatttgctctcttaatgactactttttttaagtaaggaagttaaggaagctacagcagtaattcttgaggcatattagaatatttcttactgacaaaatacttttgaaccaattattacagggatatggttcaactgaaattgtagtgacctaatttacaaagataaaactgtctattttagagattgcagtaaatttcaaaagtaaatgagggaatgtgaaaggaatgaggtaaattgcgaatacccatggtagaagaacactaggaaataaagccctggaccaggttgaactgggaatgatgcttcatcagtatagtcagaagcaacatgcctggacatagaatccaaattgtttttgagtggggggcccagagacaaaattgattttcctattctaagactgagccacaatgttaggaaattagaaagagaaatttaaaatagctcagaatcaagattaagaacagcaaaagaggacttgacaatttcacttttataaaatgctatgagcatgtttgtgtttatgggaaagatttaaagttgaaaacatccagtattgttaaaattatgaagaaataggcaatttaatttactgttggggagtatagacttattaagtagtaattggtaattatttattaaaattataaatgtggatttagtttgactcaacatttcaactcctacaagtaatcctataggaaagactgaaaagtaatgtacaaggatgttcattgcatcattgcttgtaataacgaaaactgaacacaaccaaaatgttcattatagaggattatttcaattcatggtgctacagactcaaatataactagtcttttgtggtccactcttataaggagattcattcaaaagaaactaatttagtatctctcaaagaacattgaaagagacctaattcataacctataactccatttataatttatccttgttttacagccttattattgaatacttggaacaccatatatcaggcaaaagacataaagtcagttaaaatatatgtatacaatgatatctaaaatatgttgttcaactttaccaaaatgttataaaatagaatatatggtataatttcattaatgtttaaaaaatataaaggcttccagttttgagtaatggcagagtagtttgtatcagactaaaccttccactgattatgaactcattcttctctctctccctctctctctcttgcacacacacacacacacacacacacacaagaaggaccaaaaataggcacaaactggaggagatattatacatattgaactggtttttcacctgcagacatccaccacctgcagaaaaagtagactttttcaactaaagaattagaggcttgagtacagggctgccagagcaactggaaattgaagtgggttgttgggggatcccaggaggttaggagtaatagaacagggaggtcccagaattatgtacaaaatcttctcaaaaccttggctgactctttaaccacaaatgtacagggcaagactccaaagagcatagcagaaaacatcagctggaaggctgagcagggatttcagcagctgcctagtactggagagatacagtttgaagttaaaatctcaccaaattagtggggcttgataaacatgtcttgaattccatcagtatgccagaagcatcatgccctagatataaggatcatatcccaaaactcagagttgtatcctaggagtaagagcaaaaataaaatataactagcttaacaaagcctagaaccaagcctacacaggattaaggttatccacaagaaatttacctgcctactagaacaaaaccaaatactcatctgatgaaaatgacagaatttagagtttctacattgtccagcatacaataaaaattaccagacatgcaaagaagcagaaatatatgccaataataaaaagagagaaactccagaaaataaaaggatacccacaaacaaagcaggtattggaattagcatataaggactttaaaattactattgtaaatatgttacagaatttacaggaaacaataggtgtaatttgtggagacatgaggatttcaggaaagagatgaaaatgctgaaaaagaaccaaatggaaatcagaactaaaaaaatgcaatctcagaactgaaaaatacaatacctgaaatgaaaaatacaatacctgaaaaaatgatggatgggatcaacatcagtttgaaaacaacagaaggaaagatcagagaacttgaagaaaagccaacaaaaatcaccaactaaaggagaagaatatttgaaaagaaattaacagagccttccttaccaatagggaaataataagcaatctaacatctgtgttattcaggagaaaagagaattaatgaggcaaaaaatatttaaggagacttggctgaaaattttccaaatttggagaatattgtcagtttatgaatctaagaagcccagtatacctcaaacagaaaaagatagaaattcatatctaggcacataattgacaaatggctgaaaaccaaggataaagaaaaaaaaatctttaaaacagcccaataaaagacacatttaatacgtggaaataaatataagagtcactgaaaatgattcatcagaaataaggaatgatttagaggtgggagcaggacttcccaggccctctcccaagcaaaacagaaatttaactggtgaaaagtattttttaaaaaatcattccaagtctctggaaattgtcctaaagacatacgacataacaacacatggagaagtatttattcaagaaaatctgctaaatattggtaagaacactgacagtctgtggcacttgaaccatgacttgctcattccatgtcctcacctctcctcaggtctgtgttatggaagctctaccctgagaatgtgcaactaagaaaatgaggacgggaccttcctctcccttaagttcccagtctggggctacagttttaccctcagaagggcaggctactgacatttttttgtccatcccagccccgtgttgcaggagctctattcctggtagacatggccaagaggaacaggtcttgcttccaccaccatgcaccgccaccagtagggtggaagctctgccccaactgcagcagccaagagtactggggctccaaacacctacaccccagccaactcatagggtggaggtttcaggctgagatgggcaagccaagaagaccagggactgctactcctcctcaaagcccgttatagagtggggatgtcaccccgggaaaagcaggtcctaaccccaaactccttttgagtggcatgggggttcttcccagagagaaaggcaggccataggatcaaccccacatatctgcctcagggggctgattatttggaagagaaaatggagaacaccatgtctaaagctattgtgaaatggagatgatagtggacaacaattaaaaggagtctggtaactgtgacataagcaaaatgggagcacagaagttttcaaacagatgaaaagacaagacccaactacatgccatatacaacagatacactataaatgtaaaagcaaacaagtcagaaattcagaatttttaatgggatgtatctgtatacctctctttgagtattcttgcttggcacatagtgggcccagaattattgggttttaaattttaacctaacgacttaatatttatttatttacttaggctagtcaaatgatatagtgggtgtttctctactaatgactccctgtcatcttatccatgctctcctataatttttaaaataaatgtgaatctttgtttatcttgcctcacattaaatggaaacatttttttaaaaattttgtgggtacatagtaggtataggtatataggtaggtaatggggtattcatcccctcaagcctttatcttttgagttacaaacaatctgattattctttaagttatttaaaaatatacaattaagttattattgactatagtcaccctgttttgctatcaaatagtaggtcttattcattctttctaactgttatttttgtgtccattaactatccttcacctctcccgcagctccccacgaccttcccagcctctggttaccatccttctactctctatgtccaggagtttaattgttttgatttttagaacccacaaataagtgagaacatgcaatgtttgtcttcctgtgtctggcttatttcacttcataatgatatctggttccatccatgttgcaaatgattggatttgcattacttttcattgctgaatagtactccattatgtatatgtaccacattttctttatccattcatctgttgatggacacttaagttgcttagaaatcttagctattgtagacagtgctgcaacaaacataggagtgcagatatctctttgatgtatggattttctttcttttgggtatatacctagcagtgggattgatggatcatatggtagctcaatttttagcttttgaggaacctccaaactattctccatagtggttgtactaattcacatccccaccaacagtgtatgagtgttcccttttctctacatactggccaacatctgttattgcttgtcttttggatataagccattttaactgggatgagatgatatctcattgtagtttaaatttgtatttctctgatgatcaataatgttgagcaccttttcatatgcctgtttgccatttgtacgttttctgttgagaaatgtctattcaagtcttttgcccattttttgaatgaattattagatttttcctatagagttggaatccttatatattcttattaatcccttgtcagatgggtagtttgcaaatattttctcccattctctgggttgtctcttcacgttgttagctgtctcatttgctgtgcagaagctctttaacttgatgtggtatcatttgtacctgtttactttggttgcctttgcttgtggggtattgctcaataaatttttgcccaggccaatgttctggagattttcgccaatgttttcttgtagtagaaaacatagttcaaggtcttagatttaagtcttgaatccatttttatttgatttttgtatctggtgagagataggggtctagtttcactcttcttcatatggatatccagttttcctaacaccatttgttgaagagactatcttttccccagtgtatattcttggcacctttgtcaaaaagtgttttcatcctaggtgtgtgtatttgtttctgagttctctattctgttccattggtctatgtgtctgtttttgtgctggtaccatactgttttggttactatagctttatagtataatttgaagtcagatgatgtgattcctccagttttgttctttttgcttaggatatctttgactattctggctctgtttgtagttctatataaattttaggattttttttctatttctgtgaagaatatcattggtattttgatagagtttgcatcgaatctgtagattgctttgggtagtatgaatattttaacaatattgatttttccaatctatgaacatagaatatttttctctttttttggtgtcctcttcaatttctttcatcagtgttttatagttttcattataaacatcttttgcttctttggctaagttaatttctgggtgtttaattttatgtgtggatactgtaaatgggattacttttttcatttcttcttcagattgctaactgttggcatatagaaacactactgtttttgtatgttgattttgtatcctgtaactttactgaatttgtttatcagttctaatagtttctttgtggagtctttaggtttttccaaatacaagatcctgttatctgcaaacaaggataatctgacttcttcctttccagtttggatgacctttatatcttcctcttgtcttattgctgtagctaggactcccagtactatgtttaataacagtggtgaaagtgggcacatccttgtcctgttctagagcttacaggaaaggctttaagtttttccacattcagtattatactatctgtgggtgtttcatatctgacttttattatattgaagtatatttcttctttccccagttttttgagggtttttaatcatgaagagatgttcaattttattatatgctttttcagcatcaattgaaatgatcatatagtttttacctttcattctgtggatatgatatatcacattgattaatttgtatatgttgaaccatccttgcatcccagggataaatcccatttgatcgtgatgaatgatctttctaatgtattgttgaattcgatttgttcgtgttttgttgaggatttttgcataaatatccatcagagatattggcctgtagttttttgtttttcgttgtgtgtgtgtttgtgtgtgcgtgtgtgtctgtgtgtgtgtctttggttttggtatcaaggtaatactggccttgtagaatgagtttggaagtagtccctcctcctctatttttcagaatagtttgagtaggattagtattagttcttctttaaatgtttggtagaattcagcagtgaagccattaggtcctgggcttttctttactgggagacttgttattatggattctatttcattacttgttattggtctgttaaagttttgggtttcttcctgattgaattttggtaggttgtatttttctaggaatttgtccatttcttatagattttccaatttattggcatttggtgcttatagtagccactaatggtcctttgaaattctgttgtatcagttgtcatgtctcctttttcaattctgattttatttgcatcttttctctttttttcttagtctggctaaagttttgtcaattttgtttaacttttttaaacatcaactttttgtttcattgatttttgtatttttttatttcagtttcatttatttctgttctgatctttattatttcttttcttctaccaattttgggtttggtttgctcttgcttttctagttctttaagatgcgttgttagattgcttatttgaagttttccctcttttttgatgtaagcacttatagctgtaagtttccctcttagtactaattttgctgcatcccataggttttggtaccatttctttcaagaaatttttttaacttcctttttaatttcttcattgacccactggtaattcagaagcatattgtttaatttctatgtatttgtaaagtttccaaaattcctcttgttattgatttctagttttattccattgtgatgagagaagatgcttgtcattatttcaatttttttgaatgttgtaagacttgttttgtgacctaacatatggcctatccttcagaatgatcaatgtgctgaggaaaaaaaacgtgtattctgtagccattggatgaaacgttctgtaaatatttactagatccatttgatctacagtgcagattaagtctgatatttctttgttgattttctgtctggaagatctgtccaatgctgaaagtggagtgttgaagtctccagctgttattgtattatgatctatctctcccttcagctctaatatttgttttatatatctggatgcttcagtgttgagtccatatatatttaaaattgttatatcctcttgctgaattgacccctttaacattatttagtgactttctttgtttcttcttataattttgggcttgaaagctattttgtctgatggcactatagcaactcctgctgatttttgttttttttccatccttttattttcagtctatgtgtgtctttagaggtgaagtgtgtttcttgtaggcaacatattaatgggtcttgttttttcatccattcatccagtctgtgtcttttgattggggagtttagtctatttacattcaatgttattattgataaataaagacttacttcttccactttgttatttgttttctggttgttttgtggtcttctctttcgtctttctttccttcctgtcttcctttagtgaaggtgattttctctggaggtaagatttggtttcttgctttttattttttgtgtctccattatatgtttttttggtttgaggttaccacaaagcttgcagatactctcttatgtcccattattttaacctgataccaacactgtttgcataaacaaacaaacaatcaaagagaacactaatacaagctctacaccttaactttgtccccttgctttttaactttttgttgttctatttatatcttattgtactgatgatgtcttgaaatgctgttgtcattattattttctattggttcatcatttagtctttctactcaggataagagtagtttacatatcacaattacagtgttaaaatagtctgtgtttttctgcgtacttaccattaccagtgagttttgtactttcaggtgattacttagtaatgttccttcctttctgattgatgtattccctttagcatttcttataggacaggtctggtgttgatgaaacccctcagcttttatttgtctgggaatgtctttatttctctttcatatttgaaggatatttttgccaaatatactattctagggtaaaagtgtattttcttctttcagcactttaaatatgtcatgtcattctctcctggtctatttctcttttcatttccactgtaaagtcttctgccaggcatagtggagctccattgtatgttatttgtttcttttctcttgctgcttttaggatccattctttattcttgacctttgtgagtttgattattaaatggcctgaggtagtcttctttaggttaaatatgcttggtgttctataaccttcttgtacttgaatgttgatacctttctctaggtttgggaagttctctgatattattcatttgaatacactttctacccctatctctttctctacctcctatttaaggccaataactcttagatttgtccttttgaagttatgttttagatcctataggtgtgcttcattgttattcatttttcttttgtctcttctgactgtattttcaaatagcctgtcttcagcctcaccaattctttcttctgcttgatccattctgctattaaaggactctgatgcattctttagtataccaattgcatttttcagcttcagaatttttgcttgattcttcttaattatttcaatctcattgttaaatttatctaatagaattctgaattccttccctgtgttatcttgaatttctttgagtatcctcaacacagctattttgaattttctgcctgaaaggtcacatatctccatttttccaggattggtccctgatgccttatttatttcatttggtgaggtcatgtttccctgggtggtgttgatagatgttctttagtgtctggccattgaagagtgaggtatttattgtagtcctcactgtctgggcttatttgtagctgtccttcttgggaaggcttttcagatatttgaaagaacctgggtgttgtgatctaagccatatctgcttcactgggcaccccaagcccagtaacactgtggttcttgtagactcatagaagtactgccttgatggccatgggacaagatctgggagaagtatctggagaaccaggcagagactcttgttctcttcccgtacttaaccaaacaaacagtctctccttgttcagagccacctaaagctggggtgtagcgacacaagaacctctgtggctaccaccactatgactgctgtggatcacacctgaagccagcacagcactggatttcaccaaaggcctgatgtaaccactactgcctatgtaaccactacgtggctattgcccatgttcactcaaagccctagggctcttcgatcacttgatgccaaaaccagccaggcctgtgaccttcccttcagggtggcaaagtcccccagacaccaggtgggtccagaggtgctgtacaggagtcagggaatacagtcaaaaaccttagaagtctatctggtattctgttgtactgcagctgagctggcactcaaaccacaaggtgcagatcagtgcacaagatgcagtccttcctcctcttcctttccccttccaaaggcagaggaggctcactctgtagccactgccactccaggccataaggagtactgccagactaccacctatgttttcttaaggctcaagggctcttaagtcagcttatggtgaatgctgcctggcctgggattcactctttagggccatgtgctcccctctggcccaggacaggtccagaaatgccatccaagagtcaagtcctggagttgagggctccaagagcctgcttggtgctctatccccctgtggctgtgctagtacctaagttgcaagacagagttccctttgcttttccctctgcttttctcaagcagaaggagttttgtcccacagccaccacaactggtaatgtcctgagtctcacctgaagccagccagtctcagaggcccacccaaggcccccaacatattacccgagtgttgctactggttattcagggcccaagggctcttcagttagtaggtgatgaatgctgccaggactgggtcctttccttcaagtaaggaaagtacaggagtaagtatgggaagagaacaagagtctctgcctggtaatccagataattctcccagattttgtccaagaccattaaggcaatacctctacgagtctgcaagaaccacagtgttactggggagtgggtccctcctggcccagggtatgtctagaaatgtcatctgggagcaaggacctggaatgaaggcctcaggaccctgattagtgtcctttcctgctgtggctgagctggtatccaagatgcaagacacagtactcctcactcttcccttttctctcctgaatcagaaggaaggggtatcttttggagccatgagctgtgtagcctggggtagggtaggggtgatgtcagcactcccttggctgccccaactggtgtctcagtaggtcacatgccccacccccagtccactctctttaggccttgttcagcactaggattcattcagtcttccagtccttatggcctagactgccttttaagtttatttagaaacacagcgctatagcccatggtggtgaggtttgtgggaactcaagttctgaccactgggattggcgattccctctggctagggctggtttaaatgcctcctccatgggtgggcgttagctgagtttggtcctgtttccctttctgctctaacctgacagcacactggggaagggtggcatcggcaattcaagactgttttttctatctcttcagtggctctttcatcggtatgaagataaaaccaggtactatgagggctcacctgatttttggttctgatgaaagtgttttttttctgcgtagatcgttgttaaattggtgtccttgctggggggaagataggtggcactttctattctgccatcttgctctgcctccaaatctcccacaatttttattaagcagatttttttcttctgaatcttctatattctttatcttttttcctcatgatttttttctgtagctttttgcactatgttcagggagaataccttgatttggtcttccaaatcactgttgtcttttcgattgtatctgttctgtacttcatttctggtattgagtttctataatttgttaatcatatttttagtttttaaagatttctttctttttctctgattgctactttttctacagctctttttttatggatctaataaggattttatctcaggaagcttaataaaattacttgaatgttctctttggctgcctgcatttgctctctcctcagaatttaattctctactcattcagctttcaggctataaggttggttttaaggtctggtgattctcagttattccttttcgaatataaattgatctgcattggtaactggtctcctttcctcaccaattgtttaggttcccttccaacatctcttgccacgtctgccccctaaatgtggtgactaactgtaacacatgtgttttactccaaggttcatgggcaggtgggggaggccagcaggttgccctcaaataaacaagtagggaaagttaccttttagagcacctcagggcatttcacacctgtcccaggttgtgtctttccttaattaacagttcaataataactggagcaatgctctacttttctctctggccctagttcttattctaagggtctcccgcgactgatcctttactcagagagcctgggagcaaacacaataactagctgctctatgtgccactgggagaggtggggcactggcctggcacttcgactatcttgtcaagcgtcctacaatacacttctaccctgtcctgttgaccttgggttgatttttctcttgagaaaattagcatattcagatttgacagtaatatcaaacacctactctatgccaggagctatgcaaggcagaaataatacagtaatgaatacaacagatggtgacttgtcccagtgaagtttacaggctggagaattatttatccagtaggcccctccttcactgtggtggactgtgtgtttctcagtgctttggtattcctgtcagcctgctaccatccagaaattcttcagctcccctcaactggcattttctaggtaatgtctaggacttagtcttatcttacggatcacatttcactgggatctggaaaggagaaagcatgttggcttagtgcaccaccttgaaccaacccctttttttttcttcaagtggaagaggaagagctagtggagttcagatgttctttatgagtctataaacaaaagaagtcatttccacccccaaaggaaggctttgaatacaattattcctacattggttctggctctgtaactggagtttctatggagattggcgggagaaatcagagtcctagtcatattctaacatcaaggagcaagtctaggaatgggactgcgcagctcaccgtcttgctttttcattttgcttcttctaacatttttcatgatcccctaatccgtgtgacttttaaaaatatggtttggaagtgccacttttgaagcatgtgaatagaagagcatctcatcccctcactctccccggtacatcccaacccctaccatgcttcgaaaggactgtctctacaaattttgcttcactccctgatgtctggagatcagtcagataggtggatttcttcaggtcttctttggaacccaaaagatctctttctgcctttcggttgctcccaagctttggcagaaaactctattttcagaatcggtactttttctagttgacctttgttgataagttccttcctcactctggtttcagtagatttgtttttgttagaaccaaactgagtgaaaggctttccttctcagaaataagaactaacacctcactaggcagcttgtttagccacccttaggcaaacaccaaattgagcatttagcaattccttttttgaagctggagggaagggtccaagaaagccaactcccagttccaagaaagtgcagacactatttgtgtacttttcttcagatggttgtcatttttaaccaagtagctacactgtcaacctctgatatctctgtgacaacatctatgtgacaaagtcaatcaaaccacccttggcctacctaccccaaagcaacaaagatcttatcttctgatgaggattaagaaagactgagtcctctcagaaaggaagaagttaaaaaaggttcaggcagcactttgtttgtttgtttgtttgtttggcagcagcagtattttgtggctggtttcttttaccacacaaaaaaagactgtggctaatagatatgtcacagctttttagaaacacgtcaattttttttgtgttctgcagctctcaaaaaaaaagtgtggggggggggtggggatcaatcctttgcagcttccaagaaaatggtttttcttttcttctttttgtttgtcacacatctaaatcctagaatcatttagaaagagggagggatgaacgttttcaaaagaattggctccctcactccacatatgcagttacaagcatgtgcagaagagaaggtactgttggtattactgggtcacaatttggacttttgatttaagtaaagaagacttgtactatatagtcaacatttattatataaagttgcccctgagactaatcttcagaaactagataaatagaactgtgtgctctgataaagtgtctcccttggagattatctcacgaggatatgaaaacattataccctacaccaaagatgtgagtgattgaaatatataggctgggcggggtggcttaccacctgtaatcccagcactttgggaggccgaggcaggcggatcactagaggtcaggagtttgagactaacctgaccagcctggtgaaaccccatctctactaaaaatacaaaaattatctgggcttggtggcatgtgcctgtcccagctacttgggaggctgaggcaggagaatcgcttgaacccatgaggcagaggttgcagtgagctgaaatctcgccactgcactgcagcctgggtgacagagtaagactctgtttcaaaaaaaattaaaaaaggccaggcacggtggctcatgcctgtaatcccagcactttgggaggccgaggtgggtggatcacaaggtcaggagttcgagaccagcctggtcaacatggtgaaaccctgtctctactaaaaatacaaaaaattagctgggcgtggtggcaggcgcctgtgatcccagctactcaggaggccgaggcaggagaatcgcttgaacccgggaaacggaggttgcagtgagctgagtctgtgccactgtactccagccagggcgacagagcgagactctgtctcaaaaaaaaaaaaaaaaaaacggaaaagaaaaatatatacatattatacacacatacacacactatccccccacccccgtgtgtgtgtgtcttaaacactcatacatagctaaatttgtatataaaagatttgtatggagggccttgtttttgagatacatcatgaatataatgtctatttatacctctttcttcttggctgggtaactctcacttttcttcttaatcacccttaaaataaatgtggcctctttctgatttaacgtttttgaacttttcaatacctatacataaatcagtggatcgacttctgaagacagcgttgtcttcaagggaaggagaggaaatgcacacaaagagggaagcaggtttcctggagcctttggctcaatgttaggtccagcttgagattccagagttaggagccactaaagatggaactggcctttgtggtttcctttccattctcttcctttcctttccatttcctttccattctgtgattcttaagggtaccctcagtctttggaattaacatctgactgtctcaggggattgcgtaattgagtaaaaacagacccaaagtggcaacacgaagagacttggaattaatatatctttggggccaaaatattcagcataattaagcataatttgattaatgtgggatataatttaattaggcatatggacaaaggagggagaaaatgttctccactgtgaagacgagatcactctatcatacatgctggaactaaaattagagggcaggtttgaagataatacaaaaacccatatttaagtccaagaggtttcttagacttctcttttatttccacatgtggacttattcagcaacctgtagtgtctataaaatttaatgtaaactgctacatttggctttctaccaaaagaaattcaaaccctacacttttgacatttaaaatatgaagtattactataagctaaatataaaactaaatctccttctttcttttactgaataattatttactgagatagtaatatgagtcaggtaccacataagacattaagaatttaaagacaagtaagaaatagtccatctcagacctcaaggactgagaaaggctgagcatgttgggtcctataattactcctgtaatcccagcactttagaaggccaaggtgggaggatcacttgaggccaggggtttgacattagcctgggcaatatagcaagatcccatctctaaaacaaaaacaaaacaaaaaaaacaccacattagactggcatggtggcacatgcctgtagtcctagctacttggaaggctgaggctggaggatctgttaagcccagaagtcctaggctgcagtgagctaggatcctaccacagtacttcagcctgggtgacagggtgagaccttgtctctaaaacaataaaataaaataaaaaggagcaagggaatgtcaagcaatgattcatataaagacaatgaagggtacgttctgagaatggaatcccagaggcctctccaggaggcttctcaggatgtggcaagagggtgatccaagagaaagagcagccaagatggaggctgcagagtcccagcctcagaagtgacacaccagcacttctgccatagttttttgatcacacagatcaaccctggtacgggtgagaggggactaaaaaagggtatgaataccaggagcagaggctcactggggactgtctggggaggctggctaccacagttctccagagacaggcagaggacataagtcaaataacaaagtactgcattttattaattgagccaccatccaataacctccattacaagttttaactaaaaatgaatagaagctgtaaggcctaagcagaatctcctacttcttcctgaatctaaaccttgggatcttagtaccttctagaaggatgcagagaggaaagataacaaaattgatagagacaggagacagccagaggtccctggcgaaaccctgccttcaagcctaaaacagcctgaaggctgaaaaaccgtactgctggtcccagatgaagcctactatttcccgactgattctttctgaataacgcccacctgcacacagggaggacggggtggggcctcgggaagttcacggaatttgcagcgaggaggaacctggcctctcctgttcctgtgtggtgagctgggattcaatctgtgaggtgggaatcctgctagcaggattttctctcactttgcagataattattttccctttttcctttttgcccaataaattcctctcctcacccttctatgtgcccgtgagcctaatctttcccagtcgagtgacaagaacctggttttagctgaactaaggagaaaattctgcaacaaaatgacagagaaaataaaatgacttatctccttagtcacttgtatgaggaggtggagaatcagagagggggctgagtgcacttgtccacccgaatgcatagagtgggagagaaggagaaccattcctaaggagggcatctctgtctactaactacaagttgctatctctggtcccacactctgaccaatcagattagcaactcctcttcccttgggttgggggcaggggtgctaggaagaggtgggaatggcctgggagaaggactgacaagtcctttttcctgtacagaaggtattgtcttccctgtttttcgtataaggaaactgagatgtggaaaggttaactgaagtttggtgaggcctgtttccaagaaaccatgactgaaaatcccaacttttaaattcagccatagtggtcacatcaggtcaaagacaccgtaattgctgctgaacttgtggtgaactccagatttatcttttaggcatttcttctatgtcacaggtatttgggctatgcattaaaccaaagatccacttaaagaaatacaaacacaggagggaacttggaaacattttttgcaatctgttctttgcagagataaagaaactgacatccctagggaatgaagcctaggtcctcgtgcccccgccaccccccagtctggtgctttttcctcagtggcactgtggaggggttgttgagtatgtgttccctgtgaggctgattggaaccttcctcttcctcaactgagtgagaggcaggtgagtgtcattgaaagaacagttcttggagctggaagcccccagtgaagtcccagctccattctgcataataagcttgtgtgatctgggtatattctcctcagtttcttcttttgaaaaatgggtataatgaaatttgccaccctctcgagatggttgtaaggatgaaagaagatcctaactatgaaagatctctgtaggggccaggcacagtggctcacacctgtaatcccagcactttgggaggccgaggcaggtggatcacttgaggtcaggagtttgagaccagcctggccaacatggcaaaaccctgtctctactaaaaatacaaaagttagccagggatgatggcacgcacctgtaatcccagctacttgggaggctgaggtaggagaatcgcttgaatctaggaggcagaggttgtagtgagccgagatcatgccattacactccagcctgggtgacagagtgagactctgcctcacataaaataaaataaggatctctgtaggatcccaggtgctgggcaaaggtaaggaatcagtctttatatctataagatatacaactgccaagctaagatggacatgcctctagctgctgatgcttttttttttttttttttttgagacagaatcttgctctgtcacccaggctggagcgcagtcacatagtcttggctcactgcaacctccacctcctgggctcgatcctcccacctcagtctcccaaatagctaggactacaggtgcatgccacaaaacctggctaatttttatattttttgtagaaatggggttttgccatgttgcccaggctggtctcaaactcttgagctcaagcgatctgtccgccttggcctgctaaagtgctgggattacgggtgtgagccactgcgcccagcctgcctcttgcttcttacatttcactgccttgagagtttatcaactccccacccataggcatttcactttctcctcctcacatgattttgtttcacctgacggtagtccagctgaattctggagataggcagttcaagtaatgggagaggtcagtgactcagtcttctatgtgggattaagttttcccttccccaggaccacaagaatgagcagagtatgtggatcttactttgaaggaacgaaaacaaacaatcctatcatttaataggagctttaaaagctttcgcagcatgggtgagtgtggccatcgagactgtctggcaactgcccctgctaacagtggagatttattatcatagaaaatcatttcaatctgcggaggttccaaagggaccattttatggtcatgggcataattaatagcagaactgtttgggaaggacgctaatatttattcactgcctaccacgcgcaagacagagagtgaggtgggaggctggtgccattctgattctgcagaagagaaagctgaagttcaaggaagttaggtgggttgcccacagttataagcctataaacagtagcgtgaagacttgaatccagatctttgcacttcctgtagtgtaacacagggagggttcagtgcattttgaatctgctagtttgtctcttttgaaaatgagagaaaatctgtggggaaatatgagaattacaatagcttacccaatcgtccaaaggtcacaaagccccagaatttggaaaccttggggtaaaagggagatcaaaacgatgattaaaaatgaaaaatcaaagtctcagcttctgctgcctcttgacaccaggcacagatacacttttaatgacaggcttttatcagatattgccgtcggcagatctcaatgccagggccgctaacgagtggagggtaaggaaggtcacaacacagaggatacaaaataaggatttgaagccatgtccgtctggcaagaagaaattaagcgaaactcaggaagttcttaaatatgtcgaaggagactgtgtttcacaacttctacaaacaaattccaaaatacgtagacttctaggaagcagagaagttagcaaatcgccaaggtgttaatagtcggttcttggtattgttaaagcacagtttgatttgcacatctgactgaaatacttgctttagcaagcacactctttcctagtagtgcctcttaatgcttctactaaaaggcaactcatctttttgatggcctgagcactttagtcacaaaaataaaatttactgagcacatactacgtgcctggctgtgactaaggcacaggggatacaaatgaaaacagaattacacgttaacgtttatggagttcatagctggatgggaaaagcagtcaagtcaacaaggaattatggcatgtagacttcatgtataacatgaaggcaggacaaggtgcccagggaaatgcagtagatgggtacctaactcagtcttggaaagtcagcaaaagcttcccggttaaagtgccacctgagctgagacccaaaggatgagtgggagttaatggagtgtattctcagtggaaagagaaacatgcacaaaggaatagggatgagagaatggggtgtgtttggggaactgaaagagattcagtctggacagactgttaaggatagagatggcaggccgggcgcggtggcttatgcctgtaatcccagcactttgggaggccgaggcaggcggatcacgaggtcaggagatcgagaccatcatagctaacacggtgaaaccccgtctctactaaaaatacaaaaaaattagcgggcatggtggtgggcgcttgtagtcttagctactcgggaggctgaggtgggagaatggcatgaacccgggaggcggagcttgcagtgagccgagatcgtgccactgcactccagcctgggtgacagagtgagactccgtctcaaaaaaaaaaaaaaaagatagagatggcagatagatgggtgggggctcaccttctataccatgtgaaagcattagggctttatcccaactgactgttgcaagggtttaagcatgaggataagatgatcatatgtgtgttttagaaaggtcatcattctgtgcatgtgtttcagaaagatctgtttggggatttggagcatgcaaggcagggtggtggggtgtgggatggggagggcaagaccagtagcaggagacccagcagctggagttgctgtcatccaggccagagatgggggtagtctagtccaagttaatccattagagctggagagaagtagacagattcaagagctccttaaggggtagactgaaccaaccacatcttgagattgttgtcagatgtgtggaatgaggtagggaagcagtcaagaatggcttccaggtttctgggctgtatggctgaggataccagctcctggaccacagaaccctgcagaaggagcaggtttcaaagaggtggtgaggagctccattttggaaatgctgctggaggagtggtggggtacagccaaggggagctgttccataagaaccaccgtcagaatctcaggagagagatccagatgggttgtggaattgggagtcatcggcacatggatggcagttgatgccaaggctgacatcatgtgacaaggctagctccagcagccctgtcttcaaagagggtctggaagctctcactttttcctggtttgtgcttgtcggaccatatgcaagtaattaaaacaggacattcattaacatgccactttatgccttttagtctccctatgtctccagggctagtgggtgaggtacatagagagatgccatgcacattttatataggaccaagttcatgcaatgccaagcagtgacagagcccagctcaggttcctccaggtgctcttctgaccacactgtaattcctctgaggtcaccctaaagaaaacactcaattcatagacaatcatgacaggactgaaattcatgatgacagataaaagggggcatcttttctaccaggctcagtggcttttagcctctgccatcctcaccccctcacccttgccctccactgcagcacttctcacctggtgttggcctgtctacccccagcgggtctcagaggaagggccgtggctccatggctcccaagtctctggacacttggccaagcgagggttgtaagtcatagcccaatcaggccccagctgctcaaagatgcaactggaggtgatgccgtaacataaagagatagccccggaagtgatgcaataacatagggatgtggtcagtaaattgggaatgggagaagaaggagcttttcctgctgaccccggaaatcatggtgccatggagagaaggtaaagtggagatcaccagggcttggggctttgttttggttttgtctcagagcagtgagattatttttctaaaagacaacttgaagggaactccagtatgtaaaatggtttttaaaaaaagacctgccctaacaaaagtaggagccctggggcctgagccagcttcctcttcctcaccccatacatactcagcccgggcctccgagccttcttgcaacacttttgaaaaccgatagtttagtccataccttccaggatggtgggaagtacataaatttgaaagcatggaattatagtcaaattcccctgggtttaactctagccaggctgtttattagctgtgtgtattttggataggttatttaagttttctgagcctcagatttatcatctgtagaatggggagggagtacagaattgctgtgaaggtttaaagagaaaaaataactaaaatattgagcactgtgctcagcattgagtatattctcagtacatgggaattattgttatcaattgctgaacatttagatatttctagacaagctggaaatctggattttaatagatgggctagaaattgggatttttataagaatctcccaatttttaaatgttggcaagtaattttaaaaaatgaaaaacattgtttgagctcaataagacacgctcccgcagtcagtttgggacctctgtccgtgcaggaaggaggttagatctggaggggaagggcaggagcccagagcttgggtccctgggcaggacttgtgggtttcagtcatgggtggagactggccctgccatcctgctgtaaatgcaaccaattctcaaccagaaaatttttcaatctacctatagcctgcttccagttgtcccaccttactgaaccaaaccaatgttttcttttgttgttgttgcttgttttttctttctttctttttttttttttgagacagagtctccctctgtcacccaggctagagtgcagtggcactatttggctcactgcagcctccacctcctgtgattctcatgcttcagcctcccaagtaattgggactacaggcacgtgccacacctgactaattttttggtattcttagtagagatggggttttgccctgttagccaggctggtctcaaactcctggcctcaagtgatccatctgcctcagcctcccaaagtgctgggattacaggcatgagccaccacgcctagcccaatgtatttcttaaatgtatttgattgaagtctcatgtctctgtaaaatgtataaaaccaagctgcagcctgaccaccttgggcacatgttctcaggatctcctgagggctgtgtcacaggcctctctcatatttggctcagaataaatcttttcaatggcgtgtgtggtggctcacgcctggaatcccagcactttgggaggccgagacaggcagattgcttgaggccaggagttcgagaccagcctggccaacgtggcaaccccatctctactaaaaacacaaaaattagccgggcatggtggcacatacctgtaatcccagctacttgagaggctgaagcacaagaatcacttgaaccctggaggcagaggttgcagtgagccgagattgtgtcactgcactccagcctgggtgacagagcgacactccgtgtcaaaaaaagggaataaatctcttcaaatattttacagagtttgattctttttgtttactctgggatggggactggggtatgcagggaggtgtgcatgtacacacttatgtgtgtgtgtgatggaaggggttaacacccagctgtttgcagaccacactaggtgctatgcacgtattacttcatggtcaatctattattatccccattttaagactgagaaaactgaggctcagagaggttggagaacaggctgaggttcagtaagctgtcatagctgagctgagacttgaatgccggtcagatttcagaatctgggctcctcgcacttctcaccacactgcctgtcccttactccccccgacctccttgtcctctctcctgccacttcttcccttccctttccaagaatatcctgttttacccactactgtaattaccagtattatggttatactttctgttatccatttcaaggatgtcatagattatggtttatcaaatgctcccatgaacaagatctcatttggtcccaacaaaccctgtgagatagacaggtgagtattaagcccactttgcaaaggagaacagagctcagagaggtgggagatatacgttgtgcacaaagacccctgctcttctgtctccaaatccagggcttctttgctcacgctgctttaccgagctccttcaaggaggccctgcaaagccaaagtcaagtgtgtgctgatcggcaggtacacccaatgtctgtgaaactggatcttgattttaaatttcaatattttgatattttgttcatcctggatttttgacaccaattttcacttaaaaatattgcattaaaatattatttgattattgcgtttatttggtgcccctaaattttgcaccacaggcagtgcccccactgatctcaccccgatcccagccctgcgcctgtctgtaccagtgtaaggattacgttgtgattgcaactgtgacgtaagcatgtgagagcgttttaccacagtgccgagtctgcctgccttttctgacccttctttgttcctttgtttggttcggagtgtcactcccctaatctcccttcaaggaaccctgtctgactggaatgatctagtaggagtgggtgggcacgttgggtgccaggacagtgatgcctggccttggaaggggggcccttgctgttagctggtgggcgctctcagtgctttgggcaagtgaacataatgaagccttgtttctggaagggatcattcgggaataaactttcatggataccttcttgctcaccccatctgctctcccgtgctccccctccagccctgttggccactagggaaatagaaggaacagcttgatcaaggtttttcctagaaaagcctttccatgggcccattatggaaaacgaagctgtttttgttttccttgattaatcacagtgtcttgtttcccaaagcaaatgtggccttggctcttccgaaagaacacaggctgtgctgtaaagaagggctgcagccgcctggtgcttgacaaggtccccaagacgggaagggacacatgtagccctgtcctccaggactcggctcttccttttttaccttccagggagctcaggttaccagtttcctttgtgtttttctgccagtgtgaacaggagaaatattagcctttagagatttctttacagttccttgaaagctggaggggtgaaatcagccagagaattatataacagcaaagctcatttaaagcaacagtgtctttctatagggctgtggtggttccttaccagtttttgttactaactataaagaaaaggatgctaattttgtgaataaaatagaggggcattcccttccctcattactttctgtttgttcattggacggacacaattcctagggtgttgatttaaaaaaaaaaaattgaagcctctttcaaggaagactaggggaaatcatgtacattaacctcaggcagacacggcatacttattcttgttagaagtcagaagaaaaaaaataaagagaaaagctttctaaagcatttgtttgttttaatttaagagtcacggggaattttataaatactcggctaaattcttcaaagggagccatgttctttaaatttaagcactaggctgggcgcagtggctcatgcctgtaatcccaacactttgggaggctgagatgggccgatcacctgaggtcaggagttcaggaccagcctggccaacatgatgaaatcctgtctctactaacaatacaaaaattagccaggcgcggtagcatgtgcctgtaatccgagctactctggaggctgaggcaggagaatcacctgaacctgggaggcagaggtagcagtgaaccacaccactgcactccagcctgggcgacagagcaagactccatctcaaaaaagaaaaaaaaaaaaataagcactagatcatctattcctacgttgtttgacctagagcttaaatacatctcaaagtgcaccacacacattagctcagctgatcgccatactcccttgatttgaccttctctttcttctcattttagagatgaggaaactgaggccaaaggattctgttacttgcctggcttcacagctcacctggagattctgaactggcatcttcctctctctgccatcaccccagaccctaccctctttcctctacaccagtggttctcaatcaagggcgattttgccttccaggggacatttgacaatgtctggaggcgtttttggttgtcacaattctgtgtatgtgtgtgggtgggcggggggcaggggattatgttggcatctagtgagtagataacagagatgctgctaaacctacaatgctcagatggcccctaacaaagaagtatgttgtccaaaatgtcaatggtgcagagggtgagaagccctggtctatacagagctcagcagtccagagcaattgcaacctctgggagttgccaagagctcctctgcccagcaacaggcttggcctctctcctgtggctgccacaagagttaaagccactgtctggaatgccctttggcagtggccaagtgtcccctgcagaactgactgcgggacatgcggtgcatcagccggagctgatgtgttttgtaatttatagtcacagggcgcctgtcttcatttagcagtaggcctgctggcagcttccctgccagggaggaagcaagttccacagaggcccacagcccccgccagctgccggcccgtggtatttggggacggctgttgctcagagacacctgggaataggccggggccgagatggcgctgagcactcggtctccccttcagacccatccatcagcagcggtccctgccagaagatggcctattgaacatttccagaaatagcacagccaagcccgtcaactgctttcttggaaatacattcaataaggatggcggtcctccagcagggagagcagaaagcctggcctggatcagtctgctgagaaacagcaatgcctggctacaggccatgtcggtgccttgggaaaggggagcggttctcatgggacttcccaagccctgcagcctctgaagtcacttcaaaatgttctcagtatggagggagagagtcacaccttgcagaaggccttaggccctgccgacttcttctaactcagtgacctgcacatcttgctgtgttcgttcagacaccccgcagacaggaaggcgattcaggcttggaggcaaggtattaactgtcagcagagagagacctctgcatcatctggggaacgtttattgcagtccctcctcttgtgagcttcactcccaagtagaaccaaaggagcatcagcagggggagtattttcttccccaatccttcggtcattcctgaggtacaggaaatacaaggcaaagatgtcatattgaaagaaaagcttataatttctactcctcccctccccacttcccacagaattaactttcccttaacttccctaacaggggcctgacattgcggtttgaattcagccaccctgggaatctgcaccctgagctttctccaatttctgggatggcacagtgatggcagggcttaagagtgcctcaagaaggccagctgcctttaaaaacaagctcctggaagatgtaggtgtcacataaaagcaagagaccaaaaactctctgcaatttggggtgttcaggaaatgttgattgatcacattttttaaattataagagactgctggacatggtggctcactcctgtaatcccagcacttcaggaggcccaagtgagaggattgcttgagcccaaaagttcaagaccagcctgggcaacatggcaaaacctcacctctacaaaaaatctaaaaattagccaggtgtggtggtgcacacctataatcccagctacttgggaggctgtgtgggaggattccttgagcccaggagactgaggctgcagtgagccatgatagtgccactgcactccagcctgggtttacagcaagaccctgtctcaaaaaaaaagtgtaagacagttaccaggttcatcataaaaaattcgtgggacctggttttatttgcaagagccactgactctcaggacaaacaagatttgaagcccacactgagctataggtggaggcagggctgtgagaatacaatacaggatgcccagttaaatttaaatttcaggtaagcaataatattttttgtataattgtattccaaatattattattatttatctgaaattcagatttaatgggcatcaggtgttttgttcaatctgttcactccatttggggtataaattgatctagtttttaaactgataacagggaacactgacacatattcaatacatatgaaagacgataccagttaagagaagaagaaggagattagcaatgaagagggaaagcgagagaaataccaggaagaaaaggagatgggcatagcgaaggagaaaaagttccaaatgaaagagaaacaggaagtgctgaggagagagaagaaaacaggaatgtttctgaaggaccaaaaatgtttgataaattatgactgttacacagagagccatctccctgggaaatgctgttgagttggctaaccactgttcctggatctgcagctctttgttctgtctggtaaaacacacagtgaccactagggagaaatgactctctaagccacagtaccattatctgggtcactattaccccaggctcaggttgttaaataaaatttataggaggccattgctttggacagagtccttccactgggctccaacagaccaaagcaaaccagaatagtgtcacttgtgctacctgacatgtgctcaaactgaactttaaaacgggccagttttccaaaaatcaggagatttacagcaaccaactgaaagtgaagtggtgtcattcatctggggtgatacctgaggttcactgcctcatgccaaagaaatcgaggatgcagacacacacagagtgagtttaacaggcgaaagaaagagaataggtctctctcctgcagagagggggattctcgagtaggtcttccggttccatggtgaaatgcacagggttttatagatgatcttgaggaggcagtgtctgatttacatagggcccaaaggttggttggaccaggtgtgtcatttacataacgtgcgaagaagatggctaccccaccctaatcttttattatgcagatatgtgccatattgcctgtttctttactgtacacgtggtgacaaagaaaagggaagatggagcctccatgctgaacatgcctggtccccaggtagccttttcctattggcatagctgccagcattcatccatgcaagcttccagtttgcttatctatgtttgcagctcaacttttcaggccactctttgttagaaaagaaatgattcgggggctgctttttattaaaagggtaaccttgctgaggactctcttaccctcactaactgcctaatttctttctagctcctgtatcaaaagggtccccatccacctgcacaggcatgagagggaagtcccctgtgtataaaccctttaaggaaagtaactttgaaatgaccaagccacttcatgtttcttgatcttgctatccccaggcttttctgcccatccatctgcttggttcttcaaagcaccttttctattttatagataagatgctgcctgattcacaaatcgataataaaagccaactggacctttaaattcaatgtgtgaaaattttgttctttgacagggtgaagccacatctaaggctgtgtccaactccaggacctaagggccctccctactcctcccacctccacccccccccgccttcccccacaggttgctgtcattcatggattgaggattttcgaaaaattgggatctaaacaacaaaatggatttggctgccacaattctttgaaattgttttgttgtggatgattcagaaaacccttcaacagcttctttcacctcagggtcaatgtgtttgaggaggagagtcatcgtaggcctgtgtgcagacaatcgaggttccttgaattataaacacccttattcccatccccacagatgggaggtcaggttggcttaacccaaagggagaagactatgtaggctgggggtaggtgtggtaagagaggaggcctcccaaggaggggcctgtagtagttggacctgccatcaccatggacgctacggaattgaaaagaggagacaagcagggaccctcctcttaggggcctgtaggggatggactggtgggagagggtcaagcatggaaataaaggaaagccttgagtccctttaagggaaattccaggcacctagctagccctgaggagcttagccccatgctaagaccctagtccagataacaactggataagcaagaaggtaatagtagcctaaaacaggctgggcgcggtggctcacgcctgtaatccctgcactttgggaggctgaggtgggtggatcacttgaggtcaggagaccagcctggccaatagggtgaaaccttgtctctactaaaagcacaaaaattagccaggcgtggcggcgcatgcctgtaatcccagctacttgggaggctgaggcaggagaattgcttgagcctgggaggcggaggttgcagtgagctgagatggcgccactgcactccagcctgggcgacagagcaagactctggcttaaaaaaaaaagtagcctaaaacaatagccaaggaagccagagtcacaggatgtttggttccctatagaaactaaagatagcatcttaacgtgagtctctgagttgtttttcagaaacctggactctcaccaaacccatcccccctacatatagatctcagataaggaggaactaggaactgaactctgatcactgtactttgttctaaatttcttcctgaagggcctagagaaagtcacacccaaagaggtagagctaacctttatttctgctggccccagatttttaaacaaagcttctctttcttaaccagttgcaaatcagaaaagctttgaatctacttatgacctgtaagccttctgcttcaagatatcctgcccttttaggcccaaaccagtatgtaacctgggtattggtttatgattttgcctgtaacttctgctttcctgaaatttaccgctgcctttaaaaactcttacctgcaagccatcagggaggtggggacttaagcattagttgcctggttctccttgcatggtgccctgcaaataaacaccttcctttctcccactgcaaaccctgatgtagatatctgatcttaccgcactggggaagtggaccccagttagattctataatataataaaggggctgcctttggctacctgggctggggagtaggtctccccataaactccagtgaggagcagaagagacacactaaatgtctcaccatgctaagacgtcattccagatacctggagatatctaggctgtccatttggaacatcatcattgcaacaataacctttatggagcatctactctgggccattgcatgatctgaattgatcctcaacaactgagtcaggaaaaattcagtgtggtcaaaggagaacagaaaattccaggcagtattttcacatgccttgcaaaaaggaaactcttgaaataactatagaagctgggggctgataagaccctggaaaaccagggtgtgggccaagctggctaagaccaactggacccaacatggtgctgcatttgacctaggtttctcccaagacctcattataccctcacccaccagtaccatgatgtttccaggaacacccatatttggtgtaaaaatgggtggcactacagttccaagaaatcctcacctttttccaggaatctttatgaatattccaccccttggttaaagaaatcaataatgataggaaccccaagctccatgtgactctgtcttttgagtacgccagcactcccttgtcttgagtgtgtatttttactttgcaatcaagctctctgtctagccgggcgcagtggcatatgcctgtaatccaagcactttgggaggctgaggcaggaggatcgcttgagtccaggagtttgtgaccaacctggcaacatggagaaaccccatctacacacacacacacacacacacacacacacacacacaattcaaaaactagctgggcgtggtggtgaacacctgtagtcccagctacacagtgggttgaggtgggaggatcacttgagcctgggaggtcgaggctgagatcatgccactgcactccagcctgggcgacagagtgagaccctgtctcaaaaataaaaataaacaaatctccatactttcactgttgttcagctcctccttgaattccttctcatgaaagtgtcaagggcctggacactagctagggtcgaggtcccaccattgtttggggacctctcccagcccaccagtgtcacagcgatctcatgttgtaggtataatattatttatattactacagcaatgccctaagtcaagagatggagaaattaggactgcaaaaagttaagttgttgtctaaaagtcaattgattagtgagtgttggggcagagatttgtctcagggatgcctctctcccagcccagggatcatccctaaccctccagtcagactgccgggttcaaatctcagctccatcactcacaagctgtgtggccttgggtaagttactgaatctctctgcatctgtttcactgtgtgaaaagtggtaataaaaataggacctagctcatggagatgctgcaaggatttaatgaaggctgggtgcagtggctcatgcctgtaatcccagcactttgggaagccaaggtgggaggatcacttgtgcccaggagtttgagaccagtatgggcaacatagtgagaccccccacctccacacacacacacacaaaattagccaggcatggtggtgccacctgtagtccagctacttgggaggctgaggcaggaggattgcttgagcttgggaggtcagggctgcagtgagctgtgattgtaccactgcactccagcctgggtgacagagaaggactctgtctccaaaagaaaaaaaaaatagatttaatgagtgagaactctgactttttttttctcttgcccaaattcctatctaaggggcctggagagtcacaccttagaaaccataaaatctcattagacaggctttattagccattttttaaaattttttaacttttttttattgtgatggggtctcactatattgcccaggctggtctcaaactcctgggctcaagtgacctcctgacttggccacccaaagtgttgggattacaggtgtgagcccccacacctggctgagttttattaatcttatataatatggcttactttacaacctgactcagatatagcatcacatgacagatagcataccctgaaggaaaccaaaatattttaccccaaaatatatttctttaacatattttgaaatggctgccacagggccaacagattgaaatgactttgcaaagccatcttttgtggggaaattttgcatctgtagagaatctccataaatgtagccaggactttccccttctaggtctttccctgattaactgagagtctgacacctttaaagtctgagaagagacattcaccatctattctctctgagggctgccacctataacgttcatctacatcagaaccttggcctccacaacctccttatcttaattcaggctttcctttctactgatttcaaggatttaaatcaagctttgtgatgtcacactttttgggccaatccaacgtatactttccacgtattgatttatgattttaactgcaattcctgtctccctgaaatgtctaaaaccaaactgtaacctgactagtttaggcttcctttctcagttcctcttgagattgtgcaacctgggatgaaggtactcacatcggcttggaataaacttctttaaatatattttggcagaatttggttttgccattaacataagtttataagtgtaaagtacttaggacatgtctgtcacatacagaacactaagtattagtgctattattattcctatcattgttagtgttcagttatttccaagaaatgatacgagcctgatgggccatcaacattgtccttgggagggtgcagcagaaggggctggttctgcctctgctctgttcatgttagtggtggtgaatctgtacggtctgtagcaacctcaattcttgccccttcagaagaaagaatttgaccaaggggcataagacaaagggagagaccagggcaagttttagagcaggagtgaaagcttattaaaaagttttagagcaggaaagaaaggaagtaaagtacatttgggagagggccaagtgggtgacttgagagatccaagtatcctgcttgacctttgacttggggttttatacgttggcatgcttctggagttttgcatctctcctcccttgatttttaacttggggcaggccgtccacatgcacagtggcctcccaacacttgggaggggctgcatgtgcagtgcgtttactgaagttgtgtgcacgctcacttgaggcgttttctccttatcagttgagcattcccagaggaaggtcatttaccaattaaactccatgattttgcctcttagtgtccatgcttgagcccacttgcccaactcctgagatcttatttggaagcggctgatcacgcacttcaggtgttttccatctatcaggagactgccaataggtctattgggtgctgtctgtgataaattattattttagagagacgttttagcaaccactcaaccattacctgatggttgcctgacattcctgaggggagggagccctctcctgccatgctcatgtctgcctaactgccaacttcaacagttttagtttttgtggtttacgcatgtgtcattgtccaggcaacattttaaatttcttattcttgtgaacaaggtacaggggcttccttaagtctaccaagtagttattcatagaaagatgattcagaagactcaattttctgaatttaccttttatctctgcttgttaataatgactctattatatgccggtgaggctagacaatgctgcagtaacaaataaagccctggagtcacaatgatgtatcagaacaattttttttcccccttcatagaatgtctaggaaagctttcctccatgcattgactcggggatctaggctgtttccaccttgtggctcatcaaaggctttcatggtcacagccaaatgaaatgagagaagtggagggactctcctagtgaactgcctttacctacatttacacactcctcctctgttcaaagtccattagtcagacttgtcacatggctccaaccacagcaggtgaggaagtaggaggaatacatggattttctctttccagcaccctaatggtctctacctcaatgcacaaacccagcttatggccccaagtgaagaactgctagttgctttgttaatcaagtaatgagaacctttttcttattaattatggtcatgtatttatttgattgagacatagttaatttattcactctttcaataagtatttgttgagtatttcctctctaccaggcacctgtgggccctggggatatgtcagtaagtgaaacagaacaaaaccacttccttcatagaactagcattccagtgggaaattgtgaaagatagataattaacccccaaaaataagaaagcaatatattaggcgttgatatgtgcaatggagaaaataaaacagggaagaggtttcaagatgcaagtgtgtgtatctgtgtgtttgtgtgtattgagggaggaacttaaaataggatggttagtgaagaccttcttgcaaaagtgacatttgagtagacgctcaaaggaggcaggagagctctggggtaaaagccgtctgtgaaggggaagaagggagtgcaaaggccctgaggcaggagagtgcctggcatgctgagggcagtgaggatgtcagtgcgtctgaggagagtggtgggatatgaggtgaggaaggtgatgaggatgtacgcaccctggagggccttgtaacctgtttaaggatgttgcttttactcttgcttaaaaacctccaattttcttcccacttcccaacatacatactgtacgtctgtcagttcccctgcagcagtggttctcaaatttcaactggcattagaatcacctagaaggttaaaatcagactgccgtggtttacctcgcagagtttctgtggtagggcctgagaatttgcaattctaattggatcccagatgctatggtctgaacgtgtgtgtcccctcaattcatatggtgaaacctaatccccagtgcaatggtacaaggaggtgggacttttgggaggttattaggtcatgacagcagagccctcataaatggaactagtgcccttataaaagaggctccagagagctacctggccccttccactgtgtaaggttgcaataagaaggtgccatctatgaaccaggaatagggctctccccagaagagagacccctattcctcactgcccctcaggatgccaggcactctcctgcctcagggcctttgcaatcactaattccccatctcagacggcttttacaccagagctctcctgcctcagggcctttgcactcactaattccccatctcagacggcttttaccccagagctctcctgcctcctttgggcatctactcaaatgccacttttgcaagaaggtcttcactagccatcctgttttaagttcctccctcaatacacacaaacacacagatacacacacacttgcattttgaaccaacaaccttctgtgttttattttctccattgcacttaacatgaaatctagccgggcacagtggctcacgcctgtaatcctagcactttgggaggcagaggtaggcggatcacttgaggtcagaagtttgagaccagcctgcccaacatggtgaaacctcatctctactaaaaatacaaaaattagctgggcgtggtggcgggcacttgtaatcccaactactggggaggctgagtcaggaaaatcgcttgaacccaggaggcagaggtggcagtgagccaagatcacaccactgcactccggcctgggcaatagagtgagacactgtctcaaaaaaataaataagtaaataatcaaatctgccagtttcttatcttggacttcgtagtcttcagaactatgagaaatagatattgttgtttcagccacccagcttatggtattttcttatagcacctgagtggactaagacaccaggtgatgctgatgctacagggaacacactttgagaaccactgctctagtgaaacaagccccctcttgctttcctacttccccatgaaaacctgccctgatttttggacaaggccagctacataatttttgaggctcagtcaaaatgaaaatgcaaggcccctgttcaaaaaggcagggggaaaaagggcagtataagatactaaaatatcaaaattatccttctaaaatattttctaggtggagcatccttaatccaaaaatccaaaataaatgttttaaaatccaaaactttttgagcactgatatgacactcaaaatgccctaatgagcattttaaattttaggtattcagatttgggatgctcaaccagtaagtataatgcaaatattccaaaatctgaaaaaaatctgaaattcaaaacacttttggtcccaagcattccagataaggtgtatttaatacactacatcacttagaaagtataatgagagtaataatgacacatgaataacaacacaaatttttaaatagccaaaaaatatttttggtgttgtaagtttatataacacaatacataatagtatcttatattaacgtgacattataattaatctggcttgctttgctgcatattcattaatttctgatgtgttttcttgcatatttatgtatttatttgatcataaaaatttgtacttttaacagcttaattttcaatgatctaattcaaagcaatgtcagttgctattggcaaatgtaagatcacgaatactttttgataaatttaattttgacaattagaatctactgatgcaactcttactagaataagtttattttttaggctgtaatgatattgggatacatttctgataaattatcttgaaatatgaattttagtacatctagaggtgatgattcctatagaaatattttctaaaaagatttaactcttcatacaaatcagtttcttataaatctgaatttaattgtacatgtaaattttaatattaattaatatttcctccagcagttcctgcaagttgtggcagttacacaagaaacaaaaaaaggcttcataatttttatataattcaaggcacttctttatgcattctatcactgcatcttcaaatataaggaaatttaacttttttttttttttcgagacagagtctcgctctgttggctaggctggagtgcagtggcacgatctcggctcactgcaacctctgcctccagggctcaagaaattctcctgcctcagcctcctgagtagctgggattacaggtgtgtgccaccatgcccggctaatttttgtgtttttagtagagacggggtttcaccattttggccaggctgttcttgaactcctgacctcaggtaatccgccagcctcggcctcccaaagtgctgggattacaggcatgagccactgtgcctggccagaaaatttaatttttaaattgtcttgctaatttttggtttatctgaggttttcctgcaaataataatgttcttttctgttgaataggataatctttacatttaatttctatttccaagcctgtggatatttggtttgcaatgttgcaatggttttcaaaaccctttgaagaattttaataactccctgatatgctttattgcaatgtctgtgtgtacatcttgttttataataacttactgacaaactttgctgcctgagtaccagcagttcctgtcgcagtgcttagactggagagttaatatttatgcagatgctgcaggaacaggctctggggacagactctcctggggctgcccctccgtggaaccccagtgctgctcctctctgccacagccactacttctgctacttccatgcatctgctgcttctgctactactgctatcaccaccaatgtaggccccggtcccagcccagctgccccctcagatacccctggtgcccaggacagccccaggtatgcccgtgcataccagatggccaggccaactcctggtgctgccctttgccatgcctgtaggcatgagcctgcacgtgtacactaacacctggaatctcctctgctccatgcatgctctattgtctgatctgacttcacaacacaaggtcaaaaataaaattgtcaagaatttcaagacagtaacagcagaacattaaaccaagcatgggattccttctgagagtaggccctgtgtgcacaggttgcacacccatgaagctggtcctgctttggattaagtgatttaccataacttttgcccatgtacctcttatattattttctaacaatgtgttacactaaattgtttaaggtctattttctccactaaatcagaggtcagcaaactatggcccaatggctaaatccagccatttgttattttttaaattgtttatatttagggtgtacaacatgatggattttgttgttgttgtttgtttgtttgtttgtttgtttgtttttgagacagggtctcactctgttgcccaggctggagtgcagtggtgctatctctgctcactgcaacctccgcttcctgggttcaagtgattcccatgcctcagtcacctgagtagctgggattacaggggtgtaccaccacgcctggctaatttttgcatttttagtagagatagagtaatcactatgttggccaggctggtcttgaacttctggccttgtgttatccacccaccttggcctcccaaagtgttgtgattacgggtgtgagtcactgagcccagccaacatgatgttttggtaaacatatacatggtgaacaatacatgatatacacatacattattactgtcaagcaaattaacatacccatcatctcatatagttacctttctttttgtgtgataagagtctccaaaatctactctcttagcaaatttccaatatacaatacaatattaactatagtcttcatgttccacatgagatttctagatttattctcctataggaaccacaactttgtactctttgacctacatctttccatttcccttattcaccccttcccgtggtcaccacaatttactctttgcttttatgtatttaactttttgtttctgcctgttttgtaataaagttttattgaaacacatgcacactcatttgtttacatattgtctatggctgctttcaacggcaggtttgagtagtgtgacaaggaatgtttggcctacagagcctataacatttgctgcctggtcatttatagaataagtttgttaatgcctgcattggactataggatccctgaaggcaggaattatatctctccagttcacttctgtgttcccaatgcctagagcagggcctggcatatagtaaatgctcaatcaacccttgctaaaaaaaaaaaaaaaaagaatgaaacaaaaacatgaatatatgaagagcctagccttttttgaagtaactcattttatcttaaagaaaatcatctttggctagagtcacagagtagaaaaaaaagtaaaagaaaatcctgtaaattttgattccttttctgttttgttttcacgtaaaaatgatgtttaaaattacttaccttatggtcaaattgactctccagggaaatcgaaggtgattgtcttgtagcttggcacgccctctggcacacactccagtctggagaggcacaggcgttgaatagaatagaatagcattcatcattcaacaactatttattgagcaaagcatggggctaggcatgataacagaaatgacaatgattccactatgtcttactcaatagacctgtagagcctacagaccaaagaaaaaaagactcacaaatatatatactcatatataactataccataaaaagtgttaagtaaaaaggaaaatgtctggatgaagtgctttgaattttcagagccaggacggattccttttggctgcagaatccagaaaggctttgtgccagtcattctctatttggtctcagatccgatccctgctcttctgcgttgctttgcaccacaagatgctggcccctgcaaactacatttccgtggctgccctgccaactggctctatctaggctctgtcagtgggaggccatggaaagagatcggaggactggacaaagagaggagaagtgccacggctcctttctttcgcgtgctccagagagaggagccatggtatttctcctctctctctgaacctcagttttctcacttttccaatggaaaaagcaattgtgtctatttcttggggtttttttaagagaatgaaatgagataaggcatgcaaaatgcttagcacaatacctgataagtaataagcatttaaagaatacaggctgggtgcagtggctcacacctgtaatcccagcactttgggaggccaaggcaagtggatcagttgagtcaaatagttcgagaccagcctgggcaacatgacgaaaccccacctctaccaaaatacaaaaattagccctgcgtggtggtacatgcttgtagacccagctgcttgggaggctgaggtgagaggactgctagaaccctggaggcagaggttacagtgagccgagatcgcgtcatgcactccagcctgggtgacagagtgagaccccatctcaaataaatacataaataaataaataaaatacagaatagagctgttcttgcttttgggcttgttcagggaagtgggaaggagtgcagtgatcggtgatgtctgctaaaggtgaaaggtgagagagtagagctatgtgcgaggaatatttagtaatgtatattaaaactgtattgatataaacagttaactgatattaatatattaaaactgtattataaagatagaactgaagggacctggcaaatggactggcagactctagaaagggattaggaaaaatcaaagacctggaatggtgataccaaagcacacacagtcaatacacaagaaccagtaggctcaggagaacagattatgaatttacttttagacaatggtgtgcaaacctttccagttgcaaaaaaaaaaaatgcctacagtaataccttcaagacactttaacaggtggggatttttgttagagatataaatatatgcagtgagttagcaaaacaaaaacaaaaacaaaacatttcagcagctgcacattctggcctcatggagaactggaaaactatccaggaaaccacagcaactgcagttcctagagcctggcctcctctgaagaggagaaaccattgttttttacttagcagttctaccttgcccaaggtgccttctgtttacaatctccctctttctggttttccctttcttgcctctgtgtctgtggctggattatctgtcttgcattcaagatgattaggtgggatatttaccacccaatatgaagcttcccaactgggctgcatcctcaggttagatgccctgggctcagcatagcagttgtggtcagcacagcagattcacctgaaacaacgcaaagacccacctttctcagaaggagctgcgtaatcagtaggttttatagccagactggtgaagacagggtgaattagagatgtcttttgtttgtttgtttttgtttttgttttttttttgagatggagtttcgctcttgttgcccaggctggagtgcaatggcacgatctgggctcaccgcaacctccgcatcctgggttctagcgattctcccacctcagcctcccgagtagttgggattacaggcatgcgccaccacgcccagctaatttttgtatttttagtagagacggggtttcaccatgctggtcaggctggtctcaaactcccaaccttagatgatccgcccgcctcagcctcccaaagcgctgggattacaggtgtgagacaccacggcctgcctagagatgtcagtgggagctccaaggagctgaaaaggttaagactggattgtgattgagggaatattgaggatacctaattacttttgatattctacatttcatatggatttgctcatataagatcaatatctgtccaaggtttagggcagagcaggcagaagttatttctggtaaagataattatttcaatgagaccccaaaacttagatgatttgcagagggaggaattttattactgtcccttataaggacgtaactagtttcttagaagaacaactttgagattggtttggaagtgggaatgtggtgaggttaagatttctttactgcattgagagtaaaatattctacagctcaggaaaacaaacagaacagcccaaccctctgtgattcttcccagaactcttctcatccatcatccctcttgatactgaagaaacccagagcttgcaacacacatattccaaagataagttgatacaagctcacttatgtgaatttctttaaaaatgaagagagagaaaaaagtggagagacagaagacaaaaaaaatacacaaaattaaaaatagctaatatttggaaaatctattattgatggagctctaaggggcagatgaatccttattcttcaaattccaggtgaggaaaaaacagaacaattgtttatgcagctgtacccaagaggtggtatgtgcacttttcctctaactcttaacagagaaacaccacagcactcaaaatcctcttttagaataatttgaattaaaaataaagaatttcacaaatatcactgaagaagtagaaatttttaaataaaagaaaaatagccagtatcttattatcctctaattctgcccccttattttgtaagtacatttataattctaattcacatgcatatgcaatttttatgtaattgtcatcagaagcccttgggctcactacgcagaccttctgagtctgaatgctgtctcagcacttggcatctatgtgatttggccggttacataaactctctgggcctcagttttctcatctgagaagtaggtataataataataatacctacttgaggattaaatgagacaacatctatagagtgcctagttcaatgcctggcacatgctcagtcaatggtaatcactcattgtccatcgttaaaatcagggagctttgtaagccagactggttggacaggagagcttagcagttaaagtgtgtttgctccctattttttccctccccacaatgatgcaatcctgtatctctttcctctggctgcccggccccacccaaaccaagataaaagatgtaacacacacaacaaacattacgtgagcacctgatacgtgctggaagggccctatgaggacttggggaaataaaatcctgctgctagctgctgctgtaaacacattgccatgccccaatgccatgttgagcacctcatatgcataatctaaaccagcacccataaatgtggccatagtgactctcatgcagttgaggaagccatttctcaggaaggttacagttatgggctgaagtatgttccccccaaattcatatattgaagccctaactcccagtacctcagaatgtgactgtattcagagacagggcctttgaagagatgcttaagttaaaatgagaccattagggtgggccctcattcaatcttcttatggtgtccttactgatgtccttataagaagaggaaatgtggacaccagggatgcacacacacaaagaaaagaccatgggagggcacagcaaaagggtagccatccgcaagtcaagaagagaggctcagaagaaaccaaccctgccaacaccttgctcttggacttttagcctccaggactgcagtttaagccacccagtctgtgatattttgttatggcagccccagaaaaccattatagttatataacgtttaaaagcttagaagggattcagccttaaaaaagaaggaaattctgacacatgctacaacatggatgaaccttgaagacattatgctaagtgaaattctaagcaaaagaacaaagccagcttcaaactatacttaaaacccaatttcaaagtatgctataaggctactggaaccaaaacagcatggcactggtccaaaaacagacacatagagcaatggaaccgaatagagagcccagaaataaagccacacacctacagccatctggtctttgacaaagtcaacaaaaacaagcaatggggaatggacccctattcaataaatggtgctaggctaacaggctagccatatggagaagattgaaactgggcccctacctttcaccatgtacaaaaattaactcaagatggattaaagacggaaatgtaagacctaaaatgataaaaatcctacaagaaaacctaggaaataccattctaaacactggccttggaaaataatttttagctaagcactcaaaagcaattgtgacaaaaacagcttgacaagtgggagctaattaaactaaagagcttctgcacagcaaaagaaactatcaacagagtaaccagacaacctacagaatgggagaaaatgttcacaaactaggcatctgacaaaaatctaatatccagaatctataaagaacttaaatcaataagcaaaaaacaattaactccattaaaaagtggataaatgacatgaacaggcacttctcaaaagcagacatacaagtggccaataaacatatgaaaaaatactcaacaccactaatcatcagagaaatgcaaatccaagccaaaggaaataccatctcataccagtcagaatggctatttctaaaaagtcaaaaagataacagatgttgctgaggctgtggagaaaagggaacaattatacactgttggtgggaatgtaaagtagttcagccattgtggaaagcagtttggagatttctccaagggctaaaaatagaattaccattcaacccagcaatctcattacagggcatatacacaaaggaaaataaattgttctaccaaaaagacacatgaacttatatgttcatcacagcactattcacaatagcaaagacatgtaatcaacctagatgcccatcaatggcggattggataaagaaaatgtggtacatatacaccatggaatacaacatagccataaaaagaatgaaatcatgtcctttgcagcaacatggatgtagctggaggtccttatcctaagcgaagtaatacagaaacaggaaaccaaatactgcatgttctcacgtataagcgggaactagacattggaaacacatggtcataaagatggaaacaagagacactgcggactgccagaaggggagggcaaggaggggcagagggttaaaaaaccaccttttgagtattatgctcactacctgggtaataggctcattcataccccaaatctcagattcatgcaacttagacatacccatgtagcaaacctgcacatgtaccccctgaatctaaaatgaaagctgaaatgagaaaaaagaagacatgctagtaaaataagccactcacaacagacaaattctctagtccactcatatgaggtacctagagtagtccaattcttagagacagaaagtccaatggtggttgccagggtctggaggggagggaggaatgggaaattattattggagagacacagtgtttcagttttgcaagacggaaagtgttctggaggtagatggtgagggcggttgcccaacaatgtgaacgcctctgaactgtacccttaaaaatggttaaaatggtaagttgtatgttgcctgtattttatgcaattaaaaattaactttttaacgagtttagggggctcctactctctgtaaagttcaatctcattgaattcttgactcattgcttttggggacgatgaaggcagggagttggaggagggactcggggaaggcaagagagggctcaggatgaggaaggcctgtttgcttttcctgttctgtgggaacatctttaagtgaatgctggcatcacaacagctgtgcagtgatcgccacctctgtcaacgatgatgatagaagagaacaggatttccaaatgagtggctgaattccctgagcgttttttatttttaatgaatttttctcttccttttttccaacttttgggcctgctctttatcgcgcacagaaagaaaacatttcctcagtggtggccaaagctcttttcaggttcttccacagcaacaataaatcagcacagcctctccttgtggccaccgtagatttgctgaccctctgcgtctgctccctgccaaacccaagagctgagggttgggccgtcagcatctgcccctttatgcaaagggtttctgaaatgacaagtcatgcccacaggaccctgctgtagaattcctcagggctgggcagggactgagtgggacagagagagactccagtcccccttcttagatgtgttctcagagagataaacatttctatttggtgggaaaggatcccaccaaaaatgggctgctggtatggtgtctgggcagaaaaaccactgaagtgtctcccacagggcaaatcaggaaaacgtgggcatcaaaataaataacaatgggtcaggcgcagtggctcatgcctgtaatcccagcactttgagaggccgaggggggcaggccatttgaggtccagagtttgagaccagcctggccaacatggtgaaaccccatctctactaaaaatacaaaaattagccgagcatggtggcaggcacctgtaatcccaattactcaggagactgaggcaggagaattgcttgaacccaggaggtggaggttgtggtgagccaagagatcacatcactgcactccagcctgggcaacagagcaagactctgtctcaaaaaaataaaaaattaataataataattataataatggcagcacattgaacccattaaatataataggaagccatgactccacctaactgaatacataaatggaaagtttaatgaagaataggatatatgtatgtttttaaactacctcaccacaaaatacttattaattactaagaatgacttattaattacaaagtctaaacaaaatacttattcattacaaaaagtacaagaaccagtggaaagcctgacagacgcttccttaagcaagagatcaaagtgaacactatcatgatgggacaagctgagctcatgtgtcacctgacaggatgcagcaagaagaccccgacatcccgttggtgacattcctgccaaagacacatagcctgaatctacttgtagggaaacacagacacacccaaactgagaggcattcagcaacacagctgaccttgaaatattcaaaagtgtcaggatcaggccaggcacggtggctcatgcctataatcccagcactttgtgaggctgaggctggtggattgcctgagctcaggagttcaagacaagcctgggcaacatggtgaaacgccgtctccaccaaaacaatacaaaaaattagccaggcatagtaatgtgcatctgtggtcccagctatcgagaggctgtggcgggagaatcgcttgagcctgggaggcagagattgcagagagccaagatcatgccactgcactccagcctgggagacagagtgagaccctgtctcaaaaaaaaaaaaaaaaaaagtatcaagaaagacaaagaaagactgagaaggtattccagacaaaggaagtaaaaaacacagccagcctgtagtctcagtactttgggaaaccaagacaggagaatcacttcagcctaggagtttcagaccagcttgggcaacatagtcagaccctgtctctaaaaaataaaaattaaaaaaaaaaaaaaaagaaccaaccgtaacttggttctggactggattattttgttgtaaagaacattattgggacaattggcataactcaaatgggatctgaggaatagacagcagggctatgtcaatgttgatttcctgattttgctggttaatgtggggtcatgcaggaccacatccttgtttggaggaattccaccctaaagtatttaggggcaatgggacatcaaattgcaacttaccatcaaatggtttaggaaaaaataattctttgtactgtcctccaatttttccataaatgtgattttgtttttcaaaataaaaaaaataaaaaagaaaagtaagaaaaaaaagaagtcagtgccttgtttagctgggaggaaggccatggtcttgggcacaagcctgagatgtttctcgaaattgaattgcctctttgctgactcctgtggggacctgggtggaaatggaggagggaggcctaagatatcagatgaataagtttgctcataatcttgctactcagttagaaggattcatgatgatttgttgtgtaatcttttaggaatgtgtgtgtgtgtgtgtgtgtgtgtgtgtgtgtgtgtgtgtgtagaaaccttttttttttaactggacaacatactatgcctaccgtttatgagcttgcctacttcatggtattcttcaacatcatttttaaaggttagctaatgagtatcccattggatgtgaatcatcatttagtttactaaccccagctggagttggatttgacattccttggtccaccctccatacctcatattttcagttcatgctgtgcctcaatgagaaagaaaagagggaagagctgccaggttctttctggaagaccttatattgtttcccactttcccatgaacagaattgggcaatgggaggaagttttgaggagagattaagatcatgctcagatgagctaggtttaatgaccaattctcctcttaccagccatgtgaagttggacatgttacctgacatctgtgtgcctcagtttcctcatctgtaaaagggggtgaaatgaaaagtacccatctcacagcgttattgaaagatgaacagactctaagtagctggcacatgtaagtgctcattggtgttggccattgttaatactatgaataaatgtaagaggcaacttttgaggtctgcagaaggttaaaaagacaccaagtggggcaacctcctctgccgaaggggaaatagtcctctgtgttggtggtgaggcataattatgatggaaaaaacattttccaaggtctggaactgacgtgtactccttgtgacattttaatctgtgagtaatagattccattgcctacagggctgcaatttttccatttattgctttttcctcttctctcccaaacctggattctgccttttctcagctccagcctgcctctagcaaccatgaactgtttctggataatccccttcccgcgccagcttctctactcaactcaggcaaggaagccgaaagccccagagccacactgcctttctcggggaaagtggagaggacctactgtttgctccattagttacattgctttccatgctcatgacaactctctaatgcagacactgcaatgatccagggtgcagcagaggggttccatgaatgggctttggaatcagcgagtacaggactggctttgcctctcatacactcactgtgaaacctgaacatctgaggctcagttttcttatctctagaatgagcgggacaatactaatgaccttacaggactattaggaagattgagttaaatcacacatgtaaagtatatgcttgtattagtctgttttcactctgctataaagaactgccttaaactcggtaatttatgaaggaaagaggtttaattgactcacaggtcagcatagctggggaggcctcaggaaacttacaatcatggcagaaggggaaggggaagcaaggcaccttcttcacaggcggcaagaaggagaagtgccaagtgaaggggggagagttccttataaaaccatcagatctcgtgagaactcactcattctcacaagaacagcatggggagaatcgcccttatgattcaattacctccacctggtctctcctttggcacattgggattatgggtattatagggattacaattcaaaatgagatttaggtggggacacaaagcctaaccatgtaaatggttaattaaacctatttccttcaatgatacagcccctagagcacaatggatgctcagtagatgctaattaccataattatcattatttggagttgaaaaaatgagccttggggtaatataattattataactataattaataattatactcttctcattacattttggaggtgcagaaaccctggtatacttatctctaagtttagtccttttcccactgtacacagcggcttgtcccactgtgctgaaaactaccattcccctatcttctatagtaatagaaattctagatgattgtatgaccaccagctaagattacatttcccaggcatccttgaggcaagatgtggccatgtgactagtttggctggtcgaatgcgcgtggaagtggtatttgaagcttcctggttaggtatttacaaggaaagggcctgctttcccttgtccctttccctcttgggttgactgagtggattttgacatagaaggatataaacttctatcttgtgtaagccattgtattttgagtctctttgttacagcagtcaaaccctcaaagagagggagtagcagtgttggtagtaacaggactcaggctaggagtcaggagacttggctctatccctcatttgcttcatggctaaaatattcatttgctcccttatctgacaacattttgccagcacctgtacaagacattagcaagagataaataaaacatagctccagaaattatctaatccatctgcagtcttggtgatgttatccatgttaatctttcaggacgatatgctcacttatagaggatatggagttcagttgcagatgcagaccagggctcttaaataattgctctgcaggttccaaacattttatgggttcagaatgggttacaaggctgttaatatactgagcaaaatgcttaaaacaatcatagatgttgagacacttactaattgcaaatcctttgcaagatatcgaacctcagttccagttgtcatatggaaataatggtatgaagggaattaaattagagaacacatataaagtacttaacactctatctgacatttaggaagcagtcaataagtgctgttgacaatgacaacaatgaaaacaatgacaatgatgatgatgatgaaggcataggcttgattttccactgccctggaaaatcggccaaccaaggccctcagaaaagcagtcatcaccaatactctgccacccatgtgtactctgagggccaaacgaggctgtctttgttaaaacactttttaagaagggagatgtgatagtggggggacatctttgacaacatccaaacctgcagcattccaccctacctaccttggtccctcaaattacttttcttgtctttgccaagctcccatctgatgactgctgctgcattgcaatgctttactattaactctgaggggttattctattgactagtgatcgtcatctagtctccatgtccactgggatctgtccacatacatgcaaaattcatcagataaaagtcaggaaaaggaaaaagttttagtctaatgattatattaaataacctctttacctttgaatactcataatgagttacctttttgaattctggaatgctgactctcaatacaaggtgctatacatggaatttcatatatattgtattgtatgttccttaattccacagactaatgattattatcctgactgcaggtaaggaaactgattcaggatgtaacttcctaggtacatagaggcaaatcaagaaactaataaagtttaagctcagcccccttgtttacacaatcctcttccaagaccctgtactgatctcgaatccatgtttgtgctctttttcttagagagccccccgaattttatcagctacaagccctacaaaatctggatctgtccctataagtcatatagatgctaaatattggagccagaatttgaacagcaattatttagtattttaattaagtgtaacttgaattctttgtaatttattaaaatagtggtataggcacataaagttgtgccaatgaaccaatgctggtccatgagtttgggattggaatctcccagtgatatgcccaaatgatatgctgcataaattttatggagtcaatatattggtatcagcacttcctattgcccaaggttctacacttgataatgaccataataccttggttttacagaacatatattctctaacatgctcagagactgcatccattattctgacgaggcagaattatctccttcacattgtaattgctaatcaagctgagaaaacaaacatcttaatgggggaaccagagtagaagatgaagggactgatcaggagcatataggagacaccctctgggaattccaagatatgactcagggacctgtcgagtgagggcactgggcagtttgtctttaaaagtgaagaaatacacctgactccagtctgtccccagacttgaaagttctaactgatctcattttctctttcacatcttcaagtcttggattcctgtattcatctcctccaaacaccgcacccccagcccccatccttcagacctagaattgggcatggcaggggagcatagaaaagagaagacagtcaccatcatccaacagtataagaatgtgaagatgggaaaaggatgtatgtggccaccttttttgttgctgtttttttcttgttttttatttttattttttattttttattttttttttgagatggagtctcactctgttacccaggctggagagtgcaatggcatgatcctggctcactgcaacctctgcctcctgggtttaagtgattctcctgcctcagcctcccaaatagctgggactacaggcatgtgccaccacacctggctattttttgcatttttagtagagacggggtttcaccatgctggccagtctggtctcaaactcctgactcagttgatctgctcgccttggcctcccaaagtgctgagattaaaggcatgaggcactgtgcctggccacatgtggccaccttttgcctcccattatgaacctgggttatgttgatggttgagctgaatgctcctgttgtgacaccaaccctatccttcaggatggttagccagagagaactctcagattctctttctctctcatctgccgccacagggtcttccctgcctaacaatctctgtgtatggtttaaatcacctccagagcttcacctggtagagaaaaacaaactcacctgaagtttccaattcttctaatttaattccaggaaaagtgccatctgcacatctttggtatcaagatctctgcttatctcatcaccaaaatgtcagcaaacaacagtaaaaactatgactcacattcaaaccaatctggtattaaagatagggaggcgtgactttctttatcccttgagaggagagataaaactaattctttctcatttttccaggaaagcagggtgcacgttgggtaaagagatgggtggaggataagccagaacttctgagtcctgtgccaactgctccaagcttggcaaaggcatgccaagaaaacaaagacatgctggaggtcaaggtccctgcgggggcctcagtggagacaatggaaatatgtggtgattcccttcgtccagcaccctcccttggagtcagagacggatgctatgtaatgtgccactttccagaacagctactggagggttgtttctgactatttgacaaggctttgaaatcctgaaccacctccattatagctagaacagctatctctctctttttttttatccccctacttctttaatattaaggctgggcactgtggctcatgcctataaacatagcactttgagaggctgaggcaggagaattgcttgaggccaggagttcaagaccaacttgggcaacatagcgagacccccatctctacaaaaaataaatataaaataattagccaggcatggtggtgagcctgtagtcccagttacttgggaggctgaggctggaggatcacttgagcacaggagtttgaggctgcagtgagctatgatcgccactgcactccagcctgggtgacacagtgagaccctgtctgtcaagaaaacaagcaaaaacaaaaacaaacaaaaactcccccaccaccacccccaagcaacaacaaatttaaataattaatacacacatgggggaaaattaaaaagttaagatgagtttgtaataaaaagaaatagtttcctgccttgcttcaccctagccaggtccctttttttgttttttgttgttttttttttcaagacagagtttcgctcttgttgcccaggctggagtgcaatggcgcaatctcggctcaccacaacctctacctcctaggttcaagcgattctcctgctcagcctcccaagtagctggcattacaggcatgcgccaccacacctggctaattttgtatttttagtagagatgggggtttctccatgttggtcaagctggtcttgaactcccgacctcaggtgatctgcctgcctcggcctcccaaagtgctgggattaccggtgttaagtcatcatgccgagccaacaggtctctttctttagataccatttctttttttatattttaaagttttaacttgtctagtggttgccttcatattgataaatacatttgctatactgacgtttcattatttatcaactttataatttaaacactgacttcctgtgaggataaattattgtttcactcaattcctcctctaatccccttacccttcacaaagttgcatcactgttttcagttcacagcttttgtatttcaaaatgttatctttgaaggatgatttatcttattatatcttatcacctaaaaccaattcttgccaatttattccaaaaaatgaggtgttttttttttttgaaggacagatacccataaaaatcaaagaaggtggctttgaagtcaggtttcagaaaagccagcagtaagagttgtcctgaaaatttcaggagcaagaattaatgcattgtctctttagggcattgcacagtgtaaagtaatggggatttaactttttatttctgagaaagatagagtctgattggcttacattgggccacatgctcacccatcaactaaggaaggtagggcaggttgacaatctcatgaagacttcatgtgttggggatggtaagtgacccaaataaaaactggagtgctgttactcaaagatgaaaataaggttgctgggtactcagctcctccctttgtgagacattatacattacatgatcaccacttccttccctttgcttttcctttcctatgtctctcacttaaatctatggtcttacactaagaagattcattatatttatatctttttttgtgcatactttgtgtttttgctgatttcaaaaattaaaaaatcattacacagggctgggtgtggtggctcatgcctgtaatcccagcactttgggaagctgaggcaggtggatcacttgaggtcaggagtttgagaccaacctggccaacatggctaaacactatctctactaaaaatatgaaaattagccaggcatggtggcaggtgcctgtaatcccagctactctggaagctgaggcaggagaatcgcttgaacctgggaggcggaggttgcagtgagccgagattgtgccattgcactccagtctgggcaacagagtgagactctgtatcaagaaaaaaaaaaagaaggagaagagataaaaattattgcacagtttttacagtactatctttttggagagaagaaaattgtgctatgattacattcattttcttatatctttttatttttcctggaatttctaattgccttcattttgtattctctgcctttatcctatgcttatgctcctaagaagtctcaagcacactgcctgttaaggaagctcttttctcccccagagccctcctcttggaaagctccatttatcactcccctcatttagactgactgtcttctgggactgatcataagttgtcattttccttcccttcctttctcccccaagttgggcacatcattccctaaatctcatgatttcatctttcttgactcatgtgtcttctcaagtaactccccagtgaagaatgaataagaagtaagcttttcaagtatcgcatgtctaaatatgtctattctgcctgcattgtttaatgatattttgtctgggatagacttcaaagcaaagataatttttcttcagttttataggtttgctccattttctttaagcactcagtgctgctgttcagaattcagatgtcagtctttttctttcttgttcctctatagagaaatttttttgttgttgttgttctgaagctttttagtatggtttcaccttggaaaatttatttgcattacttctttttctcccttttctgttttccctttttggaactcctattagtcagatgttggatcttctgcatcgatcctttatgacacttatttttttctctcagatttttgtctctcatctcaacattttggaagtttccttcaactttatctgtctacccctcccttgaaactgacatagcaggagcaccatcatctcagacaaacaccaccactttaagtgccagctccctttctggactcatgtatttcaaggaaatcacttctgttctaattacaagcagccagaaagagcagacagtaaaacacagataagacagctcgggcacagagggaggtcgggggaaagtctcttgggtaactgccaaacttcaccctcatacagtaaaacagtgggccttaataagcacattcatttcccttcaggtgcactaagttagggaagctaaaagcagactggggggatatgcctgcagctacagaaagatgtatggggatagatacataactcaccctcccggataagtacaacaaagagacacagaagcagcccaagcctctgataaactctcccaccctgaatccttacaatctcttagtctttaagagagtgggctctgacctaaaacgcccagaagcccctctcaggtttatttaaaataaacttgtccccgttgactgaaaagccaccctttgtgtttctcccctctttctttaattcttacagaaacttttattttggcaatcatatttctaattcctaaaagctcttatttggtatatagttgctcatttttcccagcataccattctaattttacggatgcaattgtttctgaagtttctttgaagacataattcaatttttaacatattcttgttttttaatatatctgtctcctcttggatcatattttttattttgttctttttcatcagtgttggaagcttttctgaaatgtatgatgatcttgatgttttaaaaaagaaagaggcaatgtaaggctgaaaggagtcttgagaatgtggctggagcttgccacataattggctccacattgcagagagggtgggaagaagaccatggcactggggtcccacagtgtcaaaacatagaggtgtttggtgtccattacccatattggttactcagttgttacatgacaactcatcaatttctttaaagaatagataaataaatgttactggatgaattgtatccctctaaaatttgcagtaagtcttaaaccccagtatctcagaatgtgactgtatttggagatagtctcaagaggtaattaagttaaaataaggtcattagggtaagccctagtgccatttgactggcatccttataacaagaggaaattgggacacatacaggaagaccatgtgaagatacagggaaaagacagtcatctaaaaaccaaggaagaaactgactctgccaatgtcttgatcttggacttatgatctccagaattgtgagaaaataaatgtctattgtttaaatcacccagactgtagtaatttatgatggcagccctagcaaactaatataacaatgcttcttttggaggcatagacggtaaacactggatatgtgatataaacagactggtcctgttttaggactcaactctcactccatccctgtgcccgctctgagcatagtctaggttttctgttctctactctggtggattggtcaatattatttcatctgattttcagaaatttgtttaaatttcaaatctgctgatagctcttctcttggtttctattttgttatgaaattgtagcttttattacaacatcagtgtcctctctggaggaaaaggacagaaatgtgtgtgcttggattgccgtatcaaacctccagtctaggtcattttacttccaccaccttttattaaaagcctactatagaccgggcatggtggctcacacctgtaatcccagcactttgagaggtcgaggcaggcagattgcctgagcacaggagttcaagaccagcccaggcaacatggtgaaactccatctctactaaaatacaaaaaattagctgggcatggtggtgcgtggctgtagtcccggctactcaggaggctgaggcacaagaattacttgaacccaagaggcagaggttgcagtgagctgagattgcaccactgcactccagcctgagtgacagagcgagactctgtctcaaaaaaaaaaaaaaagaaagaaagcctattatatactaggacctgtttagctactagtgatacaagatgaacaccacaaaatacctgcttttaaggaagtcaacaagtgaaggaaatagtgatgttatggcatgtggcagatgtaattgattggctcactcaacataccttttggctttccatcctctgctatagagactagcaaactaaaatatacgttttgtggaacctcttgcagatagggttcaggtatgtggcctgtgttcttctaatgagatgtactagcataagtggaaacagaagtgccacatgaggtggcagccacacacagggtgaatgaattttctgataagaagagtggtagaagtgtcaagttcttctgatatggctgtcgccatgcttatatcttcaggccttcaatgggtaattaatgatgaggatcaacagcagccgccgccatgtctcactgaagcagctagtgtggttgtgctctttcctagctagataacattgaaacctggttccctatccctcccaaacactctttgagccacccaatatcctttaacacatttatttctgcttgaactagccagagtaacttggttgtttgcatataagaaccttgacatggaggcacatactggatatatgggaatggaagcaaagaggctttcccctacctggaatgaaagaaagtatttcacagaatgaatggcaactgagcagagacttactggataaggagaagtttaccgagtgagcaaatgtaggcgatttcaggcaatggtacatcagtgagaaagctcatattcattcatttatgtattcagtactcatcagcacatattatgttctaggtaccgtgctagaccctaggcatacaacagtgagtaagacaattataattcctacccacagaatgtttacatttttccaaattgtgcatgcagattaggctaacctgtaaccttttagatatggagatccctgttcatccgaagtaactgccttttgagaggtgaagaaatacactttcttggctgccttcctacaagtaagtaagggtgagacaatcctaagactactgaaatatttggttatatccaggtaaaaatgattgtccttttctgaataaatagtcctgtctatctgatatagtttggctgtgtccccacccaaatctcatcttgaattgtagctcccattatccccacatatcatgggagggaccctgtgagaggtaattgaatcatgggggacgggttttcctgtgctgttcttacgatagtgaataagtcccatgagatctggttgttttataaagggcagttcctccgcacatgctctcttgcctgcagccatgtaagatgtgcctttcctcctccttcatcttctgccatgattgtgaggcttccccagccatgtggaactgtgagtccattaaacctctttttctttataaattacccagtctcgggtatgtctttattagcagcatgagaccagactaataatacactatcctgcctaatcagtgcccaaagtagtgtgtgttggtgcttcagaaagtcagggctagaggaggataggcattgacaagaggcataaaaacatgccagtgccatggcccacttttccatatcaggtctgatggagagaaaaatccaattgtcgaacctcaaaaccacttcagacatccactatcattatagtctcttggctttgtgtcttagactccaaatggccaagcccagtcatggaatgacaagtcccaaggaacagcatatgatggggttgatgttcctaggcctgaggaaatttgctgtcaacggccttctgtgtgctgataatccttttacctggaaggcttgaagctttggctgggtttttgatttataaatgacttgaaagataatgtcccttcctgattcacagtgagttattgtctataataccatcctcacttttccttggctgtctccctcttgagaattggctcagtcatatgctcattaattaaatccatgggaactgatgggaagccaatggcaatggcaatccaagaaggcaaatttcagattccaatagccagttgcagagtctaattttcaaagatttcattattagaacgttttgtgaaagcaatctataataacaatagttaacatttacagaatgcttcttatgtgccagtagctatgataagtattgacatgcactttcatctttaatcctcacaacctcactctgacattggtattcttattgttgctggattaagatgatgacattggggtggttaagtaaactgttcaaattgagtcagccaagaagtggcagaaccaagattagaacctggggcagtcaaaatctaaggcctgagctctaaaatacttcattctattgtctcccttttagagctggtgttttggttctgataatttatcctccattgccctcctacgcctccttggccctggcatagagtttaaacaaaattaaggtttacttaagccaaagatttgatcataattatgagccgaacttaatcaagttagtttcatgtataggcacagcctaaaatacagcattggaagtttcttctctgatgggtctaactggcatatgaattgcagcattcatggctccaaaacagttgggattttaactcaatagaaaaaacaggggtacattatttaaaatgtcctttctaaggtgccgtcacattgcaagttgttttatgacattcagtgataacccactggtgttactactacgtgtgtgtgtgtatgtgtgtatttatatatttatatttatttctaagatctctacatagaatattacagaaattcagctggaatttgatctttacaaatctggagataaccaaatcatttttcggatttaagtgaagacactctccctgctaaaacagcacttttcttagattcatttctagaattgcattggtaatgcatgaaagtagtataaatgtgttgctaacccatctgcagatggtggttctctttttagtaaacatgcaggggctgtaatagcactgtttagaacaaatggggcaggttctctgattaagactgatcgcaacgaatttaaccatttctctacattatgaggagatgggaattgaaagcaatcacttccttttgatatatttccttaatattatttagatttcacccttgagatacaaatgctataagttatttcagccttctgagcacaggcaagttagatggccagcatccagattggataagagaggaaaagtggcttaaatgcaatctcttccattgcaaactcccaaactgtgaaggacaaagtccagtttagaaaatacaaatggcagtttctctccaaagactcttggaggttttctaaatagatcccagaattccaggaatttataagaagaggacctcaagtatcgtccagagcacacaggagagcccgtgctggctctagtgtgaaaaccaatcacacctcagtacaatctccttcaccctcataatgaaaaggaatatgccctgactgccatttctcatttactttattttatcgtgttgttttttccttaaaaaaaagagagagagagaaagagagacagggtttccctatgttgctcaggctggtcttgaacccctgggctcaagcaatctgccagcctcagcctcccaaagtgctgggattacaggtgagagccaccacacccagcctgtgttgtattttcctaacaaaataagtttgttgtagaaaagtagaaaatagtccactgtgaaaagttagacaaaaagatacataaaacaaagaaaaaagaggaggcaaggagaaaagaagagagagagagaaaaagaaaaaaagagagagagaaagaaggaaggaggaatgaatgaaaggaaggaaggaaaaagaaggaagaaaggaaggaaggaaggaaggaaggaaaaggaaggaaggaaaaagaaggaaggaagggagggagggagggagggaggaaaagacccagtgattctaccacccagaggtaacctctatggattttgggtacatatcttttcagtgtttttcagtagatccatgtagtattttttctgagaggaatcctactctgaatagggtataagaatatgatgctgggtgctatggtgcatacctgtaatcccagcactttgggaggttgaggcaaacacttgaggccaggagttcaaggccagcctgggcaatatagcaagacctcatctctacaattttttttttttttaattaaccaggtgtggttgtgcaactatagtcccagctacttgggaggctgaggctggaagatcgcttgagccctaaaatttgaggctgcagtgagctatgatcacgccactgctttccagcctagacaacagagaaagaccctgtttcaaaaaaagagatataagtctaatcacttaggtaatttaatttatcttataagcctgtatttacttgcaggataaaaaagtaatttagttcagagtttcaccaccaccctttcccaaggccccaaaaggtcacatctttgtaaaccaaaaataaaattctaagccccaccacaaccatctgaatggacttcttcttcagtcagggcactcttgaaatttaacccgaaagactggttccagccatgatgggaagtcggggtcggacgtgtttcattatacctctccagcattaacatcaacgcagactctaagttggctgagaaacattgtacaacctattctctctgaagcctactacctgaaggcttcctctgcacataagaacttttgtctccacaatcctttatcttaacccagacacttcctttctattgatcccaggtctttagataaatacaaccaattgtcaaccagaaaatttttaaatatacctgtagcctggaagccccactgcttccagttgttgagccttgctgaacagaaccaatgtatttctttttttttttttttttgagatggagtctcactccgtcacccaggtgggagtgcagtggcataatctcggctcactgcaacctccacctcctgcgattctcatgccacagcctcctaagtagctgaaattacaggtgcctgccaccatgcccagctaatttttctgtatttttatcagagatggggtttcaccatgttggccaggctggtttcgaattccaggcctcaagtgatctgcccgcctcagcctcctaaagtgctgggattacaggcatgagccactgctcctggcccaatgtatttcttaaatgtatttgattgaagtctcatgtttccataaaatatataaaaccaagctacagcctgacccccttgggcacatgttcacaggccctgttcactcatatttggctcagaatagatctcttcagatattttacagagtttgactcttttggtcaacgtcttcattcctgggtccagatgcaatgtcaaggcatccaggacctgatgctgggtcctcacctcccatgtggtcatctccttgtctctccgatcctccacctggctggtgctcagaacacacagcactgttgagacctgccttgttctaactgctggtccctccagggccccctctctttcagctgtgtctgtatctctcttgagtcctcctcagctgcaagaaactcagtgagcttgtccgaggccctgctgattgcatagcactctcagatacataggtccatctgccacaaccaggccacactagggcccaggacatgctccctgattactgaaagcccttccggcacacaggcagctcatctctgggtcatttcttcttcccggtcttaccaagaaaatgcagccttcccttctacaaatgtccatgtatttgagaaaagaaaaacgctcagagcaatttgagctctgtgaggtatgccggcctggatagacataagtatgagacatcaatcatcctcccccggcgtcccccacttcaatcatcctcccccagcatcccccttcacttggcagacaattgtttaaaattcatgttcttggaagttgtggcacaaagaacagcatatcataaataacctaaccaatagctatgttattttcatgtaaattcttggtaaacaaatcaggaactgcctcttcctttcctttaaaaacccacttgtaactgtggctatttattcagagtatttattcagggcatcttgaatctatgctcctgggttgcaatcctcaagcttgacctaaataaactctctatttatattaattttgtctcagcttcttccttttaggtcagcatattcataagctctccaattattttacccctccacccagtatctgaaggcatgagaatctgcttgagcccgggaggcatctgaagaacatttataagaatcttttctctttctcataggatcttccaaatctattgttcatgctctgaatttttgttgtaattgttgttgttcttcccaagggctcaacttttaaaagccagggcttggcacagtggctcattcctgtaatcccaacactttaggaggctgaggctgaggctgaggtgggaggattacttgaagtcaggagtttgaggttacagtgagctatgatcatgccgctgcactccagcctgggtgacagagtgaggccctctcaaaaaacaaaacaaaaatgtcttcttgctgttcaatttaattgctcagactgaaacggtctttgcaaaaattataaccatgagaaaagtatgacaataaaaggcatctgatttaagcaacccttatcttgcctttagcctcccaattgcccttaatcattcctggtcttgggccaaactaactttgagagacatttagtttacagtgtaaatgataatagcccttccccagtactaaaccacctttgtaaagttagtgaaagaccacaaagttaggaggatgagaggaacctgaattctgctaaggtgtaaatgattaccagccgttaattccagaggtcacaagttttgcaacttccccaattactcctgcagataacatcactcttgtagaatctaagtttggccttttgagatgtcttctcaggtttttgcatttctgatgactgatggctccacctggacctgccaactgctcctgtggcccccacccagggtccagacttagcacccacaaggaccattctccacacccctatgattgcatccccagccaatcagcagcacccattccctggcctgccaaactattcttgaaaaaccctagcctctgaatttttggggacactgatttgagtaataaaactccagtctcctgttcagttgtctctgcatgaattaaactctctattgcaattcccctgtcttgataaattagctctatttgggcagtgggtgaaatgaacctgtttgggtgattgcaaggcaaaaactcaaaatggcctcattcgaagagtggaagggccataggaggaaatgaaaaagcaggaaagcaaaagaacaccagctacaattttagaatggagtccctcgagttgtgcttacaggactgtagctcctgtattactcctagggagttaactggcaccaaggtggcaacaggcacatatctggaggaggtgaaaagtagaatgacatttgctctaatcaaacataaaggaggaaagagctttctaagagaggctatggtgtcccttaggtgttgcttgtacctaagtcctgctgttgaagcctttgcttatgtagatgcaaacacacaggcacttccctggatctagactttgccctctaaagcccagaacaaaggtgtccatccatgaagaaccaagttttcttatctctcaccctcactgtggggatggagtggaggcgaaggaaaggggggagaaaaggaaagcccttgagcgcaataatctagagagaaatgtactttctaccagcaatgtaagtatgatttatgtgactcctcccagctaggctccttttatttcctcgagttggaaatgcagaccagaggtttgtacttattttctgtcccagaaggcaactgtcttggtagaggaaggtttgatattggtccaggatctgaggtagagatcacagccttgagacaatgccaaggcagccaattaagaaggtgttgacaacactttccaggaacaattttctagatgcttaactttgaccgaaggtttaagcttctaataatccccaggaaacacacattttccagggaatagtgcctggactcttaagaacttccaagaaacttgggttctcagaagactgcagccaccaagcacacacacccattcaagagctttatggaaaaaacaaaggtgatataaactagatttcctcacatgcccggggagagttggacaagtaaagtcacaaaagaagtgatttaggccactacattgtccttgggaaactagaacttaccctaccctcccttcctttaaccactggccataacaaggctggaaagccacagtctgtcagcccaaattgttcaggttagtgctggtcaggccttgcttctttcatctgggatttttctcggcatccttgctcagctgaatatcactcaaaattatcacatactgctactaaaagctgaagcatatatgcccatcaacccagcgacctcactggaagtcctgcaaggtaggcatccatctccatcttacagatgagaaaactaagactcagagaaactaagggatttgcccaaagttcagtgcaagtacaaattagagcctggttgttctgattcacacttgagaatttccaagactaggtaagagcaacagaagaccttggccagggtgctggggagggtcctgctgctcccagcattaatccttcagtgactacatcctggggaggcctggaactggctggagtgggaggaacagaaaggaggcatgtggaggtcttgggacagcagccttttatcaactctcccagaagtgtttctgtaattttacaatcagtgctgccaacgtggtgcccaatggctgaatatcagcccagtcataattacattaatcaagaaatagaatagtgggataaagatgggaggaatgaactccatttgggtgggaagtggaagcattaacaacagggtccaccagaccatcagaaccacagaggggaagggaagggcatttcagggagaaagaagagcacaaaaaggctggtggcaataaatgaaaacagggcctacaacctgttttctgtggtcaactaaggaggtgaagttaggggttcagagggtggggaggtcaaacatttatgacagatgagactggagggacgtagagacctggtacatgatgtcttgactgggaattctgataaaaccattttttgtttgtcttagacatgtagacattcttgggttatttcttcactctaaagcataaattattgaatctttgaataaaaattttaaccaagtattatgtataatgaacatcttcatcccacagagacctccattgtgtcctcagtgcctcacatgcccactgaggcacagggtcccactggccacttcctatcgggcttgtcttacaactgcatttcacctcccaacaatcttgctggaactggatttctttgcaaaacaccagactgcttagatgagtgcctgacttttgcctacatagtcccaggcctcttccctggggctggatacttgctactcccctttctcaaccaggggctgcagatttgctgtgaatgaaagtatcattcagaatcacaccatgaattcccaactgcctttaacaccactttcacctggattcccactggttccattgatctgctgatttggattcccttatattaccaaggcctgcaggtaggacacctgaggtcaacatgggtgctctaaaatgtgcttcctgctattcccctcagaggtcgggtgccataaccacgtgaatttcttcaactctccgttcctgtcttgcagaatcccaaatatccgaagtgccctgctctttcctgctcacccttgttaatggagagccatcatgcattgtgcaagagtcccatgatgtgataacaacaaagaaaagcaacttaagttgtgcttatctctacaagatgtccaactctcagtgcaaatatttagacaggtttggtcttcgtgaatttgatcgctcttgaaagagaggatgtacaacgctctagacagccaaatggagacacaagctcagtgcaggcaggggtctgctgagggggtctgttaaacccctgtatcatccgttctcacactgctataaagatattacctgagaccaggtaatttataaaccacagcggtttaattgactcatagttctgcatggctggggaggcatcaggaaacttgcgatcatggcagaaggaaaaggagaagcaggtaccttcttcataaggtggcaggagagagacagaaagagagagagagaacaagaaaatgcaacactttaaaaccatcagctcttcagagaacccactcactatcatgaggacagcatcggggaaactgccccatgatccaaccacctcccctgacacgtggggactacaactggatatcagatttgggtggagacacagaaccaaaccacatcagtccctatctgttttaacagattttgtttttcctgctcattttaaaccctggtgacctaggtttatcaactcaagagtagaaataaggcatagtagaaaaaggtcttgagggttgtgaggactgaattctagtcttgaccatatggaccttaagcaagctgggttactcagcctcaaataccttctccttctataactttagtttccttagccttaagaggggactgggggcttgaccccttactaagatggtgattctcattcttctagtgcttgcagcacactttcaaataaaagaatgtggatagcactattgaaaactttaaaagactgaaaacaatacaaaaatgtcagcagtcactaagtacaatgctgactgtaatacaacagtgtctcccagttaccataaaattatccacagttatggctcaatagctgaccagcttcactacttcatgggttctttgaatggaatggtttacagccctgaccatactctcttatataccccagagtcagaggtttcccacattctggaagctctgcaatccttcattagccttggcttgacaacacacccatatcccttagagcacatttgttccaagtcacgcaatccacacatctcattgttgtatcagacacatgagccgaaatattgaggactcagatgaacccagactggttttatatattaacaaaaattgggctaaatattgaagatgactgctccaagggcatgccagctaaaaagttttatagttctatgaattaaaacaataaaacattttgagaaaagaaaatctagttgaggtagagtatttaattaaggcattgagtctatgtcagttaaagaaggaaatccttgttgataagacagagagctctgagggcttaaaggggccccagtgaacctacagagtttgaagggcattgtcagaaaaatgaatggaataaatcacacagaatatgggtagtaatgagacagaagttcagcttctctctgtttctaacaggtatatattttttagaaagtagcatttaaagttttttttttttttgtagtaggaagcaattatttttatgttcttagagattattattttgggggtactaaactattggctccattgtattcctataaattatttttcatttcctctaatgctctttccaaacatctgttagtttattgttctgggcacagaaaattatgatcagtttagtagttgcataatacagattcagattcgtttgtcaaggactggaaaagatcacagcacttcagagccaggcagcaaatggatcaaaggaaatccttatttcgtatactatagggtgagatttatctttaaatatcaaaaaatggacatttggagtttatattattatcataaaaatactgttctgcttctgagaaaacaagctacccagctaacaacctgcacttgtgccaagaaatgaggtgggtgtgagtaacgaggatggtgatttttcttttcctctctagtgagcctcattcaatgggtcaatgagtttactttagtgtcttctctatgccagacatgtgctcgatgctggggacgcagagatgagtgaaaacagacaaggtccctgcccgcatctagaccagctgggaagacaggcaactgtgtaagcaattgccttaaattgtagtgagtgttacaaccaagagcgtagacacacagtggaaggcccataaagggagatttaacctggcccagacatccagaacacctcagtgaacgaacacctgggggacaagcagaagttaacgagtgaagtctgggccatggaagagtgggtcacaaagaaatgagataagggagggcatggttcccaacaggaagtgagtggcagttcagtctgggtgaaagacagaatataagatgatattgtgaagatgctagtactgagagggatgcagtaggcaggtcacacagggccctggaagccacattagtttatctaggaacaatgggaaatcgttgggaaactttagagaggacgctagcatgagtggatttgtgtttttgaagaatccctggagaggactggtaaaagtgtatgtgtctgtgtgtgcataatacacagacttttaccagtcctgtccgagatgtacatgctcacatacacactaggcaatcagagaatctatctacaaagccattttccctttccattatccatccacaaacttgatggctttcagttgaggaattgaaatagggttctccacttgaataagatgagtgagtaggggttccttgccaatagtaggggcttgatttccatttcacagatgttgagagacagttgtttcttcagtagcagtatattttttacgacactgtgcccatggcaggtgtttggccaaaactacctccagtgcactgcccggcatctgtcctcctcctgagaatccctctggaggcaccttgctcctttctttctaatcttccttttcttcctctccagatctggagactttcatcagccctaggcgaggggcaatatggacaacattggtgtttgggctccaagctactttttatgcccaacttctcttccttctgatttctttccattttatagcattctcatctctccagttacaccaactggccccacatctctaaatattatcagaagtctttaaaaaatgacccagagcatttttttcagcttctcctagttgtctatctcctctcttcttctgacccctgttagggttgcgtgaaaactagcattacaatatttctgttccatctatacctgattaccataaagtgcaatgactatgcacatcactgtgttggattaatctgggctaagttttattggtcactatgtcatattcatgtggttactgatgtaacctggctgtttttatacactgtgatcaaaatctagggcagtgatcataatcaaggcataaagtagggaccagtctgcctcgtatctcaaaaactgtgcagtattaagatgactgttgggcttctattaaaggtagctgttggccgggtgtggtgcctcatggctgtaatctcagcactttgggaggccaaggcagatggatcacctgaggttgggagattgagaccaccctgaccaacatggaaaaactctatctctactaaaaatacaaaattagccaggcatggtggcgcatggctgtaatcccagctactcaggaggctgaggcaggagaattgcttgaacccgggaggtggagattgcggtgagccaagattgcactgttggtggcttcctggaagacatcatgttgaatgaatgaagtcatgagtaaataaacggaatgtggagctgcactgccagaattaaccccctgaacaaaagtaaagagcatcccaagttcaatgaggagtaccctgggtaaacaaggaactcctgagagatgaaaaaatccaagtgcctgcgctctacactgggactttggttaacagggcaaggaagagagcttttggagataatacttgatgatgctatacagtgtccccttagtctctgagattcttatcccaagtaacccaaagaagggagataaaaaggaaagagcagtctcccatttggaagtcaaaaaggcattataatctcttaggagtacaccctctcctaaattccagggccttggcagggaaaacactgatattcatggcagccaaagaaaatgaccatatcaactgaaccaagaggacacagcagcagcagagatcaagagggacagtggcagttggactgtagcagtagttacagaggaagggagtaagccacacaagcaattctggaataaagggaaatggcttgagggccttgcaattgcaatgatctcctggggttgaagcttaagttcattcacattgtgactgtcaccaaggctttaggtcattcatttagttttagtacctcatttacataccatctgtgtgtcaggcacagtggctgtgttggcctaggccaggggtcagtgaaccttttttgtatagctccagagagtaaatattttaagtttcatgggccatatggttcctatcacaactacctaactttgctgttgtagtgcagacacaaccacagacaatgaataaacaagaatttgcttattggatgtgttccaataaaatttttcttatagaaacaggtggtgggccacatttggcccatgagtctgctgaggctcagaaaatgatccccagtgtgaaggcctcagaaacagcctcagaagtaaagtctcttttggaccttctcctgccctcctgtctctcgcctctcattctccctgaggctagccatagaaataagaattcctcttccccaaggcaggtcacagaaaccagaaccccttctccaaagccagccgcaaaacctaacaatattactctaactttctccctccctttttgtgtgggagttggccatgaagaaactctctgacctgggccggtgcggtggctcactcctgtaatcccagcactttgggaggccaaggcaggtggatcacgaggtcaggagatcgagaccatcctggccaacatagtgaaaccccatctctactaaaaaaatacaaaaattagccaggcatggtggtgcatgcctataatcccagctactcgggaggcggaggcaggagaatcccttgaaccagggagttggaggttgcagtgagccaagatcgcaccacagcactctagcctggcgacagagcaagactctgtctcaaaagaaaagaacttctctgacctgccttgtctgattgtaggtcataagcctcccattccagaaagcgtcctgtcccatatccagaaagcgtcctgtcccatatccagaaagaagcaatgctgcacagagaggccaggaagaacctgaaaagacaggccttgctgggtctccccactcagtctattcccattagctcttaccctttttatccagttgcaggcctacacagctgtccattcttcatcaaaccccagcataaaaatggacagttttccccatgtatttttgtcttcactctgaaggatcccatgtcacataaaactatgtttaaagaaatttgttatgagtttctcttgttaacctatcttttgttaaaggagtgttggctgtggcccttatgatggggaggagagggatcactccctttccacctttacaggcaagagtttgccaacccctgatttacaggaacaaagtgtgctagttattttgttgcctttcagatcaaatccacagactccttctaccctgccctttattccaagaggctgccctctgcagactatgatacccaggctccttgccttctggctcctggttaggcttgggtaatcagaagcatgagaaatgaatcagaagttgggaggagagaggggtggagaaatgttgtcactctacaccctcccttctgggctgggctgtggcagtggctgtgctcgtctatatctggtcacagctctgcctggtggcccatacccatggctacacctctcactccgttcccacaacagctccttcatcattcaccttcagccctagggggttggaactagtgtccccctgttcccagccctacatgcttctctatcctttgtctgtttcccttcgtaaaactctcttcaattgctcctttgagtgtgccatctattccctgccggacagtgtttgaatacgccctcgtggtggacattcactgtttttagatgtaacggtattgttccaacctcagatccaggacgggatatgtaatctagacatggccaattagggcactgaatcactcaagccacagtagttggttctggaatgttcacatgaaccaagttgtttctttttcttttctttgtcttgctctgtcacccaggctggagggcagtggcatcatctcagctcactgctgcaacctatgcttcatgggctcaagcgattcttgtgcccgcctcagagtagctgggattacaggtgtgcactaccatgcctggctaatttctgtattcaggtttttccgttggaggaaatactaatacttacatagaagccaccaagaagtgccatctattccactgaatttgaacctagaagagtaaatttgaagcttccagaagctactatgtgaagcctgaggacaaggcccaacatgaaagaaggcaaagtccagaggtggccttgtatgagtccttggaactggctgaagctagctctgctcatcaatgatttgtcaatgagacagtaaaattccttatttttttcctcaagaaattctgtcacttgtattcaaaagcaaaacttatttcttaaaaaaacaaaacccttaactactttataccaatgtattacattctctggattatctaagcaaggggccagtccgatgtcatctttggattagatacacactaaggcagtgtagttaaaccccactgaatttcagcagggatagaagccagagttggtttgccatcaacccacttccaaaaggaaatggcaggagtccagcagcatcatgtagttacaatctcccatgccaggaagaaacatctcccaagctcaaattctacccactttgacacttgaaaagtaaaacatcttcatacgaatgaatggggagatgggtgtgattgctggcagtgcaacaatgagttgaagcttgattgtttattaactgttgtaaacaaattatgaatttgtgccagtagccaaaatagagacaactgggcataataaatattaattctcaaggagatcatctaacaaactacctaaaagatcctttgtggactccaagggtgttaattatatgagactttattctctattcattaattcattcaagattttgttgagtgaatgtcagcctgctacagtacagggctggcaaattgtttccatctctagtgctaattgtggttatagctgctcagtgggctgtattgaaaaagactgagtccaaatctgggcttcatgagaaagagtatcatgaagatactcttcatgatactctacattagaggtgtcttctgtgaaagtggaacaaaggagtgtctgaggtatttgtcattcctgcaagttggaaaaggccttatctggcatgagaaggagtagatttggggtaaatcgtttccatcttatgtgtctttatttccttaaattggtaaatcgaggaagttcatctaataatttttaaggttcttccttcctactcttatttatttatccattattttatctgtccttgcatttgaggtgatttctcaccttgtgaatgcattcctccctagcataaaaaccaaaatctcattttcctagcctcctatgtagtaagaatacagcaatgggatctaggtccatcagtcagatacatctgtcctacatttgtttagaatattatgtaggagatgagactatttcaccccaaaatatggctgtaggtggccagaatgtgtaccccaaatatgcctctttaaaataaggatcactttgagctgattatttggggagacagtagacacaggagaagctctgaaaacagagtagaagttaagcttttgtaagagaaatttgcatctataaaggaaatctccatcgtaagggtgtctcatctctgtagaagaaaaagaatgagtctaagttactaaaaactcttatcaatagagaaggcaacttaaacacaagtaaggttttttttttgtatagttacccttgtttaaggtgcttttcctccctctaactgggtaggaactttctttgtttcagagaatagtatttaagcttgaagtcaaagctatgatacttctgagatttattcaaaagctttgagatatttcctgtattatttcatttatgttgctataaaggaatacctgaggctgggtaattcataaagaaaagaggtttgtttggctcacagttctgcaggctgcacaagaagcatggcaccagcacttgcttctggtgagggtctcaggctgcttcaactcatggtggaaggggaagggaagctggcacgtgcagaaatcacatggtgagggaggaagcaatgggggtgggggaggtaccaggctctttttaacaaccagttctcgagggaactaatgagcaagaactcacttattatgacaaagatggcaccaagccattcatgagggatctaccccatgactcaaacacctcccattaatccctacctccaacattgggatcaaatttcaacatgaggtttggaggcaatacacattcaaactatagcattccccctgaaggatcccagggaatttcacaccacagtatggcattctgatatgctgattgtaaaaaattaaagtaaaatgctgggagatacttcacactgatattgacttatttaccttaagaccagccctgccaaatagaatacaatcaccttccattacccttccctgaatttgattatctatcataggtagaagactgaagaatctacatctggatgaacttcttcacaagataatatctaattttgaagacaatcatttacaagctaatttctgtcccttggttcattcattttccctaagaaacattttactactcctcaaaagaaattcctaccattttccatccctcctctcccccttatgaagaagggtgtgtaatcatctggacctcattaggtatttgggtaatcactctcctgtgattttcccttgtgcattttaaaattaaatttgtattcttttgctcctactaatctccttcttatcagttcactttcagtgaaccttcggagggcgaaggggaagctttccttctttgaccctacacctgaatatctcccatgtgtacatacatgaggtatacatgttattaaactttgtttttctctcattttgttacagcagtccattccaaccaagagctcagaaaggggagagaaaaaattaattttttcctccttacactagtgatggtgcacagagtccatctggcaaggataaaggcagagacattctgttcattaaagcagcagtgatagggccagctctggtggctgtcccaagcagggggcaatgatgacttcactgagcagctctgcagcacaggttggggcactgttcctgtctgctagcctctaatcttttgtctctgggcctcccttggagcccttcagctgtttaattctttttgaaataaactcattttactgctgaaatgagtcagagtggatttctttgtcttcaaggaactcaaaaacatgatcgggactacgatcataagatcgtatgtgccttcaaatagaatttattctcctttaaagatgaaaaaattaattatgttttataaattatgaagaggatgcttagctaatggttttcaaaatgtattttatcataattatcagcaggatagttgttgcaaatggataaatatgtgttatagagaggttattctcacttgtatcgtcttcattattctaagtgcactagagaaaatgtaattccttcaatgtttttgtttcatagctttacattgagagaagaaaccctcttcttaatcgttgctagtgtgattttcaagagtttgcaggagtattttggtaggattttatagttttagtaattcctttaattttctaatgaagattagagctaagtatctcataaggataaatggccacagcaaagaaactcacttgactaattgcccttatggagagtttctttaaaggatgaaagaagttcttgagacttacccccaaattctgtgtacaagaaagatcacatagttttattttctttaataaatcaaaactccccctctacctccagcccaccatgctaaggaaacataggtgtttagtgactcgttgtaggctaatggggcttaaaatggctttacctctttcctattatccatcaacaaccatgctcccacttttcaaatagtcaatagacatattgttgactttttatgcaaaagtggtatttatatgcaaattcaagctccttctttgtaaactgttgttctcaaggtcttccagtgttgaaattttggagcctaaacaattaggtttcttccttctcttgtcctcccagccattcctcccctaggaaccttagacatttctggtgtcttacagcagcacaaagacttactggatacaacttctaattccggccatgagagaaaaatagataccagacttgtcttctcactttaatgtatttttgtgtccaagtgtaatgtcggacacaacatatgaagaagtggtttccaggcattataaaacagacaatagaggaatataattcttgagaggagaaaaacacacaaagagcttcccattcatctccatgaaaattcaatttataagaaaaaaagtaaattaactaggggcacattgcaaataaaggcaaagggaggtggaacccaaagagaataaagtgtttttctgggcaaagtaaagagagatcagagttcagaaatgctgaggctgcttggaattttcaaagtaggatacttgagaggagaaagtcccaaattttgcatatgggtttccttgagtctagctgagtactaagctgcatgtgttcagggttctctgatagagaacaactactagtagagtatgagctgaataaggggttcaagatattccagttttgataaaccagagggtaaagacttcactaaaaatccacagcaattagttgaccattataatgaccaaatgttagaagtagggctattctagccctagagtaagaacaactttagacttacccaataaagcctaaaatcaaaccctgattgccttaaaccatttgggctactataacaattaaacaatttgtgctactataataaaacatctaagcctcgatgatttgtaaagaagagaagtttattattcacaattttggaggctgagaaatacaagatcaaggtactagcaggtcagtatgtggtgagggcccaatcttttcttccaagatggcatcttattggcttacccagagcagaggaaaactgcatccttacatggtagaagaaaggggaaaagagggcagaatggtgactgaagcctcttctataagggcctaatcccattcatgacggaggagtcctcatgacctaatggcatcttaaagaccacatctcttgatgctgtcacactggctattaagtttcaacccataaattttggaggggacacattcaaaccatagcactgacagaccaagtgaagttgaaagtaaattaactgctagtgagaataaaactcagcactaattaaaggaggactgtcaaccaaataacattctaaagattcagcacacaataacaaattactagataaacaaataagcaggcaaatgtgttacatatccaggagaaaaaaacagtcaatacaaacagatccagagttgacagagatgtgagaattaatgagtcaggacttcaaaacagatataataaatgtattcaaggatttgttaaaatattgacattgtatacagaagagaaacctaaacaaggaagtggaaattataaaaaagaacaactataaattcccagagtgaaaaatgcaatatgtgaaataaaaaattctctggatgggctcaatggcagatgtgccattgcagaagaaaagttcagtacacttgcaaaccggttaaaataaattatccaactttgaaaaaggatttaaaaaataaatacagccttagtgacctgtagggccgtatcaagaagtctaacatattagtaattttagttccaaaaggagagaagagaaaaaccgggaaagaaaaatacatttgaagaaataataactaaactttttccaaatgtgatgaaaaataacaacccgcaagcctcaaaaatctgaacaaattccaagtggaataagcacacagaaaactatttctagccatatcatcatccaatttttgagaacaacaatgaaacaaaacaaaaaattcttaaagggataagttatcacaggagaatgataaaaatatgcactaacttctcatcaaaatcaatgcaaaccagagaacaatggaatcacattttaaaggctaaaatggtagggacaccctatcaacctataattctgtattcagcaaaaatacctttccaaggtaaagtagaaataaacatacttccatagaaacacacgttgaaaggattcattacaataggctacactacagaaaatgttaaaagcagatcttcaggttgaaataaaatgataacagaaggttgggctgggcatggtggctcatgcttgtaatcccagcactttgggaggccaaggtgggcagatcacttgaggtcaggagttcgagaccagcttgatcaacatggcaaaatcccgtctctattaaaaatacaaaaattaggcaggcatgtggtgtgcacctgtagtctcaggtacttgaaggctgaggtgggagaatcacttgaacccaggaggcagaggttgcaatgagctgagatcgtgccactgccctccagcctgggtgacaggaggagaccctgtctcaaaaaaaaaaaaaaagaacagaaagttgaatctacatggaagaatgaagaacaccagaaatgctaaacatgcaggcacatatataaaacatattcattgtttttttatttgtttaaaagacaattgaatatgtaatatataaataataatgtattgaggaggtttgtaacatatacaggagtaaaatatctgacaataacagcaaaaaggataggaggacataaaggagtgtatattgcttaaccatactgtgtatgcgtgaggtggtataatattaaattcatagtagactagaataaattaatggtgtatgttgtagttcctcttaaaaagacaaaataaacaggcatagctaaaagttaataaagaagataaagaaaatactaagaaatatttgtttaacccaaattaaggcaaggaaaaaagaacagctgtagaggacaaatgtattgaaaaggacagaaacagcaaaatgatagggttaaaccctatgttatcaataattacattaaggcaaatggactaaacactacaatcaaaaggtagagactgccaagctagataaaagcagggcacaaatatatgttgtttacatgtcctaaacataaggatacatattggttaggtgttaaatttgggggaaaaaatatgccgtgcaaatactcactgtagtaaagctagaatgactatattaatattagacagtagatttcagagcaaagaatactgtcagagataaacaggaatacttcataactgggtcaattaatcagaaatctataataattccaaataaacttacacctaataacagcttcaaaatacacaaagtgaaaatccgacagaactaaagaatgaagtagacaaatccgtaaatatgattagaaattgtaataccttttactcagtactttaaattatacagagtaagttgctgattacccagaattaagttacaaatcagtaacaaaaagatacctgaaaaattcacacatctttagaaagtaagcaacatacttctaaataatccacgggtcaaaaaagaaatcataagaaaaactttaaaatatttcaaaatgaatgctaatgggaaagtacaatatgttaaaacatgtgggctgcagctagagaagtggttagaatgaaatttatagttttaaatgctttattgaaaaagaaaaaatatttaaagtcagtgatctgagcttctattttaaaaatctacaaaaaagaacaaattaaagctaacataaggagaagatatgaaatacagagcagagaacaatgaaacgaaaaaaagcaaataataaaattgatatacctctggcaagactgatcaataataaaaaggaaacacaagttaccaacaccagaaatgaaagtgaaaacatcagttcagttacttcagacagtcaaaatacaaggtaatactataaacaattttgtgccagtaaattggacaacttagctgaaaaaaaaatttcttgaaagataccaacactgatacgaaaataaattaaaaatccatgtagtctcatatccattaaagaagttaagtttatagttgaaacctccccaacaagaaatttctagatttggtttgttccactggtgagtttgtcaaacatttgaggaagaaataaaatttaccttacacaaactcagaaaaaacagaaaaagcaaacactttccaactcattacatgagttggaacatgtaatgaattggaaagtgtttgctttttctcttttttctgagtttgttaaggtattatgttgaggccaacataatactgatacaaaaaccaggtaaggatattacaagaataaaattatagactaatattgttcaggaacatagtaggaacaaaaatccttaacgaaatactagcaaacaaaatctagcattagagaaaataatacattttgactaagtgggtttataccaggaatgcaggattggttaaacaataaaaaactaatcagtataatttaccacattaatgaaataagaaaatgtgatgaacttaataaattcagagaaagtatttggtaaaatttagtacccatctattatagaaattctcagaaaactaagaatggaaaaaataattaatcagtatgataaaggatttttatgaaaaactcagcgttattatgaataagtctgtttgaacgttcatagcaaccttatacatcatgcctctaatctggagactatcctaatgtccaccaacaagagaattaacatacaaactatggtttattcatacaatgaaatagtactcagcaacaaaaaaagataaattaccgatacatgcaacaaaattgatgagtcttaaaacactgtgatgaatacaggatgcaagacaccaaattgcacataccgtatgcctccatttatataaaatcctagaacagataaaacctatgcatgttgatagtaatcaaaacagtgcttttcttgatagtgctgggattgcagaatatggtgtctactgaatgcgtatcacatccacatcatcataaagttgaaaagccctaaatagaaaaatcctaaattggggtcatttaataccttttttttttttttttttgagatggagttttgctcttgttgtccaggctgcagtgcaatggcatgatctcggcccactgcaacatctgcctcctgggttcaagcgattctcctgcctcagtctccccagtagctgggattacaggtgtgcgccaccatgcccagcgaatttttgtatttatagtagagacggggtttcactatgttggtcaggctggtctcgaactcctgacctcaggtgatctgcctgccttggtctcccaaagtgctgggattacaggtgtgagctaccatgcccggcccatttaataaatattgatgtgtactttctaatatatgccaagtactatttctacgtaccagtcatagtaagttctgtaaaaaaatagtgcagaggaagggaagaaacagtgacggtggtgggcaatagagtgtgctattttgtgtaagatatcctttgagctgagcagagacctgcaaaaggtaaaagagtgaggcatgagggtatctagggagaaagctttgaaacagagggaaaagcatgtgcaaagactctgagatgaatgtgctgggcatgtgtgtggcacagcaaaaaggccaatgttgctaaagtggcatgagtaatagggacggtgggaagagatggggtgagtgagaggctgggagaacattttcattctaaatgatctgagaagtcatagagggttttccataaggaatgatggcagctgacattttcatgatatcactctgactgttttactgagaataaataaattactaagggggctcaaggcaatagtaggggcagttattgcaatcttctggacaagagatactgttgacttttgactaaaatagtagtggtggggtgttgaaacatggtcaaactctgatcatatttagaaggcagagtcatcggggtttgctgatggattcaatgtgggacatgagacagaagtcaaggacaactccaacgtttttctttgggaaattgtaaaggttaattttatgtgtcaacttgactgggtcacagtgaacccagacatttggtcaaacattactctgggtgtgtctgtgagagtgtttctggatgagactaacatttgaatcagcagaatgagtaaagcagattgcctttccgatggtgggtggccctcatccgatctgttgacggcctgaatagaacaaaaagtctaatccttcctccaggaagaggaaagtccttctgccagactgagctaggacactgattggatctagccttcagactcggaccgaaacatcagctccccttgggtctcaagcctgctggcgttcagactggaacttacaacactggctggaacttacatcactggctctcttggttcttagactcagactggactacacattaactctcctggtctcctggtctccagcttgccaacaacagatcttgagacttctcagcctccataatcacatgatccaatgtctcataacctctctctctctctctcagttcgtttatctggagaacactgaataatacagcaactaaaataatgcatttgccatttatgaagatagagatcaaggtttctgtttggccatgttaagtttgagatgcctcttagacatgcagatggaaatgttgagtaggcagttcaatatataagtctggggtctagggatgaggtcaaggccgaaactaaaaagtaggagtttttatcatttgataaaatttatatccactagactgaatgagaccacctagagaatgaatacaaagatgagaagtggtgtaaggactgagccctcagatacttcaatatttagagatcaagaagatgaaagaagtctagcaaaggccgctgaaagggagcttgtcagcaggaagactgagggacatcctagaagccaggagaagaagtgtttcgaggaggaacaagtgatcagcagtaccaaatgctactactgacttatggagaaacgagattgggccattaaactggcaacaggcaggttactgctgactttgacaacaacattgtcagtggagtgggttcaggaaacaatgggaggagagagtgaagacaaaaaaaaaatagaaaaatactttacaaagttttgacccaagacaattagaaagatggaacaatagcaagaggaattttggaagtcagggaaaatttttcaaagatagctacagcatatctggatattgatgggaatgatccaatagagaagaaaaattctatgacaatgtagacagaaaagggggagcattgcacgtatgaagtccttgtgtaggtgagagaacatggggttcagggattgaggtattgttcttaggtagagcctggaaagatcaaatatagtagtaggagggaagacagaacttaaggaacagatgcaaataagttagtggatttgatagtgggtgagtatgaaagttcttttcctagtgcttttattttctctgtgaaaatccagattacaccaacctgggttttaattccagctctgacaccttttaacagctgtgtaatatcggtcccatcacctcacttcttcattacaatctggctagatgaatttagaaaatttaactgactccacgatggtagcattgtacactgtgcaatttgcagtacatgtgatttatgatatagaccatggaaactatgccatagtagactatgtgatattgcaagctcaacttaaacttaaaatcataaattttcacaaattttataggtcaagcctcctcaccacatttaaataccttttcataattttctcctccaagttgggtgagtaagtacttcaactgttgtattagtccattctctcactgctatacaaagaaatacctgagacttggtaatttataaagaaaggtttatttggctcatggttctgcaaactgtacaggaaacatggctgggaaggcctcaggaaacttacaatcatggcagaaggcaaaggggaagcaggcacatcttacatggctggcacaggaggaagagagagtgggaggtgctgcacaccgttaaacaaccagatctcacgataagtcactctcaccacaacatcaccatgggggatggtgttaaactatgagaaactaccccatgatccaatcacctctcaccaggctccacctccaacattgggaattacaattagacatgaggtttgggtggggacacagatccaaaccatatcaaccctttaagctcatttcatttccattgaggagttcattttaaagtccccaaaatagctcctttttcctctttttgtgaattacatattagatacttctcccagtaatttgaacagtggaattgggttatgatcctctccttgttccaggcaatagcctctgctgatgatttctgggctgttggctcaacttctttggtgtagccatttgattcttcatacagacatcctggcaataagcatcttcatattttctaaaggaagttgtttgttaacagtgctccccaaatctgggttgatctgttctcagctttgattgctgcactcatgaaatcttctgtaatcatttatttaacctctgcagaattcagatatatttggctgtagcacctgccaagatccggctcattctttagtctttccctgactttaccattgtgagactcctggctgcccttcccatttgtctgcaaggattggcttgccagaactctgtggcctacttcagtgattttcatttttttggtttctctgtaagtttcatgttaacttgttatttggtcagtttcattgcttctttttatttgaagattattattttttaagttgctacttattggaaactttttatctcaagcctattaaatttgatgtagaaatcagattctggcttagtactctggtatatttctcataatcctcctgttctatttccccttctctcaatgaccttctcagctgatgtcatatttgggctggttaccccaagaaatggatggggttggatatgataacactaagcaagcatccctaggccatgctgaattgtagaatgacagaatgttaaagctgggaggatacccaaggttggttagttcaatttctctcccaatgcaagaatttattctacagcatccattattacctcctctgctgaaatccttctaagcagggaaagctaattagttggatagatacatttctcctttttttccagttctaattattaaacttatttttttctttcatcaaattgaactcttcctccctataacttcctcccattggttctatgtctgccctctggagggctagagaataagtggatttaatctcttaataatatgatagtaattgctaccatgtgttgagtatttgtaaggttctgtaccaagtgtcttatgcactgtattagtcatggttcttcagttgcaagcaatagaaaccaacctggccaactgttttagttatcttttgctacataataaattacccctaaaattagtggcttaaaaaaactaacatatactacctcagtttctgtgggtcaggaattcagaagcaacttaatgggtgcttctgcatcagtctttctcaaaaggttgcatccaaaatgtcagccagggctgcagtcatctgaaggctagactgggtttgggggattcacttctaagctgctttacatggctgatgacaagaggcctcagttcctcactagctgttggccaaagccttcagccttgttgccacaaggacctcaatatagagcaactctaacacagagagagagagagaagccacagtgccttttatgacctaatctctgaagttactgaatatctatatctatatctatatctatatctatatctatctatatatatatatacacacacatatatctcacagtaaacacaaggcttctgggtcagagacaaactgtttatttagttacagaatattttagtggcagttactcatgtcccatttcccccactccgggtaacatggtgagagccaggtggatcctgctcatgttaaagagagaatctatattttagaagaggaattatgaaatcatgaatctcaaatcttgtataggagctggaacatctacactttctcctctccaaaaaaagggacagaggacttggaatgtaaactgatatctcttgggggaaaggaggaaggtctctacctacaaatataagcatttgactctggggaagataagaaaggtattattattatttgaatgggagtagatggctccatgagaaaagaaacaagttgtctcagtctgtctcccttagaacgtgaaaagcaaatggctcttgggaaaaggaaaaatattatctatcttcatggcatgtcaatttccattgctcagaatgctctgatcattcagacacatgaaactattcatactgttttccaacagtcactaccattacttcttcatcattgtatgtattaggagcaagtcactaaatttccgtgatgaacacagatacaaaaatcttcaacaaaatactagataacaaaattcaacagcacatcaaaaagatattacatcgtgatcaagtgggtttcatcctggggatgcagggatggtttaacatacagaagtcaaaaagtgtgacacatcacataaacagaattaaaaacaaaaaccatatgatcacctcaatagatgcagaaaaggcatttgacaaaatcaggcattctttatgataaaaactcttaacaaactaggcatagaagagacttacctcaaaataataaaatatatatatgcaaacccacagccaacatcataccaaatggggaaaagttgaaagcattcctcctgagaacagcaacaagacaaggatgcccactttcaccactcctgttcaacatagttctggaagtcctagccaaaacaattaggcaagagaaggaaataaagggcatccgaattggaaaagaggaggtgaaactattgctgtttgcagatgatatgatcatatacctagaaaatcctaaagactccaaaaaaagactcctagatttgataaaggaatttagcaaagtctcaggttacaaaatcagtgtacacaaatcagtagcactgctatacaccaacaatgactaagctgagagtcaaacaaagaactcaatcctggctggacatggtggttcacacctggaaaccaagcatttcaggaggcccaggcatgtggatttattgagcccaggagtttgagaccagcctgggcaacaagggagatcttgtctctacaaaaaagttacctgggtgtggtggtatgcatccatagtcccagtgactccggaggctgaggcagaaggatggcttgagactgggaggtcaaggctgcagtaattgcaccactgcactccagcctgggagacacagtgagactctgtcttaaaaaaaaaaaaaaagaaaaaagaactaaagctcttttacaacagctgcaaaaaaataaactatctaggaatatacccaaccaaggaggtgaaagaactctacaagaagaactataaaactactgaaagaaatcataactgatataaacaaatggaaacacattctatgctcatgaattagaagaatcaatattgtaaaaatgaccatactgcccaaagcaatctacagattcaatgaaattcccatcaaaataccaacatcgtttttcacagaattagaaaaaacaatcatcaaattcgtatggaaccaaaaaagagcccaaatagccaaaccaattctaaggcaaaaagaacaaatctggaggcatcacattaccagacttcaaattctactgcaaggctatagttaccaaaacttttatagttctataaaagtaggcatatagaccaatggaatagaacagagaacccagaaataaagccggatacatatagtcaactgatctccaacaaagcatacaaaaacacaaattggggaatgaatactctatttcataaacggtgttgggaaaacttccaaaccacaagtagcagaatgaaactggctccctatctctcagcttatataaaaatcaactcaagatggatcaaagacttaaatataaggcctacaatcataaaaattctagaaggtgacattggaaaaattcttctagacattggcctaggcaaagattcatgactaagaccccaaaagcaaatgcaacaacaataaaaaaactaaataaatgacacctgatgaaactaaaatgcttctgcatagtaaaataaataatagagttaacagacaacccacagaatgagagaaaatacttgcaaactacgcatttgacaaagactagtatccagaatctacaaggaactcaaacaaatcatcaagaaaaagacaaacaatcctatcaaaaagtgggcaaaggacataaatagacatttctcaaaagaaaatatacaaatggccaagaaatatatgaaaaaattgtcaacgtcactaatcaacagggaaatgcaaattaaaaaacaatgagataccaccttacccttgcaagaatggtcattattaaaaaataaaaaaataatagatattggcatggatctggtgaaaagggaacacttatacactgctggtgggaatgtaaattagtacaacctctatggaaaacagtatggagtctccttaaagagctaaatgtagacctaccattcaatccagcaatcccactactaggtacctactcaaagggaaagaagtcattatatgaaaaagacacttgcacatatatgtttatagcagcacgattcacaattgcaaagatgtggaaccaacctaagtgcccatcaactaatgagtggataaagaaaatgcggtatatacacaccatggaatactacttagcgataaaaaggaatgaaataatgtcttttgcagccacttggatggggctgaaggccattattctaagtgaagtaacacaggagtggaaaaccaaaagccatatattctcacttataagtgggagctaagttattcaaaggcatacagtgatgtaatggactttaaagattcagaaggagaagggttggtgaggggctagggttaaaaaattatacattaggtacaatgtacactactcaagtgatgggtgcactgaaatctcagaattcaccactatataatctatataatttatctatgtaacaaaaaaaaaaaccacttgtacacccaaagctattgaaataaacatttaaaaaaggaagcaagtcactaactccagcccacgttcaaagggaagggattaaggctccaccacttgaagacagaaatatcaaaaaatttgggaacactgtaaaaccaccacatcctgccccaatttcacacacatgcaaaatataggcaccccctctcaagatttccaaaagtctcatcctattatatgtcagcttaatttacagataggtcatttaaatcaagaccaggtgcatatgaggttacttggttgtagctccctaagtacagttctttttttcttttttttagagacagggatctcgctatgttgaccagactggtctcaaactcctggcctcaagtgatcctcccatctcagcctcccaaagtactgagattaaaggtgtgagccaccctgcctggcccttaagtacagctatcgatccaaagatctgtgagctaaagtgaaagttatcttctccacacacccaacacacatggtgaggcaggcataggataactgatattgatacttctgttcagaaaagaataaaacaagaagcacacaggagtcactggttcatagcaattttgaaatccagttgggaaatattagaattagattaaggctcaaattatgggaataattctccataactcttagctctgttttttgagttcttagttctgccttcttagtcgtgcttcctttttcatgaagatattgggactcagaaaacaacatcccaaagtgaaggtgtcagaaacagcctcagaagcaaaagtttttctctaaccttctcatgtcctcctgtttctcagtctcattttcccttaagggtagccatagacatgagaatccctcctctctgaggcaggtcatagaaaccagaactctttttccccaaagccagcgaagaaacctaaaaatattactctgacattccttccacctttctgcataaaaactgaccataaacaaattacctggcctattttgtttgactatagatcataagacccttattccagacagcaccttgccccacatccagaaagaagaaatgaacactcagaaagaccaaggatctacacaggcaggccttgctaggtcttcctactcactctattagcagtagatcatactgttttgtccaatcatatttctaaaaagctgcccatactttgttgaacctaagcataaaaatggacaatttcccatgtatttttgggtgttcattctgagggttcttatgtcatataaaactatgatcaaataaatttgtatgccttttctcctataaatctgcctcttgtcagtgaagcacatttttgcagctgagcagttttgtcagcctgcttcctcctattcatagaagttcgggggtgcaaccttcattttgtattatctctatcccttttggtctaagctggtggtgtttctgtggatataattctcttaaaaacactgttaaccttattggggtttacttcacttggcaaaagccacactcacaaatcatttggagagaaactcttctctgccttgagcttttgctgagttgacgacataacaagacccttaagcttcttggaagtcctattatttgattgacaggatctgtgagacccacccttaaactctttagaagacctttggtctgagtggacagatcttgagatagacctttggtctttctgatatcttagaaaataattctagagtcatacctttggcctcatctttagaccaagctttcctgatagtgccctggatttgtatttttgcttggaagccatttctcaatgttagtattatttgctatattggcagactgagaatttgaaatcatcaagtcccagctcctccatgtttaacattacttttgttaattttttttatcctactatcacattttatataagtagcaaaaagaaaacaggtggcggcctcaatattccctctggaatcctctttacctaggtcatgcagttcattcggtatattttctactttccacaatactgcaggtgacagtattgctaaactttctaccactgcataataaacattccctttgatccagtttcccaataaatttcacttcactttcctttaggccttcaccacagcctcttgaaaggacaataacgcttctacaaacaattgtttcaaggctcttgagacttcctcaaatatttcagagcttctactcactttctggtttcaaagtcactcccagattttagttatttgttatatagcatcccatttctaggtaccaaaatccatatcacttatttttgctatataacaaattaacacttagtggcttaaaacaacgtacatgtattatttcacagtttctgtgagtcaggaattttggagcagcttagcttggcagttctggctccaggtttcatatgaagttgcagtcaagatgttggccaagacatgtacagaaaatagctatgggatcagaaccccagcctcccagatggaatccaggggaaaggccagttacacagtctggacctcacagtgagggatgaatgggaaatcctcccctccaaaatgacaaggagcccataggccaagaattctgattagaattaggagctgggggccgggcgcggtggctcacgcctgtaatcccagcactttgggaggccgaggcgggcggatcacgaggtcaggagatcgagaccatcctggctaacacggtgaaaccccgtctctactaaaaatacaaaaaagtagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaagaattaggagctgggtcaggctctggccggcatagggaatgcctgggactaagtctgtgagtggcagaactttggtgcccaaagccaggcagggataggctcacattaggagctgctgcatgacagccctctcagcatttggggttagttaccacataacataatattcaaattctttatccttcagtggcctttctccagccacgctctacttcatcaaagtccttctgattctgtggtagttaatgcctcaggcatagtctgtccagtgcagagaacagaggggccattaaacgcatccagaaactacgcccaaggggcttatttctgggatgaatcaaacaaaaggagattgtcatgacaagaacttgggtaaggattgagaaatgtctctagattcataggaacacgtccagtttaagttcaccattcattagaaccttttacagtcctagcccatcaaattagctcttgaggtacagacatgaacacccacatatatttcttcccaattgagaagcacccattcttgattctcaactccttcagccagcttctccacatcaacttcttatgtacacttgggatttatccactcctctccctctccttccatgtccaagccatcatcatcatcattgttcacctgaaagaccacagtaagctaacacatctctttcttacattcctgtgttcctccaattctgttctccccacagcatccaaagtagtctttccaaaagttgaatcagacgtttgtacacaatataaataaaagatcactcctctgcttaaatgtcttcaatcactatttaatccactttaattttgttgttgttgtttgattgtttgtttttgaggcagggtctcactctgtcacccaggctggagtgcagtggtgcaatctcggctcactgcaacctctgcctcctgggttcaagcagttcttccatttcagcctcccaagaagctgggtccacaggtgcctgctatcacacctggctaatttttttgtatttttggtagagacgcagttttgccatgttgcccaggctggcatttaattcattttgaattaaattcagacttataaccagggcccccaaagtcctgtgggagctaatgctcacttcagctaccttgtcttttcccgtgccctcttcactcactgtgccacagccacaccagcctccaggacctggaggtctcaggcattacaagtctttcacacctcaggacctttgaatgtgtcagctcccagctggaaggccttcgtcattctgatcacaccccaacacacatgtgtactctgttctttgcttgattatgtctatttcatcctctagaccttcatcaatcgtcctatctgtactattttcttactctccaatgaaggcatactttgtttccatcagataatgcatcacaagttgtaattatatgttatttacttgcttatatgctatttttctccaccaaactaaaagcttcttggggtagagactgctttgttgcccattgtgtacttaagacttagtgcaatgcttggccaataataccaggctcttgacagatacttgttaaataaatatttctttaagttatcattcacataaattacaaaaagaagttattaattaggatacacaatacatttccagatttttataaggattaactttattgttgtgaggaataaatgagatatgtgaaaacttaacagtttaccatctgccccttatccctccattactccctccctctttccatccctccatccctctatcctttcctccctccttccatccctccctcccttcatccttccactccttcctccctctttccatccctccatccctctatcctttcttccctccttctatcctccctcccttcatccctccactcctccctttctctttctatccctctatccccctatctttcctcactccttccttccctcccttcatccctccactcctccctttctctttctatccctctatccccctatcctttcctccctccttccttccctccctcccttcatccctccctccatctctccatccctctctccctcccttcatccctccctccatccctccctccctctttccatcccttcatctctccatccctccctccctctatactccctccctccatccctccctccctccatccctcccgccatcctttcttccctcactccatcccttcatacccccttccctccatccctccctccctcttcccatccctccatccatcccttcctccctccctccctctttccatccgtccatccatcccttcctccctttatccctccctccatctctccattcctccctccctccctccatccttttctccctctctccatccctccctccttcttgtactaagaaaaacatggaactctcttgactttgattttcttttctgcctaccttctctctccatgaagtttgactacaatgagatttttaactccctaaagaatctctccttcaaaggacatggattatagaggaaagagcattttcttaatgctctgttaaaaccacctataaagaaatcgctctataaaatgttgacgtctcctaagacctcacaagcaatttttagataaagtcatcacccagaattttgaattcactctcaaggatcaaagcatagaaccacacctgaagtaaatttagaaataacaaccaccacaactagtactcagtgaggttttccttgtgccgaggctatctcatctcttttaatctacccagcagcctggggagaaatgtactgtgattaccccatctcccggtgagaacctagagcttaagaagcaggactcgactgcaggactgtctgattctggaaccctctgacactttcctgcacggattcccagcatttatgcctctgtctctctgttttgtacttcaatctggctcaagtctaggcctctccctctcttgtcacagctctttaggattccttgtggcagccagcctggatgagtgtgcctagtttttctgtgaattctctctacttcataactgctgatctcgtcttcccaccttctttctttcaagttattctacattccacatagattaatgttgctgaatttacatgtttttgtatatcacctcaactcaaaaagttgtactaatccccctgtttaagatgtcagatccagttctgccttttattagctgtgtctttgagcaatgtaatgaatttttctgagtctcagttttcttatttctaaaatgaaaatgcacatctgtaatcccagcattttgagaggccgagacatgcagatcgcttgagctcaggagttcgagaccagcctgggcaacatggtgaaacgctcatctttacaaaacatacaaaaattagccgggcattgtggcacacacctgtggtcccagctactcagagggctgaggtgggaggatcacttgagcctgggaagacaagcctacagtgagctgcaattgggccacactgcactccagcctgggtgacaaaatgggactctgtctcaaaaactaaataaatacaattaatatgatgatatccactccatgaagtcattaagaagattagacaaggttgtcattctggacaggtgaggctgtgctgctgtgataaacaagccctaaaactccgttgttttgttgtaactcctgctacatgtgcctctcaagctcctcatctttacttcggggctcagactgacagagcagcctttatctgaaatgtgggcagatgtgggccagtgaatatgaatgctacaatctcctacagaaaatgcagagcaaacacccgcacagtgtctgacgcctggtacgtgctgaaggaacgttctctccttggagctcatcctcaagtgggaagtctactacaccaacgtctaaacctttatgggaagcctgttcctgcaagatgtgtgaagttcagacaccaaccattacaatcttctttcagcgggcttacactgttgaatgattaaattgttctttatgtctcctggcttcaaaaactgtgtgggttactacatctgtttcctggggcagccataccaaataaccccaaactcaggggcttaaaacaatggcaattgataaactcacagttctggaggccagaatcgaaaacgcaggtgttggcagggccacactccctccaggggctctcgggggaatctgttcttggtttcttccagaacctggtggccagatcactccaacccctgcctctgtggtcgcattgcctcttcctcttctgtgggtttcctctgtgtgtctcctataaggacacttgtcatggtatttagggcagactcaaataatccaggatggcctcctcaccttaagatccttaatttaattacatcttccaagactcttctttcaaagaaggacacattcacaagttctgggaattaggacatgggcatatttggggagggggacctccaatcaactcactactatcgtcaagtgcatactcttaagcagttcaaagttcgcaactcggttatttttcacctattttagaaagaggttgattttacacaccacattgttctttcagtgaccgacatcttataaaacccagaagtaagtaaagagcatttattgccatggtagccagttttgtcactgagaaacagcccaatgtatgttcacactgtcgtattaggaaagcaaaaagagtaattatattaaaataaaatacagcttcctctcttctttctttcctttattatttctgtgactgacagtctatcagatgaggctttttttttttttttgctgaggttgctcatacagaccatgttgatgtctctagaggttctgcatgtaaggaaagccagatttttcacctttgacaaaagtggaatttttccatttaattctgcattgactaaggtcttctgggagattctgtgcagtctctgtacctgaaatgcaaagtcattgtgaaagaagctctacgacagaataaaaattattacaattccaaaggagttggcctataattaattgtattttaaaaggagtttcatttgctttactgcttttttggaagaattaaatgtaatttgatctctgggagaaaataccaacctcttcatgtatatacttgttttgtttttttcctagcatttggtaaaagttaatgaggcacatttttttggtattgttagcacaagtccttactcttggtgtgaaaatatattgacatttgctaccgtttctatatcatgtgtaagtgatagaggaagggaaaaagagaaagaatagcaatttgttgtcatggaaatgaattaatacaaaactggtggtttgtactatgacttgagatgcttgggaagggggaggaggaagaatgataacatctatatgatcacaaagccaaaattcttagagaaatactggcaaatatctggagtgatttttattccccatctatctaaacccctcacatgttaaacctatgatgatctaacagaaccagacaaggccctaagaactttcacgtctctgagcaaggcacagccaagtgcagtgttggtagattctgcatccagtctccgcatttcttggacaagtttgactccaacttagataaaaataacagaggcatttttgggcgggcacagtggctcacgcctgtaattccagcactttgggaggctgaggtgggcagatcacggggtcaggagatcaagaccatcctggctaacacggtgaaaccccgtgtctactaaaaaaataaaaatacaaaaaattagccaggcatggtggcgggcacctgtggtcccagctacttgggaggctgaggcagaagaatggcatgaacccgggaggcagagcttgcagtgagccaagatggcgccactgcactccagcctgggcgacagagccagactccatctcaaaaaaaaaaaaaaaaaaaaatacagaggcattttcagcagctccccttcacttcctgcaattagattggctgcccaatttccactaatgccccattttctggcaagtaaaaccaccatcacgggattaacgagaattacaagtcaggttttaggcagaattatctttaggcattgaccagggcacattttgaccactcccttgcagttgctaactaagagtcatataatagcacactgactacctgcacccatctggaacccattattcctatagatagaatctctgacaatagaccattttacccatgaattgcttagggcgtttttcaaatccagcagaatggctgacgccaacaaatgtaaagaccctcaccaaggaaccaattcagcataggaatgcggtttcttcaatacgctgcctgtcccgtgacttcacccttcacttctcaacagatcaacaatccctacacgttagtccatcacctgtacagactccttagaaacagtatccccaaacctcttgcggagatggatttgaggttttttctcatcttctcctttagctgtcctatgattattaaactctttctctgctgcaacccccagtgtctcagtatgctgactcactgtgcatcaggcaatgaacctattatagttacagaaggactgtaaatcacagagttgtcccttgtggccatgtctggactattgaccctagctcctaatctacttccagccattggatcaggggtggaacctggcttaatttgaccagttgcagtaatttgctcctttgggcatggttcattggtcctggagtggccatctgagacaaaccaaattaaccacgattgttccccagaacttttcaaactggaactaagaaaagagagctggtttcattttggaggtgaagatgtgggctctgaggcctggaatctaaatgtgaccatgtgacctacctgttaaagagatcattttaagagaatgaagcatggagtggcagatgagagatggggagaaattctactggcagagaatgtaagttcccaattcagttgtcctcatagtccagctgcacttcacatcttcccgcagttatgagaatccacctccaataaattcccattgcctgactaaattatttaaagatgggtttccatgcatagaaatcaaaaaaagttctaactggctgggtgctgtggttcacacctgtaatcccagcactttgggaggcattggtgggtggatcacttgagttcaggagttcgaaaccagcctgggaaacatggtgagaccctgtctctgaaaaaaaaaaaagttttaactaatatacctctccttaccctttttgattgtgacttaaagtattctcagttaagttctaagcatcttaggagatgctagaggcatgggtgagccaaataaatgaagtcgcagagccccggcatattgctgtgttatgtgaggccagaggaaacccagggagttcttcaatgggaatattctattttgatttgctgagatctgctgaaggctccttcttgggttaaacacaagtattcccccagcttgcagagacgtttttgttttgtttgaaaaagtactgtatcaaatgcagtcctttggttggcagagctccttatatatcttctacatctcttgtggcactttcacatccattatcacatttttacctcttaagcgttcctagaggtgagtgaggccaaatggtacattactattttaaaaggaggaggcaactgcattccagaaggattaagtgttttgttgagagctactgagtttgtccaggacaaaatcagcctgaaaattgggtttcctgactctcaggatttaatccgtgccctacccacatttgaccaaaaacaaatgagtcttgcggcttctctggttcttagtctgagaaggcaaagacaaggggctgggaaatgcccctccaactggccatgtggacttgtaataagcatgtaaataccatgctgggacatggcggcaaggctcatttgctgccttctcacaaagtggaatgggagaattcgttgcacggtattaaccaattggttgcctagtagtctggtgaagtgtattaaggacattaccagagcaatgtaagctaaggccaaggaggacagtctgaccagaggaagaccacagagtatgtgtttctacatttacatatgactcaggagagtttggcatcatagctgggaccattttccaaactgaaagaaggaatttctctacttgcgagggtggctgggcaggctccatggagacagaagtttgcctgcagaattacttggctttgtgtatagctagaggtggtcaactacacttccccttccaacaggcagccaattggagagggctagggtttgcagatggctcttctgctcttctcaccatggccctggcaaaagcaaccattcagactccatttgtggtgaaaggaaacacagttgaagggtatgttttaccagggatgaaaaccaagtgaacccaggaatatatcgtgaggctccttttttcagctcaaggccctgaaaagaaaactgaactttgttgatagtatttgactattgttcgtgtttaagggcctccaaaatttggaaatgggggaaacaggactgactttttaagtgcttaactgtaataactgtagtattggactaaatgtgaaagatcaacggaaaaagacaggatgacttccaaagcccttggactagctgggagtgggaggatggtggtgcaaggggaggcagtggttgggatgggcaactgtggaaacagagaaaaaagacagacacagagacaaatattggtggtgctcattcaaacacttcccaatggaaaagaagccttagccaatggattttgggggtgcaatgccactcctagtgggtaaatgtatctagaggggtataatagctcttgtgtttgtgccttcacattctgtctgtaagactatctctgtgtgacatgaaagatgtactgagtagcttactttgctactgcatacctttggcttatccaattctctttgatctgatgtcacactcaacaagtaatctcctgattactgtttagctcctacagggaaagaatgtattgatcctagaaacttcggatattcttgtccttctaaagatggtttcttacgagaagtgaataacttggcattctgatgttttatatcagccttttgaatgtaattagcatgagcctgccctgagagacgcatggcatgatgtgttgacaaagtcaggtctgagctcaccagtctaattatccaactactgatgattgtaaatttgtaaggtaataaatgatacactgtcaggccatttgggagacggccggccaaccttcccacagtggggtatcctgatatcaccctgtaactgagaaatcacatttggaactttaatacaaccctctttgaggaagaaatagctacagcaaggtaaaaatagagtgttagtgataggaggtaggagtggtgctaaaaatgtttatggcatgaatatagtagccgtgagaatgtgtctcacagacttccaaccacagggaagtagctgtgctctgaaatctattgttatatttgcaccgaggccacacttccagtgggttgctcccagtgactgagcatagcaggaatactaaagcgggcccattcctgggaaacaaaagactcctctgatggctgatgttggcatgagaactccccagcagccttgccaaatctcttctagattgcctagcagtctagaatgcttccaatcaagcttccttcccatgctccttcttggggtcagattttcatcatgctccttacatatttagtcttgtcttttcaaattccctaaacaatcacaatgaaaaacattggatgagatgtgaaaggtcaatggaaaaagataagatgactgatgacttccaaagcccttggactggctgggagtagccaggatcttgcaggaaagagatggtatactcaaatcgggatactttgagtacagttaaataaaggaattgttttcaaagttatgggcagggtatagagaagccacaagggagagtgtagttgttcatgaatagctaggtacagctctccaccctaggcctgaaggagcaaggggagagagcagttactgaaatcccaagattaagagggctgtgggtagaagcttgccttaaaggcgctaggatctttgtataaggaatgcagcccatctgcagaatccccaaatggagttgctaaaggaatcaagacccttgcttccatgtactgtctctctctgatctcctgcttgcaattggcccagcccaactggaagctgcagggaaatgagcctattgatacctcatgcgttagcctcatgcatcctacacagggagagaaaggtggagagtggatctgtaaaggcaggtgggatgtctccagccgcaagacaatggtgcgcttttatgtggtagcagcgagccttcccttaaggctttcctatggcagcaatgacaaaagagagccccgacctgggaaatgaaagacacagactccactgaagatagtgttgcgtgaaagaaacagcaaagactgtgaaagaaattccagccctggtgttctgcctggacctagacaggacctagccctggattgaaaaccggagctattggtttttaggccttgggatatggtgctttcttcaggattggactcatgagatagtctccaaagaggtcagtaggtgggaggatatcttttcagcccagaatgggctaataagataaattcagaattaaactgcgacgactgctcaaaaacacagaaaagaaaaggaactggatggaaacaaagggagagcctgctgctggcatctttctttttaccactctcccctgggaggtttgtccctgtggcattgcagtctcagttggagacttcttggagggagcagcagagcttcttgagtctaaactgacattgaaaaaaggctctgtattacaagaatacatctgaattcatcatggaagtcaagaggaaaatgtgattgagggaattcctaaactccaccctgtctcatcatcccacgtccttatcaagcaccatgttttatggagccttcccctgtctcctggatctgcctactcctcttcattcccatggccactgcctgaggccaattcaccatcctatttgcttggattaccacaatggctgcctcaccagtccccctgcctctggcctgactgaaatgtcagtcaggatgctgttggctatgagaaaactgtgactaaaattggcttgctgttgcacataaccacaggttcctcgtaggggcaggctccagaacagcccaccaaggctctggccctacttctttctgcacctcttaaccttaaactcacccatgtggtaacttcatcaggctggtagattgataaccacatccattcctggtgtcatatccggtctctacaaagtccagaggtagaaaagtccatctcttcttgtgtgcttcacttatacaggaggaaacctttctagaagccctcaaggaaacccccctaatgcatttggccacccagaagagggggatttctaaacaagctgggagttctgttaggaaggaagaaggtggctgctacatccatttttctacacagcaaacttaatgatctttctaatgcagaaatcgatcatatcatttttctgcttaaagtccttcagtggccaccactactctcacacaaagcccaaatgtcttacatgagcatatgaggccatttttactatgacccctgtctaccgccccagccttactcctctccctaccctctgtcctgcagtcatgctaaactgcttgcattgatataaacaagccatgttctcccctcttatcagttgcttcttggcttctgctgtttcctttgcttggagaacaccttgcttcttctggcttacttgggtcattttgggaaactccatatagataccagttcttctcaggaggcttcccttggccctgctgtgtgcttacccttatactatcccttggcctaccttggccaagccttcccttggcccatcttgtgcctactcttacactatctggaggtattcagacgacctatttgccaacccgtttctcttcccggactccaggccacaggagggagaagtctgtgtgcctactgtaaggagctgtctggtgccttaggtaagactcagtttctagcatcagacagcccggatttggttcttgccttcaactactgtaactaatcatattcaattactatgagtaactaaggtcactaactgctttgagtactcaaggtagttagtgaccttgggcaagttatttaactcctctgaacttttgtttcttcatctataaagcagggacaataacactcactatctcatgcagtgattgtgagggtcacgtgggatgatttgtgtaaagcacttagcacagtgcctgacaccaagctggtgctcagtgaatgttaagctgaatggtgatttggtgaacagagctgagtctctcccactgttctggggatgttaaaagcactctgatacacgtacctggatacagggctgccaaggctaatcttatatacataattgaggaggatgtagggatatgttggcttctcaaataattattatactaggctatgttgctgaattcttaatcctgccattacagattgactatttcatgttagcaatcaatcaatatttactaagaaaaaaattcttgatagtgcagtggcaaactcactcatttcctgctccaaaagacatggccttgtccaactagtcaagctgtagacagcaagtgctcttggacttcagagaagatctctacattgaacttggaggatgatgatgacatttagacagatggagatgggagaagaggacccagacaatgagaagagaagaggctggagagctctgtgcatggcagaggatagcatatgaacctctggtgaccagagggtcttgcaggtacggacttggggattttcccttgaaaaatgtgaattcacttgaattgatattttatcatagaattgtagaaccagaaaggaattttaaatccccttatttgaagaaactggagctcagagaaactaaatactgggtccaaattcacccagttagttggtgagagagagagagagactataaaccaaggttatctgaccccaaatctagactttagagctcttttacccactaccaaaccacctcttaattagtttagttatatttcttcttcttcttttttgttttttttttttttttttgagacagagttttgctcttgttgcccaggctggagtgcagtggcgtgatctcagctcacagcaaccttcacttcctgggttcaagcaattctcctacctcatcatcccaagtggctgggattacaggcatgtgccaccacacccagctaatttttttatttttagtacagatggggtttctccatgttggcccggctggtcttgaattcctgacctcaggtgatccgcccaccttggcctcccaaagtgctgggattacaggcgtgagccaccgcgcccggctctttcttctaatacgatgctgagataatgaagtgagagaaattggggattcattgtgggtggagggggtgggtgagaagggagcacaagaggaaagagaagaggagacccaggaggaagtggggaggtgggaaacatgtgtctctaaccttcagcttcttccaaccctctttgccttctgaacagagcctaaaatgcattcacacaaaaacataaatcacccaaaagccagaaacaaaacatcatgctcaagtagcctgttatcaggaggggcctggagtggaacactatgttgcaagaaccagcacttctgaaacccaagttccaattccagtctgccactgactcatattatagccttggggaaaacatgcagccaatggaaccacatagaacattctaaaggaataattctgaagatacttgaagactgtcgccatcatccagccctcctcccaaggcttcaggtcttcaggctaaataccttccattctttatcagttctttaatttctaatttaccccgattgccctcttctggataagtagcaatctgtcaatgtctcttttcaaggcactatgaatgggacatagattccagctgggtgggtatatcagtccaattctctccttgccatgcactctagacttgtattaatggagattgagtgcggggcctctttggcactttgtcttaccagtactttcctcccatgtggatgcagatccactcagttacacacgcatccatccaacaaggctatcatctactacagactcctccattttctccagaaacaaattcagaaagactttgttaaatgcctggtggaaattcagatatgttatgtgcacagacatatcttgatttacctgtctgcagtcacaatcaaaacaaaaaattgtatttggtctttctgagcttatgttgcctcctgctggttgccatctcttgttccaaatgctcatgaatctttctggtctacgacctggctcaggtcacctccatgcttaccaatctctcattgtcaggacccacctgctttctctaaaaaaaaaggaaaaaaaaaaaacttcttccttacttttggttgtctctagttttccagcatcccctccatttttctgattactgagaggattacatagagcagttcaatcatctcattgcaaaatgcctgattatcctggcatgtaatttttatttatttattttagagatggagtcttactctgtcacccaggctggagtgcagtggtgtaatcatagcttactgcagcctctaacttctgggctcaagagatcctcctgcttcagcctcctgagtagctgggaacataatgggtgctaccacacctggccctggcatgtaattttgtaacatctttcttataaaagacacttctggtagaatttaggttataggtgaagatgcaacataatttttttttttttttttttttttttgagatggagtctcgctccgtcaccaggctggagtgcagtggtgcgatctcagctcactgcaacctccacttcccgggttcaagcaattctcctgtcaggctggagtgcagtggtgcgatctcagctcactgcaacctccacttcctgggttcaagcaattctcctgcctcagcctcccgagtagctgggattacaggcacgtgccaccacgcccagctaatttttgtatttttagtagagacgggtttcaccatgttggtcaggctggtctcgatctcgtgaccgcgtgctccatccgcctcggcctcccagagtgctgggattacaggcgtgagccaccgcacctggcctttttttttttttttttctgagacggagtcttgctctgtcgccaggctagagtgcagtggcgcaatctcagctcactgcaacctccgcctcctgggttcaagtgattctcctgcctcagcctcccgagtagctggaactacaggtgtgtgccaccatgccaagctaatttttatatttttagtagagatggggtttcaccatgttggccaggatgctctcgatctcttgacctcatgatccacccgccttggcctcccaaagtgctgggattataggcatgagccactgcacctggccctaatgtaattttttaatacctttcttataaaagtcactcctggtagaaattaggatataggtgaggctgtaactaagacttgtgataatagagaattggcacagagagaggatctctctgatgcccacacctctgtaacagcccacgtgtaagcagtcctgggctcctatggcagcatcagtgaccaggatcctttgatcttgctgttccatctctagagagttgcttttgcccatatggttcaagatggctcagcagcatcatttcataagcctccttggcagtggaaaggggaaaaagggaggaggaaggcgcaaccctgaacttgcatatgttgcttctatttatatcctataggcaagaacttacacacaggcactgagccgaaaggaagactggaaatgcaatctttattctgagaagtaatatgctcagctaaaagtctgcagttctggttctatgggaaaagagaagacagatattaaagaaaattagcagtctctgccacacttcaacttcctctgtaaatctcttacattccgcattttcccatatctgaaactgtagagtcacttctacttttcctaattcttttttagttactcacaaaatcctatttattttattcttttaatcaattctattttacctcctaaaatatttttatccatccgtttcttcctatattcacaatgatcgacatccagatacagacactcatcagtctttggttttgccagccccaacccagagtccacactggtcatcttccacctgctgggggcttagcaggaaaggatagaggatagctctcccctctggcaagtggcatgggacatagttttctgctgctctcaataccgatgcctatttggcattggactggggatggggaaccaacattcttccttcttagccccctgtcaggaggtataagaaatcactgcttctgccactgcgacatccttcccaggtccagctaattcctactgacattagttcagcctcactccccagagaacagtgctcctctagcttatgtcatctttttccccatcttttgggtgctgtgtttagccattttgtcatttaacaagacaataagagccttttaacttgtgtctctggaaacatcttgtcctcctctcaatcatcctgtgcagagacaaattaatctccttaaaataatgatctcatttttaaaaactctcctacttaaaaatttctaaagggtgggccatttgtcacagcagtggtagcaataagcaaatgcatgttgccttgctcaaggtcatttcactaattgatcaagatactctttccagctcaatgcagatgaagctttagaatcctttcccacagttggcactaccaaccgattagaattggcatggaagatagatcttgtttatcacccttagcctataaaattttttccaaaagttaggcttttgacagtgctctatctctgaacgctttttgtgtgtttcaaaccttgtttatcaatatatgcagggtctatttcctcaaataaaccacacattctttattctggttttcttttccccttaaatgtctgggttctgctcacagagttgtttacagctgtccttggtcaaagaggagatggtgaaggtgctgagggccgagccagtggcagaagaaaagaaggccagaaggaaaatctaaactctcatcaagaaaggcagtaaaaggctgtaagcagaaaactggtaccaggtgtgagatccagggagcgaggcaaggtcaacaaatggaaaaaccagagctcaggagccaaaaggatgggaagcaagtggggttgcagagtgcaagttgggacaaggcaaattgttcatacctaagtgtttcttggagctctcagacctgcctctgtgcagggtcagccattaaacagaactccacatgtaatatgcactcacacatgaataagcaaaaacataaatcaaagtaataccatctaaccctatgttgaaatgccatatcaaacatccattttctagtttccctcagtcttctacacccaagttcatacaaaaatattggcttagcaactttcctttaaattactggttcttctctaaatgtctttaacattgtatttaaaccacagtggaaaagataactcttggtaagtgcagtaataataaaacacatcattttaaaggtggcagatggaaaccagaaagactccatccagggatttttgcagattagattcacatgaagctttagtccccgctctgctcctgctaaagctaagtgatgggcttcttgccacaaccgcctttgcaaaaaataacatcttgctcctaccaagaaagcaggtgacaagctcagcagctgtgctttggtttgtttttctccacagcaggaacatgtgccccggagtgggcattgtttgtggaatcagtaggacagtaaatgcaaaggcaaggagataaagatcagtcaggaaggagaaagtggcacttgggggcagaacgaaacaccaaaaaagccaggtgatggaaacaaagcgaactatcattcgcccaagttaacagaagcaagttgactcaggcaactgtgagaaaagctaagactgtttgcatgcacgtggtgagtcatctaatgtgtaagtcaagctaccagctagaattaatcttgtgcatggaaacaaattcgagtattttgaacatgagctaatgagattgacctgtaggatcacgcagctctaatagctgaataggcatgtcaaggataaaggcaaaagctaggggtgccctcgggaagtgcctttctttgtggcctgtgcattcgctctttgagggatgccggctgagctgaagaagatttgccgcacccatgctgccctcaagttcctctttatttatagtactattccaggtaagatgtcttctggagtacaagtacaaaagctgtgtttatggctctttccattttacaatgaactttcctacaggttgtggaatttagcatgatgggatgaccaagtgctagttgctgttgttgtttagattggtaggggtcatttgttggttattttggcaggccagtgtccatcccacattcctttggtaatagtgcctagttccttcttgggatttgcctcttcccttggagacagtctggtaggactttgatcaagttgtgccactctccctcagtcaaggagcaggcacatgaactggggatctatgggctccctccctacacttttggccttgaccagaaagacaaacagattgaaaaagagtagacccattttaacaaggagtagctcccagaaaagaaagctgggtgttcctgacaccataaagatccataagtgttccctggtgcaaagcctggtgctccagccatttctgagtttggtctctgagcctattgtttttgctgtcctgctgccttccaaaaatctcccgttttgcttaagttagcaagaaagagttggtttctgttacttgcaaccaaagaaccctagctgctacagattcatgtactcaaagtttccactacagatgttcaagggagtggagactactggtaaatccaataagctgattatgtgaatattgattaagaaaacttctacatattttatgagggctattacacaataccatatcttgttttccttacatctccctgacctgaagtctctcttctaatttgttgtttatttcaactcctttatcaaacattccccaagatatagtgaatgggcgatatattacctaaaaccctgattatccacaatatctttcaccctgacagatcttatgggagtagaagggggtggtactttgatttttaaaaataatataaaagatatgtgtatttgactttcaatttataaaatgaaaggtaatcatttgtggaaaacaaaaatatagcaaaagattcaaaaataatgggagaaaaggggccatgtaataataataatgtatcttattgaatcgaagacaatatcagttgttggaaacactattatttaatgtactattaagaagaaaaaattgctaccaatgaatttacggcacactatccgctctaatctaaatttttgtgtatcccaaattcatctgttagatccttctgcccaatttgaggtagagcctttgggaggtgattaagtcaagaagacagaatccccctgagattagtgtccttataaaagagattgcatagagattgcatatgccccttctttctgctccttctgccatataaggttacagtgagaacaaagctgtctgtgaggaagcaggcccttactctgaatctgccagtgccttgatcttggacttcccagcctccggaactgtgagatctaaattgctgttgtttataagccaccctattgtattttgttatagtagattaaacagactaagataccattccaacttcagagatattgcaaaaaggcaaaaaaaaatgttttaaagtgatgaaatttggtaataaaactgatagctcaatgtatggagttctaactaaatggcaggccctgtttatttttttttttatactttaagttctagggtacatgtgcacaatgtgcaggtttgttacatatgtatacatgatggcaggccctgttctaactgttctacatgtattaattcatttaatactaacaatctaatggagtagtatgctatgtaagtatacaggtatgatatacaagtaatatccataattagccaaacaaatggcttagaactaatgtaaattcaaagtggagttattaaaagctttatttgaactgacaaatttatgtttcaatcaaagcaataattaaaattgtgtgagaaagcagtgctctgatttttttttttttttttttttttttgagactcactctgttgcccaggctggagtgcagtggtgaaatctcggctcactgcaacctccacctcctgggctcaagcaattctcatgcctcagactctggagcagctgggactacaggcacccaccaccatgcctggctaacttttgtatttttggtagagacagggtttcatcatgtcagccaggctggtctcaaactcctggcttcaagtgatctgccacctcaggctcccaaagtgctgggattacaggtgtcagccaccatgcccagccttgatgttttcttttatgaaatcaatatcaaaaattgtaaccttgttttttactgaaaaattcattcttagttttgtttcaatccttaaaatttaaaaacaaaatgccattgcttctaagctttgttttctaaatcttgaaaggcccctgggccaaaagcaatcaatattttgcttctttccctgtctctattctaggctgtgtaagtttacagtgttattcagcatttctctaaaggtattttgtggaatactggtgtggagatgttctgttgtaacttgaataaatcccggggcctacgtggccagtctcaacagggttagcattcaaagaaacagttcagtaaccaagtgtgatcactctctttcactttctttcatttctcaaagaatattaaagaagatccaatccataattcctaacttcatttcttaaatttttcttttcctcattcttctccttttacaattgtctcacatctcaaagctttctcaacacctctcttcccccattttttttcactcagctccacaccaaattatcttggacaccctctacctttgcaggatcttctcttttcttcctcttcctgtttctttccatcactttaaatttctttcaagaaagccctgaccctgtctgatgacaatccctcattccagataccctgagtcttccacttctgattagttgaggatgtagagtgaggaccatgagatgaatatcaaattgagggaaaggtgctgagtgaacaatgttagacgttttcattgagggtacaggtcaagaaagaggcaaaccatttgttcatacattaatgatattttgtttctttactttaaaaaatgccctgtggtcatttatattcatgaaaatttactgacacattagtatatcaaaggctctgagaagtcttgcaattaagaatctgaattatctttgttttatctagtatttctcaaacacgtttcaaaatgataattttcatctcccttccccactttacacacgtaagtacccatgaagatgattagggtaaagtggtcttaaataataaaagatataacaaaaacaattgaaagtatatttgtaacatacacatagctttgttggatggatgtttcaatgaggacaacagtagtttgaatgcagtatgcatttttcacataacatggaaagtagtgccattttgctctttgtcttgcagttggaatatgagataacccatgcagaatagctaccaactgagtctgtctggccagcatttacacagatacagttgcacaagtggccctgtacaacagttatccttgaatttgatttgtcaagatggtttgtgttattacctctgtggtatcttgatttaccttgggtagtggccagtcccttaagttaatgttggctattagcccattagctgttacatgagtttactgtcagtgggtgtggagggtatgattatttgccgatggacttgtccacagctagaggtaatatgtacctgggtgtctgaacaagttttcatgagggatcatctagaaacgattggaaaacagcacccgaagccacatgtgctcagtttggcatgcaaaaccttgcatactagattcagtagtgggggcaacaggtgatgaataatttgcaaactggtaaagttttagttggacctgataatattgggaatcttcctatataaagatacagaatattcattattaacaataaaaaaacagacaatagataaacagattttaggcaatctaagaagaaaatttaaatattctggctctttttttttgcctgttttactttggattgttggtatttggagcaatgctggatgccacgactcaaaatcattatcattgcttgagacttataatttgtttaagatttgcaccacttcaacataaatggctggttttactaacattccacctgaaattctgtatacttccatggacatcttaaaaaaatacatatccacaaatttgctcagcttaaggaaaaattggaaaaaacttagatgccctaaaatagggaatcctttattatattacattcatatatggtaaccattagtgctgtccaccaaatatttccaattctcctgctggacacatagtaggatttcatttctttcccaccttagcttaagtgaggccatgtgactagctttagccaaggaaatgtgaaaggaaatacaatgtggcatccaggcagaaactttaagagccaatgtatcaccaaggcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggctttaccattcaggacataggcacgggcaaggacctcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacatttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggaaaggatgtggagaaataggaacacttttatgctgttggtgggactgtaaactagttcaaccattgtggaagtcagcgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatttggcacatacacaccatggaatactatgcagccataaaaaatgatgagttcatgtcctttgtagggacatggatgaaattggaaatcatcattctcagtaaactatcgcaagaacaaaaaaccaaacactgcatattctcactcataggtgggaattgaacaatgagatcacatggacacaggaaggggaatatcacactctggggactgtggtggggtggggggaggggggagggatagcactgggagatatacctaatgctagatgatgagttagtgggtgcagcgcaccagcatggcacgtgtatacatatgtaactaacctgcacaatgtgcacacgtaccctaaaacttaaagtataattaaaaaaaaaaaaaagagccaatgtataattttttttcccatggtcagtttttcttctacctgggtcctggagtgagaacattatgtcacagagccgatccctaactgatctgcaattgacacatagagtgggcaagaaattaaaaattgttttatgtcactgagattttggggttatttgttactacagcttaacccagaccattctggctgataggccacaatgggacactaaacagttcacgaaaattacatagtagaaaaatgtcagatgataaaggacagatacaggttatatattcagtaaaaattgcaagttttaaacaagtattggttaatcattgaaaaatacatatgaaatggagtttcctgggatagactggatctttagaattctgaagctgaaaataattcaatgaaaaaacgtgtctttggtaagtgtccatcaacatacggataagcaaaatatggcgtatacatgcaatagaacattattcagtcttagaaaagaaaatctgacatgctacaacatatgaggacattatgttaagtgaaataaaccagtcacaaaaagataaatgttgtataattccacttatatgaggtataagtgtagtcaaaaccacatagacagaaagtagaatgatgcatgccagggactggaggagacggaaatggagagttggtgtttaatgagtatagagtttcagttttacaagatgtgaagaggaaaacaaatcattcccttttcctgggcttgggagagggctttgggtctctcctgcatgaaatggagaagcctgatgattcctggtgttgaagagtaagctcaccctggcctcagagatgtcagttggtggttgggtgggagccagcctcaacctatgattctaagattagtgtgggggctgaggcccttggtcccctaaaggtttgttgtaagatcactaacatgaagcagattgatgaataggagaaaaggcacacacatttatttcacatgtatacatgggaggcttcagaatgaagacccaaagaaacaaggaaaattgtccatttttatgcttaggttcaacaaggtatggacagccacgtagaaatatgattggacaaaaagggtctgatctactgtgaatagactgagcagggagactccacaaggcctgtctgttcaggttcttcttggtctccctgtgtagctttccttccttctgggtatggggacttttaccctctctggaatgggggctctctgcaatgggtgtcttctgacctacagtcaaacaaggtaggtcagatcatttatttctggcccgtttttgtatggaatatttttaggtgttttggctggctttcaggaaaaggggttctggtttctatgcctcgccttgggggaagagggattctagtttttatggctaggcttgggttgcaggggagggcgggagaagatcagagaaaaacttttgcttccgtggctgctctgaggccttcattttggtgtacagttttttcagccccagcattagccatttggtctgggagctggagggcctgtgttgccgtttagagggaagagccaaggaaagagtgtgtcccttcccaaggctctcatggatgtatgaggaccagtcaacagcgaagggtggctgactgtgacagagccagcaagagaggattcagtcacagagaaaaaaatgcaggcccccagccagggtcctcccgcaaagtatgacaattcagaactactggggatgatacagacaacattcagcctccagtgtgtgttcctgtctctccctctagaggacagttctcgctctcaaagtgcgctcggtgtgtcgtgtcgccatggtaaaaaggcaggagacagcaaacgcttgatccgagctgcaccatgcctcgttttcactctccctgaagacaaaagaaggtggcaagtaaggaaagctcaccccagggagttttctcggagaacacaagcggtcccaacagggtaaaggagaaaataattatctggaaaggttgcaattaatagtatcaggtttaacctttgtgctaatatgggaatctaaggcactaagtcatcgcctaagacctagtgctctctgtacgacaaagctttagtcttataatgtggaagtcagtgcttattacatccaatgcctgagttcccagcggacagagttccttctcaggcagccggccaaggacaccagaaattaagcaggggtctgtggctctgccgtctagctatgaccaaatttaaatttgtgctttttgccttgcctgccagtgaacctgctgctagactgagatgtaaatgccatttctggtgtacattaagaaaatgtgaaacaattagctcaaagccgtggttatggagcaaaaatattaaaaatataagttagaaaatccttgtgacaatgttcatgtgaatggtgagggtagggagtccattgcatatatgtgtgtgcatgtgtggaggagtacgtgtgttgaataaatatgcataaagagtgcatcagcagtagatccaagaacttatgtatgggggtgggtgtggaaatccacattttagtaacattttttccttcttcacagtcaagtgacgtttcttcaaacatctgttctgtgagcaaagtagggagggacgtacatcagtgttaagtgcttgggagaggaattctggaggaacactacccacttaatttagctcagctctatgaaagattgcagggtttgggactatttctagccacatctgagagtctgtgaaaagtggaagtaaagtcattaagcggaatgggcatttatacatttggtaatttgtcttgagtcagaaagtctagacactcccctgggaatggggggaatgtgggccatggttatgaccttcaggactctggaaacaggaatgacaaagacctggaaggtcctgaggcaaatgggctcaatagatctttttttttatttgaaacagagtgcagtggcacaatcttggctcactgcactctccgcctcccagattcaagcgattcagctacctcctgagtagctgggattacaggcacacaccaccacgcctggctagttttgtatttttagtagagacggggtttcaccatgttgcccaggctggtctcgaactcccaggctcaggctaaccacgtgcctcggcctcccaaagtgctaggattacaggcgtgagccaccacacccaccttcttggtgaaggcacataaagcaaaatgaaagcccactggtctggtgttcagacacaagccaggcctcacccgacttggagacaggcagccccagccagcaagagagttacagacctcagctagatctggggaccaccagtttcctaccagggcaacctgagaatgtactctctctgtgccgcaactctttcccctctcaaataggcacaaccattgtaacaaccagaagagctaacatggatgaagaacttcccgcgtaccaggcaccataataaatgctagatccatgtactcttcttgataatcctacaatgtagtattattatatttcattgattctaagatgttcttttttttatattttaacattctctgttatcaggatgaataattgataagaaagcctgtaagtcatggttaaatttttttttaagagacagggtcttgctatgttttccagtctggttttaaactcctggcctcaagtgattctgctgcttcagcttcccaaaatgctgggattacaggcataagtcaccgcacccagccagtcatgattaaatttatacttttaaatcttttttagtgatatataaattgatgatgtgttagattcagtgaggaaactgaggcagagatttgaaaactgaggcacaggtgggctgaataactcgcctaagttcacacagttagaaagtggtagaatgagagtttgactcaatgctgtttctagagttgactttcttctaaggtgctagacttcctggtccctccacttaccagctgtgtgatctcaggcaaattcctaacctccctgtgcctctgggattttttcatctgtgaaatggtgataataatattagcaacggcttcataggattgttgtggaggttaaacaagtttacatatgtaaagttctgaaaatagtgcccgacatatggcaagtattcaataaactttagctacaattactttttcttcttctaaagagaaaaccagcatcacttgttacgtatagaagacaactggaaaaaagagggttgtaactagcaaaaggagaataagttcatctctgtgtccctaaaatcgtcttggccccaggacaggtatgcttaccatattttgggaaatggctttttgttctatctctcaaaaattgagagatcaagtgaaagcgagatgggggaaagtggctgagagggagtggctgtgagaggtgaggagggaaggacaaacagaaggacaaggtagggcagcagatctggggctgccctgggtttgcttcagaaggtgggaacagcatggtgcttatgctggggtggccatagcagttggaaggagctatactgactggaatgaaaaagagtttcaatctgcaggttgcaattcattagtaagttatgggatgaacttggtgggtcacaatcagtatctttaaaactataggagcagaggccaggtgtgatagctcacacctttaatcccagcactttgggaggccaaggcgggcctgatcatctgaggtcaggagtttgaaaatagcctggccaacatggtgaaaccccatctctactaaaaatatttttaaaaatcagccaggagtggtggtacacacctgtaatcccagctacttgggaggctgaggcaccagaatcgcttgaacccgggaggcagagtttgcagtgagccgagattgcaccactgcactccagcctgggcaacagaatgagaccctgtctcaaaaaaacaaacaacaaaaacaaaaaaaatacaagggaaggcaggggaatgcaagggaaggcaaagtaaatatcagaggatatcatatgtaataacaatacatattgttttattgaacttgtatctcagttaagagtgtatagatgtgtgtaatgggttgagatgtaaaaggttctccgtgggtctcagtgcaaaagtttggaagccactggactaaagcaaagataagattaggtgttggctgaaaaataaatatacagtataaatttaaagtaatatgttttatattaacaaccagggacccctgctttctagtgtagctttctagaagcattcagggaccgtgacacaccacatgacatctgtaaaacactctccctttctgcacctcttggccttggggaaactactcacccccgacaccacccctcaaccctgcccagatcctgggctgactttgactttgcctctccttggctcagccactttgccttagacccaattcctgtccctctctcctgcatctttccagatgtccaggataagggccagcttttgttgatccacacagcctgggactccacacaggaacctagtcacctccagaggctgagctgtcctcttttgtgttttatgtaagtgttcttgaaatatatatgacaaggaatgacagtgaattggagaagtaacactccccagtagtgatagcagctcaaactcatgtggggcctgagtctgaataggctccaaatcatgggttgggtgatggatcctaaaccaagaattatggctcagattggaaccaggtaaaacagctctgaaagaatagatctagcttcatttatactaaaaagtaaacagaggcaagtattaaatctgaatcaagttaacattgtttaaaacatacacatgcggccaggtgcggtggctcatgcctgtaatcccagcactttgggaggctgaggcgggtggatcacctgaggtcaggagtttgagaccagcctgaccaacagggtgaaaccccatccctactaaaaatacaaaaattaaccaggcatggtggtgggtgcctgtaatcccaactactcaggaggttgaggcacgagaattgcttgaacccaggggactgaggttgcaggtgagcggagatcgcaccactgcacttcctcctgggtgacagagcgaaaaaaaaagcacacatgcaaatttcagaataatgggatcaaaatgccttccaaaaatttcggaagctttttctctgacaatactgaacaaggccaagtccaagtggtatgaagcaactctcaataagatgcctggcacaggaccagccgttgcttccttcctaatgtctatactcatcaagccacatgaacttgtggcttgatacttgaataactatttttaaattatttttgacctgcaggtaaaacaataactggaaatcgtcagtttgcatcatagggaggtccccagaagaaaaagaagtcaaatcttatcaatatgtaaaaatggaggtgatcagcctgttttgcaaaagataaatgaaacatagacattagcagactcattataattcattaaaattatctcaaggttaaagaaaagacaaaacctgggcatcattgaacatgataaagacttcacatgcaagaattcccataatgaaggcatttaaaacacagctactacatttgtaaacttatgttgtttgcaattcaagtataccttattattcagtggcttctttttggtcactattacataagtaactttttcattaactatttattcttcttattaatagaatatatccctcacttttaattcatttttgaactgatttttatataaccttttacaaatttcccagaatttttagaaacctaactattgaataaattgagacatgaatatattacctcttaagtcttgtagaaaaccaggtcaaagttggcaggagacaggagaagaggttggccaaatccctggggtctaaaagggataaacagcaaattggttttatcctgaggctctgtacccaggacctgagcttagaggaggcccaatttcttcacagccattcctcaaaagcattcctggaactccctacttgtaagctcctttagggcttgtgcacattctctgggattttcttggaagtagccaaccttcattcttttcaaaatggccaaaagtcagttggatttagatctggtggatcaggtcaaatgcatttaaacaagctatgactttgaagtgacaagtctgtctttctcatttagttcataaacagaccgtgtaggaataaacacatcagttccttaagggacatggaaaattgtgtggtgggtggggaataactaacagaattattaatcttaatggcatgcagccatgattagagctaataaagttgatgccaaagcttgactttaatgtttaacaacaaggaaaaattaaagataaggaataaattctatctcttctaataagagctagattccaggacaatcaaaaattccaaggagaagaaccgagagccagaaagatctcccagaaatgttcccttctgtaggtaattcctcttccctctcaggattgaaaaataaccaacctaaactggggaagggcgatggaaaaaggaaagaaaagttcagccctttctttgttgatgcaaatcacatgtataatatcaaaaattagaaaataaagccactcgtaagcctggcatggagagataaaccctgttaatatgtttgggcatattgccttcaaaatgctgatatataacatatttgtgtaattctgtatttacttatatatgtacatataagtagacatacacacataaaatatatttttcttttagatggtatgctatggatgctttttagtaattttgctttctgttaataaaatgaatattttacatgtcaacaaatatatacttattttataattttagatggctacttcacagtattttcatgaatagatcataatttatttaatcgaagcctaattttgaacatttacatttttataagtgtttatttactgtttataaatgctaaggtatccctattcaggcatacagctttaagcatttgctcaatttcttcctccccatggtggaagaaggtctccttgctatggtccgaatatttgtgtccctccaaaattcatatattgaaacctaacctgcaggtgacagtatcaggaggtggggcttttgggaagtgattaggtcaggaaggtggagcctcatgattggaattagcaaccatagaaaaagagacaccatgtgaggtcagagcaaaaagggtaggctgcctatgcagtagtaagcaggccctcatcagactctgctggcaccttgatcttacacttcccagcctccagaatggtgagaaataaacttctgttgtttataagctacccagtgttttgttatagcagcccaaatggactaaggcactcctgatataaatcaaacattgaaaattgtaaaataggaagtcctagccagagcaattaggcaagagaaataaataaaaggcatctaaataggaaaagaagaagtcaaactatctctctttgctgatgatatgattccatacatagaaaaccctaaagactctgccaacaggccccggaactgataaatgacttcagtaaagtttcaggatacaaaatcaatgtacaaaaagcagtaacatttctcttcaccaataacattcaagctgcgagccaaatcaagaatgcaattccatttacaataaccacacacacacaaaatatacctaggaatacaactaaccaatgaggtgaaagatctctatcgtgagaactacaaaacaccactgaaagaaatcagataacacaagcaaatggaaagatactttccatgctgatggattggaagaatcaatattgttaaaaaggccgtactgctcaaagcaatctacagattcaatgctattcctatcaaactaacatcgtttttcacagaactagaaaaaatgattccaaaattcatatggagctaaaaaagagcccaaacagccaaagcaatcctaagcaaaaggaacaaagttggaagcatcacattacctgacctcaaactatactataaaggtacagtaaccaaaacagtatggtactggtacaaaaacagacacacagaccaatggaatagaatagataacccagaaataaagccacacacctatagccatctggtctttgacaaagtcaacaaaaataagcaataaggaaatgacttattattcaataaacagtgctgggataacaggctagccatatgcagaagaatgaaactggacttctacctttcaccatgtacaaaaattaactcaaaatggattaaagatttaaatataagacttcaaactacaagaatcctagaaaaaaaactaggaaacaccattctgggcatcacccttaggaaagaatttatgactatgccctcaaaagcaattgcaacaaaaacaaaaattgataagtggaacctaattaaaataaagagcttctgcacagcaaaaagaaactattgacagactaaacagacaacctacagaattggagaaaatattcacaaaccaggcatctgacaaaggtctaatattcaaaatctatatggaacttaaacaactaaacaagcaaaaacagataaccccattaaaagtggacaaaagacatgaacagacatttctcaaaaggagacatacaagcagccaacaaacatatgaaaaaaatgctcaatatcactaatcatcagataaatgcaaatcaaaaccacaatgagataccatctcacaccagtcagaatggctattattaaaaagtcaataggtaacagattgtggagggctgtggagaaaaggaaacacttatatgttgttagttggaatgtaaagggaatgcttacacactgttggtgggaatgtaaattagttcagccacagtggaaagcagtttggagatttctccaagaactaaaaacagaattaacatttgacccagcaatcccattactggatatatatgcaaaagaaaataaattgttctaccaaaaagacacatgcaccttatgttaattgcagcactattcataatagcaaagacatggaatcaaccaaggtgcccatcaatgatggattagacaaagaaaatgtggtacatacacaccatggaataccatgcagccataaaaaaggaagaaatcatgtcctttgcatcaacatggatgcagttggaggccattattctaagcagaataatatagaaaaacaaaaaccaaataccacatgttctcacttaaaagtgggaactaaacattggatactcatggacgtaaagatagcagcaaaagaaactggggactattgtggggagggggaaggagaaaaagggttgaaaaactaactattgggtactaatgctcagtatctggatgaagggatcatttgtacccccacactcaacatcatgtaatacattcaggtaacaaacctgcacatgtaccacctgaatctgaaataaaagttgaaatttaaaaaaaagaaaattgcaaaataataaatacattaaggaaaaatgtaaaagccacctttctgagaaaacaacatttcagtgaccatttttccatgtaactctttctgcattatgtacacataggcataatatatgtgtgtgtgtatgtgtgtgtgtgcatgctcatttatgtgtgtttttatacccacacaagatttaagggggacatttttaaagggattggtgatatataattctctgtatcttaacaatatataatggaaattcctcaagatcaggtagtataggtaattaatttttaattcttggataaaattctactgtaagcattattatcattcagctattcttttactaatagagttttgatttgctatcaactttttgttattaaaaataatgctgcagtacatacacactcacacacacacacttatatatactggggcttttatttctatagtatagagtcccaggattgagattctgggttgaattgcaagtgcatttaaatttttaatagagatcacgaattgctttttcacatttctaccagtgatatatgaaagtgcccttgccctgactcccatctctgctaataataggtgcagttactctttgatttttgccactctgatggctatgatcatggtaattttcatttccctttctctgcctattggaggagattgaacattttatcatacttgctcttctgccaattgcctattcatatccccaacctattttgctattgggttgattatctttatcttattaaattgtgacatagctttttttatatatagatgcaaatttttatctatcatttgatttatattttttccagcttgtttacctactgattttgtttttggtatctcttgcactacaaataataccttgaagttttataaaggttaggttgatcacctacctttgtttaaaatatttctttaattcttaggtgtacagataataacctaattttttataaaatggttatttatttatttttactttcaagtcaaattcattaggaatttacttcataattaatataaactagggggtccacatttattttcttccaagagcatatccaattgtgatgagattattaattaaatttccccacaatgatataatgaagtatcatcttcatgaggtattacacaattctgagatctctttattattattttttactgatttttttggtagtcttgtgcctatattgtactgttttattatactggcttttaagtagttttaatactgtcattctttttgtttttgagacagagtctcaatctgtcacccaggctggagtgcaatggtgtgatctcagctcactgaaacctctgcctcctgggttcaaacgattctcctgcctcagcctcctgagtagcctgccaccaccctaggctaatttttgtatttttaatagagatgggctttcacatgttggccaggctaatactatcattctttattcatcaatttgaatattttatccaattaaaactgccagagattctatggaagttgtactgaatttatatactattttcaggagaacagctctatttatgagaaaaagtgtcacttttcaagaacgtggtgtaaatttctaattgttcagatcccatttttgtcctccagtacgattttattttttacatgggtcctattcctttgtcatataatttattcctattttatgatttttgttactattatgaatggaatagtttcctcattttcgtttgtatgtgggtatggcttatatagaaaaagctaatcatactatatctttatgttgtatctacccaatccatcaaattctttcttttacttctatttactttttttactagagtttcttgatgatatcaggtataaaattatattgtcagcaaaaagtttcacctctttctttccatatttatgctgtgcatattaggtttattgcatttactaaaatatctaaacaatattaaataataatagtaaaagtaggtgtgatttgtaaactatatatttggtcttcatcctgttttctggcatacaactcctaaaatccttggaatccccaaagtgataaatgtctttttgtatgctaataagttgactggtggctggcagcccctagatagcttcatgatgggggctggtcaccagaaaaaccaatggtcaattagagagtggggactttgcaaccctgctcctttgccaaaatgcacttcaaaacattttgcatttataactaacatttgggatttatttaatgcaaatctaatagtattcaggattagccagttataatcagactggtaagataattttcagctctttttttatatatactttaagttctgggttacgtgtgcagaacatgcagttttgttacataggtatacacgtgccatagtggtttgctgcacccatcaatccgtcacctacattaggtatttctcctaattttatccctcccctagctccccaccccctataggtccctgtgtgtgatgtccccctccctgtgtccatgtgttctcattgttcaactcctacttatgagtgagaacatgcggtgtttgattttctgatcttgtggtagtttgctgagaatgatggtttccagcttcatccatgtccctgcaaaggacatgaactcctcctttttatggctgcatagtattccatggtgtatatgtgccacattttcttaatccagtctatcattgatggacatttaggttggtttcaagtctctgctattgtgaatagtgctgcaataaacaaacatgatttacaatcctttgggtatatgcccagtaatgggattgctgggtcaaatgctatttctagttctagatccttgaggaattgccacactgtcttccacaatggttgaactaatttacactcccaccaacagtgtaaaagggttcctatttttctacaacctctccagcatctgttgtttcctgaatttttaaagatcaccattctaactggtgtgagatggtatctcattgtggttttgatttgcatttctctaacgaccagggatgatgagcattttttcatatgtctgttggtggcataaatatcttcttttgagaagtgtctgttcatgttctttgcccattttttgatggggttgtttgcttttttttttttttttttttggaaacttgtttaagttctttgtagattctggatattagcctcttgtcagatggatagattgcaaaaattttctcccattctgtaggttgcctcttcactctgatgatagtttctttgctatgcagaagctctttagtttaattagatcccgtttgtcaatttcggcttttgttgccattgcttttggtgttttagacataaagtctttgctcatgcctatgtcctgaatggtattgcccagattttcttctaggatttttatggtcctaggtcttatgtttaagtctttgatccatcttgaggtgattttcgtataaggtataaggaaggggtccagtttcagttttctgcctatggctagccagttttcccaacaccatttgttaaataaggaatcttttccccattgcttgtgtgtgtcaggtttgtcaaagatgagatggtggtagatgtgtggtgttatttctgttcctttggcccatatctctgttttggtaccagaaccatgctgttttggttactgttgccttgtagtaaagtttgaagtcaggtagcatgatgcctccagctttgttcttcttacccaggattgtcttggctatgcaggctcttttttagttccatatgaagtttaaagtagttttttccagttctgtgaagaaagtcagtggtagcttgatggggatagcattaaatctataaattactttgggcagtaaggccattttcacaatattgattcttcctatccatgagcatggaatgtttttccatatgtttgtgtcctctcatatttccttgagcagtggtttgtagttctccttgaagaggtccttcacatcccttgtaagttggattcctagatattttattctcttagtagcaattgtgaatgggagttcactcatgatttgactctctgtttgtctgttatcggtgtataggaatgcttgtgatttttgcacattgattttgtatcctgagactttgctgtagttgcttatcagcttaaggagattttaggatgagatgatggggttttctaaatatacaatcatgtcatctgcaaacagagacaatttgacttcctctcttcctattcaaatacctttattgctttctcttgccctggccagaacttccaatactatgttgaataggagtggtgagagagggcatccctgtcttgtgccagttgtcaaagggaatgcttccagtttttgcccattcagtatgatattggctgtgggtttgtcttaaatagctcttattatgttgagatacattccattaatacctggtttattgagagtttttagcatgcagggctgttgaattttgtcgaaggcctttcctgcatctgttgagataatcttgtgctttttgtcattggttctgtttacgtgatggattatgtttattgatttgcatatgttgaaccagccttgcgtcccagggatgaagcccacttgatcatggtggataagctttttgatgtgctgctggatttggtttgccagtatttcattgaggattttcacaccaatgttcatcagggatattgacctaaatttctctttttttgtgtgtctctgccaggctttggtatcaggataatgctggactcataaaatgagttggggatgattacctctttttgtattgatcagaatagtttcagaagaaatgctacaatctcctttttgtacctctggtggaattaggctgtgaatccctctggtcctggacttgttttggttggtaggctattaattattgcctcaatttcagaacctgttattggtctattcagagattcaacttcttcctggtttagtcttgggagggtgtatgtgtctaggaatttatccatttcttctagattttctagtttatttgcatagaggtgtttatagtattctttgatggtagtttgtatttctgtgggatcggtggtgatatcccctttatcattttttattgcatctgtttgattcttttcacttttcttctttattagtcttgctagtggtctatcaattttgttgatcttttcaaaaaaccagctcctggattcattgatttttttgaagttttttttttttgtgtctctatctccttcacttctgctctgatcttagttatttcctgtcttctgctagcttttgaatttgtttgttcttgcttctctagttcttttaattgtgatgttagggtgtcgattttaggtctctcctgttttctcttgtggacacttagtgctataaatttccctctatacactactttaaatgtgtcccagagattctagtacattgtgtctttgttctcattggtttcaaagaacatctttattttgccttcattttgttatttatgcagtagtcatttaggagcaggttgttctgtttccatgtagttgtgcggttttgagtgagatttttaatcctgagttctactttgattgcactgtggtctgagagacagtttgttgtgatttctattcttttacatttgctgaggagtgttttacttccaactatgtggtcgattttagaataagtgtgatgtggtgatgagaagaatgcatattctgttgatttggggagaagagtcctatagatgtctcttaggtccacttggggcagagctgagttcaaatcctggatatccttgttaattttctgtctcattgatctaatattgacagtggggtgttaaagtctcccactattattattgtgtgggagtctaagtctctttgtaggtctctaaggacttgctttatgaatctgggtgctcctgtattgggtgcatatatatttaggatagttagctctttttgttgaattgatccctttaccattatgtaatggccttctttgtctcttttgatctttgttggtttaaagtttgttttatcagagaccaggattacaactcctgctattttttgctttccatttgcttggtaaatcttcctccatccctttattttgagactatgtgtgtctttgcatgtgagatgggtcttctgaatacagcacaccaatgggtcttgactctttatctgattttccagtctgtgtattttaattggggcatttagcccatttatatttaaggttaatattgttatgtgtgaatttgatcctgtcattattatgctagctggttattttgcctgttaattgatgcagtttcttcatagcatcgatggtcattataattttggcctgtttttgcagtggctgatactggtcgttcctttccatgtttagtgcttccttcaggagctcttgtaaagcaggcctggtggtgacaaaatctctcagcatttgcttgtctataaaggattttatttctccttgacttatgaagcttagtttggctggatatgaaattatgggttaaaaattcttttccttaagaatgtttaatattggccccaactctcttctggcttgtagggtttctgcagagagatccacttagtctgatgggcttccctttgtgggtaacccgacctttctttctggctgcccttaacattttttccttcatttcaaccttggtgaatctgataattatgtgtcttggagttgctcttctcaaggagtatctttgtggtgttctctgtatttcctgaatttgaatgttggcctgccttgctaggttggggaagttctcctggataatatcctgaagagtgttttctaacttggttctgttctccctgtcagtttcaggtacaccaatcaaatgtagatttggtcttttcacatagtcccatatttcttggaggctttgttcgtttcttttcactcttttttctctaatcttgtcttctcactttatttcattaatttgatcttcaatcactgatatccttttttccgcttgattgatttggctattgaagcttatgtatgcttcacgaagttcttgtactgtggttttcagctccatctggtcatttaagctcttctctacactgtttattctagttagctattcatctaaccttttttcaaggtttttagcttccttgcgatgggttagaacatgctcctttagctcagataagtttgttattcctgaccttctgaagcctacttgtgtcaacttgtcaaactcactctccatccagttttgttcccttgctggtgaagagttgtgttcctttggaggagaagaggctttccagtttttggaattttcagcctttctgctctggtttctccccatctttgtggttttatctacctttggtctttgatgttggtggcctacagatggggttttggtgtggatgtcctttttgttgatgttgatgctattcctttctgtttgttagttttccttctaacagacaggcccctcagctgcaggtctgttcgagtttgctgaaggtccactccagaccctgttttcctgggtatcaccagcgaaggctgcagaacgacaaatattgctgcctgatcctccctctggaagcttcatctcagagtggcacccaactgtatgaggtgtctgttggcccctactggaggtgtctcccagtcaggctacacaggggtcagggacccacttgaggaggcagtctgtccgttattggagctcaaacgccatgctgggagaactactgctctcttcagagctgtcaggcagggatgtttaagtctgaagaagctgtctgctgccttttgttctgctatgccctgcccccagaggtggaatctagagaggcagtaggccttgctgagctgtggtgggctccgcccagtttgagcttccttgccactttgtttacactgtgagcatagaaccacctactcaagcatcagcaatagcggatgcccctcccccccgccaaactcctgtgtcccaggtcgatctcagactgctatgctagcagcaaccaaggctctgtggccgtgggacccaccgagccaggcatgggaggggatctcctggtctgctggttgcaaagaccatgggaaaagcacttgggcaggagggtactgctcctctaggtacagtcattcacagcttcccttggctaggaaagggaaatcccccgaccccttgtgcttcccaggtgaggcaatgtcctgccctgcttcagctcaccctccatgggctacacccactgtccaacctgtcccagtgagaagaactaggtacctcagttggaaatgcagaaatcacccttcttctgcttcgatctcgctgggagctgtagataggagctgttcctattcggccatcttggaagcaactgataatgttcttttccgattcagcttcagtttggttattaaattatgctagtttcatatgaattgggaaatttttaatgtttacatttatgaattacgatttaccagaattctctattcttaaagctagctaaaactcaggtttgaaattacctgatcctgaggcctctaacacaatagtgtattaactatctatcccaaactttttgtgacaaatgatctcttaaaattttctactacttaggccacttttgagaacttaaaatttataagagaatcctttgtgtattataggttttcaaatttattgtcaaagagttgcacgtacattttattataatattttttattttgagagcttgtttggaggtttgagcagggaaacacagctactcatatacccttaacctaagtccttctcgatcaggaatggtcatcatcttcaactgagcatgcagctttgggaaggaagcacatggagtggtgagggaggaatgggacacctgcctagccagcctgatcagcagccctggcaatcagtgggtgatggatgtcccagaaagttcaccctcacatccaccttttttattttgtatctgtgattatgtctttttgttcattccaaatgtgcaaatttttatacttttttcataatcactcctgtgatttacatatttatttcattgatcaagaagtagcttttgaatttagttcaccttttactattattttattttctgatcattaatttcagcttttttctttataactttcatttttagcttatttccttgttcagattttaattttttaagaaaagtactaccattttgtaaatgttcgtcttcttaaatagcagagataattgcaactataagtttttctttatcagtctttcatgtcttatggtgtaaatggactcattttcattactttctatttatagaaatttataatatatattttgtcactgctccacactatttatcttcagacacataaagttatggttctatattctctttttggttgatctcacctactgctatgatttaagctaccacttttaagctgatggtttccaaattttccagaagctgcaggctctgatatctaccttgcctcgtgtatataactggctcaatatgcttaaacttgtcaacgtttccccaaatcagcaataactatatatttttctcaattatttgtatcattatccacctagtcactcaagttagaaatagaaatcatctttcaactctgccttgcccctcacacccatatcctaccaaacaccaaatcctgatgactttaccttctgtataaagtttatcttctgctgttgctgccccagttttaaccctcatcatttatggtaggttatttcaaaggtgcacctttgatcaaggacttttccaacacaaaccctacacagcctacaaggctctttatattccctgctgaaaagaaaagcaactaccaacataaataacagtgtgaaccatttaatgagttattctattaatgtgcttttgtattaaaaaaagatatgtaaagcactgggtagagaaaatgactaaaatttattctctatctcctgtgagcctagtcttgtgctacggtgttatcatcttatctcatttaatattataatatgcttgtgggttgggcagttaggaatgctttcagctgcaagtatcagaaaatctcactgatggtagtgtaaatcataaagacagttcattctcttctgttacaaaagtccagaagttggtgtttccagctcaaccatgccatcgaagactcctaaactctatttttccttttgctgtacttaacacattgctttctcaaccttatgcctgtttctttgtagaagcatgagggctaatgaagctctagctttcacagggaaaagagaaaacaggtgttgctggtgtgctctctttctgagtctggccccttgacaaggaagcaaaagttcctccagaagcctccaacaggtttctatttacatctgaatggctagactaggccacctggctcctcccagttgcatgggagatgagagagcaaagacttagggtttccagtctctatggtgaatggcaatcagggagagggggaatgggagtggctaccagatgagcccaggatagagacttcacatctgcgattgtagatgtggtcaaagatgcccgaagggctactgctggtaattggtggaacgtggattgggaattaagttctgtttccaaagttaatgctgtcttctctataccactcagtctctccaaatacactttctaagaatagaatttcagatatttagacatgatttgagtgacatttcttggcacctgctgatttctccaaaatcacacaataatatgttctcagacattggatagaattatgctagaatgttctaaagatgaaaccaccctcttacttctttgatgaagccacatgtaaactgtgttccttttgtaaactgaaacattagggactatactaaacttgtcttagattgactttaaagtatagaacttaaaaagaaaccacattcaaagtatttaaacttgtatggtatgctttctctgacctttagatccccagttgggaatccttgccaaatttaatcttttagttgtgaataagcttttgaacacagtcatcctgacctttggacatgtcaccttgcctaatgaatagcttgtcacttaattaataatgatggttaaacctcctctaatatattggagaaaaaagttttaaatactcactttacagttattcatttcaacacagaattcataaggagggaaggtctgcacatgaaactttatatcttatactccttttctctttgacttaataaatgagaatccacaaggcaaaggttcaatgttttgctgctgtaaaaaagatttaaaccttttactagttactgtgtcacaattgtgaccttacaatgagaagattatgactttgggtcataagaagtggaggaagtacatatataaacagtaaaaacataaatgtgtactaattctgacctcattggaaatcattctttcctaacagtaattttcagttccacctgctgaaactcattttctataaaaatgaagccacaggcaacttaatagtcaaggttacaataaaaaggggtctcaaaaacatgtcattggtgaacaatttttttttgcaaatctcaaatctttttcttttgaagctaaccaatcttgaccattaaaatggactaaaaagacctgcatccaccatcaaagactggatgatcaagaacattcatgtcactctcttagcaccattaggttaaaaattgctatattgtttccagacttcctgatagttttaatgatgtcttcatttttcttttaaatgtagacagccaattttcctatgatgggagcatattactactggcgaaataagacatcttgcatagaaatgtttgatgtctttgaacaagggacagccatttctttacacagtcttcccaaaagcatttgaaagacttgcatttctgctgctacatgagttttcagaaaagaaaaaatgttagcaaaaacaattatgtatatttataacaatatagattagatgtatatatgtaatcttgagaccctctgtaatttatgttcatagataaaagaaatacatcacagaggcaaaccctcaacattcttcaaatttagtttatgctacaacaagtgttgctatagaaacattaaatccccaacagaattcctggaagttaaagatctgcctgtagacttgcttccagatgctgacttgctggcttgttaaataaaacttggcatttatcatatgggagattttatctcgaaacatactatgaggactacctgggacattgagtgccgtgctcacaatgggagaagggtttatataatcagaaggagtctcaggacttcagatgtaatgcctattagcctgatcatttttcctctttctccatcaatattccctataaataagcagctctaaaataggaaactccctaaatgaccagatgatggaaaatcactttattaataaaaatttttcatctgtgttaagcaggttaagtctttctggataccagtgagaaaatcacgttttcctatagacattttgcagcttctctttaagagcaatttccccctggtaattatacagcagtttgctctcagaaaacagactgattaatgaggaagcagctaaatgagttctttaaaaatgtctaaaaatgttcttgcttctgcttttctaatcttcctcaaccaaattgacagctttttaaaagaatctccttagtgaatgcatgacaattacattggaactcaaagaattaccacaagccttagtttaagaagacattttaaatcataagagtattcattaaaaggccatctgtcagatgttctccatcactgacatcacccacatctctaccttcttctcttcctgttattttaacctcatttgacttttttgactgctttggaagaaaatcagcctttcttggccaggtgcagtggctaatgcctgtaattccagcattttgggaggccaaggtgagaggatcacttgagatcaggagtttgaggctgcagtgagctatagtcactccactgtactcctgcctaggcaacagagtgagactctgtcagaaagaagaagaagagaagaggagaggggaggggagggggagggagggagagagggagtaaggaaggaaggaaggaatgaaggaaggaaggaaggaaggaaaaagaaagagagagaaagaaggaaagaaagagagagggaaagaaagagagaaagaaggaaagagagagagaaagagagagaaagaagaaagaaagaaaagaaagaaagagagaaagaaagaaaaagaaaagaaaagaatagagaaagaagagaagaggctgggcacagtggctaacacctgtaaacccagcactttgggaggccgaggcgggtggatcacctgaggtcaggagttcaagaccagcctggccaacatgaagaaattccatctctactagaaaatacaaaaattagccaggcatggtggcaggcacctgtagttccagctacttgggaggctgagacaggagaatcacttgaacctgggagatggaggttgcagtgagctgagatggcaccactgcactccagtctaggcaacagagtgagactccaagaaagaaagaaagaaggaaagaaagagagagaggggaaggaaggaaggaaggagagagagagaaagaaagaaagaagagaaagaaaaagaaagaagaaagatgaaagaaaggagaaagagaaaggagaaagataaaaagagagaaagaaagaaagagagagggagagagggagggaggaaggaaggaaggaagagagagagaggaaagaaagaaagaaagaaagaaagaaagaaagaaagaaagaaagaaagaaagagaaagaaagaaagaaaagaaagaataaaacttgcctatctccattgggccatttgtcctcaggctgtgagctcagccttccactgagatgacttcctgccttgccagccagggctcattagtcacatttccacatttccggtttttttgttttttttttttttttgaaacagagtctttcttgttctgtcacccaggctggagtgcaatggcacgatcttgactctctgcaacatctgcctcccgggttcaagtgattctccctgcctcagcctcttgagtagctgggattacaggcgcctgccaccatgttcggctaaattttttctttttttttttttttttttctttttggagatggagtctcgctctgtcgctcagtctgaagtgcagtggtgcgatctcggctcactgcaacctctgcctcctgggttcaagcgattctcctgccttagcctccctagtagctgagactacaggcgcatgccaccaggcctggctaatttttttgtattttagcagagattgggtttcaccgtgtttcccaggctggtctcgaactcctgagcttaggcaatctgcctgccttggcctcgcaaagtgctgggaggcgtaagccactgtgcccggccaatttccaactctttttttttttttttttttgagacagactctcgctctgtcacccaggttggagtgcagtggtgcgttctccgctcactgcaagctctgcctcccgggttcatgccattctcctgcctcagcctcccgagtagctgggactacaggcacctgccaccacgcccggctaatttttttttgtatttttagtagagacggggtttcaccgtgttagccaggatggtctcgatctcctgacctcgtgatccacctgcctcggcctcccaaagtgctgggattacaggcgtgagccaccgtgtccagccccaatttccaacttttaataaatgtatataaatatagtagaaagtaatttatcttgtggcccttaaaagggtggttggggtagggggaagcccactccttaagtatgagctgtacatagtgacttccttccaaagagtacagtatgggaaggaggaacaaaagagtcattttacagtggagacagctgataaatatgacctcagccaggtgatcatggccaacattggcagtcataaatcatgttaatagtttgcacctttgctatgatgtgaagaaaactgcacttcacctctgatcttccccaaaatccataactcaagtctaatcatgaaaaaaaatcagacaaatctcaaggagacatctcatgatatatctgaccaatattcgattgtccagatccttaaaaacaaaagtctgagaaactgtcacagccaagaagtgcccaaggaaaattgataattaaatataatgtggtaccctggatgggatcctagggcagtagaaggacatcatgtaaaaattttatttatttatttatttagttttgagacagggtctcactctgttgctaaggctggagtgcagtggtgtgagcacagctcacggtagcctcagcctcccagagtcaggtgatcctcccacctcagcctcccaagtacctggtagtacaggcacatgccaccatgcctggctaattttttaaataatttgtagatatagggtctcccaatgttgccctggctggtttcaaactcctggtctcaagcaatcttcccacctcagcctcccaaaatgttgggattacaggtctgagccaccatgtctggcctaaaactttaaaaatctgagtaaactatggactttagttaataataataatgtatcaatattagtttattaattgtaacaaatataccatactaatataagatgttaataatagaggagactgtgtgtgggtgggggaactgtttagggcaactctgtacttatctgctcaatttttatgtaaatctaaaacttaaaaaagaaaactctattaataacaaaaaaggaagaagtggatgaaggggttcaaagtattccacctgaaatatgccatgctgatataaagataattttgagctaaaggaaagtgagaagctgcaaataactctctggtctcctcttctctgcaagaaacagcagaatttttaaccaccaaagacactctagactcagcagcacagagatggcaccagaggaatctacatagcaaaccttgctaaaacaatccttatccgtctccatgagttttccaatatattgaccttcccatggttggccacacctaaaggcctaaactccttctcccttgtcacttctctacaaatttattgctctttgttaagatgctatataagccccagttaaccatgcctttgagttactcattgatgtggtttggctctgtgtccccacccaaatctcatgtcaaattgtgatccccacatgtcggggtaggggcctggtgggaggtgattgaatcatggggtcagacactcacttctcatgatagtgagtgagttctcgtgagatctggttgtttgaaagtgtgtagcacatcccccttcaccctctctgtctcctcctctgccatagaaagatgtgccttgtttccctgtcaccttctgccataattgtaagtttcctgaggcctctcagtcatgcttcatgttaagtctgtggaactgtgagtcaattaaacatctttttttcataaatgacccagtctccagtagttctttatagcaatgtgaaaacagactaatacaaaaaactggtgttaggagagtggggcactgctataaagatacccgaaaatgtggaagtgactttggaactgggtaatgagcacaggttggaacagtttggagggctcaaaaaaagacaggaaaatgtgggaaagtttggaacttcctagatacctgttgaatggttttgaccaaaatgctgatggtggtatgtaaaatgaagtcctggctgaggtggtctcagatggagatgagaaatttattgggaactggagtaaaggtcactcttcctatgctttagcaaaaagactggcagcattttgcctcttccctagagaactgtggaacattgaacttgagaaagatgatttagggtatctggcagaagaaatttctaagcagaaaagcattgaagatgtaacgtggctgtttctaaaagtgtatacttacatgtgtgaagaaagagatggtctgaaattggaatttatatttaaaagggaagcagagtataaaagtttggaaaatttgcagcccaaccatgcagtagaaaagaagaacccactttctggggagaaattcaagctgggtgcagacatttgcataagtagtgaggaactaaatgttaatacccaagacaagggggaaaatatctccagggcatttcagagatcttcatggcagcccctgccatcacaggcccagaggcctaggaggaaaaaatggttttgtgggccaggctcagagccctgctgctctattcaggctcgggacatggcgccctgcatttcagctacttcagctctagccatggctacaaggggccaaggtacagtttgggccattgcttcagagggtgcaagccccaactcttggtggcttccatgtggtgttgggcctgtgggtgcacagaaggcaagagttgaggtttggggacctctgcctagatttcagaggatgtatggaaatgcctggatgtccaggcagacatctactgcaggggtggagccctcatagagaacctctactagggcagtgcagaggggaaatgtggggtcagagcctccacacagagtccctactgggaaactgcatagtgggtctgtgagaagagggccactatcctccagaccccagaatggtagatccactgacagcttgcactgtgcaactggaaaagccacaggcactcaatgccagcctgtgaaagcagccacaggggctgttccctgcagagccacaggggcagagctgcccaaggccttgggagctcacctcttgtgtcatcgtgccctggatatgagacatggagtcaaagaagttttttttttggaacttgaagatttgatgactgccctgctgggttttgaacttgcatggggcctgtagcccctttgtttaggtcaatttctccctcttgcaatgggagcatttacccaatgcctttacccccattgtgtcttggaagtaactaacttgttttttattttacaggctcataggcagaaggaactggccttgtctcagatgagactttggacttggacttttgagttaatgctggaatgaattaagactttggggaactgttagaaaggcatgattggttttgaagtgtgagaagggcatgagacttgggaggggccaggagcagaatgatatggtttggctctgtgtctccacccaaatctcatgcagaattgtaatcccctggtgttgggggagaggcctgctaggaggttattgaatcatgggggcatactacttcccccttgctgttcttgtgatagtgagtgagttctcatgagatctggttcttcgaaagtgtgtggcacttcccccttcactctttctccccctcatcctccaccatgggaagatgtaccttgcttccccttcaccttctgccatgattgtaagtttcctgatgcctgctagccatgcttcctgttaagcctgcagtcaattaaacctcttttcttcataaattacccagtctcaggtagttctttatagcagtgtgaaaaaggactaatacactaatcactgagtttctcccaagtatatgtcatgctgcatgtgttaataaatttctgtttgtttttctcttattcatctgtcttttgttagtttaatttgaagggcctcagttggagaacctaggagggtggaagtaaaagcttttttctcccctatgtgggaaagactgaggaacatgtgtagctaattaggtatacaaagcttggtatttgctgccattgaatttgggagcaaaggtggacccccatatgggaaggatataaggcacaaagcccccacagggtagccggcctggttgaagtagcctggattcagtgagtacaggacctatgcttccttcatgtccataacttcatgccaagctcagcatcttcaacatgagcactgatattcatcaagtatccactatgggcctgatactgcactaagcactttaggtacgttatctcaaatggtcttcatcttagtctgtttacattgttataaaggcatacctgatgctgggcaatttatgaagaaaagaggtttatttggctcatgattctgcaggctgtacaagaagcttggcactagaatctgcttctggttagggcctcaggctgctcccactcatagcagaagacaaaggggagccagcaagtacagaggatcacaagggaagaaaggaagcaagagagtggagatgtgccaggctccttttaacaaccagttctcatgggagctaatagaatgagaactcactcattcccctcccaggcagggcattaatctattcatgagagatctacccccatgacccaaacatctcccattaacccccacctccaacactgaaggtcaaatttcaacatgagctttggaagcctcaaacaaactatagcaaactataacccaattgtacacacgagggaaactgagggaacaaagtagtttacccaaggaaacacagctagtaaatgacagagccaggacttgaacccaggcagtctgacttcctagtatcatcctgtgtaccaccacaagcagatactaaatacatactggcagtatgacatgattttctgctcttacaggttacatttcaagtttgaatcactggttttaaacatctgaaattctcaagctgtgtttggcagacccagttgatccttagctttggagatttatggttcttggattggcatatggcggagccacctaagagtccatgacatgtagcaatttataatactattgagacacgaaccagaatcaccttcctgtgaggctggtttaacagcagttatttgttttgagcactctcagaggtaacccctgcagaagctggatggccaggtccaacctctttggctgcagcatgtccagcagctcagcatgctaacagagggttactccttagtgggaggacttgggagtgataccaatgacaatcttgtatgtggatttcttaccttgatgtctaattggcagccctacagtattgactggacatgtgattaaatagggatcactctatttgaacatatcactaaatgcgtttcctgtatgcttagacaagattgtttacccaggacagtcccagcttacaactattgtccccacataattatcaatagagtcctctgtcactctcaaaagtgctccagtttgaacagtgacttgtacagcctccatatttataacacaaacagttgtctgctactcccaagctaaaacctctagagaccacactaactgtgattgtagaatatcagtgacagctgggactcctgttcctagaggtttggtagagtgagttcatctggaaaaaaaaaaggtgattgtgaaagaaaccatgattttcagaagtgtgattattcattcattccaaatgggaactattttgcaactttcataaatttcaactacattttatgcactaaatggtgaaactgctgcaaaaaccacacgtgttttaaaataaatatacatgtgactatcacctgagttccaaagccagacagttgcctttaaggtgtgacagatggcatcatcctctaggaggacagtcagcatgatcacatgtgatgccacactgagcatcagggcatcaatagctatcctgttggaacagggcctggagcaagaaatgcaatagttcaaccataattgtcttgtcattgaaaatctttttgtagttctcgcccttgacatacatcatgaacttcttttcaggtccgatataccttgtcatacactgagtgtacaaaatgtgacagtgctgccacatcacctgtcatcatagaactcttctataatgcttttacatttctctctctctctttttttttttttttagatggggtctcactctgtcacccaggctggagtgcagtggcacaatctctgctcactgcaacctctgcctcccaggttcaagcaattctctgcctcagcctcctgagtagctgggattacaggcacccaccaccaagcctggctaatttttgtatttttaatagagatggggtttcaccatcttggccaggctggtcttgaactcttgagctcgtgatccacccgcctcggcctcccaaagtgctgggattacaggcgtgagccaccgcacccggccacatttctcttctatctatgttgttttgttgttgttgccttgtccgtttccttaccatttgtgaggtcaacacattcactgaaaaatatgggatttcacttccaaaaccttctaaggtaagtatcagctattgattcctattattttctttctctcaagaattctgatttgttgcaaaattttctctcatgttcacaaatttgtagtaacctccaaaaatccaaatatgaccttgattctaagcttcaattaaggctgttgatgaaatgtggtctcctgtctggaagaagctactcttagggactgtagtgagaaattttaaaatatagaacaaaccaattactggagatggatgatgatgatggttgcaaaataatgggcacatagttaatgccactgaattatgcacttaaaatggttacaatgggaaattttatgtcatgtatattttaccagtgttaaaaaaaaatagagagaatacatcagtcagaagcattcggggacaaaatccatgaatatgtatgcagatgtgtgtagatgctacagggcttggctgacaaaaaaaaaagcaaccaagaattagagacgagcaaagcttcctggagaatgtttgcccattgttggatggtctgaacatgcagcgaactttcataaggacagatatggatgatgccttactcaccagagcacacaagtgactgcataaaggctgtccaggagctgcaaaagaccgaagtggaacagcagcatcctaaaagtgaaattggtggtgaacacatttatttgttcattaaatacttattgcactcactaccatatttcatcaaatctaatataatacaaactattaagttagttataaagcatgtgtgtttattagatgattttctatttcttgggtatctaaaatacttagctatttaaaagctctaacatcatcacaagtaccttaagtactggtatgatgtaaacatactttattcccatagattaaaaaaaatggtgcatagaagatcacaaagacaagaaaataaacagaagctctggctacagaacagagaacaactgaaaggggactcggggagaccagtgagaagatggccattgggcttagtatgaaatgataatggtggtcgcttccatgtgctttgtgttgatgctggaaatgaagagaagatatatctaagaataagctagaagaaaaaaaaaagacaattttgtggtgacacatcacaacttaagctgctatttgccagatggaagggaacactttctcccctctgcctacatttcttcacctcttctcccagaggagcagagaggaatctgattgatcatgtttcatgacagtgattgggtcacacttgtttacttgtgtgttgaaaggccacctgtccaggtgtggagaggatggagtaagatcacttgggtttgtagcttgccactgccatttgcatgtcatgtgacattgggcaagttatttagtctagtgaagcttctggtttttcattataaaaaaataaaaataaaaatttctacttcggccaggcgcggtggctcacacctgtaatcccagcactttgggaggccaaggcggaaagatcacgaggtcaggagatcgagaccatcctggctaacacggtgaaaccccgtctctaataaaaatacaaaaaattggccgggtgtggttgcgggtgcctgtagtcccagctacttgggaggctgaggcaggagaatggcacgaacctcggaggtggagcttgcagtgagctgagatcacaccactgcactccagcctgggcgacagagccagacttcatctcaaataataataataataataataataataatagtttctacttcaaaacttagttgtagattaaataatagtatctatataggtgcttagcctagcacctggcacatagtattcatctaaaaaatgctagttcttgttattatcccatgccatcagcagacccatcttgctcactctcttttattctgtttccttatgtacccaagtgtgcaccttatttcctatttcataacccataattaggattaggtttagagaaatagaggcatacacctagctttcattctaatcaggttgctccagcccagctttgaccaaggctctctagctagagtatcagcaactgtccttgataaaaatgaagtaacatttaattatcatttgtttaattagcacactgcctcttgccagtatagcttcattaagaactttatgggaaatatgtacacctactatgtacccacaaaaattattaaaaattgaaaaaaatgaacttcatgggatggagtagagttagaaggacaaggattcctagatctctggcctaatattatctgttcaacatgatttgaacatatactatgtgcttgtcattgttctaggtcctgggatttagctgagacaagacagattttatcactcatactccttacttgatctttcatatatatcttattatagtccttgtcatattaggcaataattatttgttttcttgtctgtctccctctgctaagccattgagtcctgaagggcaggtactctaacttccttcaatgtcacctaagagtgggaaagatgtaggtatagaactatcaaggaagaactggctctcatccttgcttttcctgtctttttcctccctgtgttgtgatctcagtaattccttcaggtctgtcttctacattactgattctcatttcagctgtgtctaatctgctgttaactcatccattgagggtttaatcttagcaattttgtttttctattccagaaatcctatttgagtcttctttaaatcttcctagtcttttttgatagtgtcatgtaaagaaacatgacactatctttctttcttgtgttcttgtttcttgtgttttcaattccatattttattttaacattttaaatataattaatttctatattttataatgattatcatttcattgcctgatgttcttgaggaaaggatgtgggccacctcctacttttcgtttctgctgatactggcttgcttttatgtgtttgcaattttggattgtgagcacaaatttaattgagctttatccgtgggtcacttctgaagcttggattgaaagtttatctattcaggaaggattattttctcctctgctaaatgcctgggagcattataaacctgagtttactttatattaatttattgctttggaatttccaggcctatgcaaatagtgcaagtttaaattatgtgctaacatgcctttggtcactaattttgagggaatatttttattcattcagaaccttggccaagacaaacacgtttatttctcattttccattatgggacaaatttttcctacccctgtctttcactgagtgtgtacctttaagagttccagatttctatggcattctcaattcgtttcccactttttgcaggactaagatctttcagtccccatagagtcactgaaaccctgtttcttggttatgaaattgggaaatagcttccgagcttaagttttcagcttaagttttgggcactccagaatttctcctactttttttcactatcacctttccatttgagaatatgtttatgatattttttccaatttttccaagtgtgttgtaatgaaagggctttcaaattaccaccatattgcagataatggaggttaataatgtaatcagagaagtatagaagttttgttattgctgcctttgtggaatttacaatcttctgggcatttatttggaactatctctagaaagatacaaaggaatattttcaaacagtcagatcctacagatactgctcagttggaacaaacgtgatgaatttcactgctctttcaatcccagcattacaggcatgagtattgttactgtcatgtggggttaggcggatacaacaccacacccagctgaacagcaagaatttagtgaagttcatctgaaagttggaacaagaaaaccacctaagagaaagacttttgagtaatggaggagagactttcaaataccgtttagaccaggatatgtttatttcccaaccaaaatagggaaatgctatcgaaccttcacatcactgggagggcatcagataaggaatgttttccacaaaggggttgcctgaccaactacctcagaatcatctcaaaagtttgtttgaaaaagcagatttctgaatttcactcttggatattctgattcagtagtctcaggtggaatctgaaaatctgcatttttaaccaggaccctggtgtctcttacgtacactgaggtgggagaagctttaatgtagggtatgttttaatttgaaaagagtctgttgccataattttaggggctcactgagttatgcagcaggaataaaaatgccaaaggaaaatctgcttcagctcatgagattgagtctctaagtctctgctgctttgagccactgtcgagacagatagagagagacaaagacaggctgatagacagacagaaagctctctgtagttaaaccagcagccttgacccaaatacatgcctatctggactcccatgacatcatgcttggatgactgtagaatgcagaagtgtctgaaaaagagagaaatagatccaagaccctaaaagaagaagagtttctagagccagaaagaaactgaaacttcactccaggccctcctggagagaatctttcacaattgtaattcaggaagggattggtaattactgccagaatcacactgtatataaagacatgtgttacttgctgtctatagtatataacatattttatttaaccattacttaattatatacatttcttcccatattgtgggtttaattcttatccctaagttaagtctttgtaaagcccaagttaaaagaataccttctagaaagtttatatagagacactggaatcacagtcctgctgctcagagcaggtatgtggtacacatgtactaaaatggtgaccaaacagggacccctggggcactagtaggaaaaaacactacctaatatggtgtgagtgtgtgtggcttggcaggagtgacccataatcaataggattaggcagaggatttggctcagaaaatataattgcaagtgcaatggtcctttaaggaatgccattaaggtaaaatattttaaagaataccatccacttggaatagttttggggaaagaatttaaaggaatttcaaatgaagaaccttgctgtgattgttgctttaagcaccatttttggtttacaaattacatgccattttacagacaaccaaagaaacatgatccaactgtattattcttttaccccatgttttcacagttccatatggttaacatcagttgggtggtttctttagaaacaattaaaaatcttgccagacacacaagaagaaaccatgtgagcatgttttctgcttgctggtgacattttatcccctccctatcccttttgtctttaaagaattactcagtctgctggagtaggatcccttaaaggctgggaaatgacagtcccttcttaccacaatccaacttaggtctttaggcaaacaataatgcagaaggacatctgttttgtttctgtggctcccaaatgacagtattagaaaatgaagccagtatgaaaaatgctcaaaatgcagtacaccatcaagggaaaggaattgactataaatcaatagaattttgaatagaaatttgaatagaacctccaaatagaacccattttggagtttgcattgataaggatagtctacgttttgctgcagtaatatctacccccaaatcttagtggcttatgatcacaaaggttcatttatccctcatgctgtcagctggggtggggatgagcccaggtcactgccaaagtcattgctctgagactcaggctgaaagagatggaaccatctggaaagctatcaatcgacatggcagaggggaaaaagaaagtgctaggtttgctgcatacactgtcttattcaacctttctgacatccaatgagataagtagtaatatccctatgttatagataaggaaacaagctaagagttgttaaagaacttattcaagtaccacctagtgaatggcaaagagagaattcaattctaggtctgtctgaatgtggcaggcagactctaaaatggcctgcaataatactggtattcaggtcctcatgtaatctgctccccttgagtgttgactggacccagtaacttgcttgtaatgagtagcatatggcaaaagtgatggaatgttgcttctgagattaggttacgagagatagtaatttccaccctgctagcagaatctctttattgacatgctcccttgctagctttgatgaagcaagttgccaggtttgatgaacctacttggcaagggactgagcgaaacctttgtccacagccctaaatgaatggaatcctgccaacaaccatgtaagtgagcttggaagctgatcattccccagctgagctttcagatgagccccagccctgtttgacacctggattgtggcctcgtgagagactttgaagtagatgacccatctaagccatggttagatttctaacacagagaagctatgaaataataaatgtatgttgttttaagccactaagtttttagtggttcgttacacagcaatagataatacactgactacagagtccatactcttcccactaaattagttagcctcttttttgcagaaaacttgttccttatcccacattctttgttatggtttgtggcattctatacatcaacactcttaagccataagcttgaaagtcatcctagatcccacctcttctctcattttcacacaaaaagagttatcaaattttatgaacactggattctataatctcaaaactctattgtgtcctctccaatctctctgtttaagtcaggcctcggtggtctttgcctggactgtttccatagctcctgtctccctgcatccagacttgctccactccagtccattctcacacccatcactgtctcccacattgcttccagtgtaggtctacactgtatagcatcttagtatgatattgtcatctggtgatattttgctccagactccctgttgcctccagaaacttcttcccattcaggccccaggttaattgctccatttactgcttcatggaaaggttgttgatgcagaaacagaaaagtaaaatcatgaaaacctcagcttttacatattaagattgggtaaaagcctggaaggactgagggcatatatttcatgccatgtaatttttgaaggatgtatgatcagtcgcaatgttttcctcacctgagacttgaccaaggttctgtgagctggggcacaagaaggatgcaaggagaacatgagacctagatatatgtgtccctgagaagaggttttgcttcccgaccacatgccccatcccagtcttggggagaggaacgacagaaaccataggtgggtttcggagatcagagaatggagaaagacctgcacctggcttctggggccaagaggaaaaagaaagtgcagggaaaacctggcagagttccctggtactctgtgaggctcggctgtagcattagagacccagctaagtggggcgcctaggcagacaggtggccatctgagtagactctcaatgggaggccagatgagaaggagggtatattagtgaatgctagcatagacaggtggggatgaaggaccagctccttcccctcttctgaccctctgtcaatactttagcatgttggaagcccccagctggacacaactaagggactggaaaaaggtctttaattaatggagacttagcatccattgctggacagatgagagatcagaaacacaggtttcaccctctcaccaagtttccctctaaaactctttctatgcttcccccacttgaagagaaagcatttgagaaactaaatgtcatcctaaaagtttggtacattgaataggaaagtgattttttagtagtagtagtagtagtattttgagacagagtcttgctctgtcacccaggctggagtgcagtggcacgatctcagctcactgaaacctcgcctcccgagttcaagtgattctcctgcctcagcttcctaagtagctgggactacaggcgtgtgcaaccacacctggttaattttcgtatttttagtagagacagggtttcaccatgttggccaggctggtctcgaactcctgacttcaggtaatccacccgcctcagcctcccaaagtgctgggattacaggcgtgagccactgcgtctgtccacatgattcttaataactatgagattacacaagatctcagtaacagaatcaccaccaaggttgagcccacacacccttgtctcctctggccctttccacagtatcactgtctaattttccatcaagttttctctaccacatcccttccctgcctgctcatcctttgacattgaggactttctccatgaattctactccactagatctgcagagtcgtggaaagaagcatatccatgaaactatttgtgatcacactctacttgtcactcctatttggtataacggtcaggagatgaaagggacacttatggtttccttctatttctctttttacccctcactataaatctctctgttgcccatgctgtgactggcaagcatgatctcccctggacagcaaccccaactcctaggctgccggtggacttctgtaagagtctagaatcttagggagctggagtgaaattttctggattggggaagttgaaatgacaacctttggggacttgtatctattggtgtttgagtgtgattacatgtccaaaggcaagggacagaagagcttttgggcttgtaaaaaatagacaagtagaacaaaaacaatccagataattactctttcagaacttaattgactgggtgtgatggctcatgcctgtaatcccagcactttgggaggctgagccaggaggattgcttgagcccaggagtttgacaccagcctagacaacatagcaagagttcaactctacaaataataaagaagttagctgggcatgatggggcatgcctgtggtcccagctacctgggagactgaggtgggagagcctgtggggtcgaggctgcagtgagacatgattgcaccactgcactccagcctgggcgaaagagcaagaccctgtctcaaaaacaaaacaaaacagaaaaacttaattgccaattctcctaacccctccatccaatgtagacagggactctccatagaagaagagaatgacagaaacactgattcttcacaacatgatcaacaagcacagtgagtttcagtgagacattcaatgcttggtcttttgatctggtcctaacaaatatttagaaatgcttgtgcgatgataaatctgggatcacagaggaaaccatggagaataaaaaaaaaacacaggtttgttgttgtataaatgtgctctgtgtgtgtgtgtgtgtgtgtgtgtgtgtgtgtgtgtgtgctgtccccgtgagctaaggaaatctaaccgacatgtcagcctcgggtgcaaggtaacttactgttgtttttgtttcttcctgtcatgaaactgatttcctttttcctctcccctcccatctgttgaatctcctccacttcaaggcaaatacaaactttcctctccacattctcaaccagttttcactcatttcttctagtctctctctcttctttctcatcacttttgggggaatgaaacaatccttcctcactccatccccggccattaaaccatacacactgtgccctgtaaggaagggcacaaaaggaggagggcctgcacggggctcttaaaagcaaggccaccccagtatggtcttgggaggactgcatcatcataatccaggagctccttagaagtgcaaaatcccaggccccaccccacacgaactgaatctgaatctttggaagtagcggggcgaacgtcaagtatctggggtgggcgtcaagtatctggggtgggcgtcaagtatctggggtgggcgccaagtatctgggtgggtgtttttgcaaagctctcccaagttcctttgcatgcgaaagtttgagcatcactgctataaagcttgggtcctagaacagggaccctcctccttttgtacccttgcttacagggtacagtgtctacggtttaagagcctgttacccatccacagcctagactcctccccttcatctagaattctagccaagatggagtcagttatgttggagttttctcactgtgataattttgcaaaggcagttttagtttccccatatgtaaattgacggtacctcactgggttttgtgatgaataaatgagttgcatagatagagcacaaaaaaacagtgtgtggaaaatttaaaaaaacagtcttagtgtttatcttgcttttatctccttcaggttgcaaggacagaaatgatttatctccccctctgcgacatgttgcctcttacaagtccggaagcaacatccagctcctctgttgcttctgtgaatgaaaatcaatttctaatttaggacacttttggcatcagtaccttctcattttcccctctgtcagggtattactatgaactaaggatttatatagcaattttcatctgagggagctccatttttttttaacagagtgaatttattaaatcaccactaaccatcataatagcccttcagatggggcagatgcattcatttattgcatttacttattctgaacatcaaattgtagtagccttcaggagcctctactcaagctgggaagaaacaccatggagttcaggaaaactggaaagaccatgcttgtcttttaggtataagaattagggaacccagttgaatggtcccttttggggaacagggaaaaggggtttgtttcagcttcctcaatctctttctggaccacaaactccttcggaatggaactggtcaattccaaaaaggattgtccctggaatagaattacaagtccctggtcccagttcaatcagtctggatgagcatgattttgctattgtaacaaagagcaccccaattctaagtgttttaaaacaacaaaggttcatttccagctcatgccacagttccagcatgtattgccagtgttctctgccccacggcatcccactctaggactcaggctgatgtctccagactggcagccaaagaaagagaacatggaaaaattgcaaaacagcccttaaacgtttttgccaaaaaagtgaccaacctcacctctgctcattttttgttggccagaccacatctcacaccacagaatctgtccctcccatgtgcccaaagtgaaggggaactggatagatatcagatatcgatgaacatagtaatgtttatcactctaattagctttggctgctttactaacttggttctgatttatttgcttccctgttagcatttggaacatgatgtaatttccttccacttcacctctctcctaacttgacaacatccctaatattctctgaaatctgtgcatgggaactaagctcctcagcagtacaatttttttccctgaaatctaaggctttctgcaaagaggcaccttcagtgttgtcaagattaagtttgtttttcctcctgagttttccacctcacccagcccccacccaggtctagttgtaaaatgtatctgcatgttttaaaagctcattatgtaaatgtatcagagtccttatccatcaacagataatttaaaagactctatacatatttatgagttcgcttaatatggctttaatgaggaggtttactagaaataccaaatcaaggaggcaagaagaaaaacgatcacaaagatgagcatgagttttcagccgttcttggtagttctgagagctgtcagaacattcaaagagctgccagaactgaggcttcctgttagcctaccgtatatggtaaaaagcagctggggaaagaggtaagtcatgtcgctcaatatttctttgaatctaaggctaaacttttttggtttgtttcaaactgaagatatttgatgagccaaagtctcatgtttccaccacctctagaagcaaagtcactgtgggagatggtcaaaagtctgacatagcccccagcaatgtcaaatacattcagagagagagtcacaactctagcccatgtggctccattgtggtaattagatagaggtgcttcctaggcgatgaggaaaacttgtgtctccctccagcagacaaagctctaaaggtacttggcttggtgaggagaaggtgacagagaggtaggtaccccttattccaggtggataaagtcagtgaatgaagcctagtgccaggacaagcagctaggtgagtgggacgtgggctagaatttagccttcatgtgccctgacagccaggcacattagtttagtgcataatctgcatagtggcagtcctgtcagaaactcatgagttctcaccaacagctggtcaaagtctgtaggaacagaagacttttcctcattctaccaactactctctcttgtttacccaaatgtctgctcaaccccacctctggggcctcttaattgcacctctcttcattatttacacacattttattggccagacctcagtcacatggcaccaccaaagtccagagaaaaatgggaagtgttggctcactgagtgaccagaaagaaaaggaaatcaggtttgatgatcacatagcattgtcattgtctgccacaatttacctatctgatcaccaaacattcatttcactcctttcccctcatatagaacacatgcatcccaaatgagacaccctatttttagggtcttttgaccatgtagatactacaatcatctcaaagtccaggatctcagggatgttgtacagtcctccccattgggtccagattggctccctgtgatctggtgacttgtgaactagaagacaagttatctgcccaccccaccccctacacactggtggattagaaagaggatatccaaaattaaaactcccattcagtcaagggaaccaaaaaagaagctgtctttgcccatagcaattctgaaatcctggctgtgggggaagttccttgatttgacctaatgctggactctaggaagcactgccttgtgtgtcactctcctttgcatgtccaagctggaatgctgactagtgtgttctcttgggaagctccaccgctatgggaccctggttcctcctggagcaagtttagaggtctaaggttattttgcaagttcaatagttgaaggcttttttttttcttttaaattcacgcttgtcagttcttggcttaaacatagtacatacccaaaggaatataaatcattctattacaaagatacctgcaagcatatgttcatcacggcactattcatgatagcaaagatatggaatcaacctaaatgcccattgacaacagactggataaagaaaatgtggtacatatacaccatggaatactatgcagccataaaaaagaatgatatcatgtcctttgcagggacatggatgaagctggaagccattatcctcagcaaacaaatgcaggaacagaaaatcaaacactacatgttctcacttataagtgggagctgaacaatgagaaaacatggacacagggaggggaacaacactggcgcctgttgggggtggggttggggagggatagcattagaaaaaatagctaatgcatgctgggcttaataactaggtgatgggttgataggtgcagcaaaccaccatggcacatgtgtacctatgtaacaaacctgcacatcctgcacatgtaccccagaacttaaaataaaaataaaaaataataaagtgtatagttcaatggcttttagtgtactcacaaatctgtgcaaccgtcaccacaatttattttagaacattgctatcatcccctaaaagaaactctatgcccttagctgtcactccccaattcctcctctgtcccctatcctagcccaaggcaatcacaaatctatttctgtctctgcagattttcctattctggatattacaaacaaatggaattatacatgtggccctttgtgactggtttctctcacttggcataatttttaaagattcatcaatataatagtagcatgtatcagtactttatttctttttgtgcccaaataatattccattgtatggatataccacattttatttttccattcattagacagtgtacatttgggttgttcccactgttaactattatgaacaatgctgctatgaatactcgtatacaaggccatgagtggtggcccatgcctgtaatcccagcactttgggaggccgagacaggcagatcacttgagtttaggagtttgagaaaagctgggcaacatggcaaaaccccatctctacaaaaaatacaaaaattagctgggcgtggtggcatgtgcctgtagtttcaactacttgggaggctgaggtaggaggatcacttgagcccaggaggcagaggttgcagtgagccttgatcgtgccactgcactccagcctgggtaatagagcaagaatttgtctcaaaacaaaaacaaaaacaaaaacatgtacaagattttctgtggacatgttttcatttatcttggccatatgcttatgtatggaattgctggatcatgtggtaatctatgcccaactttttgagaaactactagacaattttccacagtggctgcaccattttacattcccgccagctgtgtatgagcattccaatttttccacatcctcaccaacacatgttattacctgtctttttattatagccatctcagtgggtgtgcagtggaatcccactgtggttttcatttgcatttccctggtcgctaatgcaagcccttcttatgctcactaagaactcactatctgacgaactctgggcaaattatttaacttttctgtgcctctgtttcttcatctggaaaatgatgataatagtattctctacctcatagggttgttgtggtgattaaatgggtaatttgtgtgacctgtgcctgacacagtgcaagtcctcactagatgttagctcctgtttatagaagaacagcactggaaatttgagccacctgtttctgtgagttacatcttaaccactgacaagaccccagttcctgatgaaaaatagaaagtttcgcaggcttagatttttagaaacaaaatagacactagttctgacatcccaagcccatcaaaaagtgtttatgatacataatgaaagttgagacttattccagcacagatttggataaatgggtaccatctaggcattccagggatgcactggcagtgagattgaaagggagaaaaaaatctgatagctctggattgaactatttaacaataaatgtctcttcttgagagtaagccctctgaagatcagcttctaattgccaacatcattttctaccttctgtacaaagtcaacccttccacatagcctaccaagcagggcttgctgcacatctgcatcatgactgtgcaaattagaaaagggcgcttttacaatatgagccagggtggatggcttggtgagttgagcatgggctgaattttacccacaccagcccgcttggttgggcacccttttgcagtgcacaacctgaacaaccatatatgagcagccctgctaccaagcactctgcattccagagagtaggtaactctctgtatattaataactagatagtcctagtcctggtgaatataagaatcttggcaatcaggaagttacttgccataaatcaaataatgagttgccaaaatctcctcactcttcataatctagaggaagaaacaactataggagcaataaatgactgatagagcctttgtctggcataatggagatataagccaacaaaactcaggtatacacaattcaagccaaagccagaattcaatgccgaactcattcatctccatttcagtacctaatccagaaagcctggatgcccttggaatcccgcaagatagaatatagcaccaacaaagaactggaggtttgcagctcagagctgcaggcaaactgcataccatggggccaaaccatcttccagcaacacatcctgcttctttaggcacttgacagagccaactttaacacagactttgagaagtggccctgatgaaaccctggccaacagccagccagccactacccaaaaatgtctgcctgaaagcagctccaggaggcaggccatggggagtggaagtcggggagaaactggaagaggcgccaagcagctgtcaggggaagtgatgacacggagcaacaccaactcttattttcttttccccccagcttcaaatgatgtggcacagtggtggcttgccgagaaactgcagtcacagatggaatagcagtgttcagaaagaaagatggtacatgcacagaaaggaaaagcaatagattacagcaggtagtacataaacatgggcacaactctaataatggtaataattatttataataaataaatagactaataaagttactaataaattgctaaacctgtactgtgccctttacttatattatctcacttgcattaataaggaacccaacaatcctaagaggtgagtgttattaacacaagtttcttataggtgagaatgctgaaacacaaagaggctaaatgacttatccaagatcccacagctcccaagtagtggagactgaatctggagccctgtggtctgaattcaaaacccaagctcttaactacagccctatcttgtttctcaaaggactatctatgggtagacatgaggtgtagtaacgattggggtcacctgtgagtctgtgagtcacaatcacacaccctgggcacattttccatctgcattacgccattcttgcgttgctatagagaaatacttgagactgggtaatttataatgaaaagatatttaattggctctttaggccaattaagcctctgcaggctttataggaagcatgatgctggcatctgctcagcttctagaggggcctcgggaagcttacaattatggtggaaggtgaagaaggagccgacacaacacatggcaaaagcaggagcaggagagaaagagcgagagacaaattggatggggaaatgccacacacttttaaatgaccagatctcatgagaactcactatcaggaagacagcatgaagccctgagggattcgcctccatgagccaaacacctcctaccaggccccacctccagtactgggaattacaattcaacatgagatttgggagggaacaaatatccaaactctatcaccatccatctatccacaaatgaatacatacagttatttaaggaatatttgttgtgctcagctctttgtatacattgttacattaaatattccccaaaactcttaagagtttgggaaatacattaagaataaaacacggtccctgcaaaaatggttgcaatagtatcttccacccctcatgtattttgcaatgtgactctgtcaatcctctcattaagaggtagaatctatttaccctcaccttgaatctgagctggtgtgtgacttgctttgatgaatacattacattagaggggatattctgagattcaaagtccaaggtttaagaggactggcagctttcacttttcttatatcccagctaccatgtattagtttgactactctgaggccaccatgctgcaaagaagcccaagctagacgtgtaaagaaggagtggtcatatacatatacatatatacagagagagagagaggtttaaagaattagttcatgcagttatagagattggtaagtctaaaatctgcagggtgggccagcaggctggagacccagggaagagctgatattgcagttcaagtccaaaggccatctattggagaattccttcttgttttggtaaagtcagtcttgtatttgatttgggccttcaactaattgggcaaggcccacccatctgatggagggcaatctgctttattcaaagtctactaatttaaatgtttatcatgtccaaaagtaccctcacagaaacaccaggataatgtgtgacaaaatatctgggcactgtggtccaggcaatttgacacataaaattaaccatcttatagtccaacccaatcactagcataatatatttgagtgacccctgctgacaccatgtggaacagaagaaccacccagctgagccatgcccaaattcctggcttataggatcatgaaaactaattaattgttggttttgagctactaagttttggggtcatttgttatacagcaacagaaaattgaaaactgccttaatgaaggttacaatttagtggccttaatcaacagtaagcatatagatgtataattatataatttgatacatattaagaacacttcattgcatttattaaaaacccactaggtaaaattttccatggtagtgtcagacaaggctatggtgacaagatcttccttttacaggctctgactaatttgtagtggtggctgagcaaaccactgaccctttctggaccttggcttctccatctataaaatggacatggcagcagacagcctctctgcctcacaggctcttatgaaaattaagtgggacaagaaacaaaagtgctatcaatgctgaaaagtcctctgcaaactacgtcataaccgaataaatgatcccttgtgccaaaaatgcaaaaatgtttcacaatttattgcttaagcggaaacatctggctaaggaaacttgaaaaaggcagcaacctttccgaccaaagcaatttcatctaatagctggtctctggagtctccccttcagctctgatttgtccgttgctgagaatttcactttaaaatatgtgagccttgcacttttttttttttttttttgcacttctgctttctctatatttttgacaaggttagaaaaggaaaaccttaaacatgataaatatccattgttgggcattccagctaacgtataggaattgtgtccataaatttattcaccaatgtcttttaattgtagagcaaactggagggaaccagaattacataggaatcttagaagcaacctcagcaggctacaattagtctacaatgaatgagtttcccacctggcttacaagacagtgaacccagaagccaaatccaaccacattttgcacctgtttaaaaacttgttaatgacttacagtgccctctttataaagaccaagctccttggcatagcactgaggtccattccagtctgaccgttccttacctctccatccctgctgctcaccgctcaccttcttgggcttctagtgttaatgcaactgtctcatctctggcctctgtgtatactaatctcccacctagtacactttcccgcatccatccttgcctagctaactcctttgtccttcatatctgactttagatgccctctctgagaaatcttccctaaacccctaagactggatttcatgtttcttgtcttttaccccttaccactaaggtggtcttacctctaaggtgtcagatgataatttccaaaaagttaaaggtgtgactctcatgcaaatacatcaaagtctatgccaaagatttatttaactcgttaatgagagaaccagcaggatgataaagttggattgaaggaacctataagaagctgagtatatacagaatagtcagtgaaagcaaggatgctgaagtaagactgctgacctaggtacaaaactgaataatgtcctagaagcaacacaattataaccctttggaactgtttattccaatggagagaaatcatttacatctctgccagacaaaaatcatttgcaacttatcaatttcctacaaattaagatctaacttttcaggatctagaccataagaatttgtgatagtgagccaaatcaaggatttcagatgacgcttgggctggcccattagacaaggctttagaatgacactgaaggacacacagacatcttgctgggtaatttttaatgtgcgtgtgtgtgtgtgtgtgtgtgtgtgtgtgtgtgtgtgtgtttaccagtgacatcaatactcctttgtaactacctgttatcttgtctgaaattcccagtaaactgaaagcatctagggacaacaattgtgttttgtttactcttgtagcctctgaccctagtttagtgcctaagatatagtaggcactcagatagttattactgaatgagttaaaagacttctctttcagcattgaggtccccccttcaaggagcctaccagtttcccacagatccagattatgaatgatgaggattctaggcattgattccagcccaatctttccccaactccagccaagtgtcccctgtgacccgcatcccctcagtcatttctcctgctttgttctactgcacaagccctaatagtcacctggatgatcaggcacagaaggcagcaagaaagaagcatgtctctgtgcaagaagcagggtctcgcttttcagggccccctgcctagccccagtcccagcagattggctagaactgaggcctgatgcctggtgctgcctctgggagcacaagggctccttctgttcctggattcaactcctcagggacagctactggggctccaggcacgttgctcatcattctaactggctcacagggcagccagattttctcacagataatgagcctgtataatttacatcaagactaaattatgcatttaacaacgtgttgttcagcagggataaactgcctggtttgtgaattgcttttcttcccacaggagggaggtacaacagagggagtggagacggggtgcactccacacaccttccagttatgaggggtctggaaaagtctggaaagaaaggaattgaaatagcgtgagtgagagtgacattacccacttcgtatgttgccattgtcaatcctgtaatggtctcggaaagagctcagaaagaaacagggagttgtctgggttcagacaaaaaccacagggaagagtttcagacttcttggctaagtcttaggctccactcaccccaggggtgttggtagaaagtggattaggactgtgtgaaaaggcagcagagaaagatcagaaacacaccaacaaaggctctgcgtgctcttagaagcagggcaggtcactggaaaagctgggaagtgcatgcagtttgcctttagagctccaagtttgctctttctgggcctcctccctactctagggaacctctttcatggcaagtgctccctccagttctgcctaccccaccccccaaaccctggggttcaccatttacccttttattgtgaatttgaaagctgtgtattttctctctctctcttccagagacatccacactgaagcttttcctctgaaaaaggaaaataatgtgaccaaataatttatcatccatccaagaacatttttgagtactcttaaaaattacaccagaaccacaggaataaaccacagctgctctggaagggtcctgggcaagctggacctaagagcaccccagaaatgaaagtctttgtttctttttaaaaaattgttgacatcactgaacaggtgaaaagggctctctgattctttccaaaggggagagtaatgagaaaggatgaaaaggagcagagatgtatcagttaagatgctttcaattgcacataactgagtagccagagataatgggcttaaattaaagggatttctttgtctcacataacagtggtccagtgacaggtggatcaatggctcaaccatagcaggtgtattagtccattctcattctgctaataaagacatatgcaagactgggtaatttataaagggaaaaaagaggtttaatggactcacagttccacatgggtggggaggcctcacaatcatggtgaaggcagaggagcaaggacacgtcttacatggcagcaggcaagagagtgtgtgcaggagagctcccctttataaaacatcttatgagacatattcactatcatgagaacagcatgagaaagacctgcccccatgattcaattacctcccaccgagtccctcccaccacacgtagggattattaaaattagaggtgagatgtgggttgggacacagccaaaccatatcatcagggcttctcagagactctccctcactactgcaagatggctgctaaggctgcatatataatgtcttgacaaatgcacatacaaaatgctaggaaggaggagtcatggcttttcctcttatctatttcccttatcacatggaatatatcttgcccaggctgggcgcagtggctcacacctgcaatcccagcactttgggaggccaaggcaggtggatcacgaggtcaggagttcgagaccagcctggccaagatagtgaaaccccatctctactaaaaataaataaattagctgggcgtggtggcggatggctgtaatcccagctactcgggaggctgaggcaggagaatcacctgaacctgggaggtgaaggttgcagagagcagagattgcgccactgcactccagcctgggtgagaaagtgagactccatctcaaaaaaacaaagggaaaagaatatatcttgcccagaaactctccagcagagctctcctctggtttaattggccaatattgggtcacatgactattgtcatagttgcaagggaggctatggaattgagaatctgcattttctgcctctatgggcaatgaactgtgctggcctgagaaagggtaagaaaatggctacttggtgagcaaccaacagcatcctccagaaataacctccccctaggccttatactaaatcccacgagtcctgcctagaaaataacattcaactgggctcccagtgagaaacacagagtttcaagcagacaatcttctataagttaatatccccaatgagatcctgagaagttagctatgaatctactcagatgtccccactgattgccatggtcttttcagaaatgcttggtcttcattctggttctctgctgcccttggtttctaagcctttatctgggagttgttgtcctcctgagtctgacaagaagtcagggatctctaagaggggactggaatatgccagagggggtcggggacaggcgagtgctatctaccatcaacacttgggcctccaaagggtacacttggatggagccttgaagtctgacgaggaatttcaatctgaccagatttaaaacagattttaatagacaacactttctgcaaaggccaatgaggaaaacaaatcatcttggaaaagcattggctgaatcaagagatgagacccaagtcctgtgcctgtcctcctccttcctctcaggaatagccactgttccctgggagctaactctgagccagatttggagctaaattcatttaatcttctcagcatttccatgaaaggggtacattgttatcatcacttagcagatgggaaaactgagttttagcaaatttcaataacttgcccaaggtaactgtttcctaactcttaaggtgaataaagggcatagtacaggtctagcaagttattagcaatttgattagcaagtttattattcataattatcattaatgctattgctcccaactccttataggtcctatgtgatttcctctttcctctgtccactcttccccttggtcactatgcatcagtgatacaggccttatttccatttctccactgtctcaaaccctgttctgcctcaggacctttgtacttctttccactgcctgaaatgttctttacctagctccttcctttcttcaagccttaactcaaaaagctttccctaaccaccctaaggtccccccttattttctgtaacagcaccctgactatttcttttgttgggtttatcattgatattgtcttcttatttgcttgttcatctctttcaaactctgccaaagcctctctgaggtcaatttattatcagttatcacctttggttagaacaatgcccaacacataataggtccttggtaaatttgctgaatacccttggccgggtgcagtggctcactcctgtaatcccagcactttgggaagctgaggcaggaggatcacttgaagccaggactagcctgggcaacatagcaagaccctgtctgtacaaaaaaataaaatttttttaagctgcaacccgaatccaagtttgagtagctcaaaagcctgtagctatgatcacctaactaggagtttcttggaacacaaattagaaaaccgtgatctaatctaacctctcattttaaagatatgaaaataaggccaaaagggtttttttccccttaagattataaagtaaattagtagctgagttaaaaaaaaagaaagaaagaaagaaaaaagaacattggcattggaaactgaagactccactttacaagtcaaaccgcccttgaaaagccagttaatatatctagcctcagttttctcatttgtaaaatatcgataaggcagcctacttcacaaaacaattttgaggcctgcatgaaatcaggtaggcaagaggccagcacagtgcccagtccacagtaagcgctcaggaaaggacagcttcacttgaatcccaggctagtgttcttcatttccaccatgttctcacagtgagtgaaccccttcacaacatgatacattactctcaacagatcacttttgcacgggcatgtttttgcactcagtttcctttatttttttcctttttttttttgagatggagtctccctctgtcgcccaggctggagtgcagtggcacgatctcggctcactacaagctctgcctcccgggttcacgccattctcctgccacagtctgctgagtagctggtactacaggtgcccaccaccacgcccggctaattttttgcattttttagtagagacggggtttcaccatgttagccaggatggtcttgatctcctgacctcatgatctgcccacctcggcctcccaaagtgctgggattacaggcgtgagccacggcacctggcctgcactcagtttcttatggcaggactacgggagactcatcaaacaatacatgagtagagtcctgtctcagttcgtttctgctgctataacacaatatccaagactgggtaatttgcaaagaacagagatttattttctcacagtcctggaggctgggaaatccaagatcaaggcaccaacacattcagtgtctgctaagggctactctctgctttcagatggtgccttattgctatgtcctcgtatggcagaaggcaggacaaaagggatctagttagttcccttgagctcttttataagagtactcatcccattcgtaacaggcagagccttcatgacttactcatctcctaaaggccccacctcttaatgttatcacattggcagttaagtttcaacatatgaatttgttggggggaggggagagggaacacattcagaccacggcaggtcctaacaacttatttgtgaattcctggttcagagctcagtgtgcagcccactgtatcaagtcctagaccagccaacgaaagctgcgttgaacctatcctgcagcagaaacactggtgaagaagcctggagaaacagaggcctgcagtacccagtaactaaccaggtagaaaagcagccatctggtgtgtcaggactggggtgagtggggtgacagagagttgtgaagggaaagtggaagtggaggcaggtgactacaccttcagctgacctgaagtcagctgacgtgacttcagctgatgtgatgaaatccagctggtttcccaggctgggatgccttttgctttccacaataggaatggccagtagctgccagcccgtggtggaaagaagcaactggagattgcaaactctcctctgctctctcaacaggcaataggatattggggttgccactgcaggttctagggtcacaaaaacacaggttcaaattctacctctgccccttaccaactgtgctacattgaacatataacctgaatttctccctgccttggtttcctcctctatgaaatgggaataacaacatagcactgagttatcgaggttcaaaagaaataatacctgggaggctccctgcatagtttttggcataaacctggcttcaatgagattagcaattgatatcaatttacacagttctaaatagagaaatttttcaaagtaaaagactgagagatagggatacacaaaggcacacaaagacaggtaattttgctttctctgcttgcctttttgcactttgcaagcaagaaggcaggcaagattcggcttgtgctcagcttttatggccgcctcatttcaaaacaacctcaggctacagagatggaacctgcagctttctcagaaaccaaacttttctgtttcaggctgcacgaatggagcatgagaacaccctacagcctgttatttgctgcatgtttctacgggcaccagcaaagcacaacttctagtaatgggatcagtaacccaagtgacggaactgaaaaggcaagtctgaatttatctccatctgtcatgttccagtgaacaatgaaagcacagtaaagggaaacgctgcttcttgcatgtttgtgccagtccttccctgctaggtactattattagcagcattaataaatgcctctgacttgcagtaaaggttcagaatgctggagagttacagggcatgccaaacacataaactgcctgccctcagggctgatgggcacgaaggctataagatgaagcccaaatggcagaaacattctgaccagggaggagtgattgcaggtgaggtagggagattttttttccagggctgtgctggaaatgaaagagacaagccttcgcgcccactatttggctgctcatcctattctattcttgggaaatcattggagagatgagagaagacaagtgacagtccactttgaatgtcacctctaccatcctggagccttgggagaaagctaaagatgtgtccagccttatggctaaataaggttaagctgggacagagactgctcattgttctccagaggctatactctaacttttagaaacacagctctgagttagcagggaactcttaagacatgggactccccaggggtgagctagagacacccacccgggactctgtggccgtaggtgtggtcacaggattgggctctggccaacgggttgagcacagaatcgatgagcacaacttccaaatcacagtgtttttggtggtggtggttgttgttgttgttgttttaatacagaaacaccaagccttccattcttacttttcccctcccactggctggaaaattggaagaactgaaggagccacctcaggcccaggaaaaaaaaccacattctgaaagttgcacgtctatccagccagcaaccaaccacaccagctctaaacctctcaccttcctctgctccattgcatggaataaaagcaaacttctctcctacttaaggcactctgttttggagtccctttcttatagaagcttatctgataccacattcacagatgtggctttgaacttgagtaagagagaagtgtcctgtgtttgtaaaaggttaaaagtttatccacattgccttcctcttgttcctctctccgtccctcacctgctgggctctagctggaccggccacttttctgttcttgaactccttcacttcttccccacctcagagtcctttgccaggaactctctgtcttgtcactcttcccttggttgactcctcaccctcagtttacaagtcacattctcagagagactttctttgaccaccctatatatattcattttctatggtacataaccagtgactgtaaacttagcagccgaaacaccacaagtttttttttttttttttgagacagagtctcaccttgtcgcccaggctggagtgcaatggcacaatctcggctcactgcaacctctgcctcctgggttcaagtgattctcctgcctcaacctcccaagtaactgggattacaggcgcacaccaccacacctggctaatttttgtgtacctttagtagagacagggtttcaccatgttggtcaggctggtcttgaactcctgccctcatgatctgccctcctcggcctcccaaagtgctgggattataggtgtgagccaccgtgccaggccaacaccacaaatttattacctcacgatttctgcagtcaaaagtatatgccacatgttatctgggtcttcatctcaggatctcacaagcctgcagtcaaggtgtcaactggctgtattctcatctggaggctcaatggggaagggatccacttccaagtttccttctggctgtgtcaccaaggtccctgttcccttgctggctgtcagctcctagaggccactcttggctttttgccacacagctcccttcaaaggcagctcacaacgatatggcaccaatccaataagatagactcttatataatgtaacctactcaagggtgactatctcatcatattcatgggcctgcccacattcaaggggaagggattgtacagggcaggaagtgggtggagggaaccagctcttggcagccatcttagaattcagcctagcacatgggcaacgacttcatgactaaaacaccaaaagcaatggcaaaaaaagccaaaatagacaaatgggatctaattaaactaaagagcttctgcatagcaaaagaaactatcatcagaatgaacaggcaacctacagaatgggagaaaatctttgcaatctacccatctgacaagggctaatatccagaacctacaaagaacttaaacaaatttacaagaaaaaaacaaataaccccatcaaaaagtgggcaaaggatatgaacagacacttctcgaaagaagacatttatgcagccaacagacatatgaaaaaatgctcatcatcactggtcatcagagaaatgcaaatcaaaatcacaatgagataccatctcacgccagttagaatgtcagtcattataaagtcaggaaacaacagatactggagaggatgtggagaaataggaactcttttacactgttggtgggagtgtaaattagttcaaccattgtggaagacagtgtggcgattcctcaaggatccagaactagaaataccatttgacccagcaatcccattgttgagtatatacccaaaggattataaatcatgctactataaagacacatgcacacatatgtttcttgtggcactattcacaatagcaaagacttggaaccaacccaaatgtccatcagtgatagaccggattaagaaaatgtggcacatatacaccatggaataccatgcagccataaaaaaggatgggttcatgtccttttcagggacatggatgaagctggaaaccatcattctcagcaaactatcacaaggacagaaaaccaaacaccacatgttctcactcataggtaggaactgaacaatgaacagctgctcacaccaatatccagtcttcacttctccgccccctctccaatgtgatccttgcggtcatccttgatgactctctctcttatccctcacatccaatccatcattcagtagtggccacttctcacctcccccagctcccatcttgctctcttgccccttcaatttattctcttcacagtagctagataggagcttttaaagcatgaacttagtcccctattcaaaaccctccggaatcccccttctcatttggaggaaaatctagttttgcaaagcctatatgcacttgggcactccagtccccacctgtccaccctgagcctgccctggctctctctatggcagtcttactggtctccttgtggttctttttttttttgagacaggctctccctctgtcagctagacaggagtgcagtggtgtgatcatggctcactgcaacctctgcctcctagactcaagcgaacctccttatctcagccttctgagtagctgggactacaggtgtgtaccaccatgcctggctaattttaagaaacaatttttttttttgtagatatggggttttgctatgttgcccaggctggtcttgaactcctgggctcaagcaatactcctgcctcagcccttgaaaagtactgggattacaggtgtgagcctctgcacctggccttcttgtagttccttgaacacaacaagcatcctctcccctctgggacactcagtgttttcctgcctgaaacaccctttccctcactatctgcttgacttgcaccttcacttcttccagtcctgtgaaatgtcaccttaccagtgatccctaaccagccctttctcccctcagcctgccttcttgttctccagtgcatatatcaccatcctttttaaaacaaattatttgcaattctgtttatttgcatattgtctgcatgccctgtattggtttgctggggctgccataacaaagtaccatagactgtgtggcccaaacaacagaattttattatctcacagtgctggaggctagaagttcaaaattaatatgtcaatagggttggtttcttctgaaggctgtgaaggaaagacctgttccaggcctctctccctggtttgtatgtgtccatcttctccttgtgtctcttcagatatgagtcatactgggttagagcacaccctgatgaactcatttttatttaattacttctaaagaccctatcttcaaataaggtcaccttctgaggtactgggggttaggacttcaacatataaattttgtgaggacacaattcaacccacaacattctccgagaaagaacatgaacatcattcatctggtacaaagaaagcactcgttaatctttctcgaatgaatctgtccaaatattcaccacttttatgatcatcaacattattatcattatcaaccagaaaactttaactggcatttctatacttctataggatactgatgattggtattaatcatggtatcatgaaattctgtaaagattcccagacatcatttgactaattggataaagattacacaaaggctataagctcagtatacttttaatgttgtctattttgttgtattctacccaaaataaaatttggtcattcatagataggattttatattacttgccaaatatctagaatatttgtttttactctagtctaaaagaacttgagggtttaagtaacataccaaaaacaggatttcaataaaatgagaataaaaacagataaacctggattaagcaaagaaaagcaaatgtacttgtcatgggagtcactataattgctctatttcagcacacactcacattaaaaattgggggcaacacagcagctggtaaaaacaatatctcagctgtagatttatagcagtccttcaggagacagaagattgtgccttgtgtgaaactcaaagaaatctccacgtcgggcagctatagggtacaactgtctgctgcatcatttcaatatctttcccaacagcttcactaagaattcagaagaatccacgctgtttcttgcatccagcatcataaaaggcaacaacattaaaacattagttcaggtagtttttgaggtctgtgatgcaaattaagaatagcacatagactatgtagtggactaaatagataccacattccttaaattctttcccacaaatctcattgcttttcagctgggctttatgcaggaacgggctctagcacaatcgttaagggagtccgattctggcttttaatccaggttcctccacctctgagctatgtgacctaagacagttacatatctataaaatgggatgattataatgcttattttgtaggtttgtggattaaaggattaaattacataatgtatgtgaagcttttaacacaatgcctggcacgtgataagcactcagtaatgttagcagtgattcattgtagcgtatttttagaccacaggggtgtgtgtgtgtgtgtgtgtgtgtgtgtgtgtgtgtgtgtatgaaactacataggtgagtggtagagttcacattccattatgaaaaccaaggtgcccaaatggtatgcctgcttaaatggaaggctacactctgttcacatgttcccatgaaagagggatataagggaatctgttctagtttcactagaacaccctgttctctgatagacaacagtgtgttaacaatatttataatttcccaaaagtaatgttctcattatgaccaccagtttcatttcttggtattaattcactccattaaatggaaaacaaagagactctaattacccaactctaattacaccaccaaaaacctttgtacggacaacccatctgttgtataatcaagcatttgactggcctttgtccctggcttctgggagggagactctaagttcctggaatttcccaggtaataggtgtgtctgttattcatatgtctcttgtatcacacctgagtgtaagagatgaggtagctcagggtgggatacgatctcagaaagaccaactatgtgattagaagattggagctatgagccagctcagtctctggagagaaggggagggttaggggttgagtttaatcacatggcccatgattcactcaatcatgcctacataatgaaaccccagtaaaaactctggacactgtggctgggcacagtggctcatgcctgtaatctcagcactttgggaggccgaggtggttggatcacgaggtcaggagatcaagaccatcctggctaacacggtgaaaccccatctctactaaaaacacaaaaaattagacaggcatggtggtgggtgcctgtagtcccagctactcaggaggctgaggcaggagaatggcgtgaacccgggaggcagaacttgcagtgagccaagatcatgtcactgcactccagcctgggtgacagagagagactctgtctcaaaaaaagagaaaaactctggacactggacaccaaggctcagtggagcttgctggctgctgaacacattgatgtgctgtcccctggctccatggggacaggacatggaagctctgcaatcagggcccttccagaccttacttatgtgtgtcttcttttggctggtcctgatgtgtaccctatgtaataaaactagaatcataaatacagcacttttctgagctttgcaagtcattctagcaaagtgctcaaaccaagggtgttgtgggaagccccaagatttgtagttcactggtcagaagtgcaggcagccttggtactgaaggaggggcagtctttttagaaaccatgccctcaaaacctgtggagtctgatgttaactccaggtggttagtgtcagaactgaattttaataagcctgttgatgtcaaaataccatctgagtgctcttggggtcttcagaacccctaatcctggctgtggaatacatacctgagagagaggagaggcctcaggatgtttggggtctccagagtcctatttcaaagctgtcaacaattcctcttttccccaaccaccaccatcaccaccaccagagggatcgccattggcacatggcagtcagcgctctcaacagcatcacttcctgaccccttgtagcaagtcctctgttcatggtgaggcagaattcaccaaaccctgggctatccttccatgaggagggaacttgagaaagtttataaggctgatgagacaattttcattcaggttataggttcaaatttatgatgatggaatattattagtatctttcttatttttaagacagagtctcactctgtcacccaggctggagtgaagtgacacgatctcggctcactgcaacctgtgcctcccaggttcaagcgattctcttgcctcagcctcctgaggagctgggattacaggcatccaccaccatgcctggctaatttttgtatttttagtagagatggggtttcaccatgttggccaggctgatctcaaactcctgacctcaagtgatctacccacctcagccttccaaactgctgggattataggtgtgacccaccacacccagcctattagtatcttacttacagtaaaaaaactacaaaataaatagttactaattgctgcagattgtagtagttatttccttgttcaactgttgcattcccaacagattttttctctcctctttcttctcctaacagactctgcctgtcttccattgctcagtcataagaacgggcatgagagtacctgtccagtcagagtatttgttttagttagggtaggttaattgctataacaaatcagccacaaagcataagggctcaaacacaataaaagtttattttttgctcacataaagagttcaaagctattaaggtcagattggggaggaagagggctttgttccacatattcattcagtgatcagctgtctagcagctccttccacgcgtttccatgatgtctttggacaataatttccagctggtggaagggaaacatgagggtgaaagaccatctgtttcataatctccatgagccagaagtaatacatatcaatttcatttgtattgctttgataagaactagctaaatggcctcatctaggtgcaagggcagctcagaaatgtagtccttgcctggccttctgcttcccagaaagatccctctaatgtggaaaagacagtacaaattttggtagatggttagccatcagaaattgaataaagggtggaaccatgacccaaactgaaccaattaaagtacatttgtgggactgatacttaaaagatgggagaaaaagagaaatttccttcccagccaagttgcatcactgggaggatgcaaatctggacttctgaggccacattctccaccatgaggtgaagtgtctacaaagtgaagccagggagtgggagatggagagagaatgaatgggaaagtgagcgagtcctaatggcctcgtctcccagttctgatcttggagggtcagcttccctttttggtcctctgtttatggtgaggcagaattcaccaaaccctgggctatccttccattaagagaaaacttgagaaagtttataagactgatgagacagttgcactcagattacaggctcaaactaagcccacatttatgatgatgggatattattcccagctacacaagccaatgagttcctctctttaaggatcaaatttagtttccgtcacttgcatcattctttgagcctcagctatatgccaaaagctactaggcattttatataatttcccaaatgaatccttaaaacaattataggtattattagtttcattttatagatgagaaaacagaaataagaagtaagtagagaaacagtccaaaatctagatctaatggtacagggcaaggattgacaaacattttctgtaaggggaagagagtagatattttaggctttgtgggccatacgatctctcacaactgcttaactatgccactataacacaaaagcagccacaggaaatagtatattaatggatgtagctgggtttcaataaaactttatttacaaatcaggcagcaggctggatttgacccatagggcatagtttgctgacccttgatatgatggggtttggggaatgaacaatgctaacctgaaagtcaagacaactatggttttgtctgtaactaaatttgtgattttgaacaaattacttgacacctcagttgctctccatttccttattcatttcaatgccctcaccagccttccattctatcgcgtccttttcaattcccacatgcataatgcataattaattcacaatttaagctggagttcaactgagaactactaatgtatttttattttaagtttgccttatcacagagtatataaatcattaattaatcctttttcttgatgcccctagttcatggaaggtgtctgtgattcgtgtgatttcgtccctcaggtgcccctgggatgggcagggccattggcccccatgctatgtgccgtgaggtcagccatcagtttgtctggtggcactgcctgttgcctctgccatcacttctcactggtgctaatctgctccctaatgaatactcatttgcttagatcaaggtccaagaatgtgtccttgttcatccctccttcgagtaaactacaactatgcccatagagaccattccctttgacttcaaattccagggcctggggggttggcattcctagaaacatgatcctggaggaacagggcattgtttaaatgcctgcctggttaacttgtttagccaaaaatatgacactcaagtcataagactaattttacaaactactcttttcttaagcaattaggcttccagaagtctctggcacatgaaaattttccatgaactctgaaagccaattagaacagaggaaaacaaaagttggagactccatatccttcatctcagtaaggtcatggacgtcccctcagggctctctggagaaagtccattgtcaacatacttgtgtactgtcagtgggatcaaaagagcatcaaatcttttgggaatatttggaactagagatctgagggttagaatgagtcaaggaaggtgaaatggtaaatgttcatagactaggcctccctccctgataaagggcagatagcagataggcaactggtgtttagaagagggccagatagtaaatatttttaggctttgcaatctatatactctgcacacggtctccgttgcataatttttcttttctttcctttcttttttttttttttttttttttttttgctttttagcttttcttaacaaaaaaattaaaaatttaaattagaaaaactattattagctcaagggttgtacaaaactaggcaaatttggcccacaggctgtagtttgctgaccattgcaacaggaatcctggctttgccatcactaggtgtatgatgggggaaggaataactatccaatttgtttgtttgtttatttgagacagagtctcactctatcacccaggctggagtgcagtggtgtgatcttggttcactgcaatccctgcctcccaggtttaagcaattctcctgcctcagcctcctgagtagctgagatcacaggtgcatgccaccatgcccagctaatttttgtatttttagtagagacagggtttcaccatgttggccaggctggtatcgaactcctgaactcaagtgatccatccgccttggctgggattacaggcatgagccaccacacccagtcctagggaatgaataactatgcattctaagtctcattttcatcatgtataaaatgagaatgccaccacctatattgtaggattgttgactgggatgctgcttcacagcactagcacatagctccattcggtccatgaacagtagctggcactgctaatttctgaatcatcatacagtctctgttttcatgtggctactactttttctttgtctctgccttctctgaaaaggcccttaaatgttagtcttagggttttaggtaagggttagatttatacacaggtaggccttgaggaataagatggtgttatagttcggatgttctcaaaacttcgtgttaaaatttgatctccagtgttggaggtggagcctagtcaggggggtctttggggcagatccctcttgaatggcttagtgccatccttgagctaatgagtaagttcttgccctattagttcccatgaaagctgtttgttaagagcctgacacccctcgctcttactctctcactctctctcctctctcttgtttttcctctgaccacgtgaccttgcacacatctcctccccttccacttccaccatgagtggaagcagtctgaggccctcaccagaagcagatgtcggtgctatgcttcttgtacagcctgcagaaccatgaacaaataaaccactattttttaataaattacccaccctcaggtattcctttatagcaacacaaatggactaagacagatgcatttaagactctgctaaaaataaaaaataaattaaaaagagagtagttctttaatatctttcctgccagactgccaaaggcatgaatttccacctgcaaattgcccttttgcagcacaatattcagtctccatagtctcctgttacaatacaaatctatgactagaagagacaggggccacctggctggcctcactaataccacagcacaaggttgcttagcaaattagctcatctttgatcacatagcctgaaggaaatgcccacaatgaagaccacactagccagaagacagtctgtagaggagtcactcaaaggctttacaagaaacaagggctggagggagactcctagagaggaggtgagagaagacaaactttgtgatctgatagcctgtgtatttcactgtcctcaaccgtctctctcccgattcctaggttctggcacctactccctccattgttggtgcttgaaatttgtttgctctcctaatcccaagttaggttagccacagcctgcctccatgacttcctcaaaattcagcccatgtcccttgccaacagggcagcttgcatttccagaaattcctgtgtgcttaagtgaggtgaaagtggattttacgttaaattgtttgtctttgtgattgtgaaatctaactaatgtactgaaaagtacatggagatgaacctgcatgaaaagaaacccattgaggcctcctgttcctatgcacacttcgtcccccttcctggtcctaacaccctctctcccccctcacagtcaccactgtcctcagcattctggtgctcatttcctctgccttttaaaaatagttttatttcctcattatgcacacctggacaatatgtttaaatgttgtctgttttcggattttatgagtggaattgtgcagtgtgtattattagatgcctaacctcttgctcaatgttgtctttaagaagcatacctgttgtggtgtgaaacggcacctgttttgatagctatgtaggattccactgcttgaacacaccccaactgtttacccattctactattgatagacactcgggctatttccatgttgggacaattacagtgtggctacgaacctcttaaattgtatatactggtgctgtaagcatgcatttcttataggccctagggaattggggtcatagacatttgtaaccaataatcaattgtagccaagtattaccaatttttttccaacaatttttttcctaggcttttcttgcaattttcaagaaaatatttcaattcatataccaagaagaaagaaagtgattttttttccacaatagtcttttcaatttttttaatttttttagccacagtctcaccctgtcacccaggctggtgtgcagtggcacaattacagctcactgcagtctcagcctcctgggctcaagcaatcctcccacctcagtctcccaagtagctaggacttgggacaacaggcacgtgccaccatgcctagtgatatggtttggatctgtgtccccacccaaatctcatgttgaattgtaatccccattgttggaggtggggtctggtaggaggcaattggatcataggggtggagttctcatgaatggtttagtaccatcccccttggtactgtatagtgagtgagttttcaagagacctggttgtttaaaaatgtatatcacctcccccctttttctctcttccttttgctctggccatgtaagacgtgcccacttcccctttgctgtccatcatgactgtaagtttcctggggcctccccagaagaagatgccaccatgcttcctgtatagcctgcagaaccatgagccaattaaacctcttttatttataaattacccagtctcaggtatttctttgtagcagtttgagaacacactaatacactcagataattttttttaagagatgagggctcactatggtggctggtctagaattcctgggttcaagcaatcctcccacctcagcctcccaaagtactaggattacaggcatgagccactacgcatggctttttttttcacagtattcttaaccagctcttatgcttacattgcaccacagtacctttatttcatcattcactcaccaaatatagtaagcatctatcatatgcctagtactatgcttacagtcatgaacaaaacaagcaaatacctccaaccttaaacagctaacattctagtagtgagacaattacaaataaataatacctttttaaaaatacaccagatgcagaatatataaagaactcctacaccttaacaacaacaaaaatcctaatgaaaaaatgagcaaagacttagacatttctccattgaagatatacaaatgccaacaagcctatgaaaagatgcttcacatcactaaccattagggaaatgcaaatcaaaaccacaatgagataccacctcgcatccattagaatggccactgccaaaaagaaaataataagtattgatgagcatgtagagaaattggaacccttgggcaaagctggcagaaatgtaaaatgttacagccattgtggaaaagagtatggcagttcctcaaaaactaaaaatagaattaccatatgattcagaattccacttctggataaatacacagaattgaaagcagggccttgaggagacatttgttcacctatgttcacagcagctttattcacattagccaaaaagtagaagcaacccaggtgctcattgatggatgaatgcataaacaaaatgtgtatatataccatagaatattattcaggcttaaaaaaagaaggaaattctgacccatgctacaaacttggggacattacgtgaagtgaaataagccagttacaaaaaggcaaatattgtatgattccacttatataagtagtcaaattcacagacagaaagtagaatggtggttgccagaggttggtggggggaggtgagagcagtgaggtagggagtagttgtttagtggatgcaaagtttcaattttgcaaggtcaaaggactttcagagatggatggtggtgatggttgcacaacaatgtgaatatacttaataccactgaactgtacacttaaaaatggttacaatgggggtggaggcagagcaagatggccaaatagaagcctccagcaacagttctccccttccccagaagaacaccaaattgaacaactatccacatgagaaaacaccttcattagcaccaaaaatcaggtgagcaatcatagtacctggtttcaacaacatatcaaggaaagaggcactaaagagagtgggaaagactgtcttgaatccctgacatcacccctgcccgatcccttgacagtggccacctggtgcagagagaaaatatgtgtgcttggggaagagaaagcacagtgatcgtggaacttttgttggaactcagggctgccctgtcacagtggaaagcaacacatggcagaattcagctggtgtccacagaggaaacatttagaacagccctagccagaggggaaacactcatcccagcagctggaatctgatttctggctagccccaccaccacaggctaaaaggctttggggtcctaaataaacataaggttgtctagaccacaaggactgcaattcctgggcaagtcctggtgtggtgctcagctggttagacaccaactgaggtggccaagtgaatgcttgcatcacctctctcccaacctcaggcaatgcagcttacagctctaggagaggctccttccttctgcttgaagacaggagaaagaagagtaaagattttgtcttgtaacctggataccagctcagccacagtagactaggacaccaggcagagtcctgaggcccccattccaggcccgagctctggtcgacatttccagtcacaccctgagccagaagggaacccgctgccttgaaggaaatgacccagtcctgggaggttcatcatctgctgactaaagagcccttgaaccttgaacaaacctcagtggtacttaggcagttctcactgtgaaccttggatgagatccagggctgtgctggcttcaggtgtgacctagcacattcccaggtgtggtggccatggagacagactccttctacttgaagaaaggggaaagaagagtaaaggtaactttgtcttctggcaattccactactggatatttagccaaaggaaatgaaatcagtgtgtcaaagagatatctgcactcccatgtttaatgcagcattattcacatagccaagatttggaaggaacctaagcatccatcaacagacaaatggataaatgaaatgcagtacctacatacaatggagtactattcagccacaaaaagaatgagatcgtgtcatttgcaacaacatggatggaactggaggtcattatgttcagtgaaatgaagccaggcactgaaagacaaacttcacatattctcattcatttgtggaagctaaaaattaatacaattgaacttatgaagacagaaagtagaatattggttaccagaggctggatatggcagtaggggtggcagggggaaatgggaatggttaatgggtacaggaacatagtttgatagaatgaataagatctagtatttgatagcacaacagtgtgaatacagtcaacaataattcattatacatttaaaaataacaaaatagtataatttgaatatttataacacaaagaaatgataaatgtttgaggtcatggataccccatttaccctgatgtaattaatatgtattgtatgcctgtatcaaaatatctcatgtaccgcataagtacacatacctattatgtacctgcaaaaattaaaacataaaatttaaaaaatggctaaaatggggggtggtccaagatgcccgaataggaacagctccggtctgtagctgccagcgtaatcaatgcagaagacgggtgatttctgcatgtccaactcaggtacctggttcatctcaatgggactggttggacagtgggtgcagcccacggagggcgagccaaagcagggcagggcatcacttcaccagggaagtgcaaagggtcgggggatttccctttcctagccaagagaagccgtgacagactacctggaaaaacgggacactcctgccccaatactgtgcttttcccaaggttttagcaactggcagacaaggtgactctcttccgtgcctggcttggtaactcccacacccatggagccttgctcactgctagcagtctgagatcaatctgcaagatggcagcctggctgggggaggggcgtctgccattgctgagacttgagtaggtaaacagagcggcccagaagctgaaactgggcagagcccaccgcagcttaacaaggcctactgcctctagactccacttctgtggacagggcatagctaaacaaaaggcagcagacaacttctgcagacttaaatgtccctgtctgacagctctgaagagagcagtggttctcccagcatggcgcttgagctccaataacggacagactgcctcctcaagtgggtccctgacccctgtgtagcctgactgggagacacctcccagtaggggccaacagacacctcatacaggtgggtgccactctgggacaaagcttccagaggaagaatcaggcagcaatatttgctgttctgcagcctccgctggtgatacccaggcaaacagggtctggagtggaactcccacaaactccaacagacctgcagctgagggacctgactgttagaaggaaaactaacaaactgaaaggaatagcatcaacatcaacaaaaaggtcatctacaccaaaaccccatctgtaggtcaccaatatcaaagaacaaaggtagataaaaccacaaagatgggaagaaaccggaacagaaaagctgaaaattctaaaaaccagagtgcctcttctcctccaaatgatcgcagctccttgccaacaatggaacaaagatggatggacaatgactttgatgagttgacagaagtaggcttcagaaggtcggtaataacaaacgtctccaagctaaaggagcatgttctaacccattgcaaggaagctaaaaacgttgaaaaagattagggcttaactttaacttaaaatgcctaactagaataaacagtgtaaagaagaccttaaatcactggttggagctgaaaaccatagcacgagaactttgtgatgcatacacaagcttcaatagccgatttgatcaagtggaagaaagggtatcagtgattgaagatcaaattaatgaaataaagcaggaaaacaaggttagagaaaaaaagtaaaaagaaacaaacaaagcctccaagaaatatgggactatgtgaaaagaccaaatttacgtttgattggtgtacctaaaagtgatggggagaatggaaccaagttggaaaacactctgcaggatattatccaggagaacttccccaacatagcaaggcaggccaacattcaaattcaggaaatacagagaacacctcaaagatactctttgagaaaagcaaccccaagacacataattgtgagattcaccaaggttgaagtgaaggaaaaagtgttaagggcagccagagagaaatgtcgagttacccacaaagagaagcccatcagactaacaacggatctctcggcagaaaccctacaagccagaagagagtgggggccaatattcaatattcttaaagaaaagaattttcaacccagaatttcatatccagccaaactaagcttcttaagtgaaggagaaataaaatcctttcagacaagcaaatgctgagagattttgtcaccaccaggcctgccttataagggttcctgaaggaagcactaaacatgggaagaaacaactggtaccagccactgcaaaaacataccaaattgtaaagaccatcaatgctatgaagaaactgcatcaattagtgggtgaaataaccagcgaacatcataatgacaggatcaaattcacacataatgatattaaccttaaatgtaaataggctaaatgccccaattaaaagacacagactggcaaattggataaagaatcaagacccatcagtgtgctgtattcaggagacccatctcatgttgcaaagatgcacataggctcaaaataaagggatggaggaagatttaccaagcaaatggaacacaaaaaaagcgggggttccatcctagtctctgataaaacagactttaagccaacaaagatcataagagacaaagaaggccattatataatggtaaagggatcaattcaacaggaagagctaactatcctaaatatatatgcacccaatacaggagcacccatattcataaagtaagtccttagagacctacaaagagacttagactgccacacaataataatgggagactttaacaccccactgtcaatattagacagatcaatgagacagaagcttaacaaggatatccaggacctgaactcagctctgcaacagacagacctaatagacatcaacagaactctccaccccaaatcaacagaatatacattcttctcagcaccacattgcactaattctaaaattgaccacataatttgaagcaaagcactcttcagcaaatgtaaaagaaatcacaacaaactgtctctcagaccacagtgcaatcaaattagaactcaggattaagaaactcactcaaaaccgcacaactacatggaaactgaacaacttgctcctgaatgactactgggtaagtaatgaaatgaaggcagaaataaagatgttctttgaaaccagtaagaacaaagacacaaggtaccagaatctctgggaaacatttaaaacagtgtatacagggaaatttatagcactaaatgcccacaagagaaagcaggaaagatttaaaatcaacaccctaacatcacaattaaaagaactagagaagcaaaagcaaacaaattcaaaagttagcagaaggcaagaaataactaagatcagagcagaactgaaagagagacacaaaaagcccttcaaaaaatcaatgaatttaggagcggttttttgaaaagatcaacacaattgatagacccctagcaagactaataaagaagaaaagaaagaagaatcagacacaataaaaaatgataaaggggatatgaccaccgatcccacagaatacaaactaccatcagagaatactataaacacttctatgcaaataaactaaaaaatctagagaaatggataaattcctggacacacacaccctcccaatgctaaaccaggaagaagctgagtctctgaatagaccaataataggctctgaaattgaggcaataattaatagcctagcaaccaaaaaaaagtccaggatcagatggattcacagccgaattgtaccagaggcacaaagaggagctggtaccattccttctgaaactattccaatcaatagcaaaagagggaatcctccctaactcattttatgaggccaacgtcatcctgataccaaagcctggcagagacacaagaaaaaaagagaattttagaccaatatccctgatgaacatcaaggcaaaaatcctcagtaaaacaccagcaaaccgaatccagcagcacatcaaaaagcttatccaccatgatcaagttggcttcatccctgggatgcaaggctggttcaacatatgcaaatcaataaacgtaatccatcacataaacagaaccaaagacaaaaaccacatgattatttcaatagatgcagaaaaggcctttgacaaaattcaacagcccttcatgttaaaaactctcaataaactaggtattgatggaatgtatctcaaaataataagagctatttatgacaaacccacagccaatatcatacggaatgggcaaaaactggaagtattccctttgaaaatctgcaaaagacaaggatgccctctctcaccactcctattcaacatagtgttggaagttctggccagggcaatcaggcaggagaaagaaataaagggtattcaattaggaaaggaggaagtcaaattgtccctgtttgcagatgacatgattgtatatttagaaaaccccataatctcagccccaaatctccttaagctgataagcaacttcagcaaagtctcgggatacaaaatcaatttgcaaaaatcacaagcattgctatacaccaataacatacaaatagagagccaaaccatgagtgaactcccactcacaattgctacaaagacaataaaatacttaggaatccaaattacaaggaatgtgaaggacctcttcaaggagaactacaaaccactgctcagcgaaataaaagaggacacagacaaatggaagaacattccatgctcatggataggaagaatcaatatcatgaaaatgaccatactgctcaaggtaatttatagattcaatgccaaccccatcaagctaccaatgactttcttcacagaattggaaaaaactaaagtccatatggaaccaaaaaagagcccgcattgccaagacaatccgaagcaaaaagaattaagctggaggcatcatgctcctgacttcaaactatactacaaggctacagtaaccaaaacagcatggtactggtaccaaaacagagaggtagaccaatggaacagaacagaggcctcagaaataccaccacacatctacaaccatctgttctttgacaaacctgacaaaaacaagaaatgaggaaatgattccctatttaataaatggtgccaggaaaactggctagccatacatagaaagctgaaactggatcccttccttacaccttacacaaaaattaattcaagatggattaaagacttaaatgttagacctaaaaccataaaaaccctagaagaaaacttggcagtaccattcaggccataggcatgggcaaggacttcatgactaaaacaacaaaagcaatggtaacaaaagccaaaatagacaaatgggatctaattaaactaaaaagcttctgcatggcaaaagaaactaccatcagagtgaacagacaacctacagaatgggagaaaatttttgcaatctacccatctgacaaagggctaatattcagaatcttcaaagaactcaaccaaatttacaagaaaaaaacaaacaaccccatcaaaatgtgggcaaaggatatgaacagacacttctcaaaagaagacatctatgcagccaacagacacatgaaaaaatgctcatcatcactggccatcagagaaatgcaaatcaaaaccacaatgagatatcatctcatgccagttagaatggcaatcattaaaaagtcaggaaacaacagatactggagaggatgtggagaaataggaacacttttacactgttggtgggcgtgtaaattagttcaaccattgtggaagacagtgtggcgattcctcaaggatctagaactagaaataccatttgacctagcaatcccattgctgagtatatacccaaaggattataaatcatgctgctataaagacacatgcacacgtatgtttattgcggcactattcacaatagcaaagacttggaaccaacccaaatgtccatcagtgatagactggattaagaatatgtggcacatatacactatggaatactatgcagccataaaaaggatgagttcatgtccttttcagggacatggatgaagctggaaatcatcactctcagcaaactatcacaaggacagaaaaccaaacactgcatgttctcactcatagttgggaactgaacaatgagatcacttggacaaagggaggggaacatcacacactggggcctgttggggggtggggggctgggagatggatagcattaggagaaatacctcatgtaaatgatgagttgatgggtgcagcaaaccaacatggcacatgtatacctatgtatcaaacctgcatgttgtgcgcatgtaccctagaacaataaaaaaaaactaaaatgctaaattttgttatgcacattttaccgtaaattttttaaaacagatatatatgcagatatagacatatagttctatatcagacatatgtctatatatgtcaaatattgacaaataaaatgggaagagtagggagtgttggggggcgtagttgtaaatcaagtgattgagaaaggcctccctaaggagatgtttgagcaaaggcctggaggagggagggagggagccatgtgggtttggtgtggcagagagggagtgttctgaatagcaggtgtaataagtgcaaaggtcctaaggtgggagtgtacctggggcatcagaaggctcgagcagagccaatcaggagacgatgagatcaaggaaggaaggagggtgcagttataggtgcacaagggcatcacaggccactagaggtgcttgacttttttttttttttttttttttcgagacggagtcttgctctctcacccaggctggagtgcaatggcaccatctcagctcactgcaacctcttcctcccaggttcaagtgattctcctgcctcagcctcccaagtagctgggattacaggcactcaccgccacacctggctaatttttgtatttttactagagatggggttttaccatgttggccaggctggtctctaactcctgacctcaggtgatccgcccgccttggcctcccaaagtgctgggattacaggcatgagccactgcacccagctgaggcatttgactttttgctattgtggggttttgaacagagtggtgacaagagctgacctatattttaacagattcactctggtcacagtgtggagagtagaccatggtgctaaaggtgggggccaggaccctgtagggggctacagcacttatccaggccagggatgagggaggagtggatgagggtgaaagcataggtggagactgggttggattagggacatactgtgaagctaaagtcaacaggatttgctgaaggattgcatgtggagtgtgagaggaagacaggagtcaaagattgctaccaggtttggagctgagcccaatactccgtggtttgtgtggcaggttcatgtcaataatcttatttcctgctgatcgtcaaaccctcatagggttcacaatgtcagggcttgggtttgggagctaccaagcctgagtctggtactcatttgcagggtggcccaagccaagccccttagcctctctgggcctcaattgtccacctgcaaaatggacctactgatgtttgatagatttgttattgtgaggatcgtggcacctgctgcatagggattgttcaatagtggcagctgttattattgatgagcacagctggaattagaacatggtcctctgttcccagttctgtgttcctttcctgatggctcttttctcaatttctagacagcttctggtcaattgatcattcttgggaatagcatgtcactttccaacattttaattatgcttggtctcatttgagaaaagttttcttcgaccattagactcttttctaagagtctgacagttcctgagttggggtatggtcttgtgtgtgactgtgggtgtgtgggcggcagttctttcaattactttttcttttttctgagacagggtctcactctgttgcccaggctgaagtacagtggtgtgatcatggctcactgtagcctcgatcatggctcactgtagctttgacctcccaggctcaagcaattctcccacctcagcctcccgagtagctgggactacaggcacacacctggctaatttttgtgtattttttgcagagagagggtctcactattttgcccaggctggtctcaaactcctggcctcaagcgattctcccgcctcggcctcccaaagtgaggggattgcaggtgtgagccactgctcctggcttaagtgattttatttggtattgccccctttcaagtaggagccttgtgatccagagcccctcttctcacctggcttaatacatctttttccccagactaaactgactagaccttttaacatttattaagcaccctctcactctagctaagatttagttctagaacactagaatagggaaacttttcctctccccctcccataatttagcacataaacaatgaaatgggaagaaatgttgagcacatcacacagtagaccacgtggggcttgaaagaggggcaggaggggctgccagagcactgcacgaggagcctgaacacctgggtctctactagctgtcaatcacagatcactacctctctgaactttagagtctttgactacaaaatacaaataacagcatctgaccctgtacctcatggagttattaggaggatcaaattagagaaagcatgggaattaaggtgtcataggtcatgaattacaatatttattaaattcaaatgcataagccataatcccactcgccttccactgtgtcccaaagtgtggttcgtggacttccctcatcagaatcacctaaggttgcttaatgaaatactgaattctgggtcctacctcagcccaagtctctccctccccacctcccaaccagccaagtgattattaagcataataaagtttggagctgctggtccaggaactaagtttgatgggataaaaaaaagaagataaaggataattatttaagtgcccatagattcttggcattcacataggtgccaacctataatataaatgactggccttatccatcatgtttgaatattcccaatgggtggcacattgtgttccattaaaaatagctgggtaaggccacttgacagaattttaaataggcaatataaattgttacacacgtcccttctgaagggacatttttaatgtagagtcttttgtctaaagataaatttctaatgttctttccacctgtctcctatgcccccagaacacccagtcttggcttttcttggtactttactaaatgccacgaagctgaggactcactgcttttcaatgccagcatttctgacccaggctcctctcccacagccaacccatcactagggccaaatcagcaattgtacctgccgtaacaatctgggtgagcgcccaggggacagcctgttctggttgaagcaggacctgaagttcttacggcacattgactcagcaggactcagatgcttccacaagccagatgggcagtgggggtttccatatcctcagcctgcaatctctttagcccagataataggcccaccagctggtcatccactcccgaagttttcagctgggcatttctccatccatttaaaagtacagtaagctttatagatacatagatgctccagaaccatttggaataaattgagcatgtggcagaggaagagggcaggggatttccaagaacgaccagcagcacttggagatttgtttcttaaaaaacacgactccttttcttctctgatcctgtggtctattgtgaaatgaccagagatttctcccaaggatcttgagagagagagagagagagacagagagagagagagagagagagaaccaagtgctatcggcaaagaggccatacttggatgccatgatcatcagacatttctctggcccctagaatgagttggaacagagatgcggcgtgcaaaagcctgagcctggagcccggggtgattttagaaaagcaacactccctcacctgggagacacagaaaccttgagaaaagtgtggagcatgtgcttgtgctgaggtgatctatatatctggggcccaaggtacctgcatggacagctagttaacattcttatttttgccattattacttttgttttcctaactcccccggactcactctgcccacccccaccaatgttgtctccccatctgaaatgccctccctcaaagctcccctcctccacgctgtctttcctgaccagagttctcactgacctcccgctgctcagggcgctcctaacagtcatctacccacgttattctgtgcgtatgaatctgacattcccaatatgattgtgcgtcaggcgccaagcctgggcacccttcgttattccacctcactacccagccaaagcgggtgtctgctaaatgcctgctgactcgttggcagtgggctgggacatagaaataatctttaaaaactgaattgggtaatacaatagactttgtgaaaaacagatatacctgaatgatgagaaacaagtttggcaaaacaagacagtagaattattccatcattctgcatctaaaaaaagttagagggagagagaaaaatgaaaagttcccagtgacatcagctttggcagtccctaatggaaagtggccttgccagagccctgctccctcgctcaattgggaacgcttttcattaatgctattaacctggccccacagtcagaggcacagcctgctgggccaaatgtgctcggttccaattgctgaatcatctccatctcttttgcccttcctaataccttcaagaactaggagaagcaaaggagggcagcaaagaattagaagaagcaccaagcactatcaacattagcaaatcagtactaggaagtagcttggccgcttccttccatttccttccaaccctgggaactctttccattaaaaacatttctccaccacatccatgttttagacttctcactgtatcagcccaaaggaaaactcagctctccatccccaaccacataccatgagcgatttccttctaagggaggaaagtcaccctttgcagtttacagcttaattgcttgacatcaatcaagaaaccctagtaacatcctgggaattctgggaccttctgaaagcagcctggaagatcagaagtctttccagctgccccctagactcagcatgattaaaaggtgcggaaggacccccagatgggagatgtggagaaaaacaccaagaaggaagtgaaagtcagacataaccaagaaggaggcaaatttaatcttctctgagctggaaaattaaagccaagagaattctattattaggaacctctgttccgaaggctgggtgggggcgggatgcaaaaaaggctgcactgccctctattgggacctaacagcactcagctaagggctcttcattcatgatctcagttagtcattgcacaacttttgggagctattagtaatggaaaaaagaccagagaaatcaagtaacttgctctagctcatgcaactaggaaatggcacaagcaaggatactaaaccagggacaaatggctttcccagtttattttcttgccattcatctttatagccaagcttttcctccttggacccagaacatggcatgttgtaagcgtttgccagcagttctctctggcatgatgggtctcaaagctagctgcctattagaactacctggagacatgctctaacctgccaagtgttcaagccccacctccagtgattctgattttaattgatcttatgtagatcctagcttaagtaggttttaaaagttctccaggtgattctaacatatagccagtgctaagaattcctgttctagctgcagaagatatagaggcaaaacacatggccccttccaaacctgggacttgtatttaatagaatttaatacgtttagagggcttcactaaagaaaaatcacttttgaaggctgtaggctttctagtggaatgttagttctgctttatggtatggtaggctgaataatagtcccccaaagagcttcacgtctcaatcctttggaacctataaatagattactttacacagaaaaagagactttgcagatgtaattacattaaagatcttgagttgaggagattatcctagattatctggatggcccagatataatcacaagggtccttcgaagagaggcaggggagtcagagttagagaagatgtgatgatggaagtggaggttggaatggtgtgaggaaggaatacaaaaaatgcagtggcctctagaagctgaaaaagggagaggaaacatcctcctttagatccttcagaaagaacagtcctgcacaggcttgactttagcccattgagactgattttgaacttctgacctccagaatcataagaataaatttgcattgttatgagccactaaatttgtgttatttgttacagcagcaaggggaactaatacagatgtggtgcagctcgcttcagccatctgaggcttgggttcctcacctctaaaatggatactcatacctacttcaataggactaaattcaataattataaggaattcttgtggctggcacacagtaagtgttcaataaacggcacctactattacactattacacctactactactacagctactattacactcatccatagaggaacctgggattctcatctcctgagaatcccaggttcctcatgcagctctgagtcaaaacaggtggggcacaaagtggaaaaaatataataagatgtgagaagaaagaggcttttagttgtgcccaaatacatttctacaggacaagggatcaaggtgaatggaaaataaattagcaagagagcagtggcagcagaatttctcagccagctggcctctgggggatgtttgcacacgctggttctgaacatgctatcagattcctggcactattgggtccacttcccaggaactcagccccttattgtaagaattcacaaagagaaagagaaaaggaattagaatcatcataatacctaaaggacccagaaatatacaagttcccctgtccaaatacagctagccagtcaatttctgagcagttggacaatttcaggttcttaagctctcacaagaataaaacattgttttctatctatgtagtgttggttggattgatagtattaatggacattctaccatgtatgagacttatgaccttaggcaaattactctgttcttcagcttcttcacctgtaaaacagggacaagggtaacacctagttgtagggttgtcatgaagattaaatgatttatacatgcaaagggcatagtaaagtgcctggcacacagtcaagtgctcggtaagttagctattaacattcccagcagggttatttttattttggaaaaagacatgaggctaggtgaaggaagccaccgacttagaatacttttcatgaagaacagtatttttgttgttgttgttgagacaggttctcactctgtcacccaggcaggatggggtgcagtcacgcaatcatagcccactgcagcctcaaactcctgggctcaagcaatcctcccacttcagcctcctgagtagctgggactaagacacaatccaccacacccaggtaatttttttattctttgtacagacagggtctcaccatattacccaggctggtcttgaattcatggcctcaactgatcctcctgccttggcctcccaaagttctgagattacaggtgtgatccaccgtgcctggcagaaagacagtaatttttaatgtccttttattgttttatgtagttttgtttttaaaggagcttcaagagaaagaagtccaaaataggagccagatacaggcacgtattcactcagccaatatttattgactgtcaattatataccaggaacttttctaggaactggggcctaaagataaacaaaatctgttccctacacataaggagtgttcagcataatggtggaaagagagatggtagattcctagcacaagacagcaagacacatgctgcaataagagtaggtagggcatggtgaagagatacataggagaaaatctgatctgggataggggacatcagggaggacttcctggaggaagcaacatctaaattggctgagtaggtttgcagatggatgataaggatgtggagagttttagaggaaaccagctcttccgaagttttgagggcaagagcaagcagtgttttcaggaaactgcagtcaagatgaacccaaggggtggggccaggcctgaaacgggaggtgagagattcagcaggagttctaaatgccattcagatcacagatcacaaagatggagaaccatgataacgagtttgtattttagcttgaggacaatgaggagctgttgaaaggctttaagcagggcaatttcacaataagatttgagctttagaaagatcactctcaggagagtagttgaaagacaagatcaaagtcagaaagacaagctggaaaactattgcaataattctggtgaaagataaaagaagacagagtcaaggtactggcagtggggaatgattaggcatggacagatgttagaatggcagacctgcagactctgtgatcaggtgagaaagggaggaaaaaaatctcatttccaggtttctaacttggatgaaaggtggtaccactcactaattcaggaaatccaggaagcagaagtttgagaggcaggtaatgagctcagcttttgacaccttgatgtggacacattgaaggcctgtggggaccttcaagtggacatgcgcagttagcagctagatatgagccttgagttcaagatgaagacttgagatttgagtcattggcccatagttcgtctatttgaaaccatgggaatgggtgagaccacccggggacagtgaggagttcaaggtggaggcatgatgtcctctggcaagaatgctgtctaaggagacacagagataagacagtaattggaggggagcaggaggtaaagggagatagtgttttgctgtttttgtgttttaacaaacacttgagattgttgaaatgttgctgatgaagaggaatggggtgggtggggaaagaaaggattaaagtagagtctatcttctttgttcacagattttgtatttgcaaatttgcctactcactaaaatgcatttgtgaccctaaaatcaataatcacggtgctttcatggtcattcctggatgggcacctgttcagagtgtcaaaaaactggatcctcctgatacacttgtccccagctgaggttaaacaaggcaatgctctgccttcctgtttcaactctcatactataaatgtgtccttttcgcagaatatttagcgtcacatttttcacgtttgtgcatttcgttggtgatttcgctgtttaaaattgcctgaagcaaaatgccgaagtgctgtctagtgttcctaagcccaaaaagctgtgccttatggagaaaatatgggcattcaataagcttctttcaggcatgagttagtgccattggttgggagtttaatgctaatgaatcaagagtatatggtaaataaggtatctctagacagaaatatgcataaaataggattatgtgccgatctgttgatgaaaatgttgtgaacagagcctcaccggaaataaccctgtatttcctctaggtgcaatgatcccatattcgctaattagtgttggcagtaactttataaaatgcaactactacacataatgagaatcaactgtgtaagagagagggagagtcagaggccccagaggaggatttgggtggcgtgctttcaggtaatggagtagtctgctagagtccctgatcttgtcatgcaataagtgtgctagaccaaaatattccttttaactgaagacaccaccaggagatagctttcagctggctttgctctgaacaagctgccctggcacatgaagtgtgggaggatgggtaggaaagggaagtgagatcaataaggagacattgaaaataaaatacgggtggagagagaaagagggtctccttttgttgctctctctctacattgcgcaatttataaagtttaatgggggagccttttctgatgatttcttagggactcacagattttacattcctgcttcttctggtgataccgaactttattttgatccctacccaaaactgtacagtttaatcttcactttgcctatgccttggctcaaaaggaagttagtttcaggcaattgagatttggcattacacagtaatctcttttttattaactcatctcagcagctgaaagcattgaaaaaacactccaacaatattgtaaccaaaaaaaaacaaaaagccaaaaacattgtaaccaagtttatatcctgagggaaacactaagaacaactttccctcttcatctccctttaccctatatgagaaaagcaaggcttctctattcccaaagtgagttcaaagtaaaggaaaacattgctttgttttacgtaacatgcatattttgaagataggaacaagacttcaggagaaaaacaagttctcaaacactgaccgtccttactaggctaggtgaagttacaatgaaactctgatgttgggggggaaactgacacctgttctatttccacgtcaggtcacaaaaggcagtaccatctgttgccaagtatcagaaacctctctcatccagcccctgactccactgattgctaatttataactgtttagagatggctgggccaaagctcacttctgttctatctgaacaaaagaggctcttagctgactaacaaggtaaacaagttcaatttatttaactaaacatacttttttgcagattataaatttaacagagtttgctaacactagtgaaattttttttttattttttatagtctattaattaatagactatatttttgagtagttttaggtatacagaaaaattaagcagaaagaacagagtcccatattcctcttttccatgcaccccacccccccccacacaccaaaatttcccctgttattaactcttgcatgtccaaatgtggtacatttattaaaactgatgaaccaatacattattattatttacagtccatagtttacattagggttcactctttgtgtacaaaacataattttaatatgtgttagaggcactgaaatcataaaagtaaagctaccacttgtagagaaatctccaggtcacaatgctttgtcacaaaaaaaacccaattttttcctttatttcgaactcactttgggagtagagaaagcttgcttttctcagtgttacacgtaatgccaataaccactgtcacaaacataatattcatcataacagtcctgaagatgggctgaaactcttacttatagaaaaggagctgacgttcagagaggcaagcagcctgccaaagctcctacagctgtaaaatggcagagacaagatgggaacccaggtcttcttagttctttgccagttatgttaatgctaatttttaagaggccactcttagccccatgtcttcctcacattcagatttctgtttctaagcagaggattaagatgcacactgctcatgtttccactgagaaacaaactgtgacaaggcaaatcagatggcacttggtcaaatacatggctggttaggggacacaggtattaattattcttttgggcttggacatcaagtctatacttacagctaatttacttgtctgtcttccctctagacagcaactctagaagaaaaagaactatgtctacttgcttgctattgtctctttgttgcttacttactgcctgggacagaatagcaattaaacagcagttactaagcatgtcgatggaaggatagctaaccccatcggtaaggagtactaaccatacacactgcctctggaatcactttctgatatcttcccttttgcttttctggtagttttccaactactctttcacattgccttttctacttctatattttgggccttataatttcaaccatatcctataattacaagatcatttgaaccaacaccaaacgtcccaatcattttcctttccactacataacaagactcagacagcctaccatttctcttaagataatatttacatctttggtctgcgtccagtacccaggtccatgtgcctgtggatgtgtcagtgcaaatagctcttgccttgtcccttctcattaacatgaatggcaaaaaggatttgagagaaggaatattgggtattccaggaaatctaagctctaaatctaagttctgcttgcaggtctttatgtaatggaaacctgtttcgctttgagtttcttagccacaaaatgggaataatatcatgtgtttttaggacatctcaaaaactgttttttatacatgagcaaacaaggaacgttaaaatgtttgtacatttcattaagctgtttattagtatttgtaaatatcgcattcaaaggcttgaggcaaaagttacaaactggtaacttgagggaccacaatgagtcaatagaagtgttttgtttctccagtgatgttatttttagaatttaatccagttactaagatgtttcacattgggagacttcacattaaaattttggcttccctttaaaaatctcaggattaggcatcctaagcccactgatatggtttggctctgtgtcactacccaaatctcatctcaaactggaatccccatgtgttgagggagggaggtgcttggatgaagggggcggcttccgccatgctgttctcatggtagtgagtgagttctcgtgagatctgatggtttttaaagtggcagttttttcctgcacttgcacttctccctcctgccgccatgtgaagaagctgcctgcttccccttcactttctgccatgattgtaagtttcctgaggcctcccctgccatgtggaactgtgagtcaatgaaacgtttttcttttataaattaccagtctcaggaatttctttataggagtgtgaaaatgggctaatacacccccactgctgtttggcaggaactgaccaaagctgagcaatgatcacttccaagtaaagccataagagcattcgagtttgccacagtctccaccactccctattttatcacatgtaatctgatatagtttagatgtcccgtccaaatctcatgttggaggtggggcccacgttggaggtggggcctggtggtaggtgtttgagtgtttgggtcatgggggcacatccctcatggcttggtgctgtcctcacaatagtgagttcttgtgagatctggttatgcaagtgtgtggcacctccctatcactccctcttttgctcttgctatgtgatgtgtctgctcccactttgccctctgccatgattgaaagccacctgaggccaccccagaagctgtgcagatgccagcaccatacttcctgtacagtctgcagaaccataagtcaattaaacctcttttctttatcaattacccaatctcaggtatttctttatatcgatgccaaaacagcccaacacataatctttgccatagtccctactacttcctgttttattacagccagtctgctggactcacttaagttactgtctggttcccagaggcatttgaatttgactacccctgttttaaagaagtattacagagcatatagttgatttatcagtctgcagctatcagattgatcctgttcacaaatagttctaaagaagaaaatccatagtattttgcaagccattcaaacactaaacctttctcttctatccagaaaattttcccctcactataaataggccaataagagcaatgtaggcttagaactaaatggcatcttatagctcatctggtccaaccaccttatataacatttgagaaaactacaggcctagattgtgaagatgcccaatagctaacagggacgagaaccagcttcccactggaaagcttcctggaacttctcattctttccaaattaggcatagaaaatagctgcttattttactttgtgaaagcattttaggcttggactcaagggcaggaagtgtttttttctcttgttttagattctcaggaaacttattttcctaaccttaattaccatgaagattatctgttgaaccctctattcatttcctggggcttccataaccaagtactacaaaccagttaacttaaaacgatggaaattcattctctcacagttctgagggctagaattctgaaatcaaggggtcagcaaggccatgctcccttccaagtctctcagggaggaccctactttgtctccccctggtttctgctggctcctagccacctttggcattcctcaatttgtagttgcatcactccaatctctgcctttatcttcacatagtcttcttccttgtggctccacgtttctgtatcctactctctgtctcttataaagacatcagttggccaggtgcagtggctcatgcctgtaatcccagcacgatgggaggttgaggcaggtggatcacctgaggtcaggagttcgatacgagcctagccaacatggtgaaaccctgtctctactaaaaatacaaaaattagccaggcatggtagcaagcgcctgtaatcccagctacttgggaggctgaggcaggagaattgcttgaacccaggaggtggatgttgcagtgagctgagattgcaccattgcactccagcctgggggacaagagtgagactttgtctcaaaaaaaaaaaaaagacgttagtcattgggtttagggtccaccctgacccagtatgacctctgagatgctgagatggttaattttatatgtcaaacttgcctgggcttacggatgcccagataactggtaaaatacgattctgtgtgtgtctgtgagggtgtttccagaagggactaacatttgcattggtgaactgaataaagcagatggccctccccaacgtgggtgggcatgatccagcagaacaaattggggaggaaaggtaaatccactctcctgattgggctgagacatccatcttctgccctaagacattggcccttctggttcttgggctttcagatttggactgaaactttattagtccattctcatcttgctataaagacctaagacggggtaatttataaagaaaggaggcttaattgactgacagttccacaagctatacaggaagcatagctggggaagcctcagaaaacttacaatcatggcagaaggggaaagggaagcaggcacgtcttacacggccagagaaggaggaagagagcaaagcgggaggtgctacacacttttaaacaaccagattgcgtgagaattcactcactatcttgagaacagcaagtggagagtgtgcctccatcattcaatcacctcacaccaggcccttcctccaacactgggaattacaattcaacatgagatttgggtggggacacagccaaaccacatcagggactggcaccattgcccttcattctcaggtcttcagctttgggctgaattacaccaccaacttccctggttctctaacttgcagatcatgggactccttggcctccataactgcatgagccaattcctatactaaatctcttcatatatgcacgtatatatatacagctggccgtctatgtccatggattctgcatccatggattcaaccaaccacagatcaaaaatatttgagaaaaaaatgcatctgtactgaacatgtatagacttttgtttcctgtccttattccctaaataaaacaactatttatgtagcatttacattgtattaggtattataagtaatccaaagatgatttaaagtatacaggaggatgtgcatagggaagatggcaaatactatgccattttatatcagggacttgagcaactgcagattttggtatccaagggagatcctggaaccaatcccacacagataccaagagatgactatatatatagaattggttctgtttctctagttttttgttccactacacacagatgagtaattggaaagggaagagtatattaacagccttttcagatcatggtgaagattctgctgtagattataccaaaacttgacaagttgtagtttcttaaaggaaaattgccagctgggcacggtggctcacacctgtaatcccagcactttgggaggccaaggtgggcagattacctgaggtcaggagtttgagactagcctgaccaacatggagaaaccccatctctactaaaaatacaaaattagctgggtgtggtggcacatggctgtaatcccagctactcaggaggctgaggcaggagaattgcttggaaccaggaggcggatgttgtggtgagctgagattgtgccattgcactccagcctgggcaacaagagggaaactccctctccaaaaaaaaaaaaaaaaaaaaaaaaaaggtaaattgccatatgaaatctgaaaacatcaatgaatgtttcatactcaattactttttcaaattttgtaacattatgcactggtcatttggaaaatattgttttaatgagttgtgcagaccttccagatgttgacacatttcaatatataatataaaaatatcaccttccaaaatatcaccaccaatttcattctaatttcctttgaaagcttgaattttatcattggcatcaaatattatcttccttgacacgattaactcatattgtcatattgttttccttcactggaaaaactcatttcattttctgagaccatttctatcaaatacccaaacttgaataactataatttgtctgtcagtttttatttcaagcaaaaataatgttctgtgaaaaaaaaccaaacagctaatttagctggcaactcaaacaatcgcataagtgcttttctgcaagacaaccatcatagcctatgcaggagaaatgctttatgtgggccaggcgtggtggctcacgcctgtaatcccagcactttgggaggccgaggtgggcggatcataaggtcaggagatcgagaccatcctggccaacatggtgaaaccctgtctctactaaaaatacaaaaattagctgggcatggtggtgcacacctgtagtcccagctacttgggaggctgatgcaggagaatcgcctgaacctgggaggtggaggtcacagtgagccaagatcgcaccactacactccagcctgggtgacagagtgagactccatctcaaaaaaaaaaaaacagaaagaaagaaagaaatgctttatgtgtactttccaaatcaagggttgagatgtaacaaaattaacttttactgcaccaagggcatctcagtaaaatgctttcttgtattctgtggttgtgaggaatacagtgactacagtttggtgtcaggatttgtgctgagccaccagcagtttttcccgccatcgcttttccaacatcagtgcaaatgactatgcagtaaaaaaggcaaataatatcttgaaataattatatatgtatatttcattagatatagatattccccactgaatatataaaattttgaaaataactttgaccttgaaaacttatgaaagtgtctcagggacccctaggtatctttacacttggagaactactactccagatgaacagaaagataggacaatgactatctgaaatttagctcctttctttgggaagcaggctctgctagccaggaagaaggaagcaaagaatagctatttgttagcaaagacttggaaccaacccaaatgtccaacaacgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacaccgcatgttctcactcataggtgggaattgaacaatgagaacacatggacacaggaaggggaacatcacacactggggactgttgtggggtggggggagaggggagggatagcattaggagatatacctaatgctaaatgatgagttaatgggtgcagcacaccaacatggcacatgtatacacatgtaacaaacctgcaagttgtgcacgtgtaccctaaaacttgaggtataataatattaaatttaaaaaaaaaaaagaagaatagctatttgttggctaccaacagtacatgccgtcacctttaaagcacacttgacacagagaaagcactcattgatgttcactgttgttgtgttattattttgtatatgagcagttgattttccttcccacttgcctctctagcatgctttttaaaaagcgactaatttatttgattttctcaaaatcttgtgagatgcaacagacattgtttttagagaaataggttatgtgacctaagatttcacccaaattagggggaaaatcacaatatcacccagtacaatgctccagggcccctcaccaacctgtgtctcacaggggcctcatatgtatccactggactcaggaagcatagctggtgaaatcatatcaactcagactccagaaagctacttcagacagtttgatcacagaactatgtatgagattctcagggattttttcttctatggtactatatatccttacccagttagctaacaactcaaatgaacattctttaaattctatccatgttcttatgtcaccagagagcttacattctatagtatattattttatgtccctacagaaatgtattcattgaatggttaccaccatatatcactgatattataatgtgcccttttgtcattttaacatcttttaatttagaatgaattttatagcctatggaaagtcatcatgtatttggcagtgttttccttttcttactgatacataaaataatgatatatctattatcaacgatgtcttcaattcaacaaagtatggtatttaaaatgtgactctatcctgttccaggactgatataagaaataactacagtcctacatggcttaacaacaggatacattgtgaaaaaaatgcattgttaggcgatttcctcatgtgcaaacctcatagagtgtactcacacaaatctagatggtacagctactacacacttaggctggctgtaaggcatcacctcttgctcctaggctgctaacctgtacagcatgttactttactgaacactgcaggcaactataacacaatggtaagtatttgtgcatctgaacatatctaatcacagaaaggtacagcaaaaatatagttttataatcttatgggaccaccatagcataggcagtccatcattgaccaaaacatcgttatgtggtgcatgactgtatttaaagaccacctccatgctttctacaaaactattatgatacatcatgcattctctggtttaatgcccctaaaacaaaactggcacaataaatctctagttccctacttttagctcttttctatgtccaagagggtgagttgcacaccataatggctccacaaattgttcctgaaaatcattgaaaataatttaaaattaagaatacaaaaccaggcataaacatttggaagggactccagcaactgaatggctctgaggcttaaacttcactaggctctaggtgtggccatgtgtctggccagtgaaatgcgaacagaagtgtggagtgagacttatgggaagtctctttacagagagaaaagaggcctctcttctttccttcctccatcccacaatctagaactcacgtgtggtggcctgggctccagcaactatattggacaaagaaaataaaggacatagcccagatggagggacagaaagtctaaaggaatctaagactctgatgactgtgaagctgcctgccaaccccaggctgcttccctcccagacctcttgggttgtgaaggaatgaagcattgattgctcaaaccaccatctgcggtttctcttgttatcagccaaacacagtccaccactgacacagcatcataaagtatcttggtccatacaagaagggcatacgttgcggcaaggatggaggtcatggaatgagcctaagactgaaggtcagaaactctctttctagtctttgctactccagtcctgtctttagcttgctccaggaacttaagaaacccacttaagctgtatttactttaagtttcctcatttaaaaaaaaaaaatacaactttctcccatggagttatgctagtaaatcatatacaaataagaaaggactttgagatggtgaaatcacacatctttgttctggttaatggtagcagtgatgcactgagagagaatcttttcatggtcccgttcctgctgaatgagttcagatctagacccccatatcctgggcagtgccaatgttaaaaatcaaaccataaatagtggttcatggagtaggcacttaaaaagtcttcaaattatgaggcagttgcaaagagtgatcagtcagttcccacattctccaaggatcgtgattaggaaaagaatttcctatttgggtatcatctcagagatggttccctaggaacagagcctatgaaattggtattctcgtgtgaacggatttcaggagaagtatgtaaaggagttagggaagcaggtgagacagaggaagaagatagagatgtgagttcagctgaagtctagcctcagccccatcccacagggagctctggagcgtgaccggcaccaaggaattgtccgacctcaaggcaaggggaccaggcctttataaccctgtgcctgccagtcactggtgcagaccacccctgagggtgaggggttctcccaagcatctctggctgaggaggttcccactggcggaggacgattctccagaaagagcgtgcctgagatcaggcagcagccagcactcccagtagctgtgtggtggtgcactagtctaataaggggacctgggtgtgcatccccgcatctaccacaggaacagaatgctggagtatttggggaggaagctcctgaccacttctctagaaagtattattcatacctttcaagacttcccaacctgctacgctatagacctctgtttggggcaacaataggtgtgctctcagtgataaattctgagcttgttctttaataggcaacaggcaaggaaaacaaggaaagtgttactgtcattcaggcttggcttccaggatttctccacagccttggggatttgaaggtgttggtgaatcctactttttctcttctttggattccaaaccaatggagaaatcatccaggaggatcaaagatcgcacgaatggcattcttgccctgaaggctggttttaagacttgtcctggatccaagaccaaagggagtatcttctcgttccccttgatttgaagttgcaccctggtcacagagcaagcaatggtggggcaggcactctcagctgagtggaggggagggggatgggtgccattgggggcaggcagaaagtgttgaggagggggacttcatgccctctccccattttcccaaggaagactagaaagaagagctggaattgctcctcccataatcttcctggggtggagggccaggagggttcctgtagggatcatgtggactacagcccacagcccctcccacagcttccctcccacagactgctaaagacaaaaagaaaggatgctctaagtctggagctggcttggaagccctggtggacacactaagaaagaaaagccatcccagacttctgaatcacccacacccacttcaccattcagctgccccagatctccttttttgcaccaagaaccggactagttttgtcactcttggctgaatagctggaacacatcagcacctattgatacaaatcacttctgccggtctccaccagccagtgcccaacagctgtttttctatgtcctttctctgaaagcattatgcagccttatgtacaggttgacatcgtgaagtattgcttcttctgaatttactgcattttctgttcttggaggtaatagatggcccactcagcttcccttcactgcagacactgctctgtagtctccatagctcccaaatgcattagtggatcaggcaggatgagaattacagcatcttgtgctccaccatggcttcctgcttggtgtggtgttttccaatctgctgacatctcacaaacaaataaacattgtagttacttttgttttgttttgagatggagtctcactctgtcacccaggctagagtgcagttgtgcattctcagctcactgcaacctctgtcttctgggttcaagtgattctcctgcctcagcctcccgagtagctgggactacaggcacacgccaccatgccctgctaatttttgtatttttagtagagatgggacttcaccatgttggccaggctgttctcaaactcctgctctcaagtgatccacccaccttggcctcccaaagtgctgggattacaggcgtgagccgcctggcccattttagttacttttggctataccaacaggtcatatttttctctgtcttatctcctccttggctcccaaacccctgtgcatcatcactgtgatgtctgctgtaatgaatgacatacttccagttataagaagcatcacaggaagacaaggaaagggccctgcctttaaagcatcttctcccaagacctccaggtcttaggatgttggcccttgccctggtggccttgggtgacggaagagtcaacgatttctaaaggagacttgatttgcaagttgggttaatctgatcttctaccccgtgtaaatgatctcttacttaaaatacttgcgcattttgaactgtctggttgccgaagcagggtggaatgttccagaggaagccacataactgcagaggtttaacacacggtgggttccgccttgttgtgcaatggctattttcctgacagccgaggctgctgccaggagtcaaggagagccagatcccacaggagccaacaagaattgtaggcaaatatcctcaggctgaataatagcgatggtatcttgaaattgactcgcttccaaaaactccatcgaacagaagagtattttgcatatatgtgatctctgcttcacagggttttcttttgttttaatggaaaaacatcttttcataggtctataaaacatcccttcagcccacccaagttcaagtcatcactgtctctcacctgaattgacctcacgtcttccttctcagctttgactttctgtcttccctcccacagctgccagcttccatctcctagtgcccagcttttatcgtgtttttcttcagttaaaacttgtcaaaggctctccttattgaattgagtacaagtgcctcagtcgtcccaggcctgccatgaagtagacctgatttaccttcctaagtgtggcttgctcttccctctctccaaatgagaggcaccatgctgcctctccttgctcctgcatgaacagcccccagccacttctaccagaatcttgccatcgttcaaggccaacccttaatgccatcttcttcaggaagcttaccctgatctttctaggcaaacatactttctctgggtgtcgtgatgtggacgcacaatttcctgttctgctctatccatttgtgtgcttgtcttactcttctctttgagggccatttctctgtctgttcatcctgtatctcccacagtatgtagcagtgtcctacacttagtagttgctcaataaattgtaatcaaattagagttagagtaggtactgttattatgcacactgaaatactatcttcctgaaattttctattctatgttcagaaattataacactcatttccaaatatggcatcaagatggaaaacttgtgcttttcactgttcagaacaatttctgttcatcaaattttagaaagcatagaggtctgcagctggggacaggaagacagggcctaccagcttagaaattcccaaggttttggagttaggtttgaatccctgttccatcactgacaacttatgtgaacttaagcaagttcctcagtctcactgaacctcaatttctcatctccaaaatgaagacaaaactacctattttataagctttttgtaagaattaagttagaacatttctatgaagcacctaactcagtgcccagtaatagtaggtaaatcgtagttctcataattatatttctcctagtagtaaatcagcttccatcatcatccttatcctacccatattttattcagaatgaaatattaaagcttttaataagtatatagctgacccttgatcaatgtgagggttaggggccctgactatctatgcagtcaatagtctgcatgtaacttttgacccctaaagacgtaactactaataatagcttactcttgaccagaagccttttcaataacatgaaaagttaattagcacatattttgtatttgtatttgtattagtccattttcacactgctatgaagaactacctgagactggataatttatcaactaaagagatttaattgactcacagttccacatggctggggaggcctcaggaaacttacagtcatgatggaaggggaaagggaagcaaggcatctcttacgtggcagcaggagagagagagagagagagagagagagaaagtgagggggaaccagagtgagaaagtgagggagagccaccaaacacttttaaaccatcagatttcataaggactcactcactgtcatgagaacagcatgggagaaaccgccccccatgatccaatcacttcccaccagatccctccctcaacatgtggggattacaatttgagataagatttgggtaggaacacagagccaaaccatatcagtacaatatactatattcttataacaaagtaagctagagaaagaatatgttattaagaaaatcagaaggaagagaaaatgcatttactattcattaagtggaattggatcatcataaaggtcttcaactttattgtcctcatgttgagcaggctgagcgggaggaggaagaggaagggttggtcttgctgtctcaggtgtggcagaggcagacgaaaatccatgtacaagtggacccaccaatatacagttgacccttgaataacatgggtttgttaacaacttaacaatttgtaagttcaagcccatgttgttcaacagtcaacttatgttgagcacctactaattccctggcatgctactggggagaagaatgagggtgagtagacatgggacttcaaatattgaataatacaagattataatctgattgtacgaggatattggcaacaagaacatttactgaactgccatagacaggtgttcaatgtatgttcaaaggtaaaagagatctacttaaatcaaagggagatgcaatgtacttgtggcaatgagaagcccttggacaaggcttgtgagccccactgtccagggctcctctcccaaggctgtcaacagactgattccagcatttttgccacccatctgaccactggagcagggctggcttcacaggcctgagacctgtgcagttttataagccccacaaaccccaccgccacacttagaaggcccttgtggttggtttaattctctgctgctgttgccttgaaattcttaatgattctctaacatgcatcacattttccgtttgcactgagccctacaaattatgtaaccagtcctgcttttggagtgtgagaggtgatgcttaattcatttttgttcccagtgcctgacacagcatgtgctcataaatatttttgaaatgaatgaatgaatttcacttttataatcatacaggtggcaaatgcttgtacacccactgtattagtcagggttctccagagggacagaactaataggatatgtgtatatatgaaagggagtttattagggagaattggctcacacaatcacaaggcgaagtcccacgatagatcatctacaagcaggggaagaaagaagccagtagtgggtcagtccaagtccaaaagcctcaaaagcagggaagctgacagtgcagccttcagtctgtggtcgaaggccccggcaaaccactggtataagtccaagagcccaaatgctgaggaacctggagtctgatgtccaagggcaggaagcattcagcactggagaatgatgaaagctagaagacccagcaagccagcttatcccatcttcttctgcctactttgttctagccatgctggcaggtgatcggatggtgcacgcccacgttgaggatgggtcttcctctcccagtccactgactcaactgttaatctcctctggcaacaccctcacagacacacccagaaacaacactttaccagccatctaggcatccttcaatccaatcaagctgacacctaatattaaccatcatattcacctttacctaaagtttaacacttaaaatgtactaatgttaggtgccctgtaccttggactttgaattttttgaaataggacttttgcaattttctccaaaatccacatgtggaggaaataaggagaacagcccagcagctgggtgccttcctctccacctcagtttttaacacctcggttttacctgttctttttatacacagttataacctagatcctcctatactctaacacacacacacatgcatgcaccttttgctgagattgaaaccaacttgtactctcaagtaaaactgatagcatacattaaaaagaaattcaagtatgatttctgaaaactggtgcagtaacagtagacaaagtggaaaaaaatttaaaaagagattcagattgtttttattgttgtaacatgtatataacataaaatttaccattttactggaaaagacatttcttcaaagaggatatacaaatggccagtgagtgcatgacaagatgcacaacatcactaatcattagagaaatgcaaaccaaaactacaaggagataccatttcatatacactaggatggctactattaaaaaaacaaaaaaaaaacaaaaaaaaaaaaaacagaaaataacaagtgtgggcaaggatgaggaccccagagaaattgggacccttgagcactgctggtaggaatgtaaaatgattcaaccactgtggaaaatggtatggaatttccacacaaaactaaaaatagaattaccatatgatcaagcaattctgcttctgagtacatacccccaaaaaactgaaagcacggacgtgaagctcatcgcaactttatttacagtaaccaaaatgtggaagcaacccaggtgcccacagatggatgaatagaaaaaataaaatgtgaagtatacatacaagaatattagacagccttaaaaaggaagcaaatcctaaagcatgctacaatacagataaacctttgaggacatcatgctaagtgaaataagccaatcacaaaaagacaaatagtgtatgattccactcctatgaggcacttggagcaatcattgcctctatctactccgggaccctttcatcacccccagctgaaacctcatacctcatattattattaaacaataactccccattcctctctcctccaccctgctaaccaccattctacgttctgtctccatgaatttgaccattgtcagtatctcacatacgtggagtatttgtccttttgcatatggcctgtttcactcagcgtaatgtctgcaaactccatcatgttatagcatctatctacgtttcattcctttttaaggttaaataatatttcattgtatgtatataccatattttgtttattcattcatatcaattgacatttgggttgtttagatgcatgttttaaagacagggtcacagtattccccgagagtttttaaattttacaatatgcaatagaaagtctttttgatgatgggggttaatttctcccagcgccagcaagtcagctggcccctctttcctgaatagcctcggaggttttctgtgatcacaaaagaatgctgtcagggaaaaaaaaaaaaaaaaaaaaaaaaagcctctccagagataactcttcggtcaaaccaggtttattaagggatgtctcctgccgggcacggtggctcatgcctgtaatcccaacactttgggaggccgaggtgggccgatcacttgaggtcaaactttcgagactagcctggccaacatggtgaaaccctgtctctactaaaaataaaaaaaattagccaggcgtggtggtaggcgcctgcaatcccagctactcaggaggctgaggcaggagaatcgcttgaacccaggaggcggaggtcacagtgagccaagatcgtgccactgcactccagcctggatgacagagcaagactccatctcaaaaaacaaaaataaaaataaaaaaataaaaaaggatgtctctaaatgtctgttcaatatggaacaaagccagtgggtgctccagccttacgaaaaagacacagatgctaaaggctttctttcatcaacagcctcacacccccaaagatcatttccacataatgcaaacgagccccagtcaggtctgccatgaagatgactcaggcatgtgaaatctcaaacctctcactcttaggaaaagcatattttaaatactggagctcctggtgtgttggggatggagctgggacacaagagttgatataaatgtctcagcttatggcttatctgttgtggaacacgccaactttactaccatactagatttatctaagtcagtgaaagccttcaacaaacctcagacttcagaccttctgacttcagttagagcatggaacagcatctttgacagagttggaaagaatttatccttctttcctattcagttcatctgtcacaaatttgcagagcatgtgtgacaccgttcccagacatctttttggtcactggggctagagaagtgagcgtgacagacaaggttcctttactcaaggaggtcatacacttacaaagagccagcaagcaaacaaacgagatggcttcagattgtggtaaatcctatcaaggacacaatcagggacctgacacagtggctcatgcctgtaattccaaaactttgggaggctgaggtcagaggatcgcttaaggactggagttagagaccaacctgggcaacacagtgagactccatttctacaaaaaatttaaaaattagccaggcgtggtagcacacacctgtagtcctagctactcaggaggctgaggtgtgaggatcgtttgagccagggagttcaaggctgcactgagctatgatcatgcactgcactctaacctagatgacagagtggaccttgtctcttaaaagaaaaagacataatcaggaacatgagagagggagtgactatgaggctatgtaggtggcagagccactgcccaccagggcttgagggaagggtgctctgaggaggtgatagatacttgaactaaggcctaaggtggagatgcacaagccatagaaggagctgcagaaagggccttccaaccagaggacattgtgcatgcataggcatagctttaggaagagcttggcgtgtgcaagttgcagaaagaaggcaggcgctacagccagagtgcgatgagcgaggagcaggtggtggaggcaggcagggcggtgggggttgtgggagggcttctggccagttatggaaagccacaggaagatgagaagcaggataacgatctgaatgacatatttcaaagagtacgcaggctgcagctgcggggtggagaatggattgtgtgagtctcctctttctcccccgtctttcctttgagaatatcacaggaagggcagcaaagcgctcaccctcacctttcccttactcagtgagactctggactgtggactctcatgatagagataaacttttattttctgtcttgtttaggccactgttaggctgaacctcttttatcctttgacctaattatcaatgtctgatcctagttaataaagctctcacttttagctgctcataaaagctcaaactctgggaaccactagttcataccctccttggcctttggcatattctattcctccttttgtctctaatgttttgcttgcatccttggcacaaaacacccacccaatacctaggaggtgttccataaacactgaagaggaggaggaggatgcagcgcctagaggtgtcttgttgttttcagaccttgttagtcatcaggtgtcagaagaaatctgtaatgtggacttcatcatgcaaaatggctcacgccttgccgagtggcactcagcccaggagtgcgaacggggagaggagatttcagccagaccctgactcttgttacctcacctggggatgtgcagccttgaatgcactgactcaccatccgcttctgggaggctattatttttatcagtttgcagcagcaggaagtgagaagagagcttctaggagggaaaggatgcctgagattcagctgaggacttcagctggttccctgttgcagcctcctccagaagtctctgtttttcctgtgtagcgtttatcttaggtatgaccaattaacgtgtttattcaatatatcttcccttattagaccatcggctccacccaaaccaggaatcaactctgcctttttcaccctggtacctggcacacagaaggtactcagtaaaatatcggttgagaaatgaataaatcaaccttttcatgaagaggaaagagataaatagaatcggttaagcttgacacaggaaaacccgtttgtttgtttgtttgtttgtttgttttttgagacagagtctggctctgtggcccaggctggagtgcagtggcacgatcttggctcactgcaagctctgcttcccaggttcaagtgattctcctgtctcagcctccgagtagctgggattacaggcacgagccaccacgcccagctaatttttgtatttttggtagagaccgggtttcaccatgttggccaggctgctctcgaattcctgacctgaagtgatccgccggcctcagcctcccaaagtgttgggattacaggcaagagcgaccgcgtccgcccccctttgcaagctttaaaggaaattatttgtctcatagataggattattccctttgtgggtgagccctggcgagaacctccgtcctgagccaacttccttagcgggattctcaccctgccaggtaagatccctctgttaccaggagctccataaaatgcaaataagtttcaatattcacttaggaaaataaaaatgagcagtaagtcagctaggagcaaaaggaacgggacattcaaaggctgtgcccaatgtcagacagaagtagctttgtaattctcccagtgtagggctgcaggcacctggcgctggagacccggcctggacgaggcagggctcagggcgcggctggaggggctcgcccggcggggcgctggagcgggagaagggcgccctctgccgggggtgaggaagatcagtccgcacgcgcggtgccttggtcttgcagcctgttcgaacctcgcgcgaggacatccacttcttccacggggaaagtaggagggtgggggcagaaaaaccaaactcctgccaagaaggtgctttgcacgagcattttgcgaccccatcccttcagccccgaacctccccctggcataagtgaaaggactgtagtcaattgcagatgctgtcaggaagccaggtgcgtcctcactccccagccctaaaatccaaagaaagaagagattgtttgagacgatctgaagaaaggtcaggtcctaacagatccacgggaccttctttttcaccttccttgtcttgggttctggagcacgggcgctgaatcagctgaatgcggcctgggcatctggaagtggtcctgagggacacctcgcggtgcagcccccgggacgacccaggacaccctggacaccctggacacccaggccgagagccgggacccgcccacgcctcctcactgctgctcgagggtaggcaggagcacgcggaccccgtgggggctgaagcggggctctgctgcccgccctgcgcaagctcccggctctggttgctggtccacaaaatcgggaggctgaattagccggtcgggtggcccccagccttatagcttcgaattctgtgatcctattttagacccagacttgtccgcgaagggaaatgaagaggcgcggaaggcttggagcgtgaaccaaaaaacaatgggtggggatcgtctaaccagctcccttccctagaagggcggaaacggctttcgaagcatccgcgattctctttattgaatcttgagtgacacctagtggcccatccgcctcaccgtcacggcgatgctggtttcactgggcttttcagaaggcgtgctggcctgcccatggttctcggctaaaagactttggagcgtagggtgccgatgaagtttcctgggaccttccggaagcacttgctgtcccgtcaacagccctgtacctgcgatgcatgcaattctaatgaaaatgcccttctcgtctggagggcttgcttgagcacatcctgagctctcaggcagcaaatatagagtcgggtgctattccgggagctgggcacacaaagatgaccaacgcttggtttctgatctcaagaatctcacagcccagctggggggaaatggaccagtagaagagtgtgtatttgatgctgtggggtagagggggtggacctagctcggcctagagacatcaagaaagtcacccttgagctgagttttgaagattaggcagaattctaagatgacccctgaagattctcagcccatccccctcgcagtgtacacacacctttgcccagttattcaatcaaacaatttaggtgcttctgtgaagagaatttgcagatgtaattaaagttcccaaattaattgatcttaagatctggagatgatcctgggtaggcctaacctagccaggtgaacctttgaaagggactggattgtcctggcagaagagatttgacaagcggcaagaactcatcattggcaagattttctttgctggctttacagatgaaaggggccacgtggcaaggaatgcaggctgactctaggagctcagaacgacccctgcctgacagccagcagagaaaccagccttcaatcctaccactgcaagagcactgaactctgccaataagcagggagtttggaagggatccccaagctgtatgagacttagtcccagctgacaccttgattttatctctgtaggaccctgaagagaggacccagtcatgctgcattcaggcttctgacctccagaactatgaactaataaatgggtgttttaagctgttatgtttgcaatgtgttatgaagtcataggaaactgatacagatggtcatttcaaagaggggaaccacatgacaaatgctcagagccataaagaagcagagaactaaagtcattcagagaactaaagacattcggcatagctggaccatggggagcaaaggagacggtaagatgtactcacgagaacttggctttggatcagagagaatgtgcccttgggctagttaacttagctctctgtgcctcagttttcccaaaggtaaaatggaatcataattatagttaaaacatagagttgttatgttagtggcccataggcatatagaaagttcaacacagccttgggatataataagtgttccaaaaatgttaggtagtaatagctttagtaattaatcatgtagttaatggactggaataagaagaggacaagtcatgtggtttttacagagtggtctggggaccatctgcactggatgattccagcggtgagcttattaaaaacccacatgcctggattgtaccttggtcttaccaaatcagactctctgggggtagagcctgagaatctgcactttcaagaagcttccaaagtgatctttgtgataaccaccaagcaagaaataagaagacttgtaagtaggtcactgtagtagtccaggcaggagtggctgataaaatcaagcaaggcactggcaatgagaacagggagcgggtgtggcactctttgaggcagatggaaactacggaactgagtaatcagacaggggtggtggaaaggaaggagggcagaggatgagctggaatcaccgtggggaggtgagttcggggaggattgactcagattgggtcatgagagtccagacatctgtggggtatccaagtggaatgtcacatagacagttagaaagactaaaatgtaggaggtacattggtgctaaaaatacaacgttaagtgtacatgagtccatgaagtaatgggatgatgctggcagaataggaagatggtcaggaacagaacttcaaatgtaccagttttggccaggtgcggtggctcacgcctgtaatcccagcactttgggaggcccaggcaggcaatcatgtgaggtcaggagttagagacaagcctggcaaacatggtgaaaccctgtctctactaaatatacaaaaattagctgggcatggtggcacgtgcctgtaatcccagctacttgggaggctgaggcaggagaatcacttgaacccaggaagtgaaggttgcggtgagccaagatcgtgccactgcactccagcctgagtgacatagtgagactctgcctcagaaaaaaagtaccaattgtgggcgctgggggacctaagagactgagaaagagccaccagaatggttgactgggtgttgggtggacagaagtccgagggggtggccgtcagccagccttggagcagttcaaatggaaaaagtctgtgcacatgcctgacacctagtcaccagcagatcaatggtgggctcagcagggctcctttcagtaggatgaggaaggagggagccagactgcagcctgggaatgtacagaaggcaaggaagtggggattgttctttagcaatgtggctgtgaaaaaaggaaaaaaatagggcaggaattagagattcacacagcccttcctctcccattgcattggtgcaaacctacacacgtgactgaaaaacatggctgagccgggcagccatgtggtgcctgctgaacccagattgtggcagaagtggaggggataggtagggagggtgaggctctcagagaaggaaggggagcctaggtgctgaagaccagcggtgcaccgatgtttacaagtgtagggctggaccacgaggccaagaagaagctggggtggggatggggtttctctgtggggatggaggcatggggaggatggcggtcaacgggccaaaggatcactgagctgtgttgagggcccaaatggggttaggggataagaatccagtgtggagaaatggtgcaactttggggaaatgtcctcaattattctttgcctcagttagctcatctgtactgtcttagtccattttctgttgcttataacagaatacctgaaactgggtgatttataaatagaaggaatttattcttacagttatgaaggctgagaagtccaaggtcgaggggccacatttgctgagggcgtccttgctgctgggagctctctgcagagttccaagatggtgcacagcagcacagggccagggggctgagcatgctagctcaggtccctcttcctcttcttataaagccaccgtcccactccctggataacccattaatccattaacccatatataaattaatccattcatgaagcccaagccctcatgacccaatcacctcaaggctccacctctcaatactgccatgctggggattcagtttcaacataagcttggaggagacaaatattcacatcatagtatgtgccatggaaataatagtaatgcctccctaagaacaccttatagaggattccctgagatgacattcaagtgaccggcacatagtagcattaacaaatgacagctaccaagaggattatggttactattttataagtcagataatgacatgtctctgtttagaaccccctggtcgccttccatctcacccaaagtggaagccgaagtccttaactaggaccatgtggtcatgcacaatctggcctgacacttacctttcccttggttccctctgctccagccaccctgacctcaatgctattcaccaaacacattcctctaccagcaacactcttatcctagttggccttgtgggtcattccctcccttccttcaggactttgctcagtgtcacctcctcagtgagaccttccttgatctcctcagtttcaatttgaaccacccttgccccatccccaagggcttcttgccctcttccctgctttcttgcacttcccactgtggccatgctcagggttttatttatgtgctttctattgtctgccgtgcctaattagaatgcttttcttttgctcactgaagtatccctaagccctgcaacagtgcaaatagttggcactcggcaaatctcgatcatgcactaaagtcttggctcaaatgtcccctcttttagagagcctcacctgccattctatctaaagtagccccccaatcaccccttatcccctgactgctttgattttcttcatggaaccatacctggtattatatatttgtctattcactcattgcttgtctccccagctagatgcagcaaggtcttagttgaattgactggtacatcccaagtgcctgtaataacaccaggtacaaactaggcacatgatacatatttgctgaatgatggtggtatcgttgttatttactgttattattaatagtggtattagaaagcagaagataaggagtagttgatccctgagagtggagtagggcaggggaggactatcctaaatggatagtggaagctacaagaaggaacaagaatacctgctggctactcccaggccaatcccctcttaggcaccaaaagcatagactacaccacaggcaacaaccagggtgtttcttgctctataaatatttgcaaggtgaatgcacagaaacttcttggaacttttgaaggagcatcattaacaccaatatctgatcaatttgttctaagaggtatggggcagcactccattattaaattgcaatttagtagctaaggcaagctctgggatcatgtgctcaagagagaagaaatgaagcagagcacagacaacagaatcacgctgcctggttcaaatcttagctttgccacctatttgaataatgtctctgtgcctcagtttcctcatctgtaaaatgaggatgaataatacctcatacagttgctataaggacacacacacacacaacagtgcctggcatgtgtcaaggactgtgaaagctctggaatttttatcctacttgcaagctcgcaagttagcctgccacatttcatagaagctggtgggtgacgtgagacccctggtcagaagcaaaggactttattactcacagcaacagctatagcagtagcatcagtatttgtgctagttccctgagctcagttcctatggagtgacacaaaggcatcaccggcacatacagtgggctgcattacaggaggggaaccctgagcttagagaacccaaatcttttataatgggcagtcagcatgcctgctctttgctccaggagaagatactatctctgtcttctaaggctgtttgctaataagcatctttgaaaagataacccacaacaaaaagtcagtgctcctgctcataagatgtgcagaagtaagagcgatccgtggagaattgcctctcaagagcatgtggtaagaactttattattactatgggaaaatgaacttatactacataactttcttctggtgactttaaaattgatagaaattagagcaaatcaggacatggactaaggaaaagttacaaagactaatggcaagtcaaggaatccgagttaacattcggtgactagactcccaaatgcgtttcacaaatgggtttccagaaaaactgctgtcagcaattgattgtgatatggggcaaatgagtttgcaatttcatgatgaataatctatcactccctatcttagaaactcaggcattccatcttttttgacaggcagcatgtatattctattgccaggaaggaaggcagttgtcaaattcctaatttttctctttgaaaaattaacatttaactcaaacgtaagatctagaggaacacataagatcttaattacaaagtgcaatccaagatttgcactaattaatatgctgatgaaaaattcattgaaattcagagaagaaccaagagggaaaaaattggccagtgttaacactgagttctataaaatgtgtaagtctatccaaataggcagctgcctttctcggataattatcatttcatcattcatgattattttatttgtaagactttagttgcacatccaaaactatgcagacagaatatttccttaaactttctgatttctaacagttaaattatactagtatatgagggacttttaaagaccagcttagttacctgaaatatgggggttttttgtttttttgtttttgtttttgttttttttttaagtgagagaagccatgtgcttgattcctggttttggcattcactaactgtgacctcccgcaggttgcttaagccctttgagcctgttcctcctatccaaatggggacaataataatgcatgaggttgtggtaaggaatggctattgttgtgaatcagttgcatgccttccttttagtcttcatcacaccagacctggtactagatggggactgaaatatagtaactgatttgttattgatacagctgggttgatgaataagctagtaagtactcaggctgaaaactgggcttccaccctccccaagcccccaggtcctgagacctgggaggatagagattgtatctgcagatccacacccaggcagcctcagggaggatgccaggctgcccactgccccccacccccgacccccatcctcatccatgaggattaggaaagagagcagccagtgtagtgagagggtaaggaaggtctcctgggtatctggaactaggactggagaggggcctcagcttgaggcaggcagcatgggtccctttatgagaccagagctttgcagcgtggaggaggagggagaagggaggggtaaggttgtgttcccctggccccaccagacaatctcaccaatctcataactgcttccactcaatggagagcgatcatgggggcagatgttccttctgactcatgaagtttccatctcctgagcaactgagtaaaagcgcccctcccaggcctctctgagtcatccagcccccacgtggccagtcccccacatggccagccccctccacggccatcagagtctctttccagagtgaaaatttagtcagtatctcagaggataaagtccagccagacacatgaggacttcagtggtatgaaccctgtttcatttcccacgtcacatgccctttgccacaccaccctgccactcccagcccaccactctcaaccccaaacaagccgtgcacctgttgtggcccagccctcccacctaacatacccttgccccctgtccattggtccacagtactcatccttcatgaactactttaaacacctcctctgccttgaactgtctctgactctcacctcccaaggctggtttgctccttatctcctgggggtcccacaccttggtttctctaagcacgcacgcagatgccagctgtctggattcaaatccagtacctgtgtgaccttaggcaagttacataagttcgctgctcagtttccttattggcaaaatagggatgacaattgtactgcatggtggttataaagattatacaaaaatacaaaaaacacttataaattgtacttggcccatactaagcactttataagcgttggctgttataatcattattactattatttaccaagttggtgatttttctacatcctaataccactaggtctattattatttcctttaaatcaactttatcagtctcctgagcagtgtctgtggaattacaggttggaagggatagttatgtttatataatacaattgaaaataaaatacataatgatttaaataaaacctgatcatctgaactccacgcccgccgttcctcaccattatttcctctccaagtacaccgggaataacactgttttatgatgttactcaatcattcattcatctgtctgcagagattataagttgcatgaaggcaggcaccgaagctggattcatgttttactctgcaaacagtttacaagtgccctagaccaggggtccccaacccccaagccacgaactggtaccagtttgtggcctattaggatctgggccaccagcaggcggtgagtgcaggtgagcaagcattactgcctgagctccgcctcctgtcagctcagctgcagcattagattctcacaaaagcccgaaccctattgtgaactgctgatgcgagggatctaggttatgcgctccttatgagaatctaatccctgatccccaaatcatccctcccgactccctcccatttgtggaaaaactgtcttccacaaaaccagtccctggtgccaaaaaaggttggggactgctgccctagactcgtcacacacgcttgataactgttagtgaaatggatgaatgaatgcagttgactgaaatgcatcaactgatgttcaggaacccagaacattctacatgaaggtcagaaaataataaattaagaatttcacaataaacaaattgtgaaataaaatagcaaattaagaacggacgtgagctgccacctccctcttcccacctgtaccccgggacaatgagaatggcctccactcttaattttcctctcttccctttcaacagactaacctcctggctttttgacagcaagttgaaggggtttttaagatggaatgaatcttgcagttgtaatgaatcagaaattgggggaaaacatcagattttagcagcagcagaattctctcactgtttaaaaagcacttgtcccttaggcttggagagattagaagctaataatttgtattgaaatccagcaaagctcttcacagagtcctattgcttgtccctgtcttttgaatgacaagtaggaaaatagagactgatttgaaaacctagggctatttaactaaagcagcaataattcttccattagaaactaagaaatgagaaggtaggaatggcccagacaccacaacaaaacagatgttgctggtggaaggccacacctttttccaaatgaaactcaccagcccttcaagttgagttagctttctaaccctctggacctcaaagtggcaaaaatatttttacatgctagttaaaatgccctcaagctacagtcattagatttgctggacagtggcatcattctgatgttatcggctctgtcttcccgttttcatgaataatgtataagaagcagctattagaaatggattcttccatggctgacagtatcaccaccagacaagcccctggattctcagtcatttcatctgtagctctaacagatctcccttcttttccctctcactgctttctgcctgcctttcatggatggagactcttccaaagactccttatccctgcttctccctcaatactaggaaactggcagggaggcaaaaggaggagcccattaccttcctgccttttaactgttgctcagtgtcagaggaggagtgctgggcctcctgatgaaaccaagttcatcgtcttgcctcctggccctgccagccttgctctggagccaaatgcctgccaaaagatgcttttccttgggcacaggcaagagctggaagggaagctgtgctgagcctcctctacctgctctttttttttctgtatctttctatgtttgcatctatcatacctttacaaagaaaacaaagatctttaagtcccctgctttcattcattcattcattcattcattcatttaacatatttttcattgtttgtgaagcttccattgacagaggtgggcagtaatcaaggattattgagataaatataaaatgttttacaaagaagagcagcaattttgagagtgtctaatagagggaagtagctgagttagggaagtcagtaaggggatatgaagattgagctaaagagctcaaagacaaggaacctaaaatcagtgaatgggatccaggcagcagaaactgcatgtgcgaagtctctgcagcaggagtgggtgtggcctatgttagagaaactggaagaagacctggggccagagcacagtttgctaacaggattcagggcttctccagcccctttgacacttgcccacttttttcttcctgttactgccccctcccatagagtctgaggacggtggtcttggctctcctcccagcttctgatgggtcctaccctcccgggctcctctactattgcctttcaactattgctgctaatgatatgaacaggagacagggaaatactgggtagaagaggatggttcccaggcaaaggccccgccctcaagcctggagactcacagccctaagtgggaacaggcatttctgttttcacacccaaaaagttgccttttggcctgccagatccacctatcctatacctgtataaaccctgaaccccaggctccagaagcatatgagcagaagaggaaatgaggagatgaggggacaagtggacaaacagcacaacagcacagcagagaaagagaaaagagaaggagcatctgaacgccaagaggagtccagctgggggcggtcaaagaggagtttggccgctagacctccaaaactccaagggaaggctatcttcccattccatcccccttccagctccccatccatcccactaagagccacctccaccactcaataaaaccccgcattcatccttcaagtccgtgtgtgacttgattctttcaggacgctgggcaagagctctggatatatacagaaagctgtcacactggcccactgcccttgtgaaaaggcagaaggcccactgagctggtaaatacataagctgtctgtgaatggcaaggctgaaagagcacagtgtaacacgtgcccacttgggctttgggagtcgcagacacccacccctagatgctgccatggggcgggaacccgaaagcactcactctggttcctgcacctgacctgtcaggggttcgagcagcagcgaccaaacaggtgacctctgtcgcatgtcctgcaaaggggatcagggaactctcccgtttcactaacttagaactttcctctgtctctgtgccctggtgtcaaacacagagcctgccaccgtgggtgcctgtagttccagctacttaggaggctgaggcaggagaatagcgtgaacccaggaggcggagcttgcagtgagctgaggttgcaccactgcactgcagcctgggtgacagagcgaaactctgtctcggggaaaaaagaaaagaaaagaaaagcacaatgcatgcaatgagcctctattgttccgggtcccagttgaaaacttgaaaacattctgaccactcaatatgagaatgattaaataaacaatggtacacacaatattggagtgtcatatgatcattaaaggtaatgtttcttcagactaatgatcttggaaatgtctcttggtggaacattaattttcaagacagaatacaaaattcatcataaagcatgatctaaattgtatttggaaaaatgtatatgcaaataaaaagactagaagcaaattcagcaaaatattaacaggctatctattagtggcactattgctggtttttatctcctttttatactactccatttctcccaaaatgtgctaacttaataaataatttaagtgagttgatttaattgaactaaaattcaagcacttattaaacacgaggcatcactagcaatttaatgatgggcagaacataaacgtggtctctgtcctgaaaaattgtttttatagttttttttttaaattttactttaaaaagcaagataggccaaacatggcggctcatgcctataatcccagtactttgggaagtcaagacaggaggatcgcttgagcccaggagtttgagaccagcctgggcaatataatgggaccccatctctacaaaaaatttaaaaatcagctgatcgtagtggtgcacacctgtaattccacctacaggagcctgaggaagaaggctcgcttaagcccaggaggtcaaggatgtagtgagtcatggtcatgacactgcactctaacctgggtgacagagcaagaccttgcctcaaaaaaaaaaaaaaaaaaaggaagaaagaatattcatcatcactcctagaaaacaaattctctccagggtaagtgttatctagcagcgtcttgaagtgtcacccaccaagagtaccaaggactgaaccttggtgaatgtccatttgtcatttctgcccaaagcaagatgcttggaacaaggactctttcctggcagtgacacaaaactccccgctctaccaccctagagtagaaagccccttgtaccacttactttataaaattcagtccccacctccctgcatgcttacagtcacttcatttccagccctcctgagggtacatttccaaggattctctcctgggaatcagccttcaaggattctagatggaaatgccacgtccccacgtgtctgaaacttggctccactacttgctggttcctaacggtacccaaagcaggagtttgtgattaaaccacagacaaagcaccagcctgagcaagcaagaaaacagcaggagcccaaggactcctgtgagctaagagtctgatggttttcatgcaaattgtttttagtagtagggagataacaggcaaataaaatatgggagataggcagagatttttctaaaccagtgatgggggcgggggagttctttcataaaatcccagtgcatccttaacagtaaagctataaagttcccatatttcttatcgagtggaataaaatttgtctctctcagggatcctcctgctcctcctctcccagcctagcacaatcaatgtctctttccccttctctaacgttccatcttagccttgactgaagagtctttttcagaatggcaatgctttccaatgatgaaaagcatattatcagaggacgattttaagtggtagacaaaatgagcaatatttattctactagctgtctatttattttaatgcacttagagtaaaatctgtctagcacatgaaacctatgattttattataggctatgttggcctaagtttttaaaagggaattaatatagagccaataaagagaaaagcattcagtgaatcatgatatgcatggtaggcaaacgcaggaagaaactgtgatgtggggcctacgtgcatgatatttggaaaatacgagtaggaattctgcaacaaatccaactcagctcctggggaggggccacaaaaatcagacggttcattgccgtaactcagatgtagacatttccatttaattctggatcataaataagtctttacagttctgaatcctggaacctcctgaagtctaagatctgagtcttcaagctgatagacttggccttcagtagggagaggtgttttgtttttaaaatcaggaaatttcacataaaaatgcaggtttcttgttctctttaaaaattaaagatctggaaaaccgggtctacatctctgagtggcaataatcaggtgaccataagccacaggagtggctattatctgatactaggacctacccctgcactcctgtgactggggctgcctcagagacaaaggctagaaagggagttcctccttttctaagatttctctgccctttctccaccttctctttcttctctcttccctcgcaatccctcctcacccatacacgtacacgcacactcataaacatgtacatacctccaggagatgaagacaacttctgtcttccctcactaattcccatggtttatgtgcctcaatgctggcccaaattcactggtaattcccatgttgattatttattgccttttagctatttgattggcagaagatcatatgaaatcatctaatatgttatttttgtgtaggatgtgagatagggggaaaaattccattttctccctaattagtagatcatgaagaatagtagagtagagagacaacagacacatgaattggagccagagtatttgaatttgaatcctagttttctcatttcctggctgtgtgatgatcatgggcaagtcatttgacttctctgcaccgtaatttcctcatctgtaataccaggatgacagtatctattgaataggattgttgtaaagatgaaattagtgaacatatataaagtgctagactagagcccggtatacaataagggttatacaaaggtggcctattatatgagtaatggtcttccattctatgaactaccactggaataaactttaactctgcaccttgaaattattacatcagttgtattcctttacccaacaccatttatttaaggcaaataagtgccaggcactgcatagggcactagaaatataaaaaataagaaaatgttcttgctcttcaaagagcttcctatccctaatgtatttggaatttgaagttaaattaagaaaataacacacaatcatgtttaaataaagattaaactaagcaaaaatcatatgatgattgtttaatacgagtcttaaggagaacaaataattagaatcatttcagattcagtccacaaaaatcaatcttccaaaaagtagggacaagatgagattttgaaagataccctcagggccgggcacagtggctcacgcctgtaatcccagcactttgggagactgaagcaggtggatcacttgaggtcaggagttggagaccagcctggccaatatggcgaaaacctgtctttactgaaaatacaaacattagccaggtgtggtggcacgtgcctgtagtcccagttactctggaggctgaggcaggagaatcacttgaacctgtgaggcggaggttgcagtgagccaagattgcaccactgcactccagcctgggtgacagagcaagactccatctcaaaaaaaaaaaaaaaaagaaaagaaaagaaaaagaaagaaagatatcctttagtaagaagcaaagtcttgaactttggaccagaagaataagggccagaggaaactgatggaggctttcagaagatcaccaagggtctgtgagttacacacacacacacacacacacacacacacacacaccatgtttgagggaacacaggctagtaatgggaaccaggagaatccattcagggttcagaacaggtagaatctgttcagttctttttgtgattttaagtttcttgaattcgctctgcttaagtattcctagtacaacagaggcatactatacttttgaaatttacttttaagtacttttgcaaaatcaggatgataacgatgcatctgcctggtggtcagttaacacactatcaggaattcacattcaaggaggtcagcgaggtcagctagcattatatcagagagggccaactccagaggcagtacttttcaatcaacaactgatgatttcttaattagcactcatcactttctggccgttggcttagggaatttttaattgcatgatgcctgctaagggacagagaatcctgcctcagaaggtttgcgatcttttatccaggtggatcagagcacagcaaaggacagagagctggaacttcatcagacctacaaaactgcttgttgcctgtgtggctaaagaatttctctctaggccgggcactatggctcacacctgtaatcccaagcactttggcaggccaaggcaggaaggtcaccagaacccaggagttcgagaccagcctagacaagatggtgagccctcgtctctattaaaaataaataaataaattagccaggtgtgctggtagcacatgcctgtagtcccagctactcaataggctgagatgggaggatcgcttgagcccagaaggtcaaggctgcagtgagccgtgattgcaccactgcacttcaagctgggcaacagagcaagaccctgcctctaaaaaagtaaaatatataaataaaataaaattttttaaaaagaatttatgcttacaactagaagcatggcagaatttggcttgaaccttaccttttgttcaatgaggacatgaggtttaggggaagagataaccctcatccctcatgttctctactgcctgctgttaccctccaaaaagaacctacgtgtagtgcatgaccaaagtgacccatgtcaattcccaagaaggggtgggactccaggcgccagggccctgcccatttctggcctttgattctctggtgattctcttcccacccagccctaatgggcaggacctgcaaggctcacagatgtgacagtagctggcagaggttggctggcatccttagagagctgatatgtgaagggaagctctcaatggtcttaatttggttttgaaatattttccatttgaccctggctattcccaaggtccggggaaggtcctcactaacctaagtgccaccagaaagtcctgtccagggctcccatagtccagctttacacagagagggactcccaccactgcctcttggttcacctcctactgaatcagagagaggggttggggctgggagaagtggcaggctgggaagaagagtgaaacagcctagctggcccagcctccaggtgcactggcattagaacactgagaacagactgaaatctggatacattgtgggaaaaaatcagcctgtccacccttaataaggcctggagcagtgctgcccaaaacagctttctagcaccggcaaccatggtagccactagtcacaggcagccagtgagcattcaaaatgtgactggtaggaagcaggagatgaatttcaaattgcatttcattttaatttatttacattaaatagccacatgagactaatggttactgtagtggacagcacaggcctagagcctggcttttctccctattctctcaggaccttctcttaattctcaaatagtccgttctatggccagccccctctttttctttcttcctttttcctccctccctccctccctcccttccttcctttccttccttcctggtctcattccgtcaaccaggctggagtacagtggcatgatcatagttcattgcagccgcagcctgctgagctcaggtgatcttcccacctcagccacctgagtagctaggactataagtgcatgccactatgccaagctaatatttttttaagggggtgttaaattattatttatttattttattattttttaaattttacaattttaattgttgtgggtacatagtaggtgtatatatttgtggggtacataagatgttttgatacaggcatgcaatgggaaataagcacatcatgcagaagggggtatccatcccctcaatcatttattctttgagttacaaacaatccaattacactctttacggtgtttttttttttttctttttgagacagggtctcactatggcacccaggctggaatgcagtggtatgatcacagcttattgcagcctcgacctcccaggttcaagtgatcctcccagcccagcctcccaagtagctgggaccacaggcatgcaccatcatgcccggctaatttttttatgatttgtggggatctcactatgttgcccaggctggtctcaaactcctaggctcaagtgagctgcccacctccgacctcccaaagtgctaagattacaggcatgaaccaccacatctggcctccaatatcttgttttgaccttagatccctctcctttcttcaactctctggaatattctggcttgggtggttcaaaagaaggaaaccaatgcttcccaaatgtttccccattagagatggataaagtgtcaggctaccagaaaatagggtctttaatggcacatgggagtcatagaatgcacatgccccatttggaactaatacatccaatggtgctattcaaagtaatcataataatgtgctatactctgcttgtatatgtgtatggatacatcatcacaatgcatcctgcatgtaaagtgaccggaacaacaattaggcttctcattttaaaaattagaaaaccaaagtcagcttagctaagagaatcacattgcagataatgatagagctgggaccagcaccaggtgttctgactcctaacttctcttggaatatttgagtcagccctgattagagaagaaacatgacagaagaagagagcagaccataatcacccccaatagactggccatgtctccaacaaggctcttttctttcaggcctgcagggagtcattttgtacacagtgcacagcatattatttcctagcattgtggaagctggaatgtgttagggaatttaagcagtatctgtcttccagagctctaatgggccatcctgatcgttcttgcattctaactgtatttgtagggatcttatcaacgaatttccttctcataggatctctgctctttgcacaattcagaggtgtcttcttatttaatacaatatacaacaccatggtattactctaatggatgttctaaactgaacaagccaagcttttttttccttatgcttcagttaaatttgttttcatatcatttttctggatcctctgattaagcatgtcagatttttttaattttattatttttctggatcctctgatttttttattttattatttttctggatcctccaattatttattatttttctggatcctccgatttatttatttatttatttattatttttctggatcctccaattaagcacgtgtcagactaaggggtccaaattttggctgtatatctgaattcatggcactttattttaatgtaattaaattaattaattttgagacagggtctcactctgtcgcccagcctggagtgcagtggttcactgcaacttccacctcctgggttcaagcagtcctcccacctcagcctcttgagtagctgggactacaggcgtggaccaccatgcccaccctttttttttttttttttttccttggtggagacagggtttcatcatcttgcccaggctggtgtcgaactcctgggctcaagtgatcctcctgcctcagcctcccaaagtgctggtctcataggcatgagccaccacgcctagccctcatggcactttaaagaaaatacacattccaggctgggtgcggtggctcacgcctgtaatcccagcactttgggaggcccaggcaggtgatcacttgaggttaggagttacagaccagcctggccaacatggtgaaaccccgtctctactaaaaatacaaaaactagccagttgtggtggtgggcacctgtaatctcagctacttgggaggctaaggtaggagaattgcttgaacctgggaagtggaggttgcaatgaatcaagatcacgccactgcactccagcctgggcgacaagagtgagactccatctcaaaaaaaaaaagaaagaaagaaaaatacacattccaggttctatctcttgaggagctgggattgagcctgggcatccacatttttcaaagttcccccacatgatctcagtgctaaaaactgagactcatggaatgttggaccaaagaatcaagagacccatattctggttcctgactttcctacacactggcctctctgagcctgtttcccattctgtaaaatggagagataggagccctgtcctacttttgtgagtttaaagcataagaacttgtgtgaaagaattttgacaaggaacttttgtatttatggtgggagggatctggtgaccagcagtcagacaccacctgcaaacaggcctgcgatctggtcacttggtgacatttccactgggttctcgtggtctgcttgcctccatcacactatgctaaaaatgggtagagagtgggtggagctcagaatactttaactccagtgtaatagtgtgggcagcttccacttagttaggtacttctggacaaatggaagcttgtctgcatgcagctatatttatttccaaaataactggtgagatacccccacgaatttgagaacattcatttctgttttacctgttttgagacctttagaccatgagattagaacgccccaggcatgatcaggaggcagaagtacacaggtcgtctattcccaacctcagagctgatgctcagggtaaatccacagccattcgatgtagggacgttttaatttgggaaatcaaatgcaggaaagatattaccttactgttcatttcaagcatctcacacacaccattaaatgccccaaactaggctactattgaaccttaaccacatacaaattacgtatttacccaaatactctaacatgctaacaatcctttcttttgaaacttcctggtttaaccgatctgacaaacagatccttcatttctgttcgctctattttattcattcagtgtatcacaagttgaccatagcaagacgagaaatgcattaaggatcatgattttgcaaagcattaataaggatactgggacaaggaagttaagcttttgatggccttgatacaactatttcaaacttctctatttcaaactgacttctgcacaagggcaccacatctaaaggaccatcattgatagtaaacacagttagtttgtatatttattatgatagttttctggcagatgatagtcatgtgtcttattctaataaatcagcccatgacaacaattttccaacagaagtaagccaagtgtcttgaagaaggggtgggagtgtgccttttgtaattcacacacaggggcagtttgggctacatgcaacccagaaaggattgttagcatgttggggtatttgggtaaatatgtcatttgtatgtggttaaggttcaatagtagcctggtttggggcatttaatggtgtgtgtgagatgcttgaaatgaacagtaaggtaatatctttcctgcatttgatttcccaaattaaaatgtccctacatcaaatggctgtggatttaccctgtccactgatctcttccctggtcatccctgatctggggacaagtcttctgtcaaaaaggggctgagtgagcagcagctgggctttccctctccgccctctccagagcaggctccttgtggtctgccagccacaacataaaagtggaagtagtagtctggcttcttcttggtcagtttaaggtgaggagttttgtggggtttttttgttttttgttttttgttttttgttttttttgagttttttttttttttttggaggtggagtctcactctgtcgcccaggctggagtgcagtggcgcgatctcggctcactgcatcctccacctcccgggttcaagcgattctcatgcctcagcctcaggagtagctgggattacagacacctacctccacacctggctaatttttatatttttagtagagatgtgatttcaccatgttggccaggctggtctcgaacttctgacctcaagtgatccacccgcctcggcctcccaaagtgctgggattacaggcatgagccaccacgcccagccagagctatttttttttctacattacactttgaaaacaaaaaacttcccctcccctttctctctgtcttccttccctgagctctgtttgtgttgtccctactaatcccaggacatcccctgtggagctggagctctttcttcattttttccttttctccacttcaggtcttaactttaaaaacatctgggctattcctatacccagccctgggtgtctgaacctgttcagggaggttagggtactgttgattgccccagactctgaggtttgggcatgcacttcctgccaccctagaagtttcaaaaaaaaaaagaagtgtttcttagtaaaagggcagtgaattctcaaattctatagtttcccttcctccactttcatatctcagctactatcagagtaactttaccctactttctcacccctgtctctgtaagcctgatgaaaatcaggaagtatatagtgatgtaggagtggctgaacattctctggagatgggacacacaaactttaggatcctggaagaagctatcagaggatccagtgttaaattacaaagtttggagtagggtcacttttctaagtgctgatgtgttttcaaaagagaagtatcttgtagagcaagaggatgccatgctgcctggaagtgaccttgggtataatgggaaccctgatacattcatttattccatttgtttacaacaggtatacttttattcattcattttttacaacaggtacagtttcatttcattcattaagcatttggtatgtgccaggcaatttgctaggaatcgaggataatcagtaaacacaactagccttcgtggagtgaacaggctagtgttggagaattcactagctagataaactattcctatgcaattacacacagtgttaagtgttctaaagagaaacactgtgtggaaagagggaataatataggggacgcaactttcgactgtgagtgagggaaagcatgtctgagctgggcttttaagctgagacctgcaggatgagagggagccagcctgcggaaggttgcgccaggcagcagcaacaatcatacaaagactaagacatgaaaactctagaacataagtttcgacccttctcctttttcccagctcctaaggtttcgcttcatcctggcttctttgttatttccactagtaaagtacgagaagcactcagcaccacacctggcataactaacacttctcatgtgccaggtgctactggaagtgtgttatgtgcattaactcatttaatcctcataaccacccaaggatggagggtctattcatgtccctatttcacagatgaagaaactgcacaagtcactatgcaataatggccacgattattattggaattagtaatttcatcaataatagcacagtgacaattttcagacttctggcagacttaattttgtttatttctgacctttacactgctcattgagagcctctttagtagacttcttccgtgtactttgcaaattgtaaaagcttgtttcttttaaaaaatccattattaatgttattggtggaaaacttttttaacactgctggtcaggctttatagaaaaatccctttctgtatcctccctcatcagcaatacttctccgaattcccttcgattcagcaaaggtttattaagaacctgctaattgcctggcatgactctggagatgccagctccaaaaattcaaagtcaaggaaaaaaaccacacaaatagctgtaatagaataggatataggctctgcttgtcttataatcaaaatacaaatgcaagtgattgggaaaaagtatgatctagagtcaaggagacagctacccagaaggtgttttcttagacttacttttttttttttttaaataaatatgtaagtggtcaaaagcctttttaatatgaagatgtgatagctccatattttataatgtgttgccctcataaatttggtcttagaattgttctgttttgttttttccaaatcccccggttttttcactaatgacgacctactgtttagatgtagattgttctattgtcgaatgaattttaccttttttccttttaatttacaggtatgaaagctaatctttgaagacacacttaatcagcgaaatggtgattgttgaaggagaattgtggcctgatgcgctaatttctaagttaaaaaggaacatcattttcgcaacaataaagtagtgatctgcccttccacgcagtgttaagacacttcccacaactccttcacccttctcatttaggtaagtactaaaataaacaggaaaagggaactgtacctcttatacctatgcaactggcccagtgaattgatttcaagtttgcatttgtgagaaaaaaaaaaagatgacttccttatttatattttagtgggcacaaaattccccttccagagagccctgtctttatccctcagccattttcaaagagcactttcatgcaaagagcaaacagcttctctaggcggagagtttgaatttcctcttcctgaaccatttcctatatctgaactgcccacatcttatggggcaagaacatcacaagaggatgtaaaggatccagcaagctactaactcagcagacaacacaataatgccagtcttagagaactaagtgctaaggagagttcatggcaatgaattcaataaaggtcttttccaaccagcagcctgataggaccctttctctcttcttgttgttgaacctatctatataagaacacatttttttaaagatgcatgatataaattgtgatttaattgcttgaataggtgggacatgacctcccagagctgtgtgcatcaatgtcaagaaaacacgtaggggccctagttctcaacatggttgccatgtggtagagggacctcataacagcagtttctaacctggtctgtgaacttggatggcaaaataaaatgacatctttattttctcttacctctaactgaaatttaacattccctgcaattacaaatataggcaacaaactagaatagtatcagtagcacctgtgactttttgtcaccaagagaaatcacacatctttcaaatcgcatgacagttgttgcagctatcttgatttatacttattgttacttcagataatgattaagtattagagatgttactagtttttgttatttaaactgttattaaataacactttaccatgccatattttaaaaattattttgtagctgtatttcaacatagtttacagcttttgtaattctatttattatatttttatgcattttaaaacattctgaggaaagtccatagatttcaccacactgtcaaaggggttcatgccccccgctgccatgttaagtatgccttaggagactctcagtattgacccactgcaagcacagtttccatgcagtgaagggctcgaaaatgatccatttagtgcatttcactgtgcctttcatacagttttagttacctcttttccaataacacatcttatcaaaaacctcaaatgcagtacaattgtaaaatatggaatcgtttgatcttcaaatcgctggttaaaactgcatcagctttcagctattcaagagctgactatctaagctgtgaattatcaaggtccccttttctccctggtttcctctttggctgtttaccatgtggttcttttactactgggtcacaggtgcaccaacagataggcagggctccccgaggaaatgacattcaaatctgacaattttcctacatcactaagaagttgtggaccggtggaggttgaaagtgttgattaaattaaggcttggaattacctgtggattttaattaccattctaccactgtcccagtgtcctctgtctccccaccgccacgctctcctgtagctctaatgagacacttatcagatgctatttttgtttgttagttatctttgctctgcatacggtcttcccacagaaactgtgttctccttctcttgtgttgcccctggtgcttggcagacaatagatcccccataaataggtgtggctgaactgaatcactgtctatggtacatacccagtggtccttcatggttgaagatgtcagtgctaacatgatgattttctatattggatttcttacgtctatttggattttattacgcaacatttcttctacaaatgctgaacactatgtaccaggcatcatactagatattagagacaaagatgaatataatatgaacttccttcaaggagttctgaggtcacagggacactagacaaatacatatcgcgatggagtgtaacaagagcaagtgtaggcatatggactaggtatgtcggtgacacccagaaagggctggtcatttctggagaatgaaaatgagagtcagagaagatgctggagtgggaacccaaagcatgggttggatttaggcaatggcaagagggacggggagaattccagcatcagagaactgtgactcttttaggatgtaacaatacacaagcattctttacgtaccggacactcatttcttccctgctaagagaacctagttgtgtatctgggataatcttaaggaaggtaagttcctcctccagacttgggcttatgagccaatcatgagccaattatggtcattctttttctcttcaccagacattggtatagtgtgggcatgtgaccacattctggtcaatgacgtctaagggggaagtctgctcagggatttctgtttgggcaaaaaaaaaagacagagtcttgctaggagaaagtagccttcccctcgttttgaaaacaaatacaatgtttacagttgtggcagttatcttgtgacaggagaaagatattaaaagcctggaggggctctttaatagtaacactgaatagcaaccagtactagcaactgggctccttcttgtgcaagaaaagattaacctctacttgcctatgttctaagtaattaggggttttttccccttatagctaaacacatcacaaccgatgtatacagcttctgaaaactattttgcacaggtctccccagtgggtatcaatggggtcacaactaataccccctgagtttttctgcctgattatccctaacttgtataactctaggactcaacctcttcctccttcaatctctccagtcattttggggagtccccaggggaatatctttgagaatgtagcttcttccctgattctctctatcctccctttgatgcaaggagagtaagaaagcccttctctctgactctgtgtttcactctgccactagacccgaaggtgaatgggtctagctccattcatggaatgggaccccaagataaatgccctgaatgtcatcaacttttggtcagcgtataccttctagctgctgactacccctgctctctattaaggaatgtctgaggaatagtaagcatactaatttcatctactttcctttgtgtctttccatagaaggctagcatcaacctcttcctttagacagaccaaaacagcaacaatcatctgcaggcttatcagcctgtgccaatagatccccagagttcagattagctggccccaaggagctactcttcatctagctcagcccagagcccagtcacatgtgcacatgaaggaatggaagacacaatattgcaaaaatggtcaggcagggaccttatatatcaagctaagaaatataagctgtatcctctaagtcagggcttcccaataagtgttccatagagtgttgagatactaccctgccctctcagcccttgggactgctgggtggaacctgacagagggagctcctaggctggtcacctctggcagccagtgcccttgtttggtgtaggaaggtattgccaagaagagtggggcccaatgaagccatggtataaaacaattgggaaacaatggggagtcattgaaggatttttaacaggaagtaatcccatcagctttccatatcggaagacaatgaaagggcaatgcaaaggctgggttggaggaggtgggcaatgaacctgggaccaggaccaccagtctcacctaaaatagcctagtgatgaaatgatgagagggcaagctaaggagtaggaaagagagaggagggaggatctgggaaataagaaatcttttttttttaattatactttaagttctagggtacatgtgcacaacatgtaggtttgttacatatgtatacatgtgccatgttggtgtgctgcacccgttaactcgtcatttacattaggtatatctcctaatgctatccctcctccctccccaaccccacgacaggccccggtgtgtgatgttccccaccctgtgtccaagtgttctcattgttcaattcccacctatgagtgagaacatacaatgtttggttttctgtccttgtgatagtttgctgagaatgatggtttccagcttcatccatgtccctacaactcatccttttttatggcttcatccatgtccatgaactcatcctttttatggctgcataatattccatgatgtatatgtcccacattttcttaatccagtctatcattgatggacatttgggttggttccaagtctttgctattgtgaatagtgccgcaatatacatatgtgtgcatgtgtctttatagcagcatgatttataatcctttgggtatatgcctagtaatgggatgctgggtcaaatggtatttctagttctagatccttgagggatcgccacactgtcttccacaatggttaaactagtttacagtcccaccaacagtgtaaaagcattcctgtttctccacatcctctccagcacctgttgtttcctgactttttaatggtcaccattctaactgttgtgagatggtatctcattgtggttttgatttgcatttctgtgatggccagtgatgatgagcatttctttcttgtgtctgttggctgcataaatgtcttcttttgtgaagtgtctgttcatatcctttgcccaatttttgatggggttgtttgatgggattttttcttgtaaatttgtttaagttctttgtagattctggatattagcactttgtcagatgggtagattgcaaaaatattctcccattctgtaggttgcctgttcactctgatggtagtttcttttgctgtgcagaagctctttagtttaattagatcccatttgtctatttggcttttgttgccattgcttttggtgttttattcatgaagtccttgcccatgcctatgtcctgaatggtattgcctaggttttcttctatggtttttatggttttaggtctaacatataagtctttaatccatcttgaattaatttttgtataagatgtaaggaagggatccagtttcagctttctacatatggctagtcagttttcccagcaccatttattaaatagggaatcctttccccatttcttgtttttgtcaggtttgtctaagatcagatggttatagatgtgtgctattatttctgggggctctaatctgttccattggtctatatctctgttttggtaccagtaccatgctgttttggttactgtagccttgtagtatagtttgaagtagtatagtagtgtgatgcctccagctttcttcttttggcttaggattgtcttggcaatgcgggctcttttttggttccatatgaactttaaagtatttttttccaattctgtgaagaaagtcattggtagcttgatggggatggcattgaatctataaattaccttgggcagtatggccattttcacaatattgattcttcctatccatgagcatggaatgttcttccatttgtttgtgtcctcttttatctcgttgagcagtggtttgtagttctccttgaagaggtccttcacatcccttgtaagtcagattcctaggtattttattctctttgaagcaattgtgaatgggagttcactcatgatttggctctctgtttgtctgttattggtgtataggaatgcttgtgatttttgcacattgattttgtatcctgagactgctgaaattgcttatcagcttaagaagatttggggctgagattatggggttttctaaatatacaatcatgtcatctgcaaacaggaacaatttgacttcctcctttcctaattgaataccctttatttctttctcttgcctgattgccctggccagaatttccaacactatgttgaataggagtggtgagagagggcatctctgtcttgtgccagttttcaaagggaatgcttccagtttttgcccattctgtattatattggctgtgggtttgtcataaatagctcttattattttgagatacgtcccatcaatacctagtttattgagagtttttagcatgaagggcagttgaatttatcgaaggccttttctgcatctgttgagataatcatgtggtttttgtctttggttctgcttatatgacgggttacatttattgatttgcatatgttgaaccagccttgcatcccagggatgaagccaacttgatcgtggtggataagctttttggtgtgctgctggattcagtttgccagtattttattgaggatttttgcatcaatgttcatcagggatattggtctaaaattctctttttttgttgtgtctttaccaggctttggtatcaggatgatgttggcctcataaaatgagttagggaggattccctctttttctattgattggaatagtttcagaaggaatggtaccagctcctctttgtacctctggtacaattcggctgtgaatctgtctggtcctggactttttttggttggtagactattaattattgcctcaatttcagaacctgttattggtctattcagagattcaacttcttcctggtttagtcttgggagggtgtaggtgtccaggaatttatccatttcttctagattttctagttttttttttgtatagaggtgtttatagtattctctgatggtagttggtaggaaataagaaatcttataacaagaaatcaagcccatgattcagatcagcaggcttgctggttgattaaatatagaaggtgagggaagtatctaggatgacttccaccttctggtttgaaaacctggatgggcagtggtgccaccgaaggagactaggaacatgtggagaaaaggtatggaagaaaattgacttgacttgaagtatgtatggaatgtacaagggaaatgaccagtaggcatttagacatgtagatctaaaattcagggcctaaagttcagagatcaagagatcacttttgtgtagattttttagagtcatcagcaggtaagtaatgatggaagcccgtggtgtgcattggtgatactgaccagggagaatactacaggaatgagaggatgccaaagacagaagaagggattgatgtcaaaggaccaagagtgagctgaggactcagttctagagagcctcaacagtcagtctctctctctctctgtgtctctatctgtctctctctctctctctctctctctcatatctctctctctctctctcatatctctctctctctctctcatcactatctctatctctttctctatctagctctctctcctacttcatactggacttttctgctaggcagagagcaaagtcactgctagccccagattagccacccccataaaaaatctcttttctcccaccatccctataacaattcctggaaagaactctggttgactttgctagaatcacatgacccatgcttagaccaaacctaaggagcacttgggttggccagacccatgtcatatgcccccatattgttggaaggagggtacagcctctttatgagaagaacagggatggtaaaactttctgggcagataaaaatagttatcaggtcacctacacatcaacactttaaaaggtaggaggagaaagtggagccagtaaaggagacagaaagttggtatgtcagagtagattaacagtttttcagaggccaagatctttgtcttatccttatctgtgtccttcatcccccccatctagtatctagccttgtgcctataatcaacaagtgtgtatggaatgaattcatagacactacacatgataagtaatggggatttgtaaaagacatgacaaagaccaacactcaggaatctaatttgggcaatacacaaaagcacattttttaagtagctggccaccactgacatagataataatagagtctctaaaaagagccaaactttttcatgatttggataaaggcaccatatccgtttaaaccaaaacagtcacagatgaggatttgatttggggagtgtcttatggaaattagatggtgttgttttaaagagtgttcattttatttctctgttctagggctgactgtaatttcatgctgcatttgcaagcctgcaggcagacaccttaattactatggatgccagatagaaagaggagtgctaatcaaacctttattaattggtgacatacttccaactttcagaaacagatgctagggaggaatgaatccttgtaaaccacagtacccaccaactcccctcaggtgtggatttttttttttcttaaatcaagtaccttttacatccactagggggaatcctagcgcgcttcaaagtctgcctttttctatgcttagaatgacatacccatgaaaacttgcttgtctattgatgggtgtgtcctctactctggagaagctccgagatctggcatgttgtcatatttttcaaacagaagagaaaatatcattcaagatatgttaaagaaaataaattgctcaaattctcactggaagaaatccatcttagagaaaattttccgtgtaaacagaagtttctaccaggaaaaagagggtaattatttgtcagaatctttacttaccaaaaaatagaaaacactaaatatgtgcctttgcaattttagagagcttaattttaaatacctgttaggcactagtgcgatctttatgctcagtggagttcttaaagtattattggcactcggttgataattattataattattataagcttgccttacataattacagtataagactctccccttttcagtataaagccatgttcaaacaaagtttgaaaggtgctgtaaattaacaaataatttaaaagctatgttcagtggatgctcctccatgttatcaataatattttttgtggcaaggagttgtttttctccttttatattctctgtctctgcagagatagtcaattcatgaattggtaaatatgcactgtggagatgccaagttatgtcattgtatgtggggctgtgggtacctcaaagaatgacccttgcccctaaggagtatagagcctttacattacacttcaactgacatttattgaacactgactccgtgtaaggcccagtaatctgcacaaaaataacaccactgatcttgctcattgccataaccccagcctgcaacacatgcctagcacatggtagattctcaggaagtatctgttaaaagatggagtaagttaatgaacagaaagtttgaggaataaagggaatatggagataaactgaatttaagacaccatctctgatctcaaagaaattatattaagtgaaagagctataaacacaaccaatgcatagtgtatgatgtgactcaccagattttaatgctatcaacctacagataaagtgctcttcaagttcagagcagggaattcataaccaaagggaggaattggccccgttaaacaaattcaacaggtaagtttagttacactgctagaacagagcctggcatgaaggagacacacttcactattttgtaataaatgaatgggtacttactgtatacaaggcctagttcctgggggcacaaagatgagacagcacttagtttctagttttctttattttttaaatgggagtttatagtttagtagaggcactctagtacaatttcaaggaagactcccaggagaaagtagcttttacactggaccttagtggataagtgagagctcacaaagctgagaagatggaaagggtgttttaggtgaaatgtacagcaaatgcaaggacacaggggcttgaaagagcctgactcatttaaagaagcatgaaaatcccactgctaacaacaggagacagtaccaaggatattcctagctcttagcataaggccctacgtatgaaagtcccctaataaatacttgttgttttttaacaataatgatggtaagagtccaaagatgagcacaagttttaagtgctggacaagtatgaagctgaaagagttatctgggctggtaggatctggggccagtttatgggcaacatctttggactttgtgtgctgaggccacagaaccctccatacagcaggaaggccctttcccaccagcctgttaccatggcctgttttgtttcatctacacagtctatttaacaacaaaaccagagaaaagtgctcacagtcactacctatttctttgaggtccctctttatttttttctgagatggagtctcactctctcgctctgtcgcccaggctggagtgcagtggcataatctcagctcactacaacctccacatcctgggttcaagcaattctcctgcctcagcctcctgagtagctgggactacaggtgcgtgccaccatgcccagctaatttttgtatttttagtagagacgggggtttcaccatgttggccaggctggtcttgaacttctgatctcaagtgatctacctgccttggcctcccaacgtgctgggattacaggcgtgagccaccgtgcccagccgaggcccctcttttcatgccttcatgctaactgcacccctcctacaggcccttgagtgccacttctgtgagtctctcctcaactaggtaaaatgtggttccattaatcatattttgtcttttgggttttagttttgtcactctcattcacatacaaccagcaatgttttttgaataccctttcattcgcaatcaaatgatctcataatcctaatactgttaacaacacatagcctgttcacagaggctgaaggtctagctgaaaagataggacttgtaccttaaaagataaataatactgctacctaaaaagattaataatactactgccattagcattctttgctttgtactgtatctatgacccttaatcaaatttcacacacacatccacacacatccttatagttcacagcattcatggggtacacattcaatgggcagcaaatagcatttagtaataaagctttagtaatgcttgcctattctcaaagtctggttttttcgatggtaaatttcttaaagcagtataccccaaaatttaatatttaataaagattcttcccttgcttaaaaggactactcccaagcacaggggcagctttgccatctgccatcctgcttcatatgttctatttgcttgtaacatttataccaacttgttttcctgatcactttctcacctctttgtaagtacctgccactgaatctgctgctctccctggctttcttgcatttcttgaaaacccttccactccctcctcctgttgttacttttctgacctattctttatgccatttggaaatcacagatctgtgtatcttcttcttcttctttttttttttttttaagacagtctcactctgtcacccaggctggagtgcggtggtatgatctcagctcactgcaacctctgcttcccaggttcaagcaattctcctgcctcagcctcccgagtagctgggattacaggcgcccaccaccacgcctgactaatttttgtatttttagtagagatggggtttcacaatgttggccaggctggtctggaactcctgacctcaggtgatctgcccaccttggcctcccaaagtgctgggattacaggcgtgagccaccacacctgggcatgtatcttcttgatatcccgagatgactctgagccgctcatccaccaattacaaatgtagacttgattgcagatgttgccattcccctgttcctgctggttctgatgtacctaacacccacatccactcttaacactagtggcatcccctcttaaccttcatgaaactcaagccagtaggaccaagaggtaggtaaatgaattgtgaacataagggggttggcaggatagtgcaacaggtgagaaatgaaaaggcagagacatccagtgagaacacagcaatgggaagtgaggaaaacctttatggaggaagagactatgagaacagagtgtttgctctgctgtggctggctggccaccagccaccactgcaacagaacaaccagggagggtaacagattaagtgttatcagccactaatatcatatggtgagaatccatcagcaaacctgatgtagaagccatggacttggccagaagaaggggttcaaggcccttaccgtactgtgggaccttggcttgtcattaagctctctgcactttagtttgcttatctgcaaaatgatgtgataatacttttgaggttattggaaaaactaaatgaagaaacagaagtaaatcggctcagtactgagcggaaacatgtgcccaagaaatgccagttaaaatgttttcctaaggatagggtttgagatggaaaataggtgtgttacaggctgaattgtcaccgtctccccaattcatacgttgaagtcctatcccccagtagcttcggatgtaactatatttagaggtagggtctttaaagaagtaaaatgaagtcattagggtggacactaatctaatctgactggtgttcttataagaggaaatttggacacagatatgtacagaggaaggatcatgtgaagataccaagagaagatgaccatctacaagccaaggagagaggcctcagaagaaaccaaccctgccaaaaccttgatcttggacttccagcatccagatctgtgaggaaatacactgccacccagtctgtgatactttgttatggcagtcctagcaaactcctaatactaatagtgctcctaacacagcactagagtcctgataataataatggtaatcataataataacgttttttatttatggagcgacttcctgtgtgccaggcattgtgctaaatgctttacacatattatctcatttaatacgcatgaaaatcccatgtgatggatgcaatttttccaacccacgatgaggatgctgagggtcagagagcccaagcctacgtagttattgagtggtgggactgggtctggaacctaggcctgactgggatcactgctggcctacagtgtctttgtacaaagaaaaaggtgccacttcctttgggaacacccagccccaagccagggtgcaaggtttggtaaacagaagacaggctgggttttaattcctctttcctccttggctgggtgcccttgtgcaaacctaagcctctcagggtggcccacactgaggcccaagctcttaatcattacaccggactgctcagtgggccagggtggctgggggtaacaccattgccaccgtcgaggtaggatcagttgggcacgtaagggactgtgagtgctggcaaggcaaaccttacctccctcatggctgggaatgagatacgtgggagcccaggtccatgagttctgggacccatgtgggtgggcttccaacggtcctacaggacaacgacaaatggcccttgacttagggcaattctgcttatttctaattggccccagaacagttctgtgtccagtcctcagtcagcaagaaatccagtttgccaggatcgtgcccctaggattacacagctgtcctttcgccattatccccatgcctcctcctcctcccaccaaatcaaagagaatgagaaatgcatcttcgaccatttggctataactataagtgtgcctgtcctcacaattaaagctcctgaaagttccaaatttgctgctttcacggtgggaaaaaaaggcctccgacagcgtaaatatttaatcaccattaagaatgtccaataaatgaggggaatcaggtttcaaattgactggttcagatgattaaagtacagaagtcatagcagggtaaaaataaagtaccctctaaaaaagtagcatcttgtgggcaggggcaagatggaagatagcacgttgggacctctcaaggccgggccgggcactgcactctccaggcagggccgggcgagtgcggcaaccaccgtcactctccaaaggcttccgtgccccctggggcagctgagcggggtaatgccctccgtgatggagagcgcgtgtcccacagccgggccaagacggtgcccaaccgcagatagccccactctgaggatgacagcagcgaggaggagcactcgcacgacagcatggtccgcgttggaaccaattaccaggccataattccggagtgcaagcctgagagcctcgcacgctacagcaacaagaagctgaagggggtgctggtgtggtcacccaaccactgtgtgtcagatgccaaacttgacaagtatattgtgatggccacggagaagcatggctacaacattgagcagacgctgggcatgctctggaataagcaccatgtggagaagtcgctggctgacctggccaacttcaccccattccctgaggagtggacagtagaggacaaggtgctgttggaacaggcctttggcttccacgacaagtgtggatccaacagacgctgcccgacaagttgatttccagcctggtgaaatatcactactcttggaagaaaacccacagccgaactagcatgacggacagacaggcccggcggctgaggggctgcaaggacaaagaagacagtgatgagttcgaagagagtcgaggaggcctgagtgaaggagagcccgatgctggacacccgaagagagaggtacagagcataaagcagaggaacagcagcctgcgccaagccctggagggcgccattgatccactccgcgctctggaggccaacactaagttcaactcctgctggaccacagaggagcagcttttggctgcctaagccatccggaggtatggcagactttggggctattgcagaggtgattgggaacaagactctgacccaggtgaagaccttctttgtgagctattggcactgcttcaatctggaggaggtgctgcaggaatgggaggctgagcaggatggggcccgtggagccacagtccccgtggaggaggctaggagaggggctcccttgctagccccagcccaagaagaagatcatgaggtccagattacatcgatctccatgtctgtgtcccgatcggtgcccccctgcaccacccccgttccacctcccacctccctgccctaggtgccccctgctgctgaggccacctttgcccacggctcccactctgctctgacagccacccacagtgcagcagggccgcttcctccagccctggttggcccccaaccagcgcccaccacctctcatcctccccgctctggctgcctgtcctggccctccgcccctacccaccctgattggagcccccagtgccctcactctgaatcctgaggtcctccaccaaccacaggctccaggacctctttgctggccatccccaggcatctctggtgtcactgaggacggaaggggctagggctcttgccaggtctttccaagacccagagctgccgacagcccagcctggacctgtgggttctgcatgtgttcctggcagctgggcctgtctcttggggccatggcccgggctcaggggcctttgagctggactgagggcactttcgcttccttgctgggactggaatggctgcctcctagttggctggggcttggtctctgggccctgccctttgtgtgtcgggggtagggaccttagcgtgggggtgggacaggacagttgggtgtgctggctgttctcattcctcttcccttcttttagcaatcagtcttgggtgaggtgggaagggaggctgcagggggaggtggcagaggggccttacagcagcagaggctggaagggaagttctgtcttcaggggccagctgggaaacactaaggagctgagggtgcccaccaggcccaccttccagaagcttggagaaatgtgggttgggaacttatgcagacatggatttacttttcaacatgttttaaaagttaaaaaagaaaaaccttctaaaaaaaaaagtagcatctttagagggttcctgtctctactacataggtttccttgagtataaaggaaccaaaaacatccaagttatctcttcattattagtagggggcgacatagggtgaggtctggagatgaggaagtatagcaatctcttaataatcctgctttggtaataatgaatatcaatggaatttctcaactttattgaagggacagctggagttcagacttaaggagaaatgtcttaaaaggaaaaagcggcatgcttggttttgtatcttgtttgaaaatatatttcaaacgttcagcagaattttagagatcataaccaccctctgcccccaccaccttctgaacccttagtccccagtagttctgatttacttttaagattcttttagttttatgttttaactgaaaaaaaaaaaaatcctgcccagccaggtttccatctgtctgtatcaccgggttgaatttagtgtaggaaagcctgtgcaaagggaataaaaatgtagctttttttccattgccagattcaggggaaccaaccatttggaaacaaaggagttccattttgactagcagcctttctgctttccatcagtggacaaagtgaatgtacaggtttaaacatcatttggggtcacctctagatccatgtttggaggtagattggtttgttagttatgattctggcaggaaacaggtgacacatgcaaacagatacattaattgagggaccatggccgagccatgccaggatgaagggagaccagcagaggctagccacagcgacaaccatggaatcccacaggcctgaggaggagggtgagggagtggttactgggtccacgaaaggctgtggctacagtgtagctgtgagagaggacagcccacaggagctgtggccttgtagagggacacagccatggccaatgcatagatcagcagagagggagctgggagaataaatattcaaacttcaccctagctgtccacccctagatctctggctggggcttcccattggctgaatccaacgagaagccaaaaggcaagggtgatgtccataaatgtcaaacttctgggtctcaagcaaaagggggagcagtggggaaatggtctgcagggagaagaagagactattcaacacagacggggaagaagaactaaataggaaggactagggaaggggtgaaagagattgcggtgatggtttcaagggtgtagacttatctccaagcacaacatgttgtatataataaataggtatggatttttgtatgacagtcatacttcaatgaaggctttgtaaaaaaaaaaaaaataggggcaggagagcgaggcaaacactcggtcttccatgaactttgcatttgggattctgtgcgtggggatgagtgcctgagagatgctgtttggactgccatattcccagggcttccccaggatgggtgatgagtggggctgcccccaccctggggccatacgccaaactgcccgaccgcaagagcccatgctcagagctgatattggttgcttcctcccgaccttggtggggctattttctagggagtggcaaggacataagaatgagaagccacaccagcttggtggagagcactagagggctcactgcgaagtccagcaactttattgtcagctcagagcatctccccaccagaatctcaaggaagcggaagtacaagtggctgtgaagttatctgcgtgtttatcttatcttctgctattcatttcaagagttggagttattattaataagaaggcctggtttctggcagctcttctcttagaatgggtttatgccaagctgccagttatcagaggattcagagcctaggattatgctgacagcgagtctcagagctgtgatgggagggcaaagacacgggaaacaacgttgtattaaagaggaatcagcgttttgtgtctagtccttgatgcccttttggcttcctatttccgaagaacagcaaggaaaatacaaggagagacagactggaatcctgtgaatatcagagaaaagcttgattttcaagagactgctcaagttacagagattccccaaatctgaagaagtaattaactgatgagttcgcatacttcatgcagggtgaactccagccggtctagaaaaacactgtgatggttgatgatttaccatactttgctttcaaccagtaattgtctcagattcttaaccactgatggttttggtgaatgttttggagaaaaggctcgagagaaacttcatgacactaaacatactctctgagaagtgtggtgctagaatgctaaggtgatgtcctagacttcgcagtctcttaaacatatctgacattatattatgctatggcatgctatgctatgctatgctatgctatgctatgctatgctatgctatgctatgctatgctatgctatgctatgctatgttatgtctttttaggcaatagctcatccctccctaaagcagagtgaatgctcttatttagcttaaagacagtcattggactttgagtaaagagtcattttcttgtacgttccactccaccctccagtgtacatttgcactctgctggcgaatgaccatgagctattaaatcatgacaaagaaaaagatgacaactgtaatgttgggagtgacccccaagtcccacctactgaaggaacaccacaagccttcctcactttaaaccatggcatgggggcactatcaccaagcataagaatgcccagcaatcgtctggggccatgttgggtgggcagagaggatgaggcactgagttccttcagccacgtcttaactgtgccatgtcagagagacttttcatgttgattgaactgtgtccaactcatctctcagcaccaatgcgaacttattaaacagctcttcctctaatcttttttcaaccatctactcatcagcagactagaaagaagactggctcatttctttttcctgtcagccaccaaaagggcctgggagctttgataagggcctcgatgtggaagaccacatagatatcagcaaaactgtggaggaagaagtggtctgcttaaaacctaagaggacaatacaggtactattccacccactgggtggtatttccaaattctgcacagggggttgtagctatgtagatgaggcttagagagaattcactgaccaccagaacaaatattctcagttgctttcaatctctgccagccaagtcatgctacagaccactgtcagatgaaaaaaaaaaaaaaaaagaaagaaaatcagaaagaaaactgaagcaccaatgatagccatcttgtgactgtgaccaattgcctactgaacagttcttaatgtcctgggccccagcaggaaaccactgaatctataaagtcctgtccaccagaaatgagtctgattgtggatggcctggttaacccagattgccttcggtgcctgagggacttgatattttctcattatgaagactttcccatctagtgaacgctgcaaataaaactgctcagaatcggtctgaactgcctgtttccgtggtagcaggcctctgtctggaggataaatctgcaccatcttcttttttttttttttttttttgggtttcagccagttgtgttacaaggagttccgaaatgtgctataagtgacacccaacaagatgggctcggccagttggagagggaagctttgtcaccaaagggacttgcacccctgggccagacggtggtgtccaagagaaagtgatcaaagagatacagaacccgcatgcctaaatatttatttcagttgttcgtatttcccacacttttcaaatgtgaacttgtgtcctgaaggtggagctttagtacacaagaaaattgggaaggggcaaacatgtttgtacaaaatgggggtagaatcagcaaagaatgcatttatatgcttcctcgtcgcctacgtttttcatgccaaaaagttagcacagattctgatttctttcaccgtaggagtctgcatacaattaaatgggaggcaaaagaagcccactcttaagagtggggcttatggtcccagtagaatggcagggaactgtagccatcaaagccatttatacttcttgtgggtagtatttttaagatgttgtttctttttcaaaatgaagcagcaatgaactgagtagtgatcaaaatgccgcaccacagagtatgtttaatccaaatagctcccaagatggtctgtgactgattgtaccaactctacgggacttagagaaatgacttggttaccagtgaagtaaaactatctctggaatggaattgaactgttgcttctcagcacatagcgacactgccaccgctggttcacggagccagtgaaggtcactgagttctgcatcagtcacagggaaaactgtcaaaacaccagcgcataaatcccctactatgctgtggagggggtctctgagcttcggatgaggtttttaaaatattgatcttcccacttccagaggtgcaaaaattctgaaagcattccaggagggcagggagtgggggagcaaggccagatattttggagcaggtgaaacatctgacttgtcttgcctgagatgtcccgattaacaccaactgggtactttaggcctttccccttcttcctcccctctccttatggacactccaacaccatcatcacagcacaaagggcaacctcatatctcgtgggaaggcattttctgcctcctgccaggcaaagataatgttatccaattgcaaatgaaaggcttatgaatgaaaagatgaccactctgactttagtgtatgagagccactgctgaaatgataggatccttgaacttcacatctagagcagaaactcacacttctcttcttctccctccacctcacccttctttccttaagccttccagaactcctgccatatccctcagcactggggagaacttgaagcactgttggagaagtttgaaacctgcaaccttcggcaggactcagcatgggacaaaagccacctcattcctttcccttcccaaaacagcatctcgagctggggaacttggagggaaggaagaaaggggatagcagccaattgccctccctggggcctggggtctggaaatagcctgggaaggaacagagatcatttcccaacgatccatagaggtcctcagcaccctccactcctatgcaccccctggctcatctgccagactgtaagggtgctgatggtgcccgcagctgccccgggaagctgggaggcatttgtgcatcctctgggaagccccattccgagaaatcatgaacctattccccagtgggcaatgattccctgtgcttcagaaattcttggcggctgtgggggcaacccagctgttattcaccctctgggtgaggtggtgagacctcagggggtccaaaggataaaagtgggtaatgatgagacagatggagagcctcgagggaaatacggggacttgggtctaatagtagaaagcagggcgggggctggttggtgcatttaacttgaggaacttttcagtctcactacagagaatgatctctgggggattatggcaatggccacaggtggcacttaactagagccaggtatgtaagaggccctggggctagatatggattcgaatctcggctctgatatctaccagcagtagaatgccagcacgttccacaacctttctataaccattctcctggactactaagtagggatgacaataacagtcactaattaatagggctgttatgagaattatgagtcttaacccatgtggtgagttcacaagcgcacccggcacgtagtaagtgctcagtaaatgttagccccgctcattaggttagatggtgagcagaactttccaagtgctaggcttgagagcctgggactctgttgccaagggagattagagaacctttgcaaatatgggcgctccggccctggggattgtccagaacgagagtgtggcgcctgcctttctgccacctcactcatccgacccggggaaacccacaccctgtcacaggggcgccttggtccccggagtctccggctcggccatgtctcccgcgcgcctccccggggcctccctctcgccgctccacacctgtcagccgctctcgcagcagccctgtggcccgagcccggggcctcagctgcaaccccttcgcaccctggatcctcgctccgcgcgcctggcgtatccccgacccggctgctgtcgtaaacaaaaccgggcgttggagcagcaccgcgggcggacgggcgcgggagcccgctccgtgcgccgttagcgcgccccgggagccccaggcgagccaagggggcgatggtggcggccgcggcggccgcggcgggcggctgagctttgttatgaatagatgaaagaggccacctacacagtaacccaaattacgagacctccctcctccctatctcaccgaatcaagaggggaggggagatgggcgtggagggagggcgggcgggcgggcaggaggcggagggcggaggaggaagagaggatgaggaagggggccagttgcatcccactttcacaatgggaaagtgaaacgcacaagcgcacccaacctctccagccctccccgcccgcctcgctcctctccgcccgtcccctcccttcccctccgcgcctccccgcgagcgccagcgctgcacacaggaactctccggcgaaggagggcgaggaggaaacggtgccggagcgcgcagggcttgctgccgccaccgccgctgcacaggctgccggagcgagcctgccgcgcgccgccctccccgctctccttcctgggcgagctgcggggatggggcggccgcgggagcccgagcgcgcgcaggaaccgccgccgccgccgcccgcgtctccgttgccgcgcgcctgagccgccgtcgccgccgcgcgccctgcccgggggcggcccccccagccccatggaggtctcccggaggaaggcgccgccgcgccccccgcgccccgcagcgccactgcccctgctcgcctatctgctggcactggcggctcccggccggggcgcggacgagcccgtgtggcggtcggagcaagccatcggagccatcgcggcgagccaggaggacggcgtgtttgtggcgagcggcagctgcctggaccagctggactacagcctggagcacagcctctcgcgcctgtaccgggaccaagcgggcaactgcacagagccggtctcgctggcgccccccgcgcggccccggcccgggagcagcttcagcaagctgctgctgccctaccgcgagggggcggccggcctcggggggctgctgctcaccggctggaccttcgaccggggcgcctgcgaggtgcggcccctgggcaacctgagccgcaactccctgcgcaacggcaccgaggtggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggggcgcctcaagctgtgcgagggcgcgggcagcctgcacttcgtggacgcctttctctggaacggcagcatctacttcccctactacccctacaactacacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccaccacggcgctctgcctcttcagaatgagtgagatccaggcgcgcgccaagagggtcagctgggacttcaagacggccgagagccactgcgtaagtcctgcccccggggcgccgcggagagcgctgctgccggggagccgccgccgccgccgaggcagaacgagctgggggcgagcggcggggcgggggtacagccgggtgacatttaccaggtctcaggttcacaccgcgggcggccgtccgaaggctcctctcggacggtccccgagacctggagcacggcctgaggtccccaaagggagagtgtaaaaaggggggcggggagggttggagttagactcaaaactctagtggctgcatcccattgccatccttccctgtccaaacggggacgcttgtttggggctgagtctcctcgcgcagcccctctttcccattcgcttctccagacttctctgtgccccttccgtgtagtcccagcaggcgtgtgggtctgaccctcttggtcaacagttagcaacacagtgccctcggcagagaagccattgaacctaaagggctccctgccacaccccagcctttgtggccccctgtctccgccccccaccggcaacgcaagtgctgtggtctgaagagttgctagcccgctcagcgtggagaaatgccagcctgcaacagaggcttgcgctggaaccgaacccctggcgtgagccggtgcgagggggcggtgccgtggctctgctcagggtgcgctgtggtcgccagccgccgggagaggctgggcgggaggtggccttgtggtaaaagcctcatcctagaggggagtgcaagggaaagtgttgggggtgctacaggcagtttctgggctccagattgcgagactagatggcgggactcagagtcaccaccctggggctgaaccaggcaagcgatacaggtttcccctgggctcccagggcagccacagcttttatcttgagattggcatttctttgactggaaaataaagaggcagttcaagagggtccagttgatggggattatggagccattgtgcacttctccggaggccgtttcccttccaaggcggctggcacatcaactccacatatggctcctgagaggggagcctgctgggagcctcctttataactggacaaaaatcaaagcgcagaaattaacggctacaggtgttgccattgttttggtacaaaatgaatcagagaggaaggggagaagtcactgcttggaaaatgtgttgatacaggggcacgttggctcccaggtatattaatatgtgtatagaaagacagcttcccccacccccttctttctctgcaaagcacatcttaccaaatattagccctatgagccagggagaaaaaaaccaggaggtcttttgcaaggcttcttagaacggtcacttgctgctgcttctttgcctgtcaagctgtgtgctgggacacacacattaaggccttcattttgttactggtataatttttaaaaatatgtaaaaacacatatttgcctcctaaatgacttgctgttgccgtacacatataatgtaatatttgattcctgtctttattagatctttataatctaacggtttaagtttggtaaaattatcgtttcctacttctctgttgaaagacttgaaagtacccccgaaatattactttgtgtcaagctttagacacacttagtctctggggttaatgacaagccagctcagaggcccacagcaggtaatgagggtgaaagtccaagctttgccatctgacagctgtgtcgatgtgtggagccaaaacatttctcttgactgcgtctctctacctattgggtcctggaagactcagttcccttccaaacccagccagcatcttgaatgcactcaaaatccacgttttggctcaatcaggtgttcctgcttgtgccgggatggggaggggcagtggcagaggaagtcgcggagcttctgcgagagagctgccccttggaaatcaagcaaaggataaacacatgctgccaaaaatctggaactggaaaaataaataattaaaatgggtccctccacagcatttcttgctgctatttatcaagaactcccagtgtgctcagagctgtgtgttctgaaagacagggtctgtaccccctgagcttgtcagccaagttaaataatatactctggttcaaacaatagcatgtcatggctgcacaggtgggagcttggagctttgcatttttttttcatttaagtaaattccttgctgctagtatgcattgaaaagccttaatggaattgaatttcaagaggagtttgaatgaaaaagggtggtagttttgatgaaaaagctgacaattttctaacctattaaataggtagagaagatactcaattcaacaaatatttgtttgatgcctgctagtgtaagcaatgctctgtgctgggtgccactgattttgccactgaaaggacgatagcagattgcaaccttgtgtaatggggtcatgggatcagtgtgcccctggctgtcactcagaagaatgatgtcatttgattgcatttgttctgcattttattttcaggtcttgaatgtgtttttgaaaaggcatgctgaattataggtgcctaaaacaggagcaggacttgaaacactctagagggaacctcaatagattccaacagcaattcctttagagcagacacagtaattttaacagtaatccacaggctgcaaggcacaagcggctggatttgcttgccttctttctccctctcctcctagctggctcttattttccgtcttcaatcagccataggtagaaaagtgacaggactgactgggttgtattttcccactttctggttctcttatctcttgtcactgatcctcctctccttcagcttctgctaagcagtgatttacgagatgcttgtgtaatgagtgtgtactcagctgtttacacactggaccattactttttctgccttgccaccaactttgaatccactttcataactgtagcaggttaactgcagctctcaaatgtgctaaggcaaccgatttctgtagaccctctctctaataatcttctgtgatatttgtacagcacttccacatgtattatttcttttgagccccgcatcaagtctgaggttgattctatggggatgatttcattttccagatgaggaggctaaagatccgttaagcagcttgctcaagatagttaagtgccaaagccctccaccttaaatccaggtcttccaatgtctacatctctactcttcccaccaccccagggtttctcgaactttcccttgaaggtcccctaattaaattggcagcaaacaacctcccctaggatgtggggttgaggctagagggtaacctcagaaggcagtacatgcctctaatcttggcttgtgttttagaacttcatgtggtctctttcctttttttcattcttttttataacacacctgtgcttggattagtataaaaatgaatgtttttaattatgcacaagttaatcaatttgacttcctacctttctgaactctcactacccctggcacaccaacgtgatacacagaaagtgtttgtgttcgagtttgtggagtctgattgctccagacttgtttggccaccattgttgggttctggggtcactcgtggtttaaacatggcagccacccctcggtagacattgagggtagtacgttttcctgcagtattggtccacaggactctagatcattctagtttgttctctagttcattctaccctttgtagggggacataccgccttcttccacgcctacataattctaaagcctgacataatttaactgtcatgcagacaaccacagaatgctcacatgctgcccaacagagagcaacccaaggaacatgtgtggagaagtgacatcccagttccacttggcgatgcagcctattgacctcaaaatccgcagtcttcttgtgatgtttatttctcttccagcttctgttatgattttgtcaagccattttgcagtctatagactagatggtgattttaccctcatatacacatattatatgcaaaaatggattcaaaaaggacaattgccatgacagcacccacttagaaagaggggaaagcaatcatagctactatctactgaatagttattatggccaggttttgtgtgaagcaatttacatgccttattttctgttgattctcattcaccatatggggcaaggactgtagttatcatgatgattagagatgagaaaattaaggcccagagagcttctgttaggttccatagctggaaaatagcagaggatttagaacctgggtggtccagctctacgacctgagcttttagccaccttacaagtctatattaaggagccctaccctattactattaataatcatgatggtgatgatagtaaagacatccaaagcacacggcattttctatgggtcaagtagtgcttattctatacacattaactcatgaatccagagaatattgctgtcaaggaaatgggattccccacttataaataaagaaaccaaagcacgaagggttaaataattactacatgcaataatgtgtacatgtccactgccatggacagtctgtcagcatggacattaggtcctgatgtcaaccctaacctgtatggagcaagctaagcccttgcaactgctatgctaagaccagctttttgtggacacaggcataggatagcagagaatccttagttatgagctgagtttctaggtttgcattggtgaccacctgaagttctgactctggcaggattgtagtttcttaactgtgaacttctagacagtgttggtgttctgatctatacatcatctcaaagggtgttctctgttgaaccccccatacctagcatagtacccagtatgtagttgggacttcagaaatatttgttgaatgaataaatgaaggatcgtagagaatcatgttggaaatgttttctctactcagcagcaacactttctgggagtctggtcacctcatactcccttaatcattgtctttttcttaatgcctgatgtgtcagggccccttccttccttagttttaggttacatggtgtcctttactccttcacctcttcccaggtacttccattcattggaataccaggcttctggtgttgccaatctgagagttacttttgaccatggaaacctagcatggttggaacttctatggtgtaatttttgattgcctttcaactatgagaggaaagggctttatgctgtaggcagtggtccttaaagtgtggactgtggcccagcagcatgaatatcacctgggaacttgctagaaatgcacattcttggaccctacaccagacttactaaatcagaagctctggaggttggggtgggactggcaatctgtattttagcaagctctcaacgtgatttgaagtcatgcttaggtttaagaaccactattgtaagataaaacaattttccttgtgttccaactgaggcacctaggataggaacttgtcgcattttttttccccttgcattttacttagggccataaaaagtaaccaacacattttaccacctgatattccttattccctcctcactgatcaaaggcagtacctagaaagccctttaaagacttgccatttttgggcttagagtctgagtctcaaaaacctgtaagccatagtttaattagctccttcactcttgcatataacagtttatttgtatttcactcccagatgtggggggatgtctagagtcgtctattgtgctgtacgccagaaccaattccgcacaccagacattctctccaagggtccattctttacaacatcagtcctgttaccaatttctatcctagtcatgtacagttggttgcatggaataaagatctacttgagtaaggtcagataaagggatgagggatattgtggacagaaacacatggaattacatggtaatctaggaataaaagcaatgctgtgttatggttatgtgcacagtcactggaaccaggtcaattgggaccaaagctaccagttaccagttgtgggactgtagacaaattattcaacctttctgtgcctcagtttcttatctataaatagtgatcctcttggtttcataggattattgtctggattcacgagttaataagtatagaatgaatactactaactacttaactcatagtaaatgttatgtctgtgtttactatcatcaccatcattactactaatagtgttaggacgggctccttgatatgcagttggaaggtggttccacattcaaggcagcttaaaggagctcagtcagcatcagcaaatgatggatgctccttccttagtctccctgttaacatgacttagcctggctgctttgcaccatcctcctaccaaataacctcctctgcttcctcaaacatctactccctcccacctgagtatgcctcaggcctgccttgatccccactgtctatctttttttttttttttcttgaaacagggtctcattctgttgcccaggctagagtgcagtggcacaatctcggctcactgcaactacctcctcctggattcaagcgattctcctgcctcagcctcctgagtagctgggaccacaggcgggtgctatcacgcccagctaattggaataaaatcatttcttaaacaatatggttcctggaggagagacactggaaactttctttcttttttttttttttttttaaacagagtctcaccctgtcacctagactggagtgcagtggcatgatcatagcttattgcggcctcaaactcttgggttcaagtgatcctcccacctcagcttcccaagtagctgggactacaggcacacaccaccatgccaggctgattttttttatttttatttttggtaaagatgaggtcttgctatgttgcccatgctggtctcaatctcctgagctaaagcagtccttccgaagtgctaagattataggcataagccagcacacttgcctcccactgtacatcttaacagcctgtcaccttcggctttggctactaactggcaatgactttctgtattatttagtccaagttgccaggagagagatagagttgagtccagttcatctttcccaccagatgatgagcccgagttcagtgtagggatttgtaacccttggggcaggtgctggcccctggtccgactagaagaggatcaaacatgcaattgtccccagcaggtgctgcaggtggattcccttagaacaggatggcggaagagccacaccaagaccaacatcttgattacagtagcatacagtagtgtcaaatctgcctcccttaaagttttttgatgaccactcccttccccaaacatgcattggcacacagatgatgaagactgggaaaccccaaagtcgacttgggaacagtgtgtggccagcatgggtctaacctgttcatcaaagtggggccatggaatggtaggttttcttattatgttttttatgaaatgtgcttatcatttttcttagttttaattttctatcttgatgaaatgctaatttttacatgatcacaaaaacaaatagaactgtgacattcatttttcagtttcagtagctgattttcatgttggttggattgtctgttcaatagctacacatagtgctttccttagagaagttactagggggatgtggccctatttccatcccaccaccctggtcaatgctgttatgcaggggtcagcaaactctttctgtaaagggccagatcatcaatattttcggctttgcaggctgcatacagtctctatcacaactgctcaattctgctgctgtagtgtgaacacagccatggacaatacataaatgagcaggtagggctgtgttccattaaaatgttatggacaccgaaatgtgaattccctgtaattttcacttgtcatgagttattctttttttgattcttttcaaccattttaaaatgcaaaagctattcttagctcatgggccgtttgaaaaacaggcaacaagccagatttggcccacaggtggtggtttgttgactcctgctattatagaaagaatgagagtaaaacaaacctttcccatacagtctgatgctcatggcaagagagacgtgaccaaaagctgccgtggaagtcccaaaaagaggcactactctcagcctgggaggatctgggaggcttcagagaggtaatgcttgagctgcatcttgaagctgagtggagaaggcagagaagggagttctagagagaaggcacagcttgtgcacaagcaggaagttgagtaagcctgggagccacaagcagctcaccaggctgcggaatgtccagaaacgagtgtgcaggtccagatggtgaagggcttaatgagacgggcaaaggtggttggattttatcctgatggttggtcctctagactttccaaaccttgcctttaaaataaattatcaatcggaagctccctatgagaaaaaggttagaaaattatcattaggcagggagcagatggcgcatgcccataatcccagcaccttgggtggccaagacgggtggatcacttgagcccaggagttttaagactagcctgggcaacgtagcaagaccccatctctacaaaaataaaaataaaaatcttagccaggtgtagtggcacatatttgtagtccaactgcttgggagtctgagacagggagatcgcttgagcccgggagttaaaatccagcctgaacaacgtaacacgaccctgtctcttgagaaaaattatcattgacttggttctttttgtaagaccaattaccaagcgctgggaacatgggaggaagcaggggttgggagtttccggagccctacaacttgccacaccccatccgggcctgtccctgaggcatctccaaggaacttctagagcagggtgtgaaaaccatggctaaggttgatggagtaaaacagcgggattataaacagacacaatctgaatgtgttctagaaagattactcagaagataaagtggctgcaataaggttggaggcaaagcaccttattagaaggactatcatttgttcgaatactttcttgagctcctattatgtgccaagcaatgtgtggagacatttatatcatggtaaatagggtagacaataaacatttggcaaattaatagttacttttacattaagatgatagctaaaatttacagctcacctactgtatatcattattctaagcactttaccaatattaactcatctaatcctcactgcaactttacaaaatgggctgtattattactaccattttaaagatgaagaaacggaggcacttcactaaacaggtaatgtagcagaggcatttgggggttgcaggtgttggggtaagttctctttaaggaggccgaattgacaccaggaagataagaaaggccggttgcaggtttcccttgcagatctgggaagagcagtgctggcagactggagggcatgtgcaagaactcaaagatggaacatcctggtcttggtggttgtggagagcaaaatgctagtgtggttgaggctagggaggtagaggagagagtatgaggggaggaggctggagaaggaagcagcaggcccagcctgcaggcctccttggcaatgggaaggagattagattttcttctccgagcacaggagagcctttgaagggaagtgaaatgattggatttgaattcctaaataacggctgccctgtggggaatggatgagagattggccacagcggaagaaggaaaacctgcaggaggctcttgcagtagtccagacaagaaataatgtcaccttggccacgagcagtggtgacaaatatggagagaaacagatggattttgtttattgcaatcattcaactgagggacgttgaagagctgaactgaggttgcagcaatgaggatggagaggaggggtgaagtgaaataggtttttaagacgtggaggaccaattagaggatgagtttaatttttgttgatttttagatgccttgggacatacaggaagacaggaagagttgctaagtagggagttggcaatgaagttaggagttggggatccactctataaaccttagagtgtgccaggccctgtgtcaggccccacacatccctgtttgggctatatgtgcactgaggggagtagccaggtctggctcatctttctttcccaggcatctatcaggttggctaacacatggtgagtgagccctcagtaagtgtttctagaactggaaaaaaggtactcttcatctggtggagaagatagtgattatagcatggtgagatgagtgcgtccaagaggagttgacactggggctctgttttgaggaaaagtaaaagctgggcagcaacagggaagtgtatttccttttgactcccttcccaattagccaggattccttgtcatcccctgtctccccgcaacctgactgaggaagcgtgttacctaacacaccagctgttcctgatcatcgccccttggtcttctcctgaggctcctttctctatcattgaccccttttaaaaattggattccgagtgcaaagccttgcttctctgaggcaatagaggggggaatagcctagagcagctggtggctgtaggtgtaacctagtgtcagcccccgcacttagcaatatgtttcttcataaccctgcagagctcttgtgctgtagacctctaatgcagcctgtagaccccctgacagaataatgttttttaatgcatgaaatgaaaacattggattgcaaaatagatgtaatatattaatatatcgatctatcaaaatgttttttcaattaaaggtatagtaatgtatcttaacacattcaatagcaagatatagaggcagtaactaccataatttcaaagtagagatgagcataaatgatactttgagatatctgcaacaactatcaaataatatgaaaatatctgatttcttttggtgacaaagtcacaggttcagtaaatactgctgtggcctgaatccatgattaaaggaaatgctaagttccagttagagctccctggaataaagatttttttttttcatccagtttcatggattccctgaattctgttcatgaactgtggatatcagtggagccccactctaaccattcatttcagttaccaagtgtttcagaaaccaatgacatgaaatgcaaagtttagcattttatttcaaaactcatttgactggtttattttgacaatagggagtttgttcccatctgtattttacagatcaagtacttggtcaacagcaagtgctccataaataataggtggatgagtggatgggtgggtggatgagtggatgggtgggtagagaaagctcagaaaggataaatgactgtctaaacacttacagctcataagtaatagagtttgaacttgaaaccacatattttttactctaaatcacttgttctttctattcttccatgctaccatcagctacttttatttgaaaggacacaatgatagggcatgttcttaaaaatatgcatttgaatcatgggaaaggacaatcctattattatttgctttggtcagagcacacctaaagtactgtgtttacttcttagaagcacattttaagtacactgaatctgttgactgttcatggactgagatggcgagagacttagaaattgtctcttacaagctatcaatgagctatggatgtgaaattcagagaaggccagtttacatggtaatgggaggtctggggtggttttctattgctccccaaggcagaaccaaggcccagtatttacaagggacgaatcttggctcaattaaagaactcagtaatgattaggcctacttatcaatgtatcataattgcctgatgagatattgactgaaagtattcaaacattgacccatgtatttatttatccctttgataagcatttattgacaacctactccatgccagatgctgaggtggatgctgcattcgaagtgtagaatacaatactattggagatagtcagtcttataaagatggagtctactgggagacagtaagtttttaaaaacaatagttataataagtattttgaaggaaataaatggagtgctgtgattcagaataaaaactgaggtaggaacgggaagagctatggtcatgtgtccacgagtaggtgacattcaacttgaaacctgacagattgaaaagagccagcctacaagggagtgaaggggggtggggctagaagaagtagcaagtgcaaaggccctgaggcagaaagatggtaatgtgtccagagtctgaaagaaagtgactggacttggggagcagaagcagagtgcaggaggagaagaatggcaaggaatgggtgtgaagacgtcatcagggatcagctcagggagagtctggggaggcatatggattcaattctcagcattgtgatgggaagccattggagaattttagtcaagggagtaacaggacctgtttcatgttttaaaagatcactttggctactggacagagaataaattgaaagttaaaagggagacaccaagagactcttgcactagatcgggaggggaatgaatgggcacttgggctgaatagagcctgtagagatagagaaggtgaatttgagattattgggaaattcgactgagatttttaatgtattggatgtggggagtgacagaaagagaagagttgagggtgattagtggtgctgttgaccatgatgggtagcaggaccagagggaagaaaagtctagataaccatttgtcagcacctctgaaaccatgtcacagatttcagtggttcttaacaggggataatgacatttacttaggggatgttgagaaatgttggggagagactttcacagtagtcaacataatagagggcactgctttgtggacaggagtcaggaatgctagaagtcccgcatcacacaggacagctcccataatgaggagccatcccatgtagaatgccagttgtttcctcctggacaagcactggtggactgagtctctttcaattctgagaacctagggccaggtgcggtggctcacacctgtaatgccagcactttgggaagctaaggtgggcggatcatgaggtcaggagttcaagaccagcctagccaacatagtgaaaccccatctctactaaaaatacaataattagccaggcatggtggcaggcacctgtagctactccggaggctgaggcaggagaatcgcttgaacccgggagtcagaggttgccgtgagccgagatcgtgccactacactccagcctgggcgacacagtgagactctgtctcaaaataataataataaaaaaaagaatctaggaaaatgcagtttcacgctatctgccattcatatacttttgtaaattatttgagtcaggtcgtctttttataagtaattgactgaaattagccatagggaggagaaggaggttgtgggggtggggaagggacataaagcgggaagaaggaaggatgaatcttggagagtgggactttgctggtgggttggcctgggtggctgggaacactggggcccgtcgagggaggggagagggtagaaggaggtgaaatacaagcttcaccaccttgcatgcttcccacggctgtgctgcacaccagtgatgttttctggtctagaggctgcccagctgtgtccctaagcacactttgaacctctccttttggtcatttgagtccccagtgtaaattcttccttcagacgatcagagagctgccataacttagtcagatcccggtcaacactgtatacactagaatggagaaaagcaacccgagccttcctagctaataaaatcactgtccgacttgggcaaatagttgtcctttccatctccttagctgaataaaagtaatctaattattttcaaacacatgatttcatctggacctcacaacaacactgagaggcagggcatgtggtattattaggtccattttacagatacagtcactgaggttcaggagacttaacttgctggaatcaagcagtctataaggcacagagcaggggccagaacttgggtgcagggctccttcaggggtttcctaatggcaagtgggccccttgggaagtaacagaaaatgatgaaactgcttcaaaacaaagggatcccaaagggaacagaatataaaattaactgcccaagaaaggcattttgtcatgtacaagaaattgataggtacccagttggtatttcctcccacctggtaaggtaaaatcaacatacaggaatccttttagcaccttgggggtaaaacacttgactcttgcttggtgctcaacattggaggccccagttttgtgcccattccctcccgatgatgccgcaaaagctggagcatggctgtgagcaccctgcctcgatgagccgggccatctttcacatggtaggggcagggccaagctgtggctcagctctagagggtgcctttcacaccctggaatgcatgactggcaccccctgcagttgtgcagggcacaatgggagagtatttattgtccatgaaaaatcatatgaagcagctgcaaagaagtctaattgttttcctcatgatatgcccatgactccctgcacacacacacacacacacacacacacacacacacacacacacacgtacacacacaaacacacacacacctcaggagctttggtcccagtttgctatatcaggcccaaagctctttctctctttcagcccaaacatcgcttgagccaaggtagctttctcctccaactgagaaaagtttccctcttagagccggcaaacgtgtaggcgtgacgttatgcttagacacggcaggaaggagaagcagagtgacaactctgagggaaccaagaaagcccaaaggggagacaaggtttagagcgaaatcaagatcggattttgtcatgaaaggcagaactggcaaaagcatcattacaaggcattaaccttgttacacacagacgaacaagcagaggctgggattcagaaataaattacacataataaactagacagaataggctgagagcaacattagcgattatgccctaaggggagagaagggcaagatagaaaataggcccgaaaaaaagagagaaagaataatctctggacacagggggctgactgcactgtttcccccttcttctgcctggctccctgggtattaacctcacttttgtgaggacgtttctccggagcctgtctttcttttgttttcatttgctgcaataagcataagaaagccattcaaagggttccttttcccattcacagggacctgtccatttctgtgtgtttccagcacaaaagaatccatttccattcagccagagcagcccctagagttttcatgaggtccaagcctcctctcctgttttcttccaggctcgctgttgtaataggctgcaaaatcctgactgtggccagggtcctccaggctggtgagaggaacaagcatttgtccacgtcctggtccctgcagctggggaagaactgcagtttagtgtccgctccaacaagttgtgattgtcatttcttaaacagtgacttccttttggttccaagtagcagaaaacgcaaccaacagtggcttaaaccatgacaactattgttaacttagtaaaatgtttaaaagttgaaggtctgcggctcagtggtgtctccaggaacatagaatctcttttctttcccctgcaccaatcttagcatgttgctttgtatccttcatcttgaatctcatggaaacagaacggttgccacgagtctatgcatgatgagatcacacaactgtattccagaggaggaagtgagggaagagggcaaacgggttctcctcaagaggcttctgttatcaatgaggaaacttattcccagaaatccttccagtggacttctcacatctccctgcccaggactgggccacatgaccaccctcagctctaagggttaggaaagccagtgtctggcaatagggaatggagctgccatttggcttggcccaacgatagcttccaccaggcttgggttcattgctgtctgaacaaaattagggttcttcttggcaaagagaaaataactgccatgggtgtggcagtaacttgtgtttttaaatgaagtaatgatagcaagcatgggttatgtgttgctatgtgccaaacctgttctaagctttactgaggcttacgcacaaactcacccagtcctcataaaaagtctgtggcataaaaagtctgtgctcttatcatcatttccatcatatggaggagaaaactgagtcacagagagattaaatcacatttacaaaattacttagctagaaagtgacagagccaggagtcaaacttaggtggtctggctggctctctatgctatactgccttcattaggtaagatgataaaatacttcaggtagcacacagtaagtattagtacatgttagctggtattattattattattattattattattattattattattattactatcatcatctcttttttgtaaccaccctgccaatcagacacatcagccttattagatactagaaagctaacccctaacagcattaaattaattgcccaggtcacacagtgagtgagaaccaagctcaaatgtaaacgagtgctgggtgttctctcaagtttgagaatgttgatttaatggctgcaccacttacccatgctacttttttttttttaaggtaaggtctcactttgttgtccaggctggagtgcagtggctcaatcatagctcactgtaacctggaactcctggactcaagtgatccacctgtctcagcctcctaaataggtgggacaacaggtgtgtgccacacatctggctgattttttatctctgtagagatgggggtcttgctatgttgcccaggctggtctccaactcttggcctcaagcgatcctctcgcctcagttacctatactactgatcccggacttactttgaaaaaaaaactacaattgttgaggacagccagaaatcagagaaggacaccgggaaaggtgagatggtaatttgggacggatttttccttgttccgttttagcttttgagctgcctctgttttcttggatccagtcttttgcaaacaggatctctcatcccacctcaggaaaggctacccatggttcttggtgaattagaacaggtacagtattaagcacctactgtataccagacctggctgtacactgtcccacctggtccttgtggataatctacagtccacatccattactttttctgtgttgtgagatgaagggaatggagtcctctagccagagatagtggtattagaacattctggatacccaggcagagacgatgccctattctccgcgttagcctctctgcagtgttcaaatatttaataaaaataacaggcatggtcagctgatcttacgtttgaacaattctggatttattttaaagcaagatgtgtggcatggttttacttatttttttaatcctaaaggtcatccgacttttctttttctgctcatagtcatgaggcttccttatctaaacagtgatctattgttccaaccttagacccacagagaatttttttccttaacttcaattttcacaggacagctcctcatcttcccatattgcatgaaaagtatctttcaacaagggaaaaagaaactctaatgagctttccctaaatcttcttaaaccgagttcactatagaatattttatgcaaaaacattgccttctcttaggttatgacatcttttccttgaaaagtgatcagggcattggacaaatcctggctagcttatcttgtccttgcagcgcaacctcaacaaagaaatatagatggcactttaaaggcttcagaaatcaatttagtcccataatccatttagtttagatgttaatgaaacttggtgggtttaaaaataatgaatatttaataagacataaattgaaagacataaacactgttggcgataatataatgaagttaataagtcttagcctccccctccccaaatagggcgattttaggagttgctgtgttgcttactgaagtttgctggctgcaacttcaatgtgcctttaaaaaccttagtacagttgggaactgagctctggcagataaagtgtgctatcacactgtgttcagtagctgcagacggcaacggctcttcctagctccatatcttccagagatttgtgtaacaaactcagtttcctgtcgttgaaggcaggatgcagcacgaagcacttcattccttttaaacaaaaaagaaaaagacattttggtcgacactctctctgctctgggtttaaagaggggctttatttaatgatcaggaccaagcgtgtgattacatgtgctcagagcctcagacaatttaaatgccttcaggttgggagttagactttttgttttcccctttaaaagcatcagcaccagggccagcccttcaacttggttcctccttagctctgtggctcgatcctacccatcgtccacaactgtatctttaccttttcaccccctcaactagctaccctgtctttaggcttcctgtggtcccttttggtaaatctagaatccctcctttctgccatcacacccaacaggatcgtccgtgtcacatcttgggaaatgtttgtgtttaacctcacagaagccaacgcctagctaaaatgaattggcggcaggattttgaaaacagccaagtataagatagtctgcctcccaattcagcggtgggctgtctcttggcactaaagtggaattcagcttcttatatcagctgaggggtgttagatagatggccagctcgctttggcactcaatacctgttcatacatagtaaacaggggttttctttggttgggcaggtatggtgattttgcaaggtaatgaaaggttgctcccggggaatctagtctaagagaatatatgtggggcccagaagtgagatcctgcctaggagggcatgagtgacatttcatcagtataatgagaactattgttgttaaaaattattattatttttttgtgcgtttgtgtgcatgttcagaaagaaggggatcaacctgaaagagtccaaccaatcgcatcatctaccttgatccattccgacctgacatccgtttatggcaccgtggtaatgaacaggactgttttattcttggggactggagatggccagttacttaaggttggttttctgtgccttcttcaaatgtctattttaatggtgatattttgtactttaaaaaaacatttttttaatgcttctgggttatacatgagaccaaaccaagaacttcatgaactccttaaagacccccagaaatggcctggaagaaaatctggaattctgtatgtaagaatgccccgtagccatgtaatgaagtatcagctaccttgctgcccaggagtgcaccaagatgtttttccttccttactcataagccagctgggtgaggtaaatggaggtctggtccctaccccaaccctgactcaccttcccaagacatgtaaccttttagttctagctcctttatcatggaaatgtacaaagcacctgatttctcacaacttgaaagagatgagagattatagggcttgaaaagaagaaaaaacaggtgttctttccctccagcccacttaccacccacagagggggtttgttttttgccctttgtacccacacacaccacagagaggttagagatctaaaatcctttgagactcctcttgacttttatctcagaggactatttcttctccactgtgtggacacaccccggtcaagtgcaggtttttattcacttaggagaggggaagaggggaggaggagaaaataaaatcagagataccaaatgacttgtctgaagttatctagcgttcatcttatcaatgtcatcagcaagcatttattgaagaccttctgtggtctccaacaacattcctggtcaggaactgcaccatttctatgactaaagactgagattccttggcttctctgcagccatccatttactctcagctcagatttttaatcgagtaatggtagatctgtttccctcaactgatctcccacagataactcgctgtgtgactttaggtgaattgcttaacctctctgagccttcatttccttaccagtaaaatacagttctactagacaacccagaaaaacgctttcctcttctgaaagtctctaattctgtcttctgcacacgtattccccaccatccccatccccaagccaaacctatttacttgctcctgtttgatcctgtttccaaatatgatcctgtttccacacttgctcacactgtacctccagcctgaaatgcttttttcttttttctcttatttacggcaccttatgtgtctatgctgtggctcagctcaaaccccacctcctctttgatgacatctaggcctggagtgaccttgctctcctctcatttcctgaaatactcatgatctatgtcattcttgtggctcattccaaatgtcttgcctggagacctcaccttttcactggtgtctgtcttgccttcccaacttgattttaagcctcatgagaagggggccatgaattcccacagcctaatacagtgctgagtgcctggtaggcatttgatttaatctgttttctttggaggaaacccagtaacatatgggagggagtttgtttgtatacacattcttttaaaatatacattgatcatctttcctgttgtgttagctttatttcctggggaagggtaaatacccatccatcattctacacaagtcactgggtgacgtctgtagctccaccaacctggtcaggcttattggacccatttgcctggcgggagtttccatcaagcctttctgggcctcctcaccaattatctcttcagatttgggatgtttttgatgagtgttttgacaagaacactgtttccccaaagccgagccaaccaaaccgctacatggtgaattggaggtgaaggaacactcgtctataaatagttccccatgggatggcctggttttgcctgtcctgtgtgttcacccagcagcctgcatgccgctggccagcttttagcgatgttgtggcaaccagggagtggaccaagctgcagcttcatgctgctgaggaggccgcagccgaccgaagtctcgctctcctcaggatctgtatggggtacccattcagaagccacctgtgtggcctcgttgtttttttcaaggtttgaataacaaaggcagctttttgttgtttgttttgtgactgctaacatttacacagtgcttcctagatgccaagggactctatatcttctaccgaattcagtcctctccatgacacaatggggcaggcctactattcccattttacagatgagggaatcgaggcccagagaaatgggatgattgttgttcaaggtcacacaggggcagagcagggatttgaacctggaatgacttcagagactgcactaagatcccctatgctgcactgactttgcaacctctgccgcacacattggtactactctctgaggattccgggggcacatgggagacatgcagatagggttccatgccgtggctggggacacatgctcctggggtgagtcagccttcctagaggctcaggaaagagtcccagcttgagaataaggcggaccatctgactgaggaaatacctcactggcgtggtaacttcttgggaattaacacccaccccccaagcccccaataagagagaagttctctcactcaggagaagggtgtgagggatgaacttgagctgacttgccccaccaggctccctagggcagctcagtaatgcccaagcctctcccctgtatcctgtgtacagattcttggatgtagcccctgaatttacccagaatcctgaagacccaggatcgtgtggatgatttggaaactaccgataatcctcaaatccctttattcagaagctttcagcttctcccttgccaaggcttgtcaccagaactgttagaaaggatgaacactgatagacacaagcttggctccttaagccacagcgtgggggaactaatgagcggcaaaaaacaaaactcaacccaacgcagacagtaggaggaggagaagaaagagggcttggatcagccacagcctgactcatcagtttctgagtgatcatgagttgacggcattttgacatgtgccaggcactgttgtgtataccttgttgaatgagagtcaggaaacagcaattggggcccaactgctgttttttaccaccaccagtaaaaacctgacttcttaaatctctgcaaatcctgtgagttttaatataatttggtgcaattttaagcctcatgttatttaaataatttttccttattgtaaaggtaatatatgctcatgtaaaaagttgcagagtcgtcgggggtgagaggacaacaaagaaaaaattacccctaatcatgtcatgcagaagcaactgctgtcagcattttggattctctatttatgtagttgaggtcaggttttgcatccttttcttcagttagtgagggaaaatgcttacattaaaatgttattgcaaaccctttgtaaaaagtatttttaaataactatatcatattctattatttgggtacattattttgaacttaagctaagatactggatcacttttaaagtatctttaaagacatgcattttccaaggaagacggcattacctccaaaggtaagatttcactgataatctgtgaagaaactaaaggctacagtatgccagtacctttactgtcctccttctcttgcctatagacctaagtccctttataagattttggggaaatagaaggaatttagagctcaaagggtcctttgagagcatctaatctgctcttttattttatcggtgtaccgtcccatggtcgtgaggtgagttatgtctagtcacccccgcagttatttccccatcctgcttcttttcggaacatgattgcatgccgggtttttttcagtcgtcagcatctccactgagatcagctgaaaagtatggtcacactgaactcagctttggggaattcacactgcacgtgttgcacaatgtatgcatttctgtaaacacacaccgagtctttctccagattatagtacagcctatcatgtggtttggattcctttgagctgactctgttgcccatagaaaattgtccttatttcaaaggcagaattgcatattttgagcttttccaggtggtaaagtaagtaataacagaatatgcatgaaatttgaaatttgtaactttatgcatgcccattaaccttcgtgtaagcataaaagataagaaggcaatgggcaaggaagaataatcgctaacatttctgagctcttcctgtgtgctgggcattagaaccagcatctgcacgggttaactggtttaatccttaccagtcaatactctcaccatccccactttataaatgaaaaaacctgaggcctcgagaggttaggtatctttttcaaggtgctctgaaccaaaataatctgtcccagagcccgagcttctatcccccaactaaactgcattaactcttacagagcttagtagagtttgagagctggtttttgttatatttctttctaatactggggtataagggttgataccaagatgcagatgtttgaggtttcataagaaggggccgagaaccctgtggtttagtttgttcctatttggggatggcttcctggcaacccagctgagtgcagagcccgctcctctctgagctgcgcgtagtccacgggggtctctgaatctcctttggggccccagctttaccccagtgggctcctttgtaggaaaggtaggaattctgtattcaagttgctgttttgaatggtgtcagcagtaaagactagtgtctccccgacctcccagggactgcagtagggttcaggatacaggaagctatatcacatagctctatcctgtccccatatccagtcttgaggtatttcctatgtgcttgggctcagactggttacctatgtggccctctactcccacttaatggctttcttttgtttatttttttttcttttttgagccaaggtctggctctgttgcccaggctggagtgcagtggtgcagtctcggctcactacaacctctgtctcccaggcttaagcgatcctcccacctcagcctcttgagtagctgggactacagacctgtgcccccacacctggctaatttttttgtatggacagggttttgccatgttgcccaggctggtctcaaactcctaggctcaagagatcctcccacctcggccttccaaagagctgggattacaggcatgagccactgcacacggcgccactcagggatttcgtttattcaaatcacagcaaaattaaaccggttccaaaaagttctgtctgaattcaaacagaagcaaaaactctgtactgcctaaagagtctgccttgactctggttattgaagtttttgaatgaatgtcagagaaaaaaatcttttgtaaaggcaagctgtactatatacccagaagatgttcaaataaggaataggagaacttggggaacctagaacaggacctgggaccggaagtggtggtggtggtggggatgactgagctaacagaccaaaaagttaaaacaggaggaagtgtcaaaacttggaagtgggttcattggttggctgtttaggatgtcatgtgaagcctgcttcaagttctccccacctcattaattgcaatttatgagtttgcagggactccccagtttgaaacttttagtcccatataatccacaaatctagaacctgtggttcagactgtatgcttctcttactacctacactgcaataagtagattggaaacaaaagagaaatttgccttgatctttatatttcatctttgttactcctaactactgaggcacattaaatacttaccttgctttctcctgtgtgtgcatgtgtgtgtgtgtgcacgcatgcacaggcatgcacgtgtgtgtatatgtatgcaggcatgcacgtgcatatgtgtgtgtgagcttgtgtgtgtgtatgtgtggtttaagtctccttcccagcatttctcagaaactgcttatggaaaaaaataataataaatgaaagggttggcttgtttgcccttcaactggttagccccacagagtgaggcataggaaattaaatttggcataaaatattatagctttttgaacacccgtggcttttccatctcatggtaatcgtaaagaaaaaaaaatagttttttgtttaatttttctcccccctcattttcctcaccatgatatccttcctgtgggtgatcttgaacctgtcttacaattgtatggtgttgaaatctccactcagttaatttcagcagtgtagttgggagttttatatgcaacaaaaatcccaaggctcgttaatagtctaccatgaggcttcaggaagacatcaacagaaacaatatgttgacacgaactgaaattctccatcagagaaaatttgttttctacacaggcttcagctggaaaaagctgaagagccctataaaatcttgaatgctaatagcgtcgtttttcatttaataaatatctactgggcaccttgtatgtgccaggcactgttctgggtgctgaatatacaaaggtgaacaaaacagacaatgcccttgctctgctggtgggaagaaaaagacagaaaacaagtaaatggattaatcagcgataaagacacttcagatagtgctatgaagaaaatacagtgatgggtagagagtgacagaggtgttcagcggagaagtgatcagggaaggcttctcagaggaggtgatgttggagacttgaaagataaaggagtatacaagcatacacatggagaaggttcagattgacttcagattagatctatattaaggtcgtatcctggaagataaaaatccacatcgtgcccaaggattgtgtgtgtgaattggatgagatttctcttatgcaaaattcaacccgttttgggtttttgtgactcattgttacttcctgcattgcttcactgatcatgttctttttccgaggctgcccacctaaactgagctgaggaaggaacgtttcccttgctccagtcttgctggcttttgtctgtgtgttgatattctcctgaagtttgcaattagaaagtccaagtgttccattagtgcctgtgggctggggctcgggctaggtgagagatgatatgaacactgacctgtcctttagtcatctgagagagatgagactccaggggccacggaagcagaaatccctcacccctctgtgtagcacatttgggacctttgtggtgaaaactaaaacttcctcttgtcctgtcctcaggattatggagagcattgtttgcataatctagcaaaaagaaaaacaatttgactcactcaccctcaaggatttttaaatttaaatgttatatatttatttttaaggtaatacaatgatattgtttaaaactcaaaagaaccaagaaaatattccgtgaaaggcacctggtcttgacttccaaggcaaccaatgatagtagtttcatgggtatctttccagagatagtttatatctgtctacaggcaaaagagtgaagatattcttcctcccttttgttgaaacataaaacacagtaaacatatatgttatatatgtaaaaatacctgtatatgtaaatatgtctatatttatagatatatgtacatatttcatataactttaaatataacacaaagagctttctaattatttttatagctaaatagtatttccttgtttgtactatagtttacttaaccagttccctattgctggagatttaagttgttttaatcttttctttataacatacaatgctacaatgaatatatgtcatttcatatatatgtgtgtgtgtgtgtgtgtgtgtgtatatatatatgtgtatatatatatgtgtgtgtgtatatatgtgtgtgtgtgtatatatatgtgtgtgtgtgtatatatatatgtatatatatatatacgtatatatatgtatatatatatacgtatatatatatgtgtgtgtatatatatacatatatatatatatatatatatgtatatatatatgaggggctgcagggtccaagggtatgtcctttgtaattttgatagatgatgccaaattaccttctagagaggtctggcttccaccactgaggaaacatactaatttaaacccagcatctatggctatcaggacaagcttcagtgcaagccacgctaagtagctttttcaggaaactgattggtaaatcctgggccacagaactttttgataacttgtaaaaaaagaaagaaagaaaaacaaagaaagaaagagagagagagggagaaagaaagaaagagagagaaagaaaaagaaagagagagaggtaaggaaggaaaggaaaggagaaaggaagggagaggagaggagaggagaaaggaaaggaaaagcttccttgccacaattcagagttctagagagaatattgatgcttcatttccaaggtaccaagtaaataaatcaatgttgcacccaactagatcttgctgaccatctgtatcaatgatgctccaagagtaaataaaataagcccccaataaaaactgcagtgcagctcctaatttacgtaaaatggatgagtggtggtgtaaagtatgtttttactttgttattttaaagcaaaccccacagacatgatgtcgtttcacctcaacatatttcgttatgcatctctcaaaacctacagttgttttcttaaataatagtaaccataatgccatgatcacagctaataaaattatcagtcattctttaggatcacttactatccagtctgtgtaactaagtattcccaattgattcaaaaaggtattttaaatggttttgttcaaattggtatctgcacaaagtcctcaaaccaaatttggttgttctattatctagagcagtctcctcccttacttttattccctgccactgacttaactgaaaaaaccaggtattttgccctatagaatgtctcttatcatgtgtttggctttttgcttccttgtggtgtcatttagcttgttcctctactcctgcttcctagtgctaaatggaagttagtgctaaagacttgactagattcagtttcaactttattggcaagaatacattatgggtggtgctgcccaatgatgcttttgccatgatgaattcctgaagagataccagggcagcagcttctcttctcttgacccttccttgataatatttctatcagtgtttgtttaaaaaaaacaaaaactggcttcctgtttctctttccctatacaactgctttccagaaccagatcaactgaatctgagctgattaatacagctaatgaattagagacggcaaatcctggcaagcccataccttggtcagtgcctgtcccttggctccacttacaggattctgtagagcagtgttggccaagagaactttctgtagtgatagaaatgttctacatctgtactctccagtatggtagccagtcaccttaggtagctagtgaacacttgaaatgttgctagtgtttttaattaaatgtaaatttttaattaaatttaaatagccattatgtggctagcggctgtcatatttgatagtgcagctataaagtcgttttaaaatgacttgagacacacacctttcccacctcccttaggacctaactgcttctgttttaaaaagagcttttaagaagtcatatttcatatgtttggttagtgagattgacttttacaaagctgctgctgaatttgatgagcagtccaagggcttcaagtgagccactatttgcaccaaatccacctgggcttggcccaagcagatgatggaaggaagtcactgatcgcagggcaaagctagactcgggcccaggtcctggaaaggagaagtgaatgcgggaagttgctctgtgcaaaattgataagaagcctttggctaaacagcaaatccctaactgccatcaggatatgtgggaacaggcatattattgattagtagatgtgtgaagtagactttgtccaaaaagaatctcaggtgccaaatttttcttttgaaaccatgcgcccaatgtggctgatgtctacagtggtagagatatgaatacagataatctatctggatgtgttcaaactgacaaaatgttgaacaccttcacttttcaaagtagtgggtacaaattgtgttaggtacaaagaagattaaaggttaggtacaaaggtgattaagacatggtcccaggccaggcacggtggctcacgcctgtaatcccaccactttgggaggcagaggcgagcggatcacctcaggtcaggagttcaagaccagcctggccaacatggtgaaaccccgtctctactaaaaatacaaaaattagctgggtgtggtggcgcatgtctgtagtcccagctattcaggaggctgaggcaagagaatggcttgaacctgggaagcagaggttgcagtgagccaagatcgcaccactgcactccagtctgggcgactgagtaagactccatctcaaaaaaaaaaaaaaaaaaaaatgacatggtccctgcgcaaaaggagcttgcaatctagtaacagattattatctattgactattgattatgtgctaagcatctttcatagttcttatttgatccttacaaaactgtaataaggaaggcactattagccccattttagagatgaggaaattgaggcctagggagattaagttaccagttcaaagtagtgcagctacttaaaggatggaggcaggatgcaaactcaagcttaagccaccattatacttctctagcactataggattcgagtctcccgatggctcttcatacccacacttcaaaccctgccttcttaccatctcctcttgctccttgacccaaagccctgccatggcctcctctctctcatctacagtaaaaggcaggctgtttacacaggcccacaagacccttgattatcattcccctgttatcttactatcttactgttcactcctctacctctctccactgaagccaccctggcctcctcccattttagtttctttgcactgacagggctgcttttaagaacatgtttcattcaagtatgaaaataactcatctcctgcaagtctaaataaatatcaccttttcagtgacacctaccctgaacatatattctcttaacccctgaccccactatattttataatttacttttttcttattaatagtctgctgttactcaccccaccatacacacacaggaatgtaagttctatgaggtcaggagctctcccttccccattttgttcactgccatttttcaaacacccagaacagtgctgggtacataatgggtgttgggtagatgtttgttgactgaagatggatgaagctcaggtgtgtccaatttcaaaaccactgagtactgagtcacacttgcgtatattttatatgtgaacacaaacctacttgtctgtatctgccaagttaatctgggtcacttctaactgtatgatgatcagagtatcctgtgcaaatacatgtgggagctacttcctttaatttccagtctctcttgagacagcactaatgaagctgtcacttgtggcttcctatagggccagacatggtcagaaattgtggtcagccagcttccacatatgaggatactaccccagccctgaagagcggctttttttgtttgttcatttttggtaactttgcctttacaaaagaagaaatattatgcttgttattaccagccttgttgaggactgagatgtgggaggatgattaaggagcatggtaccttaggcagtatttgtagtgagtgaaaaaggatgtagctttatgattaagctacaatttttgccaccctgctattcaaagtgttgaatagaggccggaagtggtggctcacacctgttaccccagcactttgggaggctgaggcgggtggatcacgaggtcaggagatcaaaaccatcctggccaacgtagtgaaaccccatctctactaaaaaaaattagctgggtgtggtgcatctatagtcccagctacttgggaggctgaggcagtggaattgcttgaacctgggaggcggaggttgcagtgagccaagatcatgccaatgcattccagcctggcgacagagcgagattccgtctcaaaaaaaaaaaaaagtattaaatagaaatcatgtttctctttttgaaaaaaaaaaataggttattcttggtgagaatttgacttcaaattgtccagaggttatctatgaaattaaagaagagacacctgttttctacaaactcgttcctgatcctgtgaagaatatctacatttatctaacagctgggaaagaggtaggtagaaatactagttattgcttctgatttatgaataaaaatggtttaattgatgtcattatctagtagcaaagcttttactttgaactacagagtttaagcagtgccccaggctttgaggagacccgcagtggttcacaggcacggaattaaaaaccttactgactgtcagtaagtaagcaagaaatattatctatttagacaattttattattggctatatttccagtgccaagtttttcagaggagggtgtgcttggaaatgggcgcataatcagcaaggtaactgaatttacacatttattgtgtgggcactgaacggttagatgcatttatgaatatacccaatgggactggctttggaatttggggttaatatcaggccacagtctcatacacattcatgaaccaggaaatatatggtactccccctccccctcttcatttatcttgctgttttggcttttcttttgcttctgcttactgaaataaaagtaatatatttttatattttcttcatctttaccaagtgctgtcaccaagggaaggggaaaagaaactaattgttaatgagtctctactatgcattagtcactattctttgcatgatctctgtctaggtgcatagaattgtgtacatatacatacacacaagtgtagaaaacagtgttaatgaaatgtgttactgaccgggcatagtggctcatgcctgtcaccccagcactttgggaggctgaggcaggaggatcacttgaggccaggagtttaaggctgcagtgagccatgatcaaaccactgtaccctagcctgggtgatggagcaagaccctgtctcaaaaaaaaaaaaaaaaaaaaaaaaaaggctgggcatggtggctcacacctataatcctagcactctgggaagccaaggcagggatcacctgagttcagacgttcaagaccagcctgggcaacatgatgaaaccccatctccactaaaaatacaaacaattagctgggcgtggtggtgcatgcctgtaatcccagctacttgggaggctgaagaacaagaatcgcttgaaaccaggaggtggagtttgcagtgagctgacatcacaccactgcaccccagcctgggcaacagagtgagactctgtctcaaaaaagaaaaaaaaaagaaagaagaagaaaaagaaatgtgttattaatttaataaaaataaatgtgttattaatttattttatgtgaagaatctaagacttggagaggttaaataacttgttcaagaatatctgtatctatctatctatctatctatctatctatctatctatctatctatcatctatctatctatctataggttagcctttgcagggctgtgacaaaaactcaaccctgattctaaagcctctgataaatgatattaaatccaaaatttgtgaaaactggacattccctggctcagtggttttgacctatgaccgtttgaacatggaaagtgcaaagaagataattgagacttacataattatataatggatgtaacagatactctcagcccaaccctggttttccattcttttcctttcagtcattctaaggaaaatagcaatgacagcaatctacatgtgctttttgagtcacagataagatgtgcaagcaatttgtagtttctggtattcttataaagacgatactgttctttgcacattgaaaagtcagttatatcaaaatgaccacactgagatggccacatcttcccacagagcttgtaaaccagtccttcaccatatagaatctcctatgccaatttgcttcaccatgcagacactttgtattatgtttcttccctggggatcccatctttgaaagacttttgtctacccaacaaactgcacatattaagtaacagttcccattcccagggtttatttatcaagggcgtctcaaaactgccggtcagagtactgactgtgttcccacatggagctgataaaattccaacccaaagcaaagaaacttgatatcttccttaatccatgcgtgtttttccattcagctgtctgaaatattgcaaatagctcataagcccccattacttccttcatggatagtaatggaaccccagaactcaggaccccaggctgggaaccattatgaaaagccaccagtagttgatgggttcccactttctagaaagcaaaaagttctagcctctgatcattcaaagcctgaagtcctgggaagagtttttgactgggcatcaaagctggttagccctgcattcttcactgaggattactgctagagatcctactgtttgaactctggctgagcaaatataacgcctaaagagacaaagtccaaggaaggctcttggggagataagaacagccaaactaataagctatgggatatccataaaatggtatgatacggggccgctaaaaataatcatatggagatgtaggcattgatatggaatagtcactacggtctgttattaaattagagggcaggtctaatgtagtatttttagtgtcctctctctctctctcttttttttttttatggagtcttgctctgtcacccagcctggagtgcagtggcgcaatctcagctcactgcaacctccgcctccacaggttcaagcagttctcctgtctcagcctccctagtagctgggactacagtcacacgctaccatgcccggctaatttttgtatttttttttttttaatagagacggggtttcaccatactggtcaggctggtctcaaactcctgacctcaggtgatccacccacctcagcctcccaaagtgctgggattataggcgtgagccacctcgcctggccctctctcatttttttttgaaacagagtctcactgtcgcccaggctggagtgcagtggtgtgatcttggctcactgcaacctccacctcctgagttcaagagattctcctgcctcagcctcctgactagctgggattacagacgcccaccactatgcccagctaaattttgtatttttagtagagacagagttggccagactggtctccaactccaggcctgaagtgatctgtccacctcagcctcccaaagtgctgggattacaggtgtgagccaccacggccagccagtgtcctccctcttatacagagttatatttgtgtgtttaaatagactgagtaatagttctcagagaatgttctggagacccatattccacagaatgctctgagcaaaagtggtcccagaaccagctgttacttactatacccctcctggaatactgtgaggctcagcatagtcaaaggctccgagaagccctgtgctaaggaaacccgttttgctttttcagtctgaggttttatgtttgctggatcatggagcccttttcttgcataatagcagtaaccaatacttattgaacatttagtacctgtcagacaatagttcataataaccccatgaagtcgtgatccattttacagatgaggaaacaaggttagagagattgcatgacacttattaaaatccatcagtgttacagaggcatttgtgaactacaaggaaatacctctattctggttaattccggctcaggatcacgggctgccagctgcatctgtcagcagtgttggggactatgaaatggaagggcgtggttatcctccatgaagtcaacttggaactgaaggatccagctcaggatagtccttgttttcctcacaaaatagagaaaaatagagaggtcccttctagaactccttatttctctaacctgctaaagaagttatttatactatctagcatgtacaacttcctggcataatgagttccacaagttcccttactacctgctgtgtggttttgcctgcagaaagtgctctgtgtgatgctcagttactccctgcctctcaccgccctacttgcaggctctgactggctgcctagatgtctgggtctgcccagctggggtgccctctttgtgggctgctgtttcctgacaatggcaagaggcagctctagggatggggaaatgatttgactactccccctgtttcttttattttcaactccactggaggggtgtgagcaaaacaagccaggagctgaggtgacggcgctgcccctggcaggggtgtgggagggcctcgtccctggtcctcctcgtttccacattgagtgccaaactcctgctgacactcctggggcagagcctttgttattccctaatactcatttccaaaatgccattggccacatatggactgtctctgtatgaaaaccaggcaacctgattccatgatccgtatggaaatcatcattagcagatcggaaacccaactgggtgtcagactcacctgagagagagctcttaaaatacagattcctggccagacacagtggtgcacgcctgcaacctcagcacttttgggaggagtgctttgagcccagaagttcaaaaccagcctgggcaacgtagtgagaccctgtgtctttaagaaaaaaatcttttaaatgaaaaaatacaacttcctaggctctgcccccagacttagcgagagtctctgcggcagaggcctgggaatacgcactgtcaaaagctccccaggtgattgtgatacaatgacttcatgtcctagatcttgagacccactgcccagtgccagtatggaggtgttgagttcaagttgataaataggctctttttggcccttcattagataaggtgttgtagttttcctgctgttgcttataattccatctgaaccattgtcctctttccttttaggtgaggagaattcgtgttgcaaactgcaataaacataaatcctgttcggagtgtttaacagccacagaccctcactgcggttggtgccattcgctacaaaggtatctcctgaattctttctcaccaactcgcatttttgaaaaagtgtcatgcggcagaacacttgttgccctactttaacgatccattccagtgacctgagggaactgatctcttcctcgactaaaatcttgttgtgcaatcctaatgaattctcgaaggtgtttccagcggcgtccgtgctatgcaatcactggacccgggagctccccagtctcggggcgggaggggcaggtgtgcagccttcaggagaacgggagagagcaggcaggtttggcttttactttctccagagttcgccaagactcaagagagaggcaaaagggccccccctccgagaagataaaagaatagagatgtctgaaaatttttcagctgaatccccatcatgtatgtcatgtattctgttcgctccgcagaagcctcgttattgatggcgccgtctcctaatgcgccgcgcagctgtgggcctgatgtacaatctcagtctccgggcagaatctgcccagcctggtctggaatgacgatgctcacgacccatctaggctcaggggcgactcggagcggcttccccgccatggcagtttcctagcgtcgctgggcccggcctggttggattcgccgtcgccatggcaacccagtactggggctcttgctggagaagcaaaggaggagagagccttcgctgcagctcaggcaggaaagagagagagagagagagaaaaaaaaacccataacagtgtctgtcagtttggtgctttcagtttttaaaggtgaaaaggataagaaagagcagagcaggtggagagatgctgaaggctgaaccaggggacagtttgggtttagaaaagagcaggaggaagagaattggtgactgaagggggagacagccaagagaaatgaagggagagggggaaatgcaatacaagcaagaggtttaggaaacaaatcaaaaatacggggatggaattaattaagagttcacgggggaaggcgcaatccgagctgcagcaagaggaataattgcccctgccatttgctacgcttccttaccgggctgtttccgtcagagtcactggcagacaaacgaagcaagggccagaaaaatgctcatgaataattcactgatcacgaacgggatttgtttgttgcacactcagtgagcagtcttgccataatcttttagatccattcatttatgtagcatccctgtctgtatttgtagagctgtgtacaggagtcaattcgataatggtggcgatgatggtggtgattaaatagccacatggagctagcggctaacgtattaacaagctcagctctggagcttttgggagatctccaagctggtgatatgaatttgggagttggtagtattttagatggtacttagagaagccttaagaccagacgaaggagtgagtgttgattgaggagagaagtttgagaactgggccttgaggggctgtggtgtttaggggttggggagaaggaggggaaacagaacaagaaataaggagggagcagtcagaaggggaagaggaaaaactggagagggtggtctcctggaagccaaggaaagaaaggaggaggaagtgatccactgggtcagattcagctgagaggtcaagcaggagaagaaaagaatggatcctttgcacttagcaggtgacaatgggtgactgctgggaatgccatggttaggagtggcgctaaatccacaagagacaatgggaaaataagaccttaagaagggacagcttagagaagctttactgagaaaggcagctgaaaaaaatgaagcagacactgaaagcgaaagtagagtccaaagaattttgtctttttgtcctttttttttttttttttgagatggactctggctttgtctcccaggctggggtgcagtggcatgatcttggctcactgcaacctccacctcccaggttcaagccgattctcctgccgcagcctcccgagtagctgggattaccggtacgtgccaccatgcccgactaatttttgtatttttagtagagatggggtttcaccatgttggccaggttggtctcgaactcctgacctcaggtgatccgcctgcctcagcctcccaaattgccaggattacagccgtgagccaccacgcccagccagttttgtctttttaagatgcatgaaataacagtgcatgtctgcactgttgggaaaattccagaagagaaggagaaatggatgatacaggagagagaagggttgtggagtgttcagtctttcagcaggtggaagaaaatatgacttggtgtgccagtagggaggccagcctcagacaggagcactggcccctcaccctcagtggtaggagggaaggtagggactctgggcccaagcatggggaggtggcagaggcctgtgtggtgtcttctcctattgctcacattattttcagtggcctacggccattgagaatgaggtgagggaggaagcactggaggtttgaggagaaaagagagagaaggagtggactggaagactaggagggagaatagaatagggaaatatcgagcggttgccaggaagcattagggcccacttgaggttgatggtcctgtgtttgaagtgagagctgtaagcatggttttgtctttctcaagctgcgttcagctttggtggtatagctgtagactcagaaaaagttagctttagccagtttgggggctttgccggaaaatacatcaagaaaggagagagtggccagggagctgagggagcatgtaaggaatggatgatgatatcgatatggatgttgattcatataatgatggcacttgggctctaaggagggaaataaggacctgataggggtagggatgtgaaaaggtggcagggtctgtgttggaagttcaagttgagtttaaagattgttaggggcaggcgcggtgactcacacctatattcccagctttttgggaggccaaagtgggtggatcacttgagcccaagagtttgagaccagcctgggcaacatggcaaagaccccatctctacaaaaaatatgaacattagctgagtgtggtggtatgtgcttctggtcccagctactcgggaggttaaggtgggaggcttgcttgagtcccagaggtagaagttgcagtgagctgagatcacacctctactttccagcttggatgacaaagtgagaccctgtctcaaaaaaaaaaaaaattgttggaactagagaattggaaaggggaattattggactgtgggggcttgatattgaggtcatggagggatggagttattggcaatgacagggtctgccatatgattgtcaagatcattggcagagaggtgtcaaggaactgaggtggttaccagagtactaaatggctccatcatctgtgtggaaatcgcagtcaccaagagagtgaggagctacatattcaaggaacgaagggaagtggccagggctggggtggtctgtaatgatcacaatgaggagggacctggggtggtttgagctgacagcatgggctttgaagctggggaggaagtgttggaaagagagaagaaggatcttccagaagaggctgcaagacacaaataggacagctagatgagggagaggaagcagccaggccttgagaggggcctggggaagctgtggcctcgaaggagagctggtttcagtaatattgagaaggggaaaggaacaatcagagaagaggttgaagacatgggggcttctgttgataactggctgtgagttatagtcttttgtttgttttgagacagggtctcatcctgtcacccaggctggagtgcagtggtgcaattacagctcactaaagcctagacctccccaggctcaggtgatccttccactgcagtctcccaagtagtggggaccacaggtgtgcaccaccatgcccaggttttttttgtattttgtagagacggggtttcaccatgttgcccaggctggtcttgaactcctgggctcaagcaatcctccttcctgggcctcccaaagtgttagaattagagacgtgggccaccacacctggccaaaagcctgcttctgctcttgctccctcacccctatcccagtgcgctccaagaagagtgattcatttaaaatccaaatcagattatgtcactccccagcttaataccctcccctggctttccatcttagaactcagtctgactcccttgctgccagggcctgcataccaggctttccgtgatctggcctttcaccacttctctgacctctcatgccattctctcctttgtttacttaaccccagacatcctgatttaagactatgctaagcatgttcctgccccagggcctttgcatgtgctgtttcctcagtctagtacattcttccccacatctttctatggcagactctttcttgacggtctggtcctagagcacacatctctctgcacctgcctacccagtcttcagtagcctccccttactcacagtgacattactgttttattttcttcatggcccatcactattaggaatgaccttacttctctacctctctttattgaaatgtgctcagaaaaacataagttaaatgaatgagataggctgagtgattggtcgactctgccaatagcaggttaagacttgtgccttaaatcttataagacattctgaagtcatggagcgatggcccttcacagccatgtcagaaaccacttggtttcagacagcctgggttctggcctacaatgaaatgaaactaagtctcatatctgtgactcatatgaagctcccagtaccattcaaaattaggaattctaaagggggatgttttcttataatggtagagcatcccactgtgtttattttaaatgtcatggatttatttagaaaaataatttattttctctgttgagaaggttgagttttcttgcatacatgtctagaaagtggaatggtggggagaggcaagaaaactatcttcacttccttttgatcagatgttaagaataggcatccagactgggcatggtggctcacgcctgtaatcccagcactttgggaggctgaggtaggtggatcacctgagatcaagagttcaacaccagcctggccaacatggtgaaaccctgtctctactaaaaatacaaaaattagccaggtgtggtggtgcatgcctgtaatcccagcaacacgggaggctgaggcagtagaatcacttgaacccaggagacggaggttgcagtgagccaagatccagcctgggtgacagagtgaaactccatctcaaaaaaaaaaagggaataggcatctagtataagtagataaaaagcaattagataaacaatgagctctaaaaagtctagtattttattgttggaacctcagatccaacctgtgctgaatttgtctgtgtgggtggaaagtgaatttttgcaggctgaatatcttgggtttggaagcagtttctcagtttctcccatattgcaaagcatagcacatgtgttcagttatggatttccacaaaactggcaatcccgaaccaatgaatgggtgaggttccaaaagttcatttgcaagtttgtttggcatgcagaatgcattttcccatagaaacaatgtcataaattaaggattgattcccaagccagcccataaaatccaaaattatttaatttcaacaaatatttattgaacacctagtgagagcctaatctggggcatgagatagctaggtagtattgagagaaatcggatgccattcttggctttaaggaactcgcatgctagctgggaaggcagacttatcaatggccaacattcattcattcaatcctacatccaatcacaaatattttttaagcacaacaatgtgctaagtcctatgctcagtgctcaggatacagttctttcttgtctctatagagcttgcaatctaatgggggatataatgtgtatcagttaggtttctgatctagtaatgctgtataacaaacaacccccaaatccttagtggtctaaaagagcaaacatttatttacatttgtttttcatgctcatgggtcagcctgtcagctatgggaagaagggtggggtcaatgtcaagctgaaggttgagttcaggtctgtttcccatgtttctcattctgtacatgctcttcttaaggcacatagaagtagcatgagagaccaagctaaactagacaacatgttctaagccctggctgacatcatgctgactaatattccattgataaagcaagctgcatggccaagcccaatatccatggagtagggaaatatattccacctactctagtggaagattctgcaaagtgacctggcaaaaatgtagtgtgggtgtgtcattctagtacaggatggattgaagaattgggagcaataatccactcttatcaataagtaaaggagataaatgaatagagtgtcataagagctagcatgggggaagtttagggtttcatgggggcacataaaattatctaacccaaacttaacaggtcaaggaaggcttcctggaggaagggatatctaatctgaacctgaagggtagggggatatcagctaggtaaagatgaggcaggggaagctggtgtagggaccaggctgtacaaaggccaggagagcttggcctgaagctcagtgtggacgagcttcacattaaagaatttgaattttgttggaaggaccttggggagccattgcagggctttaattaaaagtgcgaccagatcaggtgagtgttttagaacgagaactctggggtgcaaggtggaccggaggggactgagaagagctggcagatcagttagcaggtggctgtaaaccagtaagagaccagggactgaattagaatgatagtagtggtgagggaaggaagtgggtggattagagagctatttagaagatagaattgacagggcttagtgattaattagattcccctttgagtctgacacactaaaaatagggccataaaatgaaaaataaaatctcaaggtggccactgtttttctggaagatgtatcctttctcctttgatctcagtcttcatgaagaaaacaaacaagtgatacccacatgtacacttgattcttcctgtgtcccaggcactgggctaggcaccaggttagaccccaaaagatgggcacctgagtcaaatgtgggagggcttctgagagacaccagcgctgagtctcagagtgtgcagtggggtgagttattgcattgaagctggtgttgagattacagcggaaggagtgcaggcatctggctggggtgaccagatggacagaggtgtcggttactgagtagggagtgtagaaggagtggcctgtttgggctgcatgggaaacgcggggggtggacttccacactggcaacatgggcaggacagcctatgaggacagaggaaaggtcctgtgtttgtctgtttttgcactgctataatgaaatacctgagactgggtaatttataaagaaaagaggttagttggctcatggttctgctggctgtacaggaagcacgatactggcatctgctcagcttctggggaggcctcaggaaacttacaatcatggcagaaggtgaagggaaagcagggcacgtcttacatggctggaacaggaggaaaggggggttggggaggtgccacacacttttaaacaaccagatctcaagagaactcaccatcacgaaaacagcactgaggaaatggtgctaaaccattcatgaaggacccacccccatgatccaatcacctttcaccaggccccacctccaacactgaggattacaattgaacatgagatttgggtggagacacagatccaaacgatatcaggtcccaaatgcattttgctttggatagaatctgggctttgtgtgacctgccagtttcttatctctgccacttctcctcttctataaagtggcatttataattggccaggtattgcaaaaaagtgctgggattacaggcacataatcctgggattacaggcactttgggaggccgagttgggtgaatcacttgagcccaggagttcaagaccagcctgggcaacatggtgaaaccctgtctctacaaaaaatacaaaaattagctgggtgtggtggcgcatgcctgtggtcccagctactctggaggctgaggtggaaggatcatttgaacataggaggttgaggcttcagtgagccgtgattgtaccactgcactccagccttggtgacagaacgagaccttgtctcaataataatagtaatagtacctgcctcagaggtttgctgagagaattaaattccataacgtacatcattgtaggcccagtgcctggctcctggtaggcaacgaagttgtgtcaactgtcatttggtggaagcccaaggaggcagtcattacttgtccctgaggttgggaaaggcttcaacgaggaggtggccttaaaattggccttgaagcctgggtagaccttcaccaggggaagagtggtcgggaggcatttcaggcagaagaatcagcgcagtgagaggtctgtggagagactggcagatggagttctatgcactggctgtagaaggaaggaagtgggtggagatgctgggtgggctctcagggtggaccttactagcgggtgctgggaactcatgacagggttttaagcagaggccttccagcgccatatttgtgttttaaaaagattatcccactggcagtgtggaagatgaaccacgttaatccaagtctctcccggcctcccaccccacccttcctgggtcactttcctctggtgtgttttgtaaagagagagtttatgtcacatctcgtcctgagtcagttacttggtggctattctccgaattcatgtacctccccactgggagaggtagtacgtctcccagtgcatccatggggccccacttgctctggttttagtgccatgatggaatcagggctgggtcctcttcagaaaatgggccctacaggaaagagcacacttgcattcaccctcccaacacttcgtgctccaccctgcactgggtacacacaggtggaggcaaggcccccaggcatgctgcttataaggtatctgtatgcgtccttcaattatctgtacaaatttcacattcactccatatttttctacatgtttcttccatgttgacagttggaagaccttcaagcagcccctggtggctgtttttaggtcttcagctgcagttaggctgttccacgcatgagatcgtgaaagagatcatttctcgctcggtctaacagcagggccctgtggtcagtcttcctatcagactttctgaagggttgggaataacagaagggtatttttaacacatgagagaaaactgccatctgaatgctaaacatatttgtccccaacaccccagagtaacaaatgaaaagaattacatgagttgcttgtggacacgtcccagctcctttttttatcttgctctcctgtcttgagggttcttctccaagtgacactccttcctcaagccccccaggcctatcattaacctgctgggatccttcccaccaggactgtgattgccctgaaacttgaccagtataatccatggtgcacagtaatttatggccatattcttcagtagcctgagttagtctgttctgtcatcatgagaggtgagctacatacagcagagagggcccgatagggcttagatgttttgtctcctccaaatctcgtgttgaaatgtgacctccagtactggaggtgggcctgctgggaggggtcgggtcatgggaacggatccctcatgaatggcttggtgctgtccttggcaatagtgagcgagttctcactctgagttcacaggagatctggttgtttaagagagtgtggcacctgccccctcacagtcttgctcccaccctagccgtgtgacacacctgttctcccttcgcttccagcatgattggaagcttcctgagcccctcaccaggagcagacactacccatgcttcctgtacagcctgtaaaatcatgagccaattaaaccccttttctttataaattatccagtctcaggtatttcttcatagctatgcaaaaaatggactaacacagggtcacagaaggctttgcagtagaaaagtccagatggatgtgactgttcctcattcagaaggcggctgcagtgccccttccacagggagcctgcctcgagtccaggcctggccaggagacagtgtgcatgggtagagaagaatatgcttatcatacattagacactaccttgcacgttctgtgccatgttccatttagtcctcctggtaccccatgaagaaagcactattacaatccccacttcttagagaacagccttagcttatgtatagtttcccacagctgcagaaacaaattcccacaaacttggcagcttaaaacaacatgcacttgtgatcttacagttctggaggtcacaagcctgcagtgggtttcactgggctgaaaccaaagcattgacagggctgtgctccttctggaggcccttctttgccttttccagcttttggaagcagccagcattccttggctcatggtcccttcctgcatcttcaaaaccaacagtgtggcatcatcagattacattgggcccacccagataatccaaaataatctgcccattttaagatcctccacttactcacatctgcagagtcccctttgccatgtcctatggtttgaatgtatcccccaaagttcatgtattggacacttaatccccagtgcaacagttttgagaggtggaacctttcggacgtgattaggtcatgaggactctgtcctcatgaatggattaatgacattatcacaggagtgggttagttattgcaggagtgggttacttatcacaggagtaggttcctgataaaatgatacattaggcccctttctctctctctctctctctctctgtctctctctccctcgtgctttcttgcccttccaccatggaatgatgcagcaagaaggccctcaccagatgcaggccccttgaccctggactgcccagtctctagaactgtaaaaaataaatttattttctttataaatttcccagttagtagtattctgtaatagcaacacaaaatggactgagacaccatgtaaggtgacacagtcacacattccagggattaggacctggacatctttgggggccattattctgcctactactggttgtacaagtaatggattcaactctgggcttagctctagctcctaagccattagagcaaaacaaagagacacaggcaagggacattatccctcatggcagtgggtggagaggggagagcctggagcaaatggccctaatggagcatttgtgataactgctatgtataagaaagacacggcactcagggcccacctgagtcagagaaaaccctccatcttgaaagcttaggcaaccatgcattcatttaacaggtatttactgagtacctgatatgtgtcagtcactgtcctaagcactgggattctaagcactagcagtgagtaacacaggtcaaaatccctccacacgtatgttcattgcagcactattcacattagcaaagacatggaatcaacccaaatgcccatccatgatagactggataaagaaaatgtggtacatatgtgccatggaatgaaaaggaatgagcagccatgaaaaggaatgagatcatgtccttttggggatgtggatggagctggaagccattatcctcagcaaactaacgcaggaacagaaaaccaaataccgcatgttctcacttataggtgggaggtgaacaatgagaacacatggacacagggaggggacaacacacataggctcagctaatgcaagctgagcttaatacctagttgatgagttgataggtgcagcaaaccaccctggcacacatttgcctatgtaacaaacctacacatcctgcacatgtaccctggaacttaaaatgaaaataaaaattgaaaaaaaaatccctgccctcatggagttccctctagtgaggtgttttagtttcccaaggctgccataacaaattactaccaacacaaatttatcgtctcccagttctggaggccagaagtctgaaatcaaggtgtcagcagagccgggctccctctggaggctataggggcaaatccttcctcacctctcccagctccgggtgactcctggtgtttcttggcttggggtaggataaccatctctgccttggtcttcacatgaccttcttctgtgtgtccaaatctccctctcctttctcctagaaaattcccattcactgggacaccctaaatccaggatgatttcatctcgacgtccttaactctttacatctacaaagaccctatttctacataaggtcacgttctgaggttctgatgggcacgaatttgggggaacactctttaacgcacaacatgagggaagatggacagtgtgaaaataaatgaggaaagagagaacatgtcacagagtaaacagggctgtgaaggaaaataaagcagaaaaaggaaatggggagcgctagttggaggcagggggcgctaaatttaaacgggagccctggaaggcctcagtgagaaggggcatctgagccaagacccaaagggacccactcagttttggggctatccgccttcatgggctattgcactattgagtggaatggccgacaatttgagacagaagagccttcctcctttccttccaatccgggatgtgtccttgtgcagatctcaagcttgacgtctgtgcggtgacacttctttatggtccagtgaggctctaatgacagcaataatgataatggaattggggatggcccctccttctcgtgtgaggaccccattgtgccgactaattgtgtagaagcaagtaggacaactgtctgtggggtggaagcggtggggagcaaagaggaatatgtcctttgggcctcagggaattactgaattaccgttgtgtgggctgagtccatgcatctgggttactgtgaatgctggaagggatttggggggctttccaacaccagaaggggtctgggggtcaacctgtgtcctgtgggttctctacctcctttttcagctgtgagaggagctatgagttctatgtatttcaaagcagaaggcaaaggggatagcagtgctaaggggcacctctccacccttggtgtcccagacagttggcactgggaaagtgctcgccatgctcagaagccaggcttttttgtttgtttgtttgtttggttggttggtttttttagatggagtctcattctgttgtcaggctggagtgcaatggcacaatctcggctcactgcaacctccacctcccaggtccaaatgattcttctgcctcagcctcctgagaagctgggactgactacaggcgcgtgccaccatgctcgcctaatttttgtatttttagtagagatggggtttcaccatgttggccagtatggtctctatctcttgacctcgtgatccccctaccttggcctcccaaactgctgggattacaggcgtgagccaccatgcccagccaggtttgttttttgtttagtggagctagtaactgacgttctcggacctcagcctccgtgctacttacctgcaccatctctaatggatgctctctgacttccaacaagcaccattaagaacatcccttttagtaaatatatgttgtaatggaatagatttttttgaaatgaccttatctcaggcagcatgcactttcataagaatgtattgattggcctttaaatattcctcaaatgttttcacttgtctctgtgacctaatatttgtcctgttcccagcatctcctccatatccaaacacaatgttcaggtcttcattcgaagccttcctgccagtcttttgttttttgctttttaaacattttgatgcttttattctgctatatggagggtgcactgtttctgataggccaaatgtgggatttgatattgctttcaggaggatcgggttttaatatcattgccacctgtttagtggtggagaaactgaggcccacagaggctaaggaatgtggcccccagttacacagggagtatatgggagagcagctttgaacccagacccttctgactcaagaggtgtcattttcccatttttatttccatgctgctgtttttttaaatggctcccctaaattatttagttcatggtttgcatttggaaataaacaccaacttttagtacactcattgcccacaaaagaaccacatggagcaaaggccacaaacccattttgtgtgagtgtttcagtctgcaaatgtgttttttatgtgctaaatagctcaaagtttcaagacaaaggctgtttttccaccacgccagtgaacaggccaacctagtgaacaaaaatcaatgaaatgacttctgctggtatcactgaaacacagacaagaatttagccattttaaaatttccttgttaatccaattcagctaccttttgttgaatcccagccatgggccaagtcctgtactaggccctgggggaaacaaagatgaatgagggtctactctgatgaagttcacaggtgagtgtgggaataatttcaatacactgtgtaaaatgctctaatagctggtactcaaggtatgaaaggactccaaagaaccctttaatatttaggaggaaacagagctgtgattaagaatcccccaagaagcctcgaattgtgtctgcctccttacatagaaaaggcatgttgggcattgagctggtgtgtgagcaatgccaaagggcatctggtcaacctcattgcccaaatccctttctcatcactaccattttgtctttggcttatgtcatccatttttttgcctaaattttctgttccattttcccatataatataataataataatgaatatttattgaggcataattgtaaactcttagaacagatgtacatttttctcccaacttcatcaggtgaaaactattatttgcatttctgcagatggagagcctgaaacacagagagggcacatgtcttgcttgaggtcaccagcttgcaaatggcacaaccactatcctccttccttcactaagttctagccaagctggtctatttcatcagttccttgcagagaccatgctttaagtgcactcagatactttgcacatgctgttccttctgcctggactgctcttcccactacttttttttttttttttttttttttttttttttttttttgagacagagtcttgctctgtcacccaggctggagtgcagtggcatgatctcgactcactgcaggctctgcctccagttcaagcaattctcgtgcctcagcttcccgagtagctgggattacaggaatgcaccacctcgcccagctaattttttgtatttttattagagacagggtttcaccaggttggccaggatggtcttgagctcctggcctcaagtgatctggcctcccaaagtgctgggattacaggcataagccactagcactggcctcttcctactactcttgacccgactacatggttctcacccttgaatgcttagctgaaatgccatctttcttcactagcctgtctaaagtgggttcctttctactatatctttggtttctgcagaagacgtacctcaatttgaaattattttaaatgattgtctgtttatttggtttttgtctatgtgcttctctggactgtaagctcaataagagaaggaacttaactggcttatccatggaagtgtctgcagttcctagtggagtgtttggcatctgatgggctctcagttaatatttgtagaatgaatgccaggtatggtcttaggccctgagggtgcaaaggtgaataaggtgggcctttccctttgggggatttacagtgtagctggagagacaggcaggcaatcagcaactaatgcagtatgctgtgtagagtaggagcatgtgtaaatgtcatggagacacagaggagggagtgactgctttgcctggagtctgagcaaacatcatagaggaagacactgaaatagcccttgaacaaggaatgtgatttcaccaagtgttgcaggcccaggcacgttcagggcagtgaggatggcacacgctcgggagggcctggcctgtttgccctgtatgtgtttatcaaatgcctgctctccacgaggcactatggaatagataccagggatgggtgtttttaggagcttgcagtctagagagatagactcatcaaccaaacttacctggggatgagtttgaagaggaaggcaggggccagatcacagtgttggggtcagagatgggcatggaaacatgtattgcagactgaggtgctgaaaggcatgtagacaggagagtctggtatgggagaaagggtgtcatgagagatttttaagcagggagtaacatcatcagctctgtgcgtaagagtaacccagatgttgatgtggaggttgatgagaggaacaggaagtgggaagcgggagacctcatttggctgctgcaggaacccaggtgagaggtggggggtaagcatgggttgtagaggatgcttagaattcgtttgggtacaagagttacccaaactagccaaagtaggcacaaagttttgtaatttgatccgccgtgaggattattgctcattaaaccagaccaggtagtggttcccaacatgtgtgactagaatttctcatccctcagaacatccttcaacaaaaaagctggaagatggtacatcattcattcttgtctcagaaagttacaaagcacagtggcatctacaaggctctgagaagtcctgcagcagagagacttgtttaattttatttaactagtgtttcccaagcttcttggcaatagaaccctactttaatattaacaccaaaacaaatccaggaacacagtttgaaaaatgctgagaaattgagtaaaacttgtattttcctatatgttcatgtcttggaagaatctacttgctattatgctggcatttgtgatgtcgctgccctggaagccttcaaaatttttgagcaattaggtgtagtagtaagagatagatgccagtgccagacaccatgctaactaacctctctgcacctccgtttctcaacctctgacatggaggtggtaacaataacacctacttcatgggctggttgtgaggattactgtgttaattcccagaagtccccagaaacagtgcctggcctatgggcactaggaaggtgcgatggtttgaaaatgtcacctaaaaagcgtgtgttgggaatttaatccccaatgcaactctgttgaaaggtgggacctagtgagaggtgtttaggtcatgagggctctgcctttgtgaatggattaatgccaatcatagaagggcttcaggctgcaaattcagtctctttctcttgttcacatgcgcatgccctcgctctctcttgctcttccacctcctgccatgggatgattcagcaataaggccctcgccagatgcaggcccctcgaccttggactctccagcctccagaactgtaaaaaataaatttcttgtctttataaattacccagtctgtggtattctattatagcaacacaaaacagactaagacagatgggctcagtcactattagctattctgagaggcaatataggtagctgatgagaccacaggctttgaggctacactgcctgacttagtaggtcagctcctctgcttactatccctgtgaccttaggaaagcaatatggaaccagctatgcctcagtttcccacatctgtgaagcagggacaattattgcagctacttagaggtttgttgtgaataataaatgaatcaaatcatgtgaaaagacatcgcctggcatgttagatgtttttgcttaaaaaaaatcttttaattgtctctgttattagcataattttatcatgtagactgactttcagcttcagtgatgaagatccaatttttgagctttcccagcaagttattttggtcttatgttttggcattcccctcttaaagagtctggaggcctttcatttgaagtttagtttgtcacagacttcctattctcgtccattcagtagactttggtttcctcatctcatggactggcaattgtaaagaaagtcccccgattctggagaccacctcgcccctccactgggctctgtgccttccctaaaaatgcagacatctgtttcaaatcacttagcaaaagaccttgggttgctcttatagcaaagccctcccccagcatggatgcagtctcttgtttcctgggagagagagaagctggattgtttccttgttaaaagttttctgatattatatcagtgtagaatctttggaacagttcacactaacccccacattcaagccacttacctgatatgtagttatcagattccttcagggactgtctgctcttggtgaacaattagattagaggatgctgatgaaatttgagtggcaggaagtagaagttacatttctgagttcagagtttctatttcaaggttgagtaagtggtaaatttttactgcaagattctagcctaacagagttggcttctcaaggtcccccagcccggcccatgggtatttcacctgcttggaaacttcagctccttttcagaggtgggcctccctgttctttatgttggcatgaaaacaattaataatttaagccatgcccattaaaaaaatagaaatgctgtataaatacaatactgtaataataaatttaaaagtcgatccagctgggcgctgttcccacactaccagctgagcagaaacacaaataagtaaagaagaaaactgctatataatgcaaatggctgcaatctcattgttttctgctattgtttattgcaaatatatagtagtaaagttacattatggataagtaggttttgtgggctaacctggaaacctaatcactgtttataacattatttctatgggggaaaaatgcattttatattagaaacagatggtttgcaagaaaacctttttgggagtagaatggatttctaagtccagggccgcctgaaattttaacctcttgctagttgtgtggttgtgttgtattcacagctagtgatagaggaaaattagaggcctctcagaatgcccacttctgtgttctcccccaaatccttgctaaccgcttcatcctacagtctctgccttaccttctgtcttctctgtttctggggtccccatccctgtgtcctcatcctggcccagctccaccctgcaaccactggttgaggtcccaggaagccaggaggaactatgaatgtcctctattaagtggtggttaggatctataggaaggcatgaagccagggggccaagtttgtgggctctgaaatcagacttctgccacttggcagctatgtggccttgatatgttactgtacttctctgagcttctgtttcatccgtaaagagtgaggttgttgtgagaactaactgcaaacactcccatcagtgcctggcacacagtaatgtttcctccatgccagtctgtggtggggtaattattcagggatattatgggttacacatatttctatgaacccaggaagcaaacccactgtatataaagactttctaagttttcaaacagtgaacttagaaacaagtgtctgggaccttcctgtttatgacttggggccggagtaggtttggaactttttttttttttaaatctgttgggggtgagggagggggcggttacatacttatatagttgaatgccaatatcaaactctagtattatctcgaatacattaagctctacagcagattttatagcaaactaacaagaacagctttcttaaatagtttcattgactgaattgtttctacatacagtgtttttcacataagggaagtctttttaaattaactttttggtttgggggatttttttttttttccttcaggcaatcttttctttgcatttgggcaggttctgtattctaatttgcaaataggcttgtgtctgcctgcaggctttatcatgaaagtattagctctaagtggaaataaggactagaaaaataaaatactgactgggagtctgaggactttgggatagatcctcagtagaggatggagcaaaagtaatagtaagtcaagaaagcaaatatatctctaccagtttccctagaatatgtccattcttatccaaatccaattttcctcctattcttggcctgaagaaattgaaatgaagccattaagatatcagcctatctgagagtgcatcactgaagaatcagcctcactaagagtcctgtgtgacaatgagattttaatttaattagggcagtggctcaagtgtttatgcacttgaccgttgctcttgttgatacgcaggaattagagtgatagctttcaaaaggaattatttcagagtaactagctttgtttactaaaatatgggagctataagatctgctctgtaagaaatgtaaatgtatgagtaatatgctgtcatgaagattttataatctgcagtatttgagaagtaataagatactgttgttggctggccatctggttatacatacttggtgtcatggtttgctttttattttttcattttttatttgtactggtgagaggcaaagaataggagttcagaggtggtgggttgtttttttatatatatataaaaacaaggaatttatgtttagttgcttaacatggttagattttgtttttgccttatgcagaataaaaaatgaaaggttcattttatactttcttttccctttttttttcaaaaagtaaaatggaaacctcacccccaatttgtccccagatttaaactttttgcttgttttaaaaatagtctctttggcatgaggaggagtcagacatgaattaaaactctagaaagaaaaatcagcaacagaaaagacctatagagatttcatatttcatcctttcattcaaaaatatttattgaaaccctagtatttgcatatcatgctgccagacactgagggatttgctaaagaaatattaaagaccttctcccttctttgaggagcttagagcttacttggggagaactgagatagacttatgaaatagttaagttgtaattcgaggcagcatatgattaaataccgaaatatgtacttctgacaagaaatgctataggagttcagaaaagggagtgataactcagtggcactactgttttctgcctacaaattggcaaattgtagcactatttgtatgaaatattttacacttgtttttttggcagccttaggctttgactcccaggcagcattaagagccaacaaaaatatttgtactccagtctcttcggaattggcttatttttttttttcttataggcagaggaagtgccttacacaaaccggagtgcccatgagaggcagggagtttttgacagtcatgatctatttcagatacaaccgaaagaaccagcttcgtcattctgtttttcaatccagcagtgcttgtctctccgttgcaaactctctctgacattgacaggcggtttaatttgaacttaatgtctttgacggatgagctagccatcaagggtcagataaatttatggctttggagaattgccgatgaaaatccccatggttataatgttggagaagaaactgacacagatgtagtgggaggtggaacacagatgtgcttattgggagcagggttccccaaatgtcagaagccggtgacatgctaaaggtattgtgcttggggatgacgtttagtgaaactcactgacttcctgttctatttttgccatattcaaattaacacagagctcaaagatgaagccatgaggcctaaattcttaagaattgaaagagagagagagtagagaaaggagaaaaaataaaacctttaggaagccaaatacactgtttgggcccatccattcctcattccgctcggatcccctccgggactccccgtagctgaatgtggtcatcatttggttgcttttcaatctcatgattcatgtgttttcagtttcttttaaaaattcaccatcactggtttaccacccctgcattttaatcttcagccttgaggaggtgtagtactagaaatatttcgttctttccttgatgctattcaatggaatatctgtggagtccaacaccctttggcgataacgtgctgttggtatttgttcttcttgccaggttggtgccccgtctggtgaggcaagggttcccaagttagtgtgacctagagtgactgacacatcaagcaagccagtgatctcaccactcagcttctgagcatctctttatcaaagtagttggccctggccacagcttaagacttatctgggtcagcctctgagctggctgacttgggaaaatggccctggaaaaatgtttcacctatatcttttgatataatttggtatctgtctaaataaatggtatgtagcagatggttatggaatgtcttatcaaattcttaggcagactctgcccttgaaatttttctatttaattatcatactgcaaagcacaaaatagtaactttgttattatttttaaacaaaatcaagttacacaataggttgatattctgagaatgaatagcaaacctaaaatttatacaatatgtgaactcttccttgagctgttctttgctaggcatttctaaaagggagctccctatttcagaatccatgggaggatgtgtttcagatatatttggcgatgtcatcttgagagatggctcaggagtcgaagttcaccatgttgtctacatttgttctttgctcctagacatgatggaaaaaaatgctctgctgttttcttgttgcttttcatggttttagcatcatgttcctattctcgctcaaatcaataatccactgtacaaggtctggcattttgtactgaagccaagtataagaaagttttaactaatgcacgtatggggtcgctgttttaactaacacacgtatggggtcgctgttttgttgcctcgtttttttaggtgcacttttcaaggagattgtgtacattcagagaacttagaaaactggctggatatttcgtctggagcaaaaaagtgccctaaaattcagataattcgaagcagtaaagaaaaggtaagaggaaagattttaatttgtcctcgttgtattgtctcattttgcacagcggatgctaaatttcttctgtgtgtaaaatatccattagcaatcaaacatgcttagtgatagcactccattcatttagcactcattaacgaatattgagtgcccaccagatgccatccactctgcaaggtgctggggatacagcggtaaccaagtcacatcatgggcctgctctcatggagtttgtcgtcttgtggagctgaagatgaccctcaatggttgaactggaagaaaagttggacttctaatgttgtagaaatacatattgcttttgaaaataaagaaaaaagaggttcagattcatggtcaacgagataccttaaaggtggcttaattgcagaattttgtttagtgtaatggtcccttatcctaatgtgttgaggcttccccagtaaccatcttatgaacatagcttccaacagtcttggtagcgatggagagaagaccaacatgggcagtgaccattgcaagtgaggtcctttggaaagccagtggacccttgctatggcagcaccactcttgacaacacatcagtcctgtcattggatgagagaagggagcaaggagcatatttaagcattttcaaatgcacacgccaaccgtgccctacggaaaaagggaattcctgccttgcagtctcagtggtgctataaggaggcattttctccctaatgacggctcttgtgttatgaataattgtacagagtcctctgttatgaataactgtacagcagccagctgacctgtctgttgagctcactgtgttctgtttgaatgccatattaacaaggaaatgggccactttctcttttcccttacactttgccatttcagagaaatagcaagaactttaccacttacgatgatttaacatttaataaaggagagccaaagtatttaatgagtgataaataataaaataatcaagcttctaagttgtaactgatcagaacgaacagatttaaagttatttggctgttgtcactttctgttgtcttcctggagaaaaaaaataataataataactttcatacaaacttctaccagtcctgaatcagagtgaatagatttggtggaaaagattcttaggcatctaaacataggtatatccaaattctaatttctctcatcagtctgaaaaatagccaaatttggcgctaatagagaatagtagaaagtagaataccataatccttgaatatacccaggactctgataagtggttaaaattctggaagattttttttcttatgttatttataaaaatttaaggataatacttcagctaaatgtagtgggaggaagtagcttgttcattaaattaaaagtgctgcttatacaacttccgtacctagctaggggctcactattacaaattaatcactgtttatatctggtctggtacatttcaaaactgcttaccacccaaacgaccactggtgttttcttcctcgccctaagtcccactgtggtttaccctaatcttcccagagacttcccacacagccactgcctcactctctccagctcaccaccactctcaaagaagataagaagttcgtaatttgactaaagctatcctttgaaaccaacttcggactaattattttaatagtgttgataagccatctgattctatctcttgatcacattatttcaaaatatttcctaccctattgccacctttggcttacctgaaaatctcaggtctttgtttaaataaacctgaccctgacctatggagacggcagtctagggttgtgttcagttccacctattagctctattcaaaggctatttgctacctgcctatcatatgcctagtaacattctagtcactttgtaggcagagaaaaacctccatataataagaacctctgttcacagaagctttatttctttccacaaaacaattaaaagatagtacatcctcatactcactatgggatcagcattaaaaagaaataatcagagcaattccagttgtcctggagggatttctgtgaggttttgttgagtaaaaacagcaagatgcataaaagtgttcctagcatgatcttatattgatcaaaaaatgcccctgtatatgtttatgtatatatgtctctatatgattatttgagcatgggcaaaaatatagaagaattcaaacaaggttgtaaacatgggctcccctggtggaatgactgatgtggtggagaaggaaagcagagatatgtaataaaaatagaaaagacggccgggcgcggtggctcacgcctgtaatcccagcacgttgggaggccgaggcgggcggatcacgaggtcaggagatcgagaccaccccggctaaaacggtgaaaccccgtctctactaaaaatacaaaaaattagccgggcgtggtggcgggcgcctgtagtcccagctacttgggaggctgaggcaggagaatggcgtgaacccgggaggcggagcttgcagtgagccgagatcccgccactgctctccagcctgggcgacagagcgagactccgtctcaaaaaaaaaaaaaaaaaaaaaaaaatagaaaagacacagaaataaaattattattgttattatttattatactttaagttctagggtacatgtgcacaacgtgcagttttgttacataggtatacatgtgccatgttggtttgctgcacccatcagctcgtcatttacattaggtatttctcctaatgttatccctcccccagccccccaccccccggcaggccccggtgtgtgatgttccccgccctgtgaccaagtgatctcattgttcagttcccacctgtgagtgagaacatgtggtgtttggttttctgtctttgtgatagtttgctgagaatgatggtttccagtttcatccatgtccctgcaaaggacatgaactcatcttttttatggctgcatagtattccatggtgtataggtgccacattttcttttcttttcttttctttttttttttttttgagatggagtctcgctctgtcgcccaggctggagtgcagtggcacgatcttggctcactgcaagctccgcctcccaggttcatgccattctcctgcctcagcctcccaagtagctgggactacaggcgcccaccactacacccggctaattttttgtatttttagtagagatggggtttcaccgtgttggccaagatggtctcaatctcctgacctcgtgatctgcccgccttggcctcccaaagtgctgggattacaggcgtgagccaccgtgcccggcctacgtgccacatttccttaatccagtctatcatggatggacatttgggttggttccaagtctttgctatggtgaatagtgctgcaatatacttacatgtgcatgtgtctttatagtagcatgatttataatcctttgggtatatatccagtaatgggatttgctgggtcaaatgatatttctagttctagatccttgagggattgccacactgtcttccacaatggttgaactagtttacactcccaccaacagtgtaaaagtgttcctgtttctccacatcctcttcagcatctgttttttcctgactttttaatgatcgccattctaactggtgtgagatggtatctcattgtggttttgatttgcatttctttaatgaccagtgatgatgagcatttttgcttatgtctgttggctgcataaatgtcttcttttgagaagtgcctgttcatatcctttgcctactttttgatggggtcgtttgctttttcttgtaaatgtgtttgagttctttgtagattctggatattagccctttgtcagctgggtagattgcaaaaattttctcccgttctgtaggttgcctgttcactctgatggtagtttcttttgccgtgcagaagctctttagtttaattagatcccatttgtctgttttggcttttgttgccattgcttttggtgttttagacatgaagtctttgcccatgcctatgtcctgaatggtattgcctaggttttcttctagggtttttatggttttaggtctaacatttaagtctttaatccatcttgaattaattttttgtatcaggtgtaaggaagggatccagtttccgctttctacattttttttttttttttgagatggagtcttgctctgtcacccaggctggagtgcagtggcacgttctaggctcactgcaacctccacctcccaggttcaagcgattctcctgcctcagcctcccaaatagctaggattacaggcacatgccaccacgcccggctaattggaataaaagtattccttaaacaatatggttcctagaggagagacactagaaactttttttttttttttgacagggtctccctctgtcatctaggctggagtgcagagacgtgatcataatttactgcagcctcgaacccctgggctcaaaggatcctcccacctcagcctcccaagtagctgggactacaggtgtgaaccaccacacccagctaatttttaaaaattttttatagagataaggtctccctatgttgcccaggctggtctcaaacccctgggctcaagtgatcctcccacctcagcctctcaaagtgctggcattataggcataagtgaccatgcccatcctagaaacattcttttacaaatcagaactaaaacaaggaattccaccatcgctaatactgttgacattatttgtaaagccctgtccactgcagtaattcaagaaacaagtaatacaaattattatttgaattaaatataaaaaacattacttactcatcttaagtggctgcatatctgcagaatctaaatatgttagctttaaaaattattcaaatgaattaacgttaaatgaagtgctgaatgttcaataaatatttaaatatcaataaccttactacatgttaaataaaacaaacttttaacttcatgaataaaaagtcctattcataaaaacaacagaactactcagccataaacttaaagagcaaggtacatatcctgcattaaaaccatttttactaagagatatgtgttggagtcagctaccaaaaatagtaattttgctttgaacaacttagcttaagccgttctttgtaatagtagttagatagcagagcagtggtgtattaaggctattttttttttttgagacaaagtttcactcttgttgcccaggctggagtgctgtggcgcgatcatggttcactgcaacctctgcctcccgggttcaagcgattctcctgcctcagcctcccgagtagctgggattacaggtgcccaccaccaagcctggctaattttttatattttaagtagagacggagtttcaccatgttggccaggctggtcttgaactcctgaactcaggtgatctgcccgcctcggcctcccaaagtgctgggattacaggcgtgagccaccgtgcccagccttaaggctatttataatttatcatagcaaaaccttattaattaaaaacataagcataaagaaaaataaaaacaaaaatacaccaagtattttcttagaatatatggaaaacatcttgaacatattcaggcatgttctacatttcttggtgagaagatatcataaaaatgtcacttcttcctcacctatttttcttgatttcatgtaattccaatgatttttgagttagtgtttatttaaaattaatataaaattcatctggaatatcatgagctgatcaagaatatccaaaacatattttggaaaaaaaaaagaagtcaatttaggcaagaccactcccattagattgcaaacatagatgatagatagatagatagatagatagatagatagatatcaaaaataatttaatccatgattctggtttaaaaataggaatatagattcatagaatatagtggaaagctcagaaatagatgtaaaaattttaaagaacagatatcataaaataagaggaaacaaaaattatttcataaaatgtgtgagataactggcttatactatggaaacgtaatttcatattttacattaaatataaaaataaaatttagactaattaagaaattgatatgtaaagcaaagtcacagaagaaccaacagaaaatgaagttgaacataatttgaaagtatgatcatttattttacctctgaagcaatatagtatgtaataacaaaagaaaaatattcatatacatgatttccttttacaaaaaataagagttaacttggccaggcatggtggctcatgcctgtaatcccagcagtttggggactgaggcgggcagatcacctgaaggtcaggagtttgagaccagcctggccaacctggtgaaacactgtctctactacaaatacaaaaaaattagccaggcgtggtggcaggtgtctgtaatcccagctactcgggaggctgaggcaggagaatcgcttaaatctgggaggtgaaggttgcagtgaaccaagatcgtgccattgcgctctagcctggctgacaagagcaaaactgtgtctcaaaaaaaaaaaagagttaactaaagcacacacttcaggaaaatatttgccactaacaaaatattcatcataatgtaataacactaagaaaaattaaaaagaaaaacatcaatacaccaaaaagtaagtgggccaaaacacatatattctcacaagaggagattcagaaagtagatataaatatggaaatatgttcaacctcactagttttcaaataaatacaaattaaagcgataataagctatgctaacacccagtgttggtgatgccaattagcacaacctttttggaaagcaatttggcagcatgtttcaaaagtcataaatatattcattccgtttgaagcattaatttcagccttagaatcctgaggaaataacttgaaagaagaaaatccctaggcatgaagatgctcttgccgtagcatttatagaattagaaacctggaaataatgaaactgtttagcaataacgaatgattcagtaaaataagatatgtcgatctgataagagtgttgtgcagcaagcaattctttggccttgtgaatgttgcgggctaattgacaccccagctccctctgcatcccacctgccctttaagtcttcactccctctttatccagcttgattcacgaaaaagccatcagcctggtaaggagtcctatactgggtttcttaggacgaagcttcagctttttaactgtactcgcctggaccccaagttacgcaaaaataccttcacctcactggctcctctctccttccactgcacctgaaaaaaacatgctgtctcctcttttcaggtccactccaacctggtttctgccccagtgttcccctgaacctgttcttgctaaggtcactagtgaactccatgcagccattccagcggacactgtaaggtcctcatctaacttggctgttagccagcattcttgaaactgtcttttccattgctttccatggcacgcccactccatgctctcctccttctctgtggccaggcctcaattcccttgctgggccttgctggtcccttccctccctgtctctaaatattggagccatttaaggcccagttttggctcttcctctcttcttactctacatttcgtctgtagacaatcttattcacttccatggctttataaatcatctgtatgttcatgtctcctttatccccaccccagattgatcctctgagctccaggcccatacccaacttgacacatttgcttgagtatcacacaagtatcttgaactacatacacctaaagctgaagtcttgaatcttctacccatctgcctctccatcagtatgccccatctccatgtatggtacctccatccatcccatttgctcaccagcatcctccatatccacatcccccacttccagtcctgccccatgccacttctaaggggtaccttgactgcctcgttctttcccttttcattgtaccatcttagctcagtcatttcttgatgattccttgataccatgtgaccttccagttttattctggtggaatgttctatacttctactagtctataagctctttgagggcaaggaccatagctgtttggttcactggtatattcagtacattgtgcagcacttggcacatgttgcaagcttgatgaacatttatggaataaataaatggaataattatagttatgtaaaagctacatatgtgagaactagaaggaaatgtggaaactttaaaagagttggtgaaaatgtgatttttaaaaattctgatactcttgttataacgtttgagtgtgaattcaatttaagacatatatgtatacaagataagatgtgtggtgcggatataaatgctgcgttgaagattgagcatgaatgagagttcaggcatttgttgaagatgagttagtgggaatggtttgggatctttcactgtgctcagaattccctaaagataattgaactccagtccaggtgaagtggactgaaagaacttgccttcttccagcatgataatatggccagaactttttgaaaatgggaagataggggtgacctccggggactagattagacttagcaagcttatcaaagaaccagggagacagcagagtcttaggtggcagtgcctaagtctgggaggaagtgagaagtataacagaagacagagagctgccaggttgtctagactatggctcttcatagggggtgataaggttaccacttcctgcactcccaggttccttttacttagcgctcattcccatcagatcccatcatgcgcctgatgcaaaaggagtccactgttggcatgttaattcctataatttcccttctgaacaggacacctggctgccttgttcctttggaccatttccttgggaaaaagttactttggggacatttcaagattgtctttttgtgtccctactatacacacacacacacacacgtacaggcacacagatgtatccctgtacacatacaaacatacacacacaaaaacactccctccacccaattttgatcatatgtttgaccacaagcaaaaccttaactaattctaaagcacatttcacaggccaccttctttaatcattatctaacaatattagcaataaggaatagttgacaaatgtatcttcacacctaggatcatcaaggcacgctgtcttaaatgaaccccagatcaaagagaaacagatgaaaaaagtcatgtgtttggatgggaataattaatatcataaagacagaaatttttctaacattaaggcatatatttaatacaatttcatttagactcagtcccctcaacccctttggataaaatgaatatagatgaataatgctcaggaaatggtaagaaaattatgaaaatagagataaagcaggagagatttgccttatcagatgctaaatatatttaaaattacaggagtaaaaacttaatggcattggaatagaagtagatcaatagattattagagcagagcagagttcagaaatagattccagataaatggaaatttaatataggacaaaatgatatttcagttcagtgggaaaaggaggtttgtttttgtttaataaatggctgtgacataattgattaaccatctggataaagttggacccttatctcacactgtatataaaaataaattccagatggattaaagatataagcttaaaaaataaagcaataaagatgttggaacaattttatatttgtccataagctagagtttgggaagcactttatagccgagacaagaaaccctgtatttgattactcaaaagcacattgtgtaagggtaaaagatgccacaagcaaaagttacaagacaaacaatagattaggagaaaaatatgtgtcagaaatatgacagataaagattaatatctacaccatacagagagctcttgaaaattgataagaaaaatatacacacaaagcagaaaaatggtcaaagaataagaatatgctctttacagaagagcaaaccaaatagccaacaaaacatctattcttttatatttttatttatttatttatttatttatttatttatttatttatttatggaggcagtgtcttgctctgtcacccagaaacatctattctttacatcagctcttctgagaaattctccctcctgtggcaggtcaaagggtgagatcatatgaggctctatgatggatggaaatgaggcaaaaatcatcattttttccccatatcttccccgcacagactacagtgactatggtgggaagcttctctccaagacactcaaagtgcatggtgaagaatgtggactctagcagggagctctgccagaataaaagtcagcccaaccggacctgcacctgtagcatcccaaccagagcaacctacaaaggtatgtggattcttctgggttatttttgttataaaatcaaaaaaacaagggaacctcctgagtttagtttgcccaaggaatatgaatagttccccctctgtagactcactccctcactaccccctggttcccacttttgctctgggtcctcctcacctctggtttacctcattcatttactccaagaccccactatcagatatgcctggacaatgacaagagaagggcaagttggataggagagtgcagaaaagccagatagcactgggccgactacccaaatggtttagataattcagagatctgaaaagcaagaaatgccctgggtgagatgagaaattttaacaaccaatgttccatcagtttgagttcattgcattcatacatccatccaggaagtatttactgaacatctactatatgtgaggcactatgctaggtactagggatacagtgactcccccttgcccctaaaaaaaagactgtacactgggatagagagaagtaagtagctcattacaatgcagtgtgtaaatacagggaacatagagtaccatgagaagcacatgaaaaatgtaccttaccagacatggtggagggggaaggggtaaggaaagcttcctggaggaagtgatgtccagacaaggtgagggtagagttgagccagacaaagacgatggggatgggtatttcagacagagaccaacctgcatgatggccaggagacaaaaagctttatttgaagaaccagaagagcttctacatggccaaggcacatggggtaggggaaggtggaaaggggagacggagggaagatagataccaaaggaggcagccaggggaccatgaagggccttgtgaaccgtgaatcctgcgagctgtgatgaaacactgaaaggtttaagccggaggctggcagcacaatcagatttttattacagaaaggttccattgtgcattgtctgtctttcctgctggaatgtaagccccatggaggcagggacttggagaagacatcttcactgctgtgcttagaacagtatctggcacaacgtaggcattcacaatcaataaatgtttcttgaatgaatgaatggcttgaaggtggagaatggaccaaagaagggaaagactgaaagactgagttccaacagatcacttggaggggtccaagtgagagagaaagtgaaagcggaaagctactggagggtccaggtgagagggaaagtgagagctggaggagaagccaagggggatggagagaagtggattcaatagatggtcagtaggtacggtgggcagactgaggactcctgagtctcttcgaatgagaaagactagaagtagagttgagttcatggagtaggtctccaggactgagtgatgatcattaatggagctgagtgggttttatggtgagagctggagttacccaatatcttagtccattctggctgctataacaaaataccttagactggataatttataaacaatagaaatgtattgcttacagccctggtgactggggagtccaaggtcaaggctccagcagattcagtgtctggtaatggcttggcctctgacttcgcagatggtgccttgttgctgtattctcacatacagaaggggcaggggagctctcttaagcctcttctataaggacactaatcacattcatgagggtgcagccctcatgatttaatcacttcacaaaggccccgtggcttaatactatcacattgggtattagattccaacttatgaatttaggggagacataaatattctgaccatagcacccaattgatcctaaatccttcaaaaggcaatttaatgcaccaggccagagaagtgagcttaaaaatgctctcagccactgggtggtggctgtttgggtctgattgcttggaaaatcacctcaattttccactttactttgtccacactgtgcagcctttgtgatgcatttctggttaattttgttcattaaaacgcagaccttgctcacctataaaatatgcctctaaagtatttgagatcaccttgtaaagctagttggttgcttttagcgcctccatccgttgcacccaacccttcacctgccgttttctgaatatcttacatattctgaacgggcaaacaaatttgcttcccagcctcttgtactcagccagccggtgaccattgccaagcctttatccatggccttctttaaacctagaatggcttccccctttcacaaaatcctgtctccctttctgctttgaaacattggagaaaagtcacctcttccacatgcccttgccagattctgctctgactttctcagccattctaacacccctttggtcctccatgcacacccctatcttggcacccaggttaccagagggaactgaaaccactcatatggttgtttccttgactgtgctgtcatcacctaaattattttacctcttccagaataactgtaaatgctttcctagaagaaatcatgaatattcatttccttgtgatatttccaaatagagttttgtgcctatttggtgcttgaaaaaaagtatgacttttgcagtcttcatcaccggacacttatagattccactggagtgtattttcactgggagtccctctgagctgactgtccctgtgttcattctactcacatgtatcaagtgtctgttcagaggcttttgcagagaggtcatgccagccctccaagcctctttgtcttgagaacagaagatgatcatttcacacacaccctctgtacgtgaaccgaattttatgtggaattctgactttcagagggagtgttattgctgtggagaaggaccttaaagtaagggtttttagactttgggaaccacacactaataaaatttcaatgagaaaattagggttgccaacggagtcaagccagcttcttattttgtcaagacttagatttaaaaagcaccctctcggccaggcatggtggcacacgcctgtaatcccagcactttgggaggctgaggcgggcagatcacttgaggtcaggagttcaagaccagcctagccaacatggtgaaaccccgtctcaactaaaataaataaataaacaaacaaataaatagtaccacctcctattcctattaattcaccaaaggaaaaagatattaataccttgttattagcactggtccgtggacagaaggggatttgaaaggtgctattctgtgttgtggccccaaacctgggctctatacaattgttccatggggagcaatgcaaccacaggttcctgggtccaccccaggcttgctaaatcagaatatttaggggcatggccctgggatctatagctttgtaaatttctcaggtgattctgatagagaactgggtttgggaatcactaccttggatagagcatatatgtttaaagagatacaggaaatactacatttctctaatgctgatttagtagttttgaaatccttgttattttgttcttttggggttttctaaccaatgagtaggttttcaaaggcaaataagaaaacctttatcacagatttggtgacagttgaccccaagaagatcgtggaacccagcccatggaaactacactttagagtatgttaggtaaatatttgcagcgtggatttttctgaaggtgcaggatttctaatgctccggttttcatgttctaggcacttcttgctcggtgacttgttttgttcttatgccttggccaattaaaagctgagatagtgatccctaggagagtatgagatgtaaatgagctgtaaaatggcttcttcctagtgattattcatgggaggcttggaactcgaggtgggttcagtctgtttggaggcttgagctgtgcacttcggctgcctgatgcgaatggcctatggggaaggaaccacatactgattgaaatgttagcaaacagctggcacgctcctgcccactatgcagaggaagcaaaaatatttatctttttttgcatttacagctatgcttgactatagcaggactccaccgtaaatgacattttccccccttccctccagatgtttcagttgtcaacgtgatgttctccttcggttcttggaatttatcagacagattcaactttaccaactgctcatcattaaaagagtaagattttatttgaaatttgaatattctctcgttgatcttaatttacttatttgtttgactcctcgatttcctaaagaactcttttgtgagacagaactttccaaaatgccttttgaagcatggtgtaatgggagataggagagccaccgagctaataagctccgctcgcacattctagccctgactagtaagctggcgctgcgagggagagaaatcccctgtgcttaagtgttcatacccacagggaaatatgtcttcccaggaccgagaggcagccttgaagtaagtaaagaagaagggacaagccaggtgtggtggctcacatctggaatcccagcactttaggaggctgaggtgggcagatcgcttgagcccaggagagtttgagaccagcctgggcaatatagtgagacgccatcgctacaaaaaaacacaaaagttagccaagcatggtggtatgtgcctgtagtcccagctacttgggaggctgaggtgggaggatcacctgagcctaggagatggaggttgcagtgagccgggatggcgccccgcattccagtctgagtgacagagtgagattgtctcaacaaaaagaaggagcgctgctaggttctcttctgattggaatggcttcgggaatttgggcggaacgagaagccttgagtgtaggggtaaaaagtcttacttgagaaggacaaggtgaagtccctttcaccaaaagaacatgttcctgctgccccccttttcaccatctttggcctctttgagctacataggcccctgagttagtgccaaacctcactccttgcttctaaagcagcaagaggacagaggaaatatgtttctcagatgcctgacttgccaattggaagttgggatggaggcctgcagggcaccttgggaggctgcatgagtagcagtgctgtagatcactgcatagtttgattgaccagttatgtgagcaccaaatgggagtttcttttgtcctggcctgggaaccatggtttctatggggaaaatgaatttgaacttgaagctgagctaggaggctgctcttgaatgattagaacaggagcccctgggcctcatctcttccactgaggcactttgaaaaagatgacacaaggcccagttcaattattgctaagaaacagaatggatttaaggagaaaaaaatacaaaaattgctacagaaagcctcagaagttcatgaaaataggaaaaaagggtgtgaattaaatagaattatatagctcaaagacagttgaaagaacgtagctcccccgatgcccactttaaggccagatgaaaggaaccgactagccccaggtcccacaacttggtaattaagaaccagacctcagacctaggtcccccagggagggtgagcgccctttccataggtaactgcttcctgttaggaaagcacttagtacagtaatcacaccctgggggtagaagaagcgagcaaatcacaaacccgtgtctagctcacttaggtggccggatccacgcaaaagccagtgtgtcctctccttccacggaaactgcagtttctgtagatcagaatctcagaatgtttcctcatttcttggagaaggtataaaacaaactgggtcccccggccctgtgctagcaccccttgctagagctaaggcttcctctggcctcccttggccctgtttccagatcaaccctgatttccctttttaacattccttctcataagtgcttttcaagtcctccacagtttacccaatcatgataggtgatttgattagtagaaacacaattcttccttaatttgattataaagcaaacacaggcacctcgttgcctctgcttgccagctaacactttctgtctcacatcttccaggcagttggcagtgtgactgctggagtgagtgagggcttcctgattttggaaggcagagtgggtagaggcggggagagagagagatccatctccagagggacttacctgagggtagacaaatagcagaactggattcagaaacagattcattgggttcctattatctacagaccagcaggtgacccagcttcaggtttccatggcaacacccctgcaggtgccattccggcccatcaacctgagggcttccaagagcagggcacaaagcctcacaggaatgtctgtccagggatttttttttttttttgccttcttttaaatgcttgcatgccacatcacagagggaaattctaggatgtgaacattgtcctaaaacgcaggaattaagtcagttttctgtgttgctagatgcccagcatgcgtagaaactggctgcgcgtggtgtaaaagtgcaagaaggtgtatccaccccttcacagcttgcgacccttctgattatgagagaaaccaggtaaagtgacatttttggtattgtaagtcttaaccgccgggcatggtggctcacgcctgcaatcccagcattttgggaggtcgaggcgggtggatcaattgaggtcaggagttcgagaccagcctgaccaacatggcaaaaccctgcctctactaaaaatacaaagttagtggggtgtggtggcgcatgcctgtaatcccagctactcgggaggctgaggcaggagaatcacttgaacccgggaggcggaggttgcagtgagccgagatcgcgccactgcactcccagcctgggtgacagagtgagactccgtctcaaaaaaaaaaggtttaaccaaaaataaatgtttgtgactgcctggtcctaccttctcttttatgtttgttgcacactttgaatttaccacccatctggatgttgaagggatgttctccattccaggaacagtgtccagtggctgtcgagaagacatcaggaggaggaagacccaaggagaacaaggggaacagaaccaaccaggctttacaggtcagaccctatttttgtgtggttgaggggaaaacctgtctttgaatgaccatgaccacaactcatactactttgggttccttaaaaaaattctctattttactttctaccaaaattcccttttgtgtctttggttttttaaccaagtttcacttaattagcgcaatacatcaatggctggacactcacataaaataaattaaaactctgtaattatgaaaaatgatgttgctctggtcgaaataaaattgtaaaggtgactttgcggctcactggtgaagagctggaaggaagtttagcattccatctgagggatttcaacttgcactttatataattgcgtttctgggggttatgtgtgtggatgggggtctgtgcaaagtgtgcaaactaacctcgattccgttgttttttttcaactttgtagggacgtctaaccagtagtgaacactgctaaaccagaattgttatagaatgtgtatttctctcgccttctcacaagcagttattaatccatgaactttccttggaaatgcccgttattttcttcatagtaaattacataagcccccacgtcagtcatgtttgaaaagaggggacatgtcaacgtaaacatttctgggcggaacacatgtggctgtgcttacaacttcactcagtcaacaaaagttcattgagcatctatatgtggtaaaacacaaaaagaggataagtcctgccctcgctaaccttggagtctagcagaaatagacaaattaaaaatgacagctctggggagaaaagggctccattttccatttctctaatctgtggttttgacttctccacttgctgcttacctaaggtcaagtgcaaaggtaaataagtagcatattttgaatcattactgaaaagtttatagtaacttcaggtgaattaacaaccaggcagagggaatatgaatcaaatggatatgaagttaattaaaggcattagaaaagcttgatgctcaggtatctccagactttagcagtctctgaggtcttgttaagtaatgggctccttttctcatcccattggtttggaaaactaagacacagcgacaaggacttggatcaggaagacagtggctttgtggctttttctttttaattaaactttgttgttgttccagggtttgtttgtttgttttttcgttttgataaaatacacaaacaaaatttaccatttttattgcttttaagtgtacagttagttgaggtaagtacattcacatcattgcacaacctatctccagaactcttttcatcttgcaaaactgaaactctatgctcgttaaataataactcttcatctctccttccccccagcccttggaaaccgccattctaattttttgtctctatgaatttgactactctaggtacctcatgtaattgaatttgtctatttgtgctggcgtctttcacttagcatgatgtcctcaaggttcatctgtgtggtcgcatgggtcagaattcccttcttttctaaggttgactaatattccagtgtatgtatataccatattttgtttatccattcatccatggattaacgcttgggtcgcttccacattttagctatgatgaataatgctactaggaacgtgggtgtgctgctatttcttcgagaccctgctctcagttcttttcggtatatgcccagaagcagaattactggattgtattgtaattctctttttggttttttgaagaaccattgtaccgttttccatagcaacgataccattttgcattcccaccaacagtgcacaagggttccagtttcaccccatcctcaccaatacttgttattttcgattttgtttgatagtagccatcctaatatgggtcaggtggtatctcattgtggttttgatttgcatttccttgatgattaatgatgttgagcatctttgtgtatgcttgctggccatttgtatatcttctctggagaaatgtctaatcaagtcctttgcccatttttaaaattgggttatttttgttgttgttgagttgtaggagttctttatgtattctgggtatcaaccccctatcagatatatcatttgcaaatattttctaccattccataggtttccttttcattccgttgactgtgtcctgtaatacacagagtttttaattttgatgaagtccagttcatttattttttcttttattgcccatgcttttggtgtcagatccaataaatcattgccaaattcaatgtcatgaaactttctttctgcatttatttgtaaaggtctgtagcacttatattttggcctctgattcattctcagttcatttttatatatggcataagaaatgggtctaacttcattcttttgcatgtggatatccagttttcccaacatcatttgttgaaaaaaatgtcctttcccccattgaatggtcttggcaccctcgttgaaaatcatttcaccatatttgtgagagtgtatttctgggtgttcttttctattctattggtctatgcctgtctttatggcagtaacgcactgtttgattactgtagctttgtaaagtaaattttgaaatcaggaaatgtgaattcttcaactttgttcttctttttcaagattgttttagaaaataataaacttttaattttgagataattgtagattcacatgtacttgtgagacaataatacttaatatcttttacccagtttccttcaatagtactatcctgcaaaactatagcaaaacatcacagtcaggatattgacgttgacagcagtcaagacacagaacagctctatcatcacaaggctccccaggttgccctttcacagtcgcatccatttccctcctccctcccattctccatctctgatgcctggcaaccactgacctcagctccatttctataattttatcatttcaataattttatataaacggaatcatccagatgtaccctttgggggactggctcttttaactcaacataattctctggaaattcttccaagttcttttatgtatcaataattcattcctttttatcgctgagtcgtggtccaggcagcggctttttaaacttctttaattttaaagataaatatcataaagtcactacctcctggtttcctgcagtgtatctctctgcaccctttgaactgtgtggttaaaaggactggggtcaccacaagagaagaagaaggctgaaaataaacaaaagcccagatctgtttttagtgcttctctgtggattacccctctaagtgtggagaaagacattttgttgatactgacatgttttctttaaatatgtgactcagagcagaatctctcttttgtttgatagggaatggagtgttatttgtcacaggagggatttctcgtgctctgtcaaacactgctgtctttcattatcaggtggaatgtgtaacattctggtttccactttgggccttcatgttggccttgaacaaagcacccaatgtctttgtgattctgtttctaccagagaagtcactcacagctttgcttcaatgcatctgcccacaccacatatgtactgagtacttcctgtgtgctaggcactaggaatggagcaggtactgtcctaggcgtctaggatcctgaacttgagttgattctttctagaggcatttattgcacacctattagatgcaagtataccgacctccacagattccatgaggaggattcagatgaatcaggcacatctctggccatcagtctcaagaatcttatccatgagtacatgagtaaaaatacaagattttaaaaatattaatatgaaggtacaagaaagtacacagagagcctctctgtgcccggggctttgtcttagtccttcctgtttgcttaaacccagtgccttgaagttgaaaacacttaatcagtgtggttggttaagtctttgattgatggatggattgattgctggagatggcatttcagcccacctttgaggacgagaagcatccagacacatgaatgcgggtatttgaagcagaggaaccagcatatgcacagtgtaggggtaggagccagaagattccaggacacacgctagaggaaaccctaagtaggcacagaggatgcaggaaattatgagacacaaggttgaaatgaccctggagcctgcatatatagggcctcacataccagtcctgtgagtgctcgctttattcttcagtggcaatggaatgccattcaaggtatcttattttatttttttagtgtatgagtttgctaatccaaggatctggtacttatgaggtagggtcctggttcagtccctactaggccagtagccctcacactgtttcatgaccccaagacctactcctgtatcctgaccctgaaacgtatagcgtcatctgccaagggggctgagttacagaaaagtgtgaccacaatagagaaatgagctcaaaaatctatgtatgaccttggaggaggagtatttcaagctataaaggccagtgtctgaccgtctgtctgtttctttccacatatctagtagttgaaaccttgtcagggaccgttggcccttttaccctgccctgaccacttctccttccatttcttaacattctcatatctggtgccttcactcactgagaccagagatagttcccctctcttttgtgcattcaaggagagattgtgaagatttatgatatgatgtcattctaatatttgttattaccctcaatatgcttatcactatagggcagaaataaagcatacaaagtcatatcccctggcaatttacattcaaatggttctttctcttccttgcacctcctcttctcttcctccatcacttcttcccccctccgagatggagtttcactcttgttgcccagggtggagtgcagtggcacaatctcggctcactgcaacctctgcctccccagttcaagtgattctcctgccttggcctcccaagtagctgggattacaggcacccgccaccatgcccagctaattttttccaatttttagtagagacagggtttcaccatgttggccaggatggtctcgaactcctgacctcaagtgatctgcctgcttcagcctcccaaagtgctgggattacaggcatgagccaccgcacccggcccctccatcacttttgaatatgcatttttgatctctcacaggcaatccagatgaatgcttttggggaccttgccttcaagagtgaaattaaatttcacatataccttgctgagtagcttctatgggcctagcatagagccgggtactgtagaattaacttacaatcattcatttattcattcattcaaaatttgtttgctgagcaactactatgtgctagacaggcaggcaaagtgtgtgactgcatggagcttacatggtagaacttataatattttggaggaaataagattcattttcatgaagcagttgcatgtgcacaagagaaaaagatacaagagagaatgccagaatgtactcaaatgaacagtggtagctaagattcgctgagcctgtgccatgccctgagctcagagtatctaagcctcacaatggacctattttccccattttatagataaggaaattttagctcagagagagcaaatggtaggtaagaaatatgaatccaggcaatctgactcaacagagttttaaccattaccctacattgtatgccctaaattgaatataaacattggttaaaccatactactgatgatattaataaaagtcagtctggaaaggactctaatattggcttctcttggcattagactgtcaaagcctgcccccgatccatgccacacatgtagggtgggagcaagacctccaacctggccaggatgtgggaggagtgtattaacctcaaagacatgggagaaaggggtggggcagggtgtggtccgagggaaggagtcagacccagacacggctgggcatctgctccaagacagggagagcagaataggcttagtgaggcaactgaggccctggggagaggggagcagcaagaatctcatgcatgagtcgaatcttggccaaagggtggactttgaggggctgggtttaaattagaatcagggccctccactggctgggaagagctgccctccctggccctggagttttggtcacccagtccaggtctggggagccacactcagaaggctcaaatgccaagaggaatagcaggttgttcggagggtgggcttggcagccaagtcagcctccttttagagtctgcagctcagagaagtgagtcttgatctcttcgcacagggcattggtctgtcaccttctatctggaagtctcaagctctgtgtccagaggcactgctcactattggcatttccagggccaactgaaatcacatctcaagttccctggagcctgtaccgaggggcccccgtgaaaaggcatttgtcccaggggctaagcatcaaatggataaccattttgttccatttcacactctaatttttcttgagtggacctgtattttgctattttctttccatatctcacctccttttactctttcccatttccacggctggttaccactcttaccaatttatacatttcattaatatattagttctatcctcttctcagtcattaataaagatgttaaataatcctgaaccgaatactcactcctgtagggccctacaggactctttcctttaattagttgtgctacctttcatctatctaatgtccttcggtttcagatttccagctggttttgaatccatgtgactttttatctagtcctgtttgaactaatttcatgagtgaaaatccgagagatgttttactgagtgttgattcaggtccaggcctacagagagtttgctatattcagatttttttttaacagattaatagagtacaatttggccttaataaactgagccctcctaatgcacctctttccaatattcttttcaatcatagcagtattttctccattaatgtcatggtaatttgaattgtgttgacgtcagacttcacaaaaggtactcttactgtcagaagtaatcctcttagaccttttgaaagataactatttcttagtggttgtgctatttccaatatcctataatgacttagttaaaaataaaaaataaaaaggatcgggtattctataaatctcctaattaaccagcttctaatgtgctttcttatacaaaacagggactgaaagccagagctcatagtagtttattaaataagttcaaattgtgcagccatttaaaaataaccctgaagtctttaaaacgtaacctacaggaagcacactattctgaggttaattgctggacaacatagggctgtgacggttatagtcaacggtattttgatttgaatacatagaaatccttggacatagagtgagggaggaatcccacgatagggctctaagaatttgtctctttgtattgagctcaattatgttttacaattaactccctctaaaatgcataagcttatagggctggctactatatgccaggttttatgaattaactcttgatgaaaatacaaaaattgatctaaaatattgaatgtgtagaacctttatggggaaatgattctttgctcttttgtctgtactggatttttcaaaatctttattggtaaaaagaaagaatgtatttctaagaattgttgcaaccatacagggcagccatggagctgactctacattttgttttaaaaatgttgttttatacctgcactatttatttaggagggtcctcttggtagctctttaacccatttattaagattagaagaggttccaccagcaaacaaaagacaactaatctgagtctgtttaaaagcagactgaagcacccactttcacaagacaggccagggctggattccatcctagatggccaagagaaccctctctaaacaataggggtttaaaatgtttttgaagtagcaaggcggtctccactcagggaaataaaaagttaataagatgatgtggcaagtcctctgatggtgttcgtagagccatttaaggagcaaaatataacttccttaaaaaatcttttttacattagttgtaaggctctctttatcctctgcagagaatggagaagaagcatttacttggcatgtttgaaaattttgcttgagcagacatcaacagtataaatataagaagcaggaaggactatctagaaagaaaagaaacctgggaatcatagttgacttggatgtaaacgtgagtctgcaatgaggtttacataaaaaaagaaaaaaaattctatcttgctcccctaagaagacagtggactcctctagagcagaggtcggcaaatgttttctacaaagagccaagacagtaaatattttaggctttgcgggccgtatggtctctgctgcagctactccactcgactgctgcagtgcaacagcagccagagacactacccagacgaatatttatgggtgctgaaatttgaatttcatgtgtttttatatgtcatgaaatattattcttcttttgacattttgtcatggcccatacaaaagcaggtagcgggcaggatctggcccacagactatagtttgccaactcctgatctagtgcacacatagatcatgtgtcccccacaatatctggcctaaggaccctgtaggtgctcaataaacacttgttctcttagctgtcaccacgtaagagcgaagagtaagccttttgctatataacacacacttgacatttgcaagagatttatcttgaaggctttgctaatccccccattccaagtaccactctagcagataatttcccccataaaatgcagtcaagtataacagaataattaaagtgaccctttcaggcccttagtgattctattaatacagggctaacgtccttcacaaagtgattaaaataaattctgctaccaaaatcaattctgtgtcatgttacatcattgctgtgatgacattaacaatgaatttacctcaatctgcaaaaccagtccaaagcgctgatgagtgatggggacgactgtgccgtgtagcacctgtgtgtgctggggagcagaatgagaaaatgtctgtttgagcaggatgggcagcccctgtagcccagcaatgccaccccaatgagtgttccatgtacaaaggagcagaggatactcaattgcttcaagaagcaggtgttaggcaggtgttggacatcacggagttctcccagtggctcaggggcttcttcctggactcggtcctccaagtggatgcactcagcatttagaatttcaccaaacgtcatgtgattaagcatctctggactttggggtcattttcaaatatcaagactgagtatattctgcgatggtagaggatataggggaaaaaagagtgtgagtatgatgttcactcttgctgaagttctgctggactttatattgggtagaatcttagaatcttatgtcctgttttggtcaccgtattatagaagaatacagacttgctgaaaatggtctacaaaagaacagtgaaattatcagaatgatagacagtagcatctgtaacataaaagtgaaagaactcaggattgttttatcttgaaaagggaaaatgattcttgctatcaaataaagggctttttttttaaagggagaatttgattagatatcacaaatggagaagtaaggtggcattcacctatatggtatgaagctaggtagcaagggactccaagggacatgttcttgaccttaggcctgataaagtctattgaaactgggtagcaagaaggaggttgtggtatctacaaaccttggttggccacagtggtttagacatccaactacttgatagtaggtgactgaacaggttgatttcttgaggtttttccccctgcagtatcctcctggattcaaatagcctcactgtaacaaaaatatgactgctttcttgggaactgaatttatctggaatgacatttatttcaacttaacgatgagtctgtcattggcctacggtcaatggactctctttcttttccttgattttgcttacattgtgagcctccagaggctgtaaggcagtaaacattttcaaaactctagtgatacctcactcttcagacagaatatcagacttttcaactgtattttcaactgtcttgtgagacaaagactaattggtttgacctcatgctgtcacatgttgagagacatgaatctgcagccctcttccttgaattcattgatttcattaaacactgtctgcttgtgttcgcaaaatgttgtaatttcccagtgatttcttcgaactgcagcgtataaacagatttttttggagcgatgccatttcttagctttgatctcctgttttaatcttttctttccaataggtcttctacattaagtccattgagccacagaaagtatcgacattagggaaaagcaacgtgatagtaacgggagcaaactttacccgggcatcgaacatcacaatgatcctgaaaggaaccagtacctgtgataaggatgtgtgagtcgaaatactaataatttatcctcggtaacgtaacgctcaaacctgtgccaaaggaatatcagtgtgattataaccttaatatagtcaaattattgccatgccccaaagcaggccaattagtcagagtatttgacataatataattccaacacgtaaaataattttcacaacagatctgaagttcattgtgagagaatctgttctgtgttattccccaaaaatctcagtatatagtcatttcaggatgttgcctgtttggggtcttgattcattttcagtaacaaaatcaagtatatggagtagcaaacatcattctttaggtgatgcacttggaaaaatagttgagtaccttgaaatttgatgaggaattttttggagcagctcttccagtgtgccacccaaagttgaaaaaacaaaacctcttggatccattttatgtggacattttattctttgtagccttctctttactggtttggtttcagcctccaaaaattaaattactactacatataatggtagtaaaaaagaacaccccaacataaatatctggtcaatgtatctcttgaacattattatttctgtcacttctttcccaaactcatcacatcggtgaaacttggagaaagacttttcaatttctaccgatgtccttgtgcaaatggttactcccccttcgaaaaaaaaaaagtgatgtgataactgcagttattaaataacacaacagattatttgagttttctgcttgttaactcatataagtttgggctaatttgaagtaaaagatgttacagtctacatagagtataatactaagcttattttcatcatggaaatgcatttaagacaatctgctgaagcgtgatgttttgatttttaactactaaaacagatttgtacagcattctaatctgctatgcttatttactgaattttcttctttaattcattttctgcacatcactgccatgcccttcccctcatagcagtaaatttggaatatctgtgatcttgatgagaaaagctgctcattggtggcttgcctgtgttctgctatttgccagaattatcaagcacacattagaggctgtatctatgcaacataggtttttttgtgctgtttatcctggctaaataccttattgcaaaaatctttcattttatgtagcgaaatctgtgaagttagacacctgtgtattcactgaaaggcaatcaacttcatggaaaataagtagtttttcggagcattaccctgtttctgactctttatgttctcattttaattccgaatgtgtcttgagatactgcagttattaaattaaatgactaggagacctttctgcatgtcgcatttcagtaaccacatctgtgtggtgaagccaagttcacaagcagtcaacataatactcagttaatcctatacctgagcccaggctgtaatcccaagctcttttaatatggtacttttaaaatgggtaattattttaaagagaaaaatactagtagtggaatgacctacattttcacctctcttcttctgaaatttataaacaagtttgaattttaatgttcaaccactttatgataaatttcctagagctttgctctgaatataaacctgaaaatgtgcgtctgaggtggcgtaagtacaaactgactcagatgtttttgaatttgccttatcctaaagggttagtgatagcattaaagttaatcatcatgcacatggcctttaagtagtaataacagattctcatgtagcacggttatactgagcattattcagacacaacccaggcttaatgatttgtgctttagaggatcattgtagacacacagaggaagctgcaggtgacagcgggaatgtcggagaaagcttcgctctgactctgaaagggcgccaagcatcagctgttggacatcaggagcaccctggacagccccagctaagtcccagcctggatactccttagggagcatgttggccccaatgctgattgattctgagatgcctgggctcttggtttaggccccctttgaacagcagaatttccatctctgtctggtgctgtgttttaccctctcagtgcttgactagggctttttttcttaagctttttattatggaaactcaaacataatacaagagagatgagtgtaatgaacctctctgtagccattcccggtttcaaagcctatcaacattttgccaatcttgcttcatctatcttatctgggatttttgggggggcatgataagaaccaaacaccatatccttcactgctaaatacttcagtacctctctaacagataagccatagtgccattatgatactcaacagaattatccacaattcttaacataatgtaacccccagttcatgttctgctttctattagtacttcttcagggcaatggttacacctccttcctttcccacttctaagggcaatgcaaataagaaagataaaaatgtactaaagaaagaggaacccaacccctaataataccaacttgggtcactggcccctcatgagtcagtagttgcctgcagctgttctgctccttcatgaagtgttgtagttcaagtgaaattcatttgctgtcaccttgggtaatcaactgtgctaagtgtctgtgtcatgtgagagttctttttctactcttttctaggatacaggttagccatgtgctaaatgacacccacatgaaattctctcttccatcaagccggaaagaaatgaaggatgtgtgtatccagtttgatggtgggaactgctcttctgtgggatccttatcctacattgctctgccacattgttcccttatatttcctgctaccacctggatcaggtactttctagattcataatctttttctcattgtggttaaaggtcatatgcccaaagatcattgattttattcaagtaaattcagaaacagtggtcattccaaattcctctcaccgagttctccttaggatttactcctagaaaaatgcatacctgacaagacatttgcttcccatgctcatcgtgaatgctatgagcacacctttttcccttcaccatggctgctgagaaactcacagctgaaatgtttgcctaggtttttgatatagatatatgacactctttactatgtgtccctcctgcttgtgataaaaggcttctttcttacctctttcattttatagactttagatactttaagctgttttgaattctttgggggaaatattgggagctatcaaaatgaaaagcagaatcaaccttttcaagatgttccctaagggggagatggaaaccccaaaataaactctcccagataaatccaatatgttaagaaaaacatttatctccctagttgaatttttaaatttattactattatgtattttttgcattttcatgggtacataatacttgtacatgtttatgggacacgtgatgttttttctatgatcatacagtgaatatgtaatcatcaaatcagggtaattggagtatccatcacctcaagcacttatcatttctttctgttaggaacattccaattccactcttctagctatttttaaatatgcaataaattattgtgagttatagacaccctactatgctactgaacactagatcttattctatctcattgtatttttgtagccattaaccaaaccctctttatccctctctggccccgccacaccacccttcccagcctctgatacccataattctactctctatctccattagaccaactttctcagctcccacatatgggtgagaacctgcaatatttgtctttctgtgcctggcttatttcacttaacataatgtcctgcagttccatctgtgttgttgcaaatgacaggatctcattcttttttgtatgctgaataatactccattgtgtataggtaccacattttctttatcctctaatctgttgatggacacttaggttgagtccctatcttggttattgtgaagaatgctgtaataaagattcctcctagttgaatttaaattcactttcataatatttttattcctaaatctctttaggactaaaatcctaacgatattttctttgcctgacacagtacgaagctaattttcaaagtactctctaggtaaacctacagacaaaaagctttgttaaaaaaaaaaaagaagaagaagaagaagaaaaggaggggaagagaaagaggaaaaaaagtagagaagaaaaaaatcacttttaatattcttatttaagatcaagtgagaggtggctatattagtttgctagggtggacataaagtgccacagcgtttgtggcttaaacaacagaaatttctttctccccggttctggaggctgaaatcatggtgttggtaagattggtttctcctgaggcccttacaccttggcttgtagatggtcatcttctctctatgtcttcacgtggtcttccctctgtatctctgtcctaatctccccaattttttttttttttttttttttttttgtgacagtctcactctgtcacccaggctggagtgcagtggcgcaatcttggctcactgcaacctccgcctcccagattcaagtgattctcctgcctcagcctctctagtagctgggataatctcccctttttataaggacatcggtcatgttggattagggcccaccccaatgacttcgtttaaccttccttacctctttaaccacccacgtctctaaatacagtcccattctgaggcactgggagttagggcttcaacatacattttatggggacacattttttggggacacagttcagtccataatagtaagataaggagaactgaaatttcaaaaccaaggctctagcatgacatcccccactctaggaccaattccattctccatataaaaggagacattgatgtggcatgccccatgtgcctggtgtgttcatctattgactaggttaatcctcacaacaaatttatgagatctgctatggcttgtcccttttgcaaatgagggaactgggggaggaaaagggttcaaacaactcaccccagcctcccagacagctggtactaggaggttgggctctgagccacagcagtatcctgctttgctataaagtaagaggctccctactgttctgtcacctgcgacattctgagcctgtgtgtcttggctgctccttggtcactgtgccttgagcaagaatgtggctctaaatgctggccatcgggagatcacgcttggctcggttttctggtaatggctacagactggcatgaggccaactcagcccttccccattgtggctggaggattcagagatcagtgtcttctctctgccctacacaaattgggttgctcaggcccacctcctggtcttgtcatcaggggctcagctggctgttggacctgacgtacccaggctcttgtcccctagaatgagtgtctggtgacctacgtgaacaggggtgcaagggcagacagagctgtggacagctgtttctttcacacccagtgaccgctttgcttatatgcactgagaaacgtgaagttatttggcctggttttagagagatggaatgcagctgttatttatacggcgtaccaaataggaatttacactttgcatgtcatctgtaattctaccttgcccaaagtgtttcctgtctctctaaataacataccattggtaggttaggagtttgattttgaaaattcttagattgaagtctctttatatagattaaacagtaatcaaacaaaattctgtttagtgaaaccttttcaaggtacagctcctgatctgattatatgtggcgatatgacacaaacaaaattcaaattccatcaaagaatctgggcattttcctagaattaaaataggatctgacctgaatttttatatttatgcatcttgaaacccatgaatttgtggctggtatcctgaaaagattcccaaaattgtcctgtatttgaaattaaaattcattaatttgctctcaaacataattgggtttaatattaaacatgaataaattgatagctttgttcataaatgcaaaatgcctgtgtgttagctatgaaacccttattgttgcttttattccttgcagtggtggtcaaaatataaccatgatgggcagaaattttgatgtaattgacaacttaatcatttcacatgaattaaaaggaaacataaatgtaagtctccagctgctttgtaataatagttgttttcaaggatggttctattttcatcacactatgctatgttgggggtattttttgtttctgtgactttggtgttataaacttttacctatgctatcatatattctatccatgctagaatggaaataataagaccttatccttgtagctgagtatttctagttgcagcaatgaggaaagagaaatgaacttggtacgataagacctgacattttctttttatgtgatttgtggcaagtcaccctaatgaggcaatgcttatgaatatgtgtgaaaatgctccgtgaatggttaaggtgtgatataaagaattgcatttctgtgaagagtaggtggtattgttcccattgcacagagagagttgggttcacagaggttagatgacttgccaaggtcccagaaatcttgtcatgtgcttctccttctcttcgacccaatttgttccctaccatctgatgtcaccttctcttacctttcgtctccccacaggagaaatggtaggaggggtctggtttccacctttgcccgattctcccactggtgcctccagatggggatcctctagagcaggggtgtcaaccttttggcttcctgtggccacattggaagaagaattgtcttgggccacacataagatacaccaacactaacgatagctaatgagctaaaaaatggtttgtgcataatttccgtgatatccaccaccacagataagcaaaaaagtcctcacattcaaaaggctggacacggctgctctagatggaagcttctgatgccaagaggggagatgagggatttcacatacaagtcaggcctccaagtgtacttgcacacacttctaaatatccttccccattctttcttcccctttttccctctccttgatgagatatgtgaggtggctgcctctctggggccctgcctgaccacttcctgccaaggctgacacactccctcctcaggagcagtgtgggttcagacccaaattccgggggccgcctgataggccgtccttacagccttgtggtgcacacattcacctgctgacacagttcagagccacttccaagcctcacactgtatctgactccaggcctcatctccatggtgtgaacacctccagttgaatggctcgtatagtttgaccctctgagcagaggcattacctgagtttgtcacggacttgctctccctcctacttgctgttcccaaatcaagttgaattttttgagcacctactgcaggcaaaacattttgctgggtgcagggacaaaagataagtgagatagtcatattgccttcatggaggcaggcagcaaatctacattgggattgaaagttgaggctgggtgtggtggctcacgattataatcccagcactttgggaggccaaggcgggaagactgcttgaggccaggagttcgagaccagcctaggcaacatagtgagacccccatctctataaaataaaaattaaaaaagttgacagcacagagtatcatcaggttctaggtcctctggttccctaactgttcagaaaccctgtgagtccaagaagacaccatttcttttcacattaaagagaaattaaacatgcatgggattaagtacgcctgcagtatggagtggggtgggtggaagcagggaggtgagttcaggtacagaggacagagtcctcgcaggcccgtgctgggaacatcactcaatcctgcttagtgggaacctagagggtgggtctggaatgaccaagagcgatagctgtaaaactgagctggggccacaaaaagcagcgtcagactgaaaactttgcccttaattctgtaggcagcagggagccactgaagatctctgagcaggaagtgacataggtctaggtacactggactcacactggaccgagacaattagtgacaatgaaagcagtcagaaggttaccaatgggaaaagagactatgcagaaagcagtagactagggaaaggggaggattctgacccaaaaggcttcggtgtcctgtcttgagtcctgggaaaccacgagaaaagaagagagtgtccaacccccagcaggggccagctcctgaagtgcttgttgccgctgaatcactctttgttggggaacctcctgcagggcggttattattttggcaatggtgcacagctgagtttggagaggcaggaactgaagaaaggctgggagcccagtgaggatgctcatgccagtgcaggtgtgtctgagacgtccacagtctctctgggctgacagtagctccctttgggctgtggttagcagagcaggtctcaagtgctggggcatcgtgaagctagagatgaccagcttgtctttatagcagtatcgttgaagggagagtgggggtgacatcatgggagtgagagcacagaggaggaagaaaagagcacctaggactggtggcaaagcttcattttaaggaatgacagacagtaggatgggccgtgaaggtggccgagaaggtgctcagaaaccagtgaaaaagagtaaatcgcatggcgcgagtttgtcacgagtatggaactgtagagtcttgaggataatagggttgggtgatcctctcacctgcaatccttctagaaggcatcttcagtaaaaagccagcctgctaggagttaaggctgctgaggcagtagagacagtggttttcatcctgaggacagaaatgtgagcaggagattcagggctatagtttggaaagatgtgaagggaaaggaaggttgtgcttgtccaaatctcagctctttacatcatattttcccaccaattgcctcttcctattgtcttttttatgctctagtatcagggggtggcgggggtgggggaaaaatagtttttcccacctgataaatttctttttatgagttataattgcttttctgtagaatgtttgccatcctcccctaacccaccagcctcctctgcctgtccttctgtacacctaaacaggacaatatatttatgttatgtatttactaactttttaaattttattttttatatatatagagagagacagggtctcactgtgttacccaggctgatctccaactcccgggctcacgtaaccctcctccctccgtttcccacagcgctgggattacaggcgtgagccactacgcccagcctatttatgtgttgttgtttttttttaatcctgtaaatcaggccaccttttttgcattgttttcagttttcatgctcttcatttcatgggagatgcattgttccttttacttttgttttctcctgttttctgttatgcctgaaaacccttgtcctccttgtgtctagtgacttctgctaaggccctgcaggaggttcccccaacaaagggtgattcagctgcaacaagcgcttcaggagctggcccttgctgagagttggacacttttcttttctcgtggtttcccagggctcagacaggctgaccccaaggacacctaagccccttgggtcagaatcttcccctttccctagcctactgctttcagcctagtctcttttcccatggcataaccttccagctgctttcattgtcactcatgatattaatcataatattaactagcatgttttgagtgcttactgtgtgccgggccctgatctaagcatgtataatctcagttaacgtagccctcatttaatgtaatgtagggtgaagtcaatcctgtgagggaggtagttttgctgtctccatattacacatgagaaaacagaagcaccaagaagttaagttgctcaggtcacttagctcttagagatcacagctgggattcgttaacaaagttactaaaacattcttttctttttgtccaggtctctgaatattgtgtggcgacttactgcgggtttttagcccccagtttaaagagttcaaaagtgcgcacgaatgtcactgtgaagctgagagtacaagacacctacttggattgtggaaccctgcagtatcgggaggaccccagattcacggggtatcgggtggaatccgaggtggacacagaactggaagtgaaaattcaagtatgtttcttttctttctgggtgggatgtcaccccgaccccttgactggaaaggtgtgtttatgctcgtgagtttctacatgtgctctgatttctccatcttcattttgttctttacagaaagaaaatgacaacttcaacatttccaaaaaagacattgaaattactctcttccatggggaaaatgggcaattaaattgcagttttgaaaatattactagaaatcaagatcttaccaccatcctttgcaaaattaaaggcatcaagactgcaagcaccattgccaactcttctaagaaagttcgggtaagtgacctggcagtcccacctgctgtctttacctgatttttgtgataattccttggctaaaccagaggccagaatggaatctttcatggatcttcagatcctcactttaaatagaagataaacaaagctggtactgcgagcccaagcaaaatagctccaaaatagctggctgaatccatccctgtgcctgttcgaacgtcaaagcgttggacacaccattgtctataatcctaatgagtcttgatagcttttgttctagccacacatttatacagtaggatcggcaagcaaaatctctagacccattgacaaatgagctgtcactcttttctcaaatgcggaggtgacatgtcttagcagaaacccaaaacaaacaagggcctcttcagcacactctgggtagcattagaatcagatggagaccagataatctctgggtcatgggctgcttccttcaccatgaagtcatactttctgcgattaatcttttcccagatatgtttgggggacggatcactgctatatttatatcccataataaagatgtgagaccactgagaagggaaacacattagaagtcaccctttatagtattcatgccgtatgaggctctgtacagcctatataaattcttcttgatctatcatcataaataattggataaaagacaatgcaaaagaacttcagactggaaggcaacaacaaaaatgtgttcatgtcccactggcaccagttaatagctctgtggccttaggtaaatcacttgagtttcctgagcctctcttagtccatctgtatgataaatggggttaataataagttttatttgtttttttagacagagtctcactttgttacccaggcaggagtacagtggcacgatcttggcttacagcaacctccgcttcccagttttaagcaattctcatgcctcagtcacccaagtagctgggattacaggtgcgcaccaccacacctggctagttttttctatttttagtagagacggagtttcactgtgttgggctggctggtcccaaactccttgcctcaagtgatctgcctgcctcggcctcccaaagtgctggcattacaggtgtgagctaccgcgcccagccaatagtaagttttaagtcaggaataacaactaggctgggagagacaactcaagcctataatgccagcactttgggaagccaaagcaggaggatcacttgagcctctagaagtctgggcaacacagtaagaccctgtctcaaaaaaaaataaggaacaacaactcaactcaccagtgttcccacctttcctgttagttgagaagagcaaatgctaacattcttcatcattcatgacatagctcctgagagcctacgctgtgatggggacagacagagaataaaacagacaaaaacatctgcctttatggaggttccctaaagagacacagcgtgaagaatataaataaaaattgtgttacttggtggcagttgctatggagaaaaaaagcaccagtgtgggggggtgggggggtgggaacaggagcaggtaggggggccatgctgcaggttttgcaacggtgggcagaagaggcctgcttgtgaaagtgacatctgtataaggaggagtgggaacaagccatgggctatctggggtagaacgttctaggcagagggagcagagggagcagaggtcctgaggcaggaggctgcctggcatgtttgaagagcagcaaggaggccagtgtgactggagtggagggagcagagcagaggcttctgaggttagagagttcatggagacaacaggagatgattagaaccttgtggaccatggcaagggcttggcttgtgggctgcagaaggcatgggagagttttgaggagggcgccatgagctgacttattcagatgacgtcatgaatttagtcaggacagcctaccaagaggcactcccaacatcccatttcagagatgaggaaaaagaggactggatgtgcatacctaattcagggttccatagctgagaaacagagcaggtggcagagctggtatggagagcttcagctatccgggtccaaatccatcctccagctactgtgctcagatgcctccacgggggcagcatgagtccaaggatggaaacacgccttaatacttgtatgtacatcagtgaaataattaagcttcatgtagagtttttcccttgacaagtttcacaaaatataacccaaaaaaatgctaaaactggaaaaatccctcagggatgatctgatcagcactgccaatctggtttttgccacagaatgttttattcaaaataggatgccaggtacagtggctcacacctgtaatcccagcagtttgagaggctgaggtgggaggatcgcttgagttcaggagttcgagaccagactgggcaacatagtgagaccccgtctctacaaaaaatttaaaaattagccaggtgtggtggtgtgtaccgtagccccagctacttgggaggctgaggtgggaggatcacttgagcccatgatgagttcaaggctacagtgggctatgatcacaccactgcactccaacctgggcaacagagcaagactttgtctctaaaacaaaaacaaaataagcctgcctgtaaaaatgataaaaattgagtttcttccttagaataaagggcaggcaggggcttcttgcctacaggttactactgcctctttattgccctcactcctgcaacttaaaacccccagagcaaagagggccaaaattaagactctgagggtctagtccagcatgtgtcaactgacatttcaggaaactgaggcacagtgaatattctggatttgcccaaggacacatagctaatctgccacagaaatgagagttgaactcagatatcctacccagctcactgcttctttttgtattgtgaagccattttaggggggaaattatgtaaataaatacagtccccaactcaattgggtctaatgacattctttgtcccatcaggtcaagctgggaaacctggagctctacgtcgagcaggagtcagttccttccacatggtattttctgattgtgctccctgtcttgctagtgattgtcatttttggtaagtgccctgtttaattttgtcagagaaattattccctggggcctctcgccgggcaggcagactttcagctttcaggggctgtttgcttcaattaagtataaatgggtgaaagcccaaatcaaaactttgagaaacgaataataggtacacgctgagggctttctaaacatttcttttggccaggcgtggtggctgatgcctataatcccagcactttgggacactgaggcgggcggatcgccttgaggtcaggagttcaagaccagcctggccaacatggcaaaaccccgtctctactaaaaatacaaaaattagccgggcgtgatggcaggtgcctgtaatcccagctactcaggagactgaggtaggaagaattgcttgaacccgggaggcggaggttgcagtgagccgagatcacaccactgcactccagcctgggtgacagagcaagactccatctcaaaaacaaacaaacaaaaaacaaaatttttttttaaaggatgcttcattaatagaaggctggattacacagatggtatcttgggatttgagggatataatctactttgcttctccattccttcaaattgtggtgacaaatgttcatttatgtaattccccaagaacttctctgggattttgggctcccaggacttggttatttcatcttgaccaccccccaccacccatcaccccagcctcatttcagtcttgattttctgggcagaaccacactttagaagtgtggtcatgcctgggcacagtggcacacacctgtagttccaacactttgggaggccaaggagggaggacggcataagtccaggagtttgaggttacagtgagttatgatcgtgccactgcatgccagcctggacaacagaatgaggccctgtgtctaaaaagtaaatgattttttttaatagaagtgtgatctatgtcatctcttaaagtggtcccgggcccatccacacacagtgagcccatggtggttgctcattggccaaatctggtccaccaatatattttgttttgccgtgtagcattgtctaaaactattaagtagcttataacatttaaaaattagtgattcacatttggaaacgtctcttgaaaatgtgaaagatttggatcattggatcccaaatttccatagcatcagtttattagagctgagtagcagctacgccctagagagagggaatgtgctccctaggttttgaccacagtcgccaccactccatattgtctccacctaggccatttaactcatctatgtacctgatatctgtagccatttcgtttgtgactctggttctgagctgcttgtcatttgaagtctattttctctcatccttctttgaaaaaggaactcttatccaccaacaaatagcactttggctgggcccggtggctcatgcctgtaatcccagcactttgggaggctgaggcgggtggatcacgaggtcagcagatcgagaccatcctgaccaacatggtgaaaccctgtctctactaaaaatacaaaaattagctgagtgtggtggcacgtgcctgtaatcccagctactcaggaggctgaggcaggaaaatcatttgaacccgggagctggaggttgcagtgagccgagatcgtgccactgcactcccgcctggccacagaacaagactccgtctcagaaaaaaaaaaaaaaaaaaaaaaaaaaagcactttgtatttcctgatttaacataggtattgactttctgaaatttgacagctagtacaggcagttgccagtgtctccttctatacactcatttattcactcattcatccctgcatctatttaccttatgttcattgagcacctgttatgttgctgataactgtgcaagtctctggagctagaaaaaaatgagcctttgcgtgcatgagccagtgttgctcaaactgaggcctgaggaacagtggtcccaagtgactgtcctggaaaaaggggttccatggtcaagtaagtttgggaatcactacatcatactccaccctttcttagacatgcacaatgcatgttattaagactgttgactttatgaagtagtccagtgaagagccatatttgtttcctccagcattattggtagcagagcccgtctattatgtaatttcttttttttttttgagaaagggtctcacttttttgcccaggctgagtgcagtggcacgatcacggctcactgcagccttgacctcctgggctcaagtggtcctcccacctcggcctcccaagtagctgggactccaggcatgcaccatcgcacccatctaattttctatttttttgtagagacagaaaaatatctttctctgttgcccaggctgatctcaaacccctagcctcaaggcatgctcccacctcagcctctcaaagagctggaattacagacgtaagcccccgcacctggctgtaatttctataaggaggagaagcttcctagaataacagtggttgattgttgaatacctatacttttttaaacaatacattcttaatgctttttgtgagttacttcttataatcctcccagcatcacagtgagataggcactcttacagagaaggcagccaggcacagagatgctgaggaacttaacccaggtcacatagctagtaaatggcagagcaaggacatgaacccaagcaccaaactgggttggtttatggcctctgcagcacagttagaagcaatatggaggtatgggagttccttgtggctcgctcatcatgtcaccccattagctctatgcaggtttggcccatgtagccaactgtggatctgcggttcctttctacgtttgcagcacaactttatttctccagggatgcttacaaacattcaaaaacaatggaacaatgcaagtggctgcagctgtggggaagaaacttggcttgtttcattacgtttcagccaactgggatctttggttacaagtgaaggttatttgatttagctttcacttgtaaaatgagtaaggttttggtttttttctgctgcattttggcatcttcctcttcagagtgacccctcactgggaaattttcttataagatccagctttttaatgctattttctagtttcattctagctcctgctctctgtccctatctgttttgtttttgtttttgtttttaagaactgtaaagattgctatttgttttcatttttggtttttgagttaccatgtccctctgatgcagcatctctgtctcttagcggccgtgggggtgaccaggcacaaatcgaaggagctgagtcgcaaacagagtcaacaactagaattgctggaaagcgagctccggaaagagatacgtgacggtaggctccaaaattgtgtttgtagaaaaacaagccttttatatttatacttttatttttttacccttacatagagatggccacagtaatgagaactgtttgtataatagaaggcaacggaagggcagggcctgggcctggctttgtgttttatttcagctcttctctgcagccaaccaagtcattatctattgtttcttctttaatgaaaaccaaggtcatactctgtgttagacaaaacagcagaagatcctatccattgtttgttgagttaaaatattgctcttgggattctgttttgcaggctttgctgagctgcagatggataaattggatgtggttgatagttttggaactgttcccttccttgactacaaacattttgctctgagaactttcttccctgaggtaaaagagcattgatcatattccgaaggttgagtcttgaataataatgaaggtgcttgttgctgttgtcaaaacgagtgtttgcttccaaggcagctataatgtgcttggtacaaaaataatggcttaagtttgagcagagcagggaggagggtaattattaattgcattgattagggtataaaacagtgatgggtcactggtgattattctttgcccagtaacaaaaacctaggagggacagaagctcagagtgatgatttttgctttcttttactctcaatgtagaactgaatgtgtagctgggaagtgagctagtttatttaaaaatcaataaattgtgagctagccaatttgttgtgtttatctgcatgacttacattgcagtgactagattattcactattacttctcaattggaaaggaaaaatactactggtcaaaagggaggaaagtagacatggatggaattggagttgaaaacaggcatttttagccatgtagagttcttatggttctctttggtagtttttctttagctggtcagtttgtattgtcctcatttagtagacgtagatgcacgaactgattaattcatttgttctagggctctgaggagtcgtctacttaaccttttgggttgctggtcttacctatgttctcacgcctccattttctcacccactcactcagccttctccatttaccctcccaagtctttggcgaggtacactcatcctgcgtatcatcactgccatgtcctgataccccagctctgccatattgcccttcttttttgcggtatgatgaccacatagaggcccaacctcttaaacacatcaataccaatgatcacatttcaatctagacttctaagcaacggctgaaatctctccaggccaaaggagagtttgtatcaccttaccagaagcttctccggaacaattggccagaagcctagagttcagaaacccagacacatgcagtaagcaatttccagtttctctataatttagaagaggacaccatgatatgtaatgcggggtctggaggttggaatgcctccataaaacacctgccatattttttggtccaagccttagtgttataaatcaagaaggctgtaaataagacttcagctttttgtgctggtgaagtttgtttcctttaacttatcctccaagagtaccgaggcaccgagatctaccatttgccacctcatccatttctatggcagaacaccgcctggggaaaggaattcgattccccgaatcaggatgactgtgtggggcttctgcaaaggttgcatcacgagtcctatttctgagctatctgagatccccattaagaatttaaaagcaataaaataacggagatttttgactatcaacatgaatgctgtgtgggcttttacagttaatgattgcccttgagtgctgaataatctgtggcctgaaaaaagaaatgttcttatcttctaaatttggtaatcaagaacaagatagagtaatgaatgtaaaggaacactgttgcaagttgagtgtttccaaaaaaaaaaaaaaaaaaaagatcccaggaacaatgctaccttattttaggagaagagagatagttgcaaaggaggcaaactgatttaactcagtgttgtgtataatcttgaaaaacaactgggaaagtcataaaaattgaagtcagaagttgtttaaaggagagaacccaggaaaaaacatgcataaatttgtcagaaccctttcaagaagacctaagtcaaaactgattttataataattaagaaaagatagaacagggaaacagatcgtaagaagacaatgccacttaaatgcattccaggctgcagataagtcctggtattaattaggctctttatggattgatcagaagccgaatcctctaggcctggaggttgggggctgtgggggtaggatttgggtgttcagcacctacaaaaaagcaacaggcaaaatccagaggagattgtaggttctcaaaggaggccagggttctttgctctgcctgtcggttttggcttttaaagccttgctttttattttattgactcttctttgctttgcataaagtaggagaagaaataagggtaggcagaggatctaagctgaagaaaagggaaatttgaatgaaaggaggaagcagccttaaaactcagagagccacgggtccaggcgcggtggctcaagcctgtaatcccagcactttgggaggccgaggcgggtggatcacttgaggtcaggagttagggaccagcctggccaacatggtgaaaccccgtctgtactaaaaatacacaattagccaggcatggtggcgtgcacctgtaatcccagctactcgggaggctgaggcagagaattgcttgaacccgagatcaagaccatcctggctaacacagtgaaaccccgtctctactaaaaatacaaaaaaattagccaggcatggtggcgggcgcctgtagtcccagctactcgggaggctgaggcaggagaatggtgtgaacctgggaggcggagcttgcagtgagccgagatagcgccacactgcactccagcctgggcgacagagcgagactctgtctcaaaaaaaataataaataaataaaaagaattgcttgaacctgggaggcggaggttgcagtgagccgagatcacgccactgcactccagcctgggcgacagagggagattccgtctcaaaaaaaaataaagaattgcttgaacccgggaggcagaggttgccgtgagccgagatcgcgccactgcactcctgcccgggcgacagagcaagactccgtctcaaaaaaacaaaacaaacaaaaaaacacacagagagaaccagggcggcacttccgtatttacgattaagaatcaacctgtttctcctgtctatttacatgaagttggttcagcagaaaaatattaagaaccagaaaatgcaaacctagggtctgggggtttttttggtttgtttttttggggcttttttgctttttactaggggaggatatggccaaaatagtttcaggtcttttgcttgggcttgcagatttgaaactatgaagcaaaattctctacagaagaaatttacttcacaagatataaaattagctcaaagtttctattattatcaaaaaagaagaaaaacttgaatgttttgagtttagagtctcattctgtggacttaaagtattgcttaacatacttttaaagtttaaccattgatttttaataagattgatgatacactataaaccctttttatattccagagctacctagcatttagaaaccagtggggtgatagcattgtggtctagtttgctataaattaggaataaaaccagtaatgataactgacacagggcacttactctgcacccattttattttcacactaaacctctgaggtgggaaccattactgtccccatttcagagatgaggcaagtcagacacagagaggttaggtaacacatcccacgtcatgtgaccagtatgtgattaaaaccaggactggaacccaagtagtttggtccagattctatgcttttaactaccccctgtctttcaatatcattgtgtattgaaacagtagatgctacttaggtaagacttgtaaaacttaacaacgtaatttagtctttatctttagaaggtaaattgcttgaagaggggtctgatatttgcataatcttcatcaatgaccccttctttaactcttaaatcacttcttctaaaacgtgggatgataccttcatctaccaaacctggaactaatgccatgataattattattcttagaggctttcggaattcagtggcgtttcttgaaagctgaataattatttattatgtattagagaatacgcagccaccataaacccaggggcgcttcagattagcaaatagtgtctctactttattaaaacggacttgggtattataacaaaaatacactcttcatttcctttggatgttatgaataataaaagtgtctccttcctctcagtcaggtggcttcacccacatcttcactgaagatatgcatgtaagtctctacgttttcatttttagcccagtgactgcctgatgttcatagtgttatcatcatcactatcatctctattattattactttgaatttttattgtgggttttttttggatcatgaattcaatattgaataattcattgtcttggaaaacccattgtgggtctactttctaactttaaacttatatatgattttgtattatactatatatttttttctttttatcagaacagagacgccaacgacaagaatgaaagtctcacagctttggatgccctaatctgtaataaaagctttcttgttactgtcatccacacccttgaaaagcagaagaacttttctgtgaaggacaggtattagtccattctttgatgttttaaaagcctttaagaaaaaatcaggccgggcatggtggctcatggctgtaatcccagcattttgggaggccaaggcaggcaatcacttgaggccaggagttcaagaccagcctgaccaacacagcaaaaccttgtctctacaaaaaaaaaaaaaaagagagagaaatcaaacctgagtcccatattttatttccaaaccactatctgaacttggtatcttgagaacatgcacttttccaaaggctatttgattgggagtttatgcagccttctctccattttagatcataccaccccaacacaatttttttgttgttgttgttggagtctcactctgtggcccaggctgaagtgtgtgatcataggtcactgcagcctcatcctcctgggctcaagctaccctcctgcctcagcctccccaagtagctggaactacaggtgcatgccaccacacccagctaatgttttgttgttgttgtagtagagatggggtcttgctatattgcccaggctggtctcaaactcctgacctcaggtgatctgcctgctttagactcctaaagtgctgggattataggcgtgaaccaccatgcccggcccataaattcttaataaaaaaagcagaagtgttaatttttatttttaaaacatcccgaaactttggaagactcacatcttgttaccactctagtttaaatgctgaaaacacagaaaatgttctagagatagaagtggttagaatctaaacattaaaaaaaaaaaaaaaaaagctcccaacccaacaggccagctccctgccctgccagtgagcttccatggaaactcccatgggtgtccagctaggcctgcagccaatggttcacccagctctctttttcaacaggtgtctgtttgcctccttcctaaccattgcactgcaaaccaagctggtctacctgaccagcatcctagaggtgctgaccagggacttgatggaacagtgtagtaacatgcagccgaaactcatgctgagacgcacggagtccgtcgtcgaaaaactcctcacaaactggatgtccgtctgcctttctggatttctccgggtaagtgtcacatccctcagcaatgtcagaggtaagacaataggcagttatttttagcggactctgatgcctttgccaggataaatcctgaatgctcgatggtgtcagcacttaaccatgtttcgtcttggtcctgacccagaacagagagagggaaagtaaacattgtttttgctgcaactggcctatgcaaatgtaattcatttagaatttcgtcaggtgagacttttcaggtgagtttaccttctcacgtcaattcacacccagagcccagtcagcccatttaagaaaatgtactgagaaaagggaatatttcaaacaccagagaacaaactgtttcaggccctctgaagcattgtagaaatacccgttgcctaccaatatgctgtaagctaattgcagtcaattcctaccagtcattccgcattaaagcagctctccaaagagctgcctccccctggagtttgctttgttggagttactgtgtgcatgtggttgtcactaattgaactttaaaatcttttcaaatgcaaactttctatagattccagtggagaagagggtgggccctaaagtctgctacttgatctgaatctagacttcaccacttacttggttttataaactagagaattggaagaagattttaggactattttgaagtacagatgagaaaacataggcaattgcttagccctaaggaagcctccataaatgttggccgttacgattataaaatattaatgtgaaaataagggtgtcctgttgaactcgatcttcacccagccctctgaggcccctggtacagaagattcttatcctttaattttaccagccatccagatttcagcaaaactgcataattgtgtatttgtagctagttccgaaatctaattaaactttgaataagatacactgctatgccacaggttttaacagtgctacttaagtttagatccaacagcagtgctttaaatagactgtgcttagtttaatgtttaatgcaatcttacaagtagatgcacaacaattttttttttaatttctcaccaacccctccctctccctaaggcaatacccatttattaagattaatgaaatctgccttcttttctgtttacttggtataaatcatcggaggctttggggagatgttgagccagttatttctgggacgaatatttttttgtttcccactgtctttgctttagccacaacagctgctagatggaggcaccaggactctcacccagttccctggtcttggtcttcaaaggccaactcctgccccaccacagtctcactggatcagaagctccggaagtggagcccagtaatccatgattttcacaagtccctgggatagtagagagagcaccacactaggggtcttggttagaagcagcaggtctgggctctggaaccatctcagccccggtcagctgtgtgtccctgggcatggctttttccatctgggcatctgttttcaatccaccaaatgacaggcgtgtgtgggcgttgcctttaaatccctttccagctctttctactggatcttgtgattcttaactctgagctttcaagggctgctcttgggcattagaggggtgagatgttcagaaaatctgggctgcgagcccaaacagcctccttgagcaaagcattctgggtcaagacttcacagtgctgattcaagagcgtctcgagcactctgagtggtgagggggcggctcggctcgccaggaggaagtggcatccagccagtcggcgatactttcactttcagtggaataattcccgctggtgcaggggtctgatgtccctccaccaggtgctcaagggggtctgggacaccgacagccctagtcctcctgtcctaccccacagacgtttagtgggtgacagtagctccgtgaccgccaggtaactttcccttccaagacaccaaggatttgtgggtaaaataataataccatttattgaatgtgccagacagcatgctaagagctttacctatcttttctcatttcatccccttaagggtcctgtgagctaagtgtcttcatgaccattttgtatatgggggaactggaacacagaagagctgtgactctccccagatctcactgctactgtgggacagcaccagggtccgagagctcttagccaccgccctgtgccctgaaaagatggaatctgccctggtctgttaaagtgtcgaagcctggcccctgggggaggggaatcacgtacgcagcggctgtggctcgcctaaaagttgtgtttagtggtgacagagaaacctcatggccctgtgattccccaaatcagccacacatcagaatcctcctcccccaccgcctccccgcccccggccccgggaaggtaatgaaaactacagatacccaggcctcattcttcagagagatggcagctctgtaggtctagagtggagctcaggcatctgaatgcttaacaagagcccgcaagggattctggtgattagccagggttagacccaggagcatgggcagagtgtagggccagatgttacttagctcagtctagctactctccagaaagttctggagaattcctgaccacaggcctcctgagtcaagacctgtcccttcacacagcccccgagagcccacctggccccctgactccaacccctgcgggagtacacagcccctatccaagggttctcagcctcccttctgatctgtgctggaggaaaagaggttctaagttttgtggtcagggcattacttggggtgggggaggtgggcggtggagggaaagagaagagaagggtgaggttgtaaaccactaaataaaggaagtttctcatgagaattaaatgtcatgcactagtcctgctgccctccctaccttggaaatttctgaacttccacttctgccctgcactgaagaggagactcaaggaggtatcacagcagggatagaagctgcagggtggcaggaggtggcaagaggaagcccggggactggggagggcagatattcctgcagcaagtataaaggaagggacagggttggggtgggatgctgagagacttaagatgtcttaggtaacttgcctgcgcaagggaaagcaggtgagacccagtggaatcctcctttcccagctggacgtatcgcttgtcaagcttgactcttaactggcgcttcgagccccagccacgtggctggcctttcgtcatcactaaggcactttgacttcccagccacggttcttcctccaccacagaggcctaatgtccattgattacggaaggttcgttatttagcaaatactctacagctgacccagggctaagtgccttgggaggatgccgtggaaacagaacacaccgcctcccacttgaggtgctcagagtcctttggaatgcagacatccgtgtctgcgaatgtgagccatttccatcacagcaggggaggcagccccacccccagccaggaaaaatgcatgtggcttaaatttgtagaaagagccaatcgggatgggccgagtgtttggagaaaaaccttagaggaaatggaattggctctggttcagggaagaagatggagtccctctggcccagcaccggaaaacatgtccaggtgggactgtgcagtgtgtgtctgggaactgcccgggccgggcctggcctggcccatggagaggagataaggctgcaaactgttgaacggcaggctgcttccttcgagaagtgctgttaacaccaaaaaacattgtatttggcaaatgtataaaatgttcttacatttatccttgttactaaggatacttgtgcatttttttaaatgtcgtttatttctggcttgctaaagggtgattaaatacgaatgtaaacaaaggtacactctccacatctaactgttcctaggcattaacccactgatgagcattagtctgccatatgtaagtttaaacataaaataacaaggtatactgtgggtactgcacgtcgctgtgaatgtgcacgcgtgcgcgtgtgcagatgtgcattcgcgatggagagaggaggcggttttctgagttttgcatccaatcccaagtggagcaacgtgtattttcttgggcgtttcatgttgagtgttagaaaaccctgtctcctgccttactgctgtaaacagaaactttaattctttggaaagtacagtggattccacagaaagctaactgtcacttttgtgtcttttccaaggagactgtcggagagcccttctatttgctggtgacgactctgaaccagaaaattaacaagggtcccgtggatgtaatcacttgcaaagccctgtacacacttaatgaagactggctgttgtggcaggttccggaattcagtactgtggtatgttttcaataaagctcccagccagactcccaaataaatctggcggggaattagagggtgaggtgggtcatttacaatgaaacggtatcatctctactgcgggaggccctgtgtgtttagttaattaaaaacagtagttgataaaactgttaacacgtgttcacataatagattttaattactgagattgggggagaaaatattgtaatgatgcctggggtactcatcaatttccaaagattttaatatcaggattgcttataactttcagtgtcgtcaaaggaaatgcaaagtactccctattcagcacttataattgcaatcagaatttctcaaatggctctgctctgggaagacaatgtgtgaagatatatttcaatcaaattgaggccgtcttattttagaatgataacacaagacaaattccaccacgttccccatgcaacgtgacgccctttattttcatggattagttacaaatgtttggtgtcatgcacttaatgtactgtgatctcatagatatttttagaggaacgctgtaaatcactacaggaagatgattgcctagctgctggagggtttcacccgcttgagaacttctttctaattcatccccaccgcacccaccccatgctcttcctaaagaaagaaagaaagcccagtttggggcacatttgggaatttcagagagggagccaagcagggaaggtaactttagaattaggaattttctatgcttttctgttagtagagacttggagaagagattgctgtgttttggtttgatctttagctttatgaagattctgggcttcttcacgatctcgttagtggaggaggaaaagattacagtggggtttgggaattgctcattaagagagctgagtcttctgtggctttgctctggatggtggggactgcagtgtcatctgggaagaattcattccctaattggagaaggcaccactttgccgtggagcgtgttatggttatgtcctctggtgggagaatagtccgtaggtcagctgtttcaagttttctgccactgccagatgcggctcacttctccatcaaagatggcaccatgcacagctgccatccgagagcgggaagctgagctgaaagtcaacacttctcagcgttctgaattgtatcaatacacccatccacatctgagaggccggagagtgggctgcattggttctcaaacttgagcatctagcagaatcgcccagaaagctcactaaacaccagtcgctaggcagcatgctggagtttccgatgcagtaaatccaggctgtggcctgagaattcacttccctaaccagcttcctgatgctgcgggtgctgcttaacaactgttggtagagtggttaacagcatggactctggggccagacattttggaatcctgcctctgccactggttagctgtgtaatgttgggcaagtttctaaacctctctatgcctcattctcctcacatgtgaaatggaaatgatggtcatggttcctacccatctcatgaggtgttttgaggattaagagtcagtattataaaaagcacttagaacattgccaggcatgtgagtgctacctaaaactttattccatttgatccagatctcattgaacccttgtttaaaatgcaggtgcaaatataccagtgcccgggctttccctcgggactgactgaatcagaatctctggggagggagcccaggcgtggatgtattttgtaaaccttccagatatctctgatgtgtgttcagcctggacaccactgggtatcttggagaacaagagacaaactttgcacagggcctgttgactcacctttcgctgatcctgggcttgttattcctaacctagaagatgttcatgcctttactttaagacgttttagaagccccaaaggtctccaaagagaaatatttgcaaatgattatagtcgggaatcctccagcatttcagtcatgagacaacaccggacccaaacaggaaagacaggaaaggagaagatgggttggaatcaggaagaggtcagatgtctgaggcaacttttgaggttttgaagcctttttaatgctttacatctgaacgtgttttctccctttcatttcgaaacattatttatttcacagtcaattaagaccatgtgtttctgatttgttaacactcgactcatcatcataatgttacttgatgctgaaggaattcatgtcgactcttgaaatttttttttctttatagcccctggggaaaagggtaatggaaaatcatgatttcagaaatccacataaatcttccttttcaaattcagatttgccggtacataagatttgagccttgaaaaggaatgggccacttgtttttaggggccttgcctttaaaaatgattgttagtgcctcttatggggcctggcccagcccccctttcatggttggcagttgtacgagaagctgcagagaaggcacatgatccgttctatgcttgtgtgacaaactgttagcagaaggtcaatataaaaaatttaagtttttcatttcctttcaggcatttcccccagcctgaaccaccatatttctaattttctttcttcctcccttccctcctccccttctttttcacttcccccacctacccctcccaagcatgtacacccagccattttaggacttgatttcccaaatttgcctgaggtggtttatgtaattgaaaaccaaggtgcggtgaacaaactgattctgtgtgtccttgtgtgctggggaggtgggaggttgggggcagattctttcaaggaaaggaaagtcggaaatcaagagcatcctcacgaaccacttgaaatgacagaacctggtgccaaggcagggacacgtttggaaaaaaggcccccacactcgtgttcagctaaatgctcagaagcacagcacctcatatagcaatctaaaagttagctttcacacctctcagatgaggatgtgttctccctgaggtgtgggggattttctagaacataaaggcatcttgccaatttcttatacatgaaatcatgacactaacaaagaggccctgggaagtaatgttctcttcttgcatattgagaagaaaattcctctgtcttgccaaaaatccaagcaaagtcccctagagccatacttcctccaggaccataagaaaccatccttctctatcaagcattccaggctggtgtttaatgaggcaacagtgagacagaatgccctgatatctgcatcctccctaatgtcagcaccaggggtagggctgtgcacacacaggactttagtctttccttaatatctaggaattcagatcagacagctggaagagaataagaccttttttttttttttttttttttttaatttaaggaataccactctagtgcaggctggagtgcagtggcgcagtcttggctcactgcaacctccgcctctggggttcaagcgattctcctgcctcagcctcccaaatacctgggattataggcacctgccatcatgccaggctaatgcttgtatttttagtagaaacgggttttcgccgtgttggctagcctggtcttgaactcctggcctcaagtgatccacctgccttgtcctcccgaagtgctgggattacaggtgtgagcaactgcatccggccgataataagacctattgctctgctgggtttttttcccctttgcaaaattttgaacatgtttgattttgttgatggagtatctcagactcactcagcttacgttttgtcaagagtggaactttggaggagttagtgaaagtttgaggatttcacatgggagaagggacatttgcttcactttcaggaagagatgagaaaaaccaataactcgtagcaagcgtgctgaattagcaagagaaggttgacttgtaatcaaagttaagtgtgaaatggttttttgaactcttagaaaacgagcttgccaatctgctgtatctgagagagagcatcttggcaccctggaaaactgttccgacaaaaatattattgccttcattctcctatctataagaaagttttcaagattattagaaattcttgaaaaagcacaagtacatgcctgcagaaatattaatgcctccaatttgatttattgaaggtttatgccagcctaccccagtctgtctctttctctagcagttaccattttgggacaattacgtttaataaaatatctcatatacaacagagccctaggtgtctccaccaggagtttcttactagtatacttcctttaacagtgctctgcctaccagtgctggctgcttctgttccatttagtttgtccttgcagaagatccattagccccgtaattaaacaacccactgtcccgattaagtcattctctgttacttcaattacattccattgttcattaaatcctgatgtttgcacttcagcaatcttgtttttaatactcctaccatttgtggagaaacagtgaagttaattaacaattcttgagctttttatttttctctctaccatagtgcaaatcatttccattatgacttgcaatagtactgaaaccattactaacttcatagttagtgttctgagcttcctgatcaaagagtgaaaccactttttacaatcattttaggtaagtcattccctcgttgatggcaagtcatggaaaatgaaaaattaacatgtaatgggtgctttaaatgactttcctcttcatacactttcttctcatgcctgtaatcttggaattagaaaataatttagttatctaaatataaaagtatttactttttttctttatagctcaaatgtgactctattatgttattgttaggatcattatttatatttgtacccctcagagaatggtaaattttatcacaagtcatggcggagatagaaagcattttccagatttgtcttgttgctattgtcaaagttagcattccatttgaaggtactgttatctagagcagggaccagcaaacaacagcctgtgggccaaatgtggcccctctgcctatttttataaagttctattggaacacctgttcatttccttattgtctatagctgctttcctgctacagtgcagagtggagtagttgtcacagagatcatatgagttttaagtcttaaatactttctggccctttgcagaaagtttgttggcctttaatctagagcttgacatagtagagaataggaaccagaatcctccctcccacaaacccacaaacaggttggcctctttcctccccttctgggacacagcaatggaaatgccttgccactatttacaagtctgaaactcatggggctctttgccaacacacaacacccacccccacccccaaccctgcacccgcaaatactgtgaatactaaaatcagttatcttgggctaaatcagacagctcttcatacttgattctaggatggacaaaacgttagcaaatgctagcaagtatagaaaaattggtgagagaaacctaaatttgagaaaattatctccattacttttttttttttttaaatggaaaaaggctctcgttaccctgtcctccaccccttactcttctgttagagtagcagatcccttgatccaggaagctgtgatttatggatctttgtggggaaaggaaaaggggagcagagtgaagaggggaggctggatgggcaagcgcagctcaaaggggaacgtcaggcagaatgtcccagggctgctgactctggcttggaaagaagcttagatcagaagtttccctcagacttgcacttctaactggcctcatgctgcttctacggaacttctgaaactgaattttctttcttgtttcttctctctttaattcaggttggtataagaactaggcttttctcttgactttcattcggccctgaaataaaattagaaatatattttataggttttatttaatgaaagcaattattgctccaaggccttttatgataaagttgccagtttgtaataaattatcttacagttactttctaggcattataaggtatcacagaaaggaggcagcaacgttcctgcttttattagccaagaatatggttgaggagacagtgaggtagccagatcatcttcccatgtgggaaaagacctgttcccctgcccttgattcatcctgccagccccctgcagccttatcctctctgcctcctcaatacccaaaaccaccaaatcatgtgacgggacgatgggtaaaaccggtagtgaaaggggaatgcagttacatgttcccaggccgtgtgcagaagaggtggggtttggagtctgatagtcttgggtttgaatctgggctcagccactttactctgggcaagtctctcaacctctcaaaacctgtttcctcttctgtaaacaggcaatgaccaaaacctgccctcgcatatttgtggtgaggtcagaaaataatacatgtaccacgtctagccatctttcctggtgtgaagtaggtgctcattcttttttgattcagttttccttgtctgaggtgtgcttttctcttgtctcctgtaagcttcactaagcagaaagtgtcccgtcagtattctttttggttggttatttattgatgatgtgggatgtgggggagttgattagctgattccatcatcatgaaaagcatttcttgggtgcctgtgtgcttatgttcttgttaaaaatgttacatatgaccgctgtgatggggtgtttacaacctgtggcagacagtatcccattgggcagatgtgaacaggagacgaccgtgataacctgtgagaggctgatggctgacatgctacaaaggggccaggcctttccagcctggccctcttcccgggccttctggaccatacattttccaatagtcttttctttctcataaccctccttggtaataggcatcattcccaaatcaatcaggatgcagttcagttgtacagaacagagacccaagatgtctgtggcttcagcaacagagaagctgagttctctccctggtggcattctgggtgggcagtgcagggctggtagagcagctgctcctctcttgtcctcatattctaagtgtctgctcaccccagcctcattccccatcccagccagcaggatgtaagcagggctgtagaaaggagggcagatggtcaccagccatcttttaaggaagtgccacataacatatccacttaatgtcatcggccaggacttagtcataaccagaacatgtcctgactctgagctgcgaagccaagaggccagctctgggtcaccatctcccagtgcctcctggccctgccatcctagtcacaagatggctgccaccgctccaagcactactctcccttttgttcggatcgaagacttcccactgggcatggtggctcacacctgtaatcccagcactttggaggccaaggtgggaggatcatttgagcccactgaatctggagcatactggccacacctggcagcagcagaggctgggaaatgtcacctttattctgggtgaacagaagctctgtaaaaatgtccttgggtggcaccggaggcacagggtgctccagattcagtgggttctgtggggttcaatatcaagctggggtgaggaggtcaagcctcctctaccagatcgcctatgtccagcctgtctcctgggagggcattcattgaggccttcaagcagaggggaactgcccttgggaggctcatcaccttggctggcctcttcgcttcgcagcccagagtcaggacacgtcctagttatgactcccaccggctccatgattttggacatgcttctaaatctctctggtctcggtttcctcatccattaaatgaggctaataatggcacctacttcatagagcagttgtgaggattgaatgaacctataattgcattcccagtacgtgataagcactcaataaatgctggtccttattattacaaatctagaaccatattcttttctttaccatatttttttcctatgaatagtacagggactctctttcaggtggcaggaggtggttttgggaggcaggcctgggctacaagtcctccacccatacttccacccaaagaaggtgggatttttttctgtagacttcctgacctgatagcctgagtgagtgattgaagcttcctgctcaccagtctaattagagactggaagccaagtgtctccatggtctaggggcctccctcatgaactacagctctttgcgacccaattcaaatgctgcctcctccatgcagccttccttgatttctctgtttgaaaaccccctgccgacctaaaagaggtacctctctaaatccctaaaatgctccgtctgtacctcccacattctacctggcattagaatgtgttgtatatgccccacagttcttctactagtctgctagtacttcccaagcaggatgagtacaggttctgatttgtatcacctacagtgccctgcacacaataggtgcaaagtaaatggtcatcaatagacgaatctacctcagcatccacaaaatgagctctggcagtttggcacatgcagctataagtaagagaaaattgaactaaggatgcctgaaatagtaagagcatgacttgcctcttagagcagaaagtctggagggaaggagctccaagccggtccctacattccgtggtgtcagagctctgcgtcaccatctcccagtacctcctggccctgccatcctagtcacaagatggctgccaccgctccaagcgctactcccccttttgtttggatagaagacttccaacagggtgtggtggctcacacctgtaatcccagcactttgggaagccaaggtgggaggatcacttgagctcaggagttcaagactagcctgggcaacacagcaagaccctgtctctaaaaaaaaaaaaaaaaaaaaaaaaaaaaaaaatttagccaagcatggcagtgtgcacctgtagtctctgctatgtgggaggctgaggtgggaggattgcctgagcctgggaggtcgaggctgcagtaagccatgatcactgcacttcagcctgggcaacagagtgagaccctgtctattaaaaaagaaagaaagaaaacccttggttttatgtgttggccagagctgggttacatgaccagtccctggtgaaagagaagggagttgctgctgatcatgcctcccaacccaggctggacccactgctgtgcagacctggcctttgttagcagaggagggatggctgctggttggacgacaaaccagatctgccaccgcagcttactgacactttcctgccaaggaaataggaagaggcagggcagtccctctaaacagagggcagatttctggggaagggaccagtgtacatttcacagctctttagcctttcatgggtattttctgggtattatgccatcccatcgatttggaccatgcttactttacaaaacattcttgtacttccaaaggcaggatcaccgagtgtttaagaacacggagcttgagtacccggttctaccatcttcttgctggctgaccttgtgccatttatttaacctctctgtgcctcagtttctcatctgccacaaggggatgagtaaaagaatctacctcacagggttgtttctgagatttacatatacaaatacacacacgtcatttaaaacagtgtctggcacctataaagcactccttaatttgctattattatgtgtcattatttagtgatcctgtcactcctttgagataggaacagtgaggattttaaggctcagcgaagttagacgacttccctacattccctcagctggtgagcagcagagaatgggagggtccaggtggcccggtgctgggcctggaactcagggccctgacccccactgtcctccctactcagaatcctctgtggacacttgctgagggtgatagtcactgatgggtgactgttgtcccacagatgatgcttttgtctctgaaatttatcatgaattatctgagaacaaggactatgtcataacatctctctgacatcccagccctaatactaaatagggcaggagaacatgctggttaaatgggctttggtgggagtgtgggagccggagagatggcgcttccatcgaggtgtctcccccgatggggtacagtggctgagggcagacgctgtgatgtcacgctgtctgacatggcacaggcatctgctccccatcacagagcagaggcccgcgtgcactttcccagcctgggggtggaggtgttaagaggctgaccccaagggccttgactgtacttacgccttaagaaactgctgtttggccgggcgcggtggctcacgcctgtaatcccagcactttgggaggccgaggcgggcggatcacgaggtcaggagatcgagaccatcccggctaaaacggtgaaaccccgtctctactaaaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaagaaactgctgtttgagcactaagtgttagcagcatgaaaaatgaacacatatcaatttatgtctgaatttactctcagaattccctgtggactctgtaaaatgccattttacctcttttccacccatccagctgtggaggcagtggcagatttacattattttacatccagttaagggtgttttttcttttggttatgtttttaaaaagaacatttattgcccataaaaaagtgtttttgttaaagacaatagtgcctttaggtagtaatagaatgctgtttcacaaatatttataaaactattaaacaagctgagattgctgaagctccgattaaaaggtgcctcccattcatctttccctttagaaactgaagtagcttaactgcaattacccgccaccatgagaagatcaccttgcagagaaataaggcaagaccccaacaagatcgtaggtggtggcaccagcattgaccccttcacacccacccctcccactggtgtggggaatttagcttaggacattgcttacagcctgagctaagccagggtttctggagggtcaggagggctcctgggctataggtggaaccagaaggagggagggagggcgggtggtaaagcggggatggcatagccgaggggtttgtggcaccaattgtgcagttaggcaaatctggcttcaattcctggttctgccactggtgagctgttcctggagcaagttactcagcccctctgtgcctcagttccctcactctacaacagggatgggaataataatccaggaaacatttctagaaaagggaggtgaggagagggctcgggtgtgaggcttcacatgttggttccttctaggcactctgcccaccagctccctgccttctctcctgtctggtattttttgtttcttgtttgtgagcagacaggcctttgaaccccttcctagtcggtggctggcccagaacataaaggttctctgagagcaggcaagggagtgactctgttgtaggagggaaactcgtacaggccagacggagatcaccggcttacctcagagttcagattccactgattcggagttttaatcatttggttgagaccagaacaaaatttactcttgcgtaattatcaacaggattataagggcaagatttagtggtgtttgtctcagctctttataaacaccataaactgggtggcttataaataatagaaacttatttctcacagttctggaggatgagaagtccaagatcaagagttggtgtcctgtgagagccccctttctcatgatggcgccttcctgctgggtcctcacatggtggaaagggcagggcagctctctgaggcctcttttataagggcactaatcccatttatgaggactctgccctcatgatctaatcccctccaaaggccccacctccaagtaccatcaccttgggggttaggatttcaatacctggagttagggggacatcaatattcagatcatagcagcattaaagacaagaaacacccctgagaacctcccgaaatttcagaagccccacatccacgtcagtggtccataagtcacgggctcacatgccagatgctgttctaagaactgtgcggttactgttgttatgccctctttgcagatgagaaagcgacatacacagaggttacacagctggttagggatgggttcagaggtcacccagctggcttgcggtggactgggatgaaagccaggagtctactggcttccactgggttcattgctggcagcctcctccttattcagagatactgagcatggagtgggcgtcctagctgtccaatgtgggctgaatctgtttgcaaatgagtggatactaatgccaacaatagtaattgtacaggttttattgccgatactatcatcaagcctttcccagcagcctggccccgtgctaagcccttgaatgcatgatcacatttaatctccctaacaatgctagaaggccggtactgttattacacccatttttaagttgaggtaggcctgagggttcccatcttccatatgatttgtgttttcatctctcccctgagccctaggcaaatcagacattgcctcctgcagcctctgcatatatacctggctagtgtccacagtacttggggacctcctctttcggctttggagccccccctccctctgtctctgtatgggcgagcatcttccttctgtcttctcccttccttcttgcctgttagactctccgctccttaaaaccaaaaaaaacaaaacaaaattcccattacttgatcattttacattccctcgttaagccaggctcaaaacattaaataattgtgcatttcacaccatacccaagcctttctgactttgtgattaccaaggtgcattagaatctaaactgctatgttatgctatttgcaaaatactcttggctcttccctgaatcaattcccgtgagggtacgtatcaggtaaaactttgttgttttagatctatttgttcttagacaaagtaaacttggaattgcttttcagtttgttttgaaatattccctagttctgtgttttcacacgtgcacaaaggccttacttcccccattagtctgattctgaagttttgctgcactaggagaatgttcactgacaaaatgttaagtaatggtgctgaaatgtaaagtaattaatgcaagaatcatagtatggggtggggatctcagtgctttaatgagggctggggaaaccatctgactgaggatgttgaaagcggaggggtagatgaatgttcctgtaattaatgctgcatattaaaaaagtgacctctttgggccgggcacagtggctcacgcctgtaatcctagcactttgggaggctgaggtgggcagatcacaaggtcaggactttgagaccagcctggccaacatggtgaaaccccgtctctactaaaaaaatacaaaaattagccaggcatggtggcatgtgcctgtaatcccagctacttgggaggctgaggcaggagaattgcttgaacccaggaggcggaggttgcagtgagccaagatagcaccattgaactccagcctgggtgacagagcaagactccatctcaaaaaaaaaagtgacctctggcatggtcaatatggggacctcgtaaccttccctgtcacctagaactgcacttctgggactctgtggtcctattaataaaaaagataatcaccagtctgcctcatctactgtggaacccttccaattcttttttttctttttcttttgaggagaaattagaaatcaccaaattaccatttttagactatttatgtgtatatgtatattttactctcagatatatttattcaatgcttgctctataatgagagttttaactttctgttttcccttccattatccctgaaaagaatggattatggagaaaagatgaaagtagtctaatgcaatacagtgtttgctaatgtgctgtcagaggtattagtgggacttgctaaggtttgtgtcttttatgaaatgcctttcagattgcaattatctaatagacttggaaacctgtttgtactcttgcaggcattaaacgtcgtctttgaaaaaatcccggaaaacgagagtgcagatgtctgtcggaatatttcagtcaatgttctcgactgtgacaccattggccaagccaaagaaaagattttccaagcattcttaagcaaaaatggctctccttatggacttcagcttaatgaaattggtcttggtaaggcggtgcgggagctatgtggtcccaggccctgatgagtgtccctccctgcctgccctccctccctgtcccccctccctgcccccaccagcttccattcagtgacacttacacagccaggttgttcctggagggcatgtctaggggccaagagactgctttggtctctcatgggcatcctgattcttcgaaggaagcacggtccttcaaagatggcgtttgttgttgttgtctttaaatattacgtctgtaaatcagattgatgagattgcaggccctgagactgcacggaatcaccttgcatcatgaaatacagaaaggtgtcaacacagtgccctctgcgtgtgttgcatttcacattggcatttgatttgtttgttgtgatactgagcgtgtcattactgggtggctcagactctgggtgttaactctagcctgctagaaaggtcatcttcctctgctaatcacatcctgtattaagtatatgctccgtcctccctcagtgtgcagcagcatctgctatgaattcattttcgggctctactggtatactgcaaaggagagcatatgcgtgagcaagctaacagggccccacttccctcaaatgttcatcaacattttaaagttgagctccgtgcagtcctcccaggagactgtcgtgggattttatagcagataatgggacagaaatgaagaatagaatcatggtggtgacagacagtgtaacgaggttcacttccccttgatgtacagttataggccttgactaagcaggcaattaaaatcctcccactcggccctcccagtccagccccctgctaaaaggccattgataaagccttgaggcagggtcttggaagtttgagaccatgcaaatgtggggcaacttggtgatgtggctttaaagaaagcagggctgctaaggcacccctcttctgcttccttccttgggtgaccgttgagtcacttgaggaccattttagctcatttggttagatacaggatcaaagggggagccccagccaggacaccatgaccctgaccccagacccccagcttccttgctctgagcatacatcttgcaaatatgtggctgtcactacaaaggacatgggcataccccgcccgacagtcttggtcctgccgctgatgagtaggtagtagcatccttactcttttcctgagtttgggtgtcccttgcctcctaaagtaggaaggcaaggagcagagcaaggagggggcctggggacacagcctatcagctatgtcaggcttctgtgtgcctgctgatttcccagactacctccagaaaccagccatcaactgtactgaaatccaacaccaggctggacgtggtggctcacgcctgtaatcccagcactttgagaggccaaggctggtggatcacctgaagtcaggagtttgagaccagcctggccaacatggtgaaactctgtctctactacaaatacaaaaattagccaggcatggtggtgcacacctgtggtcccagctacttgggaggctgaggcagaagaactgcttgaacccgggaggcagaggttgcagtgagcccagattgcgccactgtactccagcctgggcaatggagggagaccctgtctccaaaaaaaacaaaaacaaaaccaaaaaaaagaaatccaacaccagaagcagctatgcttggagctcttacagcagagactcaaaaacgcagatgcccaaaggggcagaaaatacataaggggtgtcagccgcctgggactacagaaagcagtggagcttgacttaatgggaaaggactcgccatccaaggggacagtgccatttgcttcagtggttgccatgtggactacagattgtattactagactgttcgattttctttttttaaagaaatcagatatccagttttttatatgcaacttaaaaacttttaaaaaaaattttatagagacaagtctcactatgttgcccaggctggtcttgaactcctagcctcaagtaatccccctgcctccgcctcccaaagtattgggattataggtctgagctcctatgtccagcctatgtgcaatcttttaatctttaaatgttggcactgagttgacactaaaataataattaaacaccatgcaggttccaaaaaaagaaaaatcacatttgtgcaccacatgctcacctaggcataggttagcagccttggccagagagtctgcccactgtggtgctgggaccttcgcacactgatgcctccccctccaccccgaacaggagcctacagagatggttcatatcatgcctctctttgtgaacatgggcacacaagtgtgagcatatacaaatttgcttctggaatttttgttgaagagcttagtcgtccctcatagaatgcattattttgtcttcagtggctttacttccaggcttatcagggaagaagtggtttgaaacatcagagccctaaacaaacaaacaaagtaaaacagaactcagaattcaggctaccagtctggctgatgcatctctacaccttcaaacaaagatttaccactttattcaagttttagttatccataaatttgtgaaagtaaagtggtggcattttaaaactctctaaaaaggaacaaaatgctctttttcagagcttcaaatgggcacacgacagaaagaacttctggacatcgacagttcctccgtgattcttgaagatggaatcaccaagctaaacaccattggccactatgaggtaagagcaagacttgaccccgtgtctccttcctcatccccaatcctagtcccatggacattcttttaaaacatccaggactcccacccatttcctggaatgacttgcagatcgatcgtgtctggggctgaagttttctttcgttgcttgtgcagacaagcccatgaagggctctcacagtgtacttgtcacgtattcccttctcagaaggctatgattttctatctcctgaactctctccaccctgaggttcagcagaaaagaacccaggaaaaaagtctaggaaagccagagaagagttatcctttagccttcactgggtgacaagcgtgctgatgctaaacaaagcccgggaagtcccaagcctcgcctccctccacaacattcacagtagaccttgtaaccttttgtgtaggtccttgcttcctgaagaagttctaaatttcctgtttgtttgcaatattgagcgatacttcctttggcctcttaacccacatactgggtgagtgccgagggcggtgaggggtgcacgtgacttctcagagatctgagtgccagagaaacctgcacataacaagacagaggaggcagtgaaggttcctgaacacactgggatactggggttcacttgtttagcagtattatctgaatctttgttgaatatccactctgataagagctggggctgcatgggagaggagcaaagaccaggtccctgccctcacagagcctgcagccctggggaaggagtgcaaaaaaggacggagagacaagtagagtcaacaccttgcgtgtagtagtgctgtgtggcttggagaatccaagaggcttcctggaggaggttatgactgaactgagagctaaacaatgagaatttagccagactgggctagggtgcaggcacatccagcagggaagggagagcatgcgtgttagactagtcaaaacttgagaggggcaatggagagggggaaggagggcagtgacagctgattatagtcagtgcttatgaagtacttacaccacaccaggtactatttccagcatgtccctgtaatgtaactgcccaacaggttcaccttccccattgcctagacagagctgatttatcaagacaggaattgagataaagtaatttggctgtacgggagacgggagttttattattactcaaatcagtctccctgagcgttcagggatgagagtttttaaggacaacttggtgggttgggggaagccagtgagccaggagtgctgattggtcaggtcagagatgaaatcataggaagtcaaagctgtcttcttgcactgagtcagttcctggggtgggggccacaagatcagatgagccagtttattaatctgggtggtaccagctgatccatcaagagcagggtctgggccaggcgtggtggctcacgcctgtaatcccagcacttcgggaggctgaggtgggtggatcacctgaggtcaggagtccaacaccagcctggccaacacggtaaaacgctgtctctaaaaatacaaaaaaattagccgggcatggtggtgcacatctgtaatcccagctacttgggaggctgaggcaggagaattgcttgaacccgggaggcggaggttgcagtgagctgagatggtgccatggcactccagcctgtgcgacagagcaagactccatgtcaggggaaaaaaaaaaaaaaaaaaaaagcagggtttgcaaaatatctcaagcactggtcttaggttttacaatagtgattttatccccaggagcaatttggggagagtcagaatcttgtagcctccagctgcatgattcctaaaccacaatcccaatcttgtggctaatttgttagtcctatgaaggcaatctagtccccaggcaagaaggtggttttgggaaagggctgttgttgtctttgttttaaactgtaagttcctcccaaagttagttcagtctacatccagaaatgagcaagagcagcttggaggttagaagcaagatggagttggttaggtcagatctcttcactgtcttctaacacatctgcttcaccgtcttataacagtgaaaggcatctgaaaggtttgtttcagatgtttttcactgttcacctttcagatgtctttcactgttatagttttgcaatggcgatttcagtatttcgccccattctatcctatagcagtcctacgagataggtactattattaaccccactttatagatgggtacgatgaggctctgggaggtctggtaacagctagtcagtggcagggccagattcggacctggatagttggctgtagggtctgtggctgaaccagtccatgctgtggcctcttacaagatgtaggggtagggaggcaagcagggaagatgcagatcacacagatgggggcagcctcttcaggagttctgagtcttatcccaagaacagtgggaagccatgggaggtcctgaagcagggaggttagtatttcagaaaatgagtggggctgtgtgtgagatgtagatagaaggggtgcaaacctggaaatagccccattagaagctgtggatttctggtgaggattggtgctgtccagcaataatgcagtggctctggacagacacagagacacacaaatggaatcagatgctcaggaggaggacaccacaagtcacgtggatgggagggatagtaagatgagggtggggtcaaagatatcagttggggatgactgtgcagatgcctggaggcaggtgctttcctagagaagacaggaggaggagcagcttcccagcacaccgggagggtagggaccccctgtttttcatggctgtacagtcccagggtgacaggtctgcaccaggaaggacctaggactctgccagattctccccttgcccaggaagaagtgagactgttcccgagcagagcttcttagacaatggccagggacagagaacacccatccttgggctttttggctgagtgggtcacccagtttgaaagtggttgcgttgggtgatgactgaggtgctgcccctgtggcattgctgtagggagtctagcagagaaagctgcaggctagcaacttgccccgtgctcactctcctatagctcagacttgccaaccctggaatcatcttgccaagagcagtcgttcttagcttttggagtttgtaaaaatccccagggagttttctaaaagtgtgcattcttgggctcaggaataaggggcatctttggctgtatttggaaaaacacggccccagagggaaggtaatggccaggaggagatcggagtcagagatgctgccctgctgggtggaagtgcttatcatggcatcagttcagggttctagacctgcaagccagcacctctccctgtgtctgggtggcaggcttgtcttgatgagttaggaggggacacagactccaaggccctcctctggtgctgttgactggagttcttgtcttgctcagctgtgcctcccctgccaggcttctcagcatcccttggccactgtggggcatggggtgggccgcagaggcaggggatggggctacccactgccattaataggaggaggcagggcaagtctctccagcagggagaatgaagaaccaccacagctgtctgcaaggcaaggtgaaggcctgtcgggagagatagaacatcagtcttcactgcagacatcggccgtgctagacacctatctgcttaaggatgataatgaaattaatccggcctgtagtcacttcccgtccaaatgatttattggcctcataccccagtgttgctgcatggtggtaataaatgacaagcctaggacatgaaggcttaaaggattctccttatgtttaaaaagctaagccataaggcaaataaaccagagagcctgaaggaaacgggaggtcattgggctccatgttctctatgcctggaccatctcaaaagccctgttttttaaaggctgcttggagaaaatcatcccccaccaccctcagccacctacatctatatttgattaagcagcgcctccgcagactcaacatttgggagtaatttgacagggctgggctgaagtttgcttttacccttttgttaaagaaaaaattttctcttgagcactagcatttccctccaaagagacaagatgctaattatcactcttattcatttactaaagcaccctagtttgagtcactgtatgtgcttaaaagcaaaaaaaaaaaaaaaaaaaaaaaaaattcatttaaaaatagggtctaattcagagttttaagtgaatcagactcacctccctccaattagtccacattagttaggttttaaagttaatctgtagtgacggccagttcctcctactatctaaacaaagtccctgctgttggagagccagcctgtttcttctttccttgtctgtccttagggcaaacagagtgtagctggtctcgtctgaatgatttactctcagcacatttgaagaacaggtttctagaggggatttgagggcatgacaaaaatatagcatctcatggactagatgcagcccccagagccccacattgctggcagggccctgtcacctactggctgacacccttggcaacccccagcaccggggaattgctttccatgacaataaccatggcagccagtgcctggcactgctcacatgcattagttcaattaatgtccacaaaaaccctgggaggcaggtgctttccttactcccattttccatctgatgaacacagaggagggtgcatttctgttccagtgtcattctgtcctgtgcagacaaagggttaagcgtgtctttacacatgaagccagaggagtctttctcccctataattaaaccctcccggtgcgcttccttaactggatgtcattctgtgtgcgttgactatgaaggggactgtgctttgctctggtgccaacagggtctggggcatgtgcacctgcatgttcagggagtggggcacactcgtcccctaggactgtggcagggtggtttctctggagtccagccttcttcctctcactcgcaccctgctgtgacctttggctgggccgagttattgcacccgcaccctgctatggagtagtggcgagtgtgcaggacaggtgttgggcaggaaattttctctaaagattacacttcgagttctgagctgcaaggttttgagaggcagaaatgttgtttaaccgctttcattaacagatgtgtactaatgcagaagtggtcactgctaacaaatttgtaattcaaaagatatttaaagctcataggaatgccccaaagggtctgttaagtaaggtcagcaatgcttctggtcaagtccatcatctgtgacactaaaagggactggacaatcgctaaaggtctgttgcagtgtgaatgtctttagatattcatttaacaaacacgtataatgcttcttgtgtactgggtactgttctagggctttgaccaacagcagctctttccgtcttctttaccgctccatgaggtgaatactatcagccccattctgaggcccagggaggctaagaaacttggccagagtcacagagttccttcactgatgcctcaaggcttgaaagcaggcgaaataaccactctagagactgtggctctgcgcagggcctgagggataccttcccccagatccaggctttcagcccatgctcctaacctccgaggcagcctggctagagagctgggcctgattgaggagaaatcctggtagttacattctctgatgtcaaattcataaagggtaacttctcttaaaatcccagggtgaatctcgtgtctgtgagtttatcaaaatgcttccctacttctactttaaccctctttttggccagcagtccgtgaagatgacagttaccttcatccaaagggggcctctctcaggcatctgggctctgacaactccaacccaacaggatcactcttgagtcttaagtgttcaggtcttcgcagtttcccacacattcttggtggcccaactccctcaggaggaagacagtctcagggctatcactaataggccgcagaaggagctggctagtggcctggaggttaatttcaagtaaacaagagagaagcaggagccctgtggcattttctctggtttccagcatcctgtaagccctcccctggatgtccagaaccttctgtgtgatttgaccagcctgtggaggatgttctgacggccccttccaatgcactggtgaacccctgtgctgaaggactcagcaaggttatccctcaagccctgagaaacaagattttgttttcatcagtttccagccttggggcatcagtgagaagagctgagggagaagacgatactgacggagggagagcaatattggcacgtggctgctgggacagcatgtggaatagaattctgttttcacgtaatattgtttcagcagaaaaggtgatttcaggaatgagagatttcaatcagagtttctgtgtagtgatttgattctcatgttttcagatttttttctttaaattatcacaatattcagaacatattcataatttttcataaaatttatagctacaatgccagcatttctcttaggtggagccatatgaaattgtcaataggtgaccatttttacctacaaaagtggtagtttcataaggttaaacataagttcaaccttacatttctagaaaatctcttttcatggaattctaagctgtgccataaacatggtatcttataaagaaatcttaccttcacttgcaagtggtttggaggatgtgtagctcctgtttattttggaaatgacttaaagttgttgatatgggtctttttctccctgagtgattacaacttctcattctaatgatgggaaagtctacagtcatctctgccacttctaacgtggggtggccccaattcccctccattgatgattggaggggaatcgcttgttgtcacatcgaatcctagaaccctgtgagactggaaggaatttaatttgaaattgccgtgcgtaccagttctgctctgggctggagaaacaatcctgctgcagatccatctagtgacattaatctttctttgacttaatttggttttcatccctaaagtaggggcccagaggacgctccctgcctcacaggactaggggacgattaatgagtcactcttagaagagcatttggagctcctcagatggaacaaatggcatctttttaacactctgcattccagggcacttttcaaaaaggcatttctgtccttacctcagcagcagctgacttgtgctaaaaagaaaacggaaacctttcccccacaaacatctgtaaataaactatttttctgtctttataatcgtgttaaagtgtcacatgggggaaatgttccagctctagagcagctgtgaaagttagaaatgcactcacacatacgcgctcacacacacacacaactcatccactaataaaatgtttctacacttgctcttgggagataatttcagagtaaaatttccttggtacaagctgtgtctatgctatcttaatgcctgagcacagcactagcagcgggctgttgccagctcttgaggagacatttgaacttttggcagcgttccttatcagaaggcccatccgaggtatttgtgattatagagtaagggtgctcgcttttggcaaaacaaagcgtctgacagtagtgaagtactggctcaacactcaatgggagacatttgggattcattctttgacaattacccagaatgaatcatcagcttccttttataaaaagatatttattggcttagaaacagagcatatccagctcttcgtggggaggaattttgtaactatgttcaaagcttctcataaactcggtgtctgagtattgctaagggggtgcctgcacagagcatttagtttaattgcatcaaatatggaggagaattgaaaaatcagccagcaaacaatgaatagctcaaggggaaaaggagaggatgctcgttaataggagcagagtcgaagagctcagtaagagttaagaatccctgctggagtcactttgcagaggcctgatggccccagccggcccctgcccagtgctgcccccaccccaccaccaagatatcatgcacaccagcagttggaggcctctggcctaaacttagcggctggctggacagctgtgtttgaggacctcttgagggctggctcttgctctgtgttcctccctgtgggtgtaacctgaaggagattaggttttaatcctttggtgcttgctaggtgggctagtacattctgataaccaatgtgcagcaggccagaagagaaattctaggtttccactctttccaaactgggaaggcaaggtccaaattaatattagaattgagaatagctttggagcttcagaatggagggaaaagtcacttagctgataaggttcagaagtgacagggtcagtcctccagaaacagttccagaatgaaggagatttgtggatctctgacctgcctccttcttgccacccgtttgtcttgtaattttgtgaatgagcccctcctcccacagagccaggcctgcccccagcatcttggcatctttgtccccctttgcccgaagggcacttccttgcttggggatttgcgagtgcccatcagggtgtgggggaggggcactgtagggccacttgaccctggtttccatggtaccaaaaggtcttaggtgagaacgcttgattttaactccaaaagaggcaatatatacagaggcctgcctttgtcaaatgtatacatttaaaatctgtggcaattcttatcagttctattgaagcataatttttgagacagggtcttgctctgttgcccaggctggagtgcagtggcacaatcgtggctcactgcacccttgacctcccacgctcaagccatcctcctgcctcagctgggactacaggcgtgtgccacaatgctcagcgcttttttgtttgtttgtttgttttgaggagagatggggatctgagttctccgggctggtcttgaactcctaggatcaagcaatcctactgccttggcttcccaaagagctgggattacagtcatgaaccactgtgtccagccaaaatataattcatattaccataaagctaattcgtttaaagtatacaatacagtggttttaggtatacttatagaattgagcaaccattgccacaatctaattttagaacattttcatccctcccgaagaaaccttgaattcattaacagtcactccttatttcccccagccctgctttagccaactagtaatctacgatctgtctatataaatttgcccattttggacatttcgtatattctttttagattcgtgggtacatgtgcaggtttgctacaagggtatactgcatgatgctgaggtgtgggcttctattgatcccatcacccagtgaacgtagtacccaacaggaactttttcagcccttgccccagacccatccccgcttttggagtccctcatgtctactgctcccatctttatagacacttcatatcaataggaccatacaatatgtggtcttttgtgactggcttcttcgcgtgtttttgcagttcatccatgctgtagcatgtatcggtaattctttccttttattgtatggcaatttttggtagtatattcatactacatgaactaacacatagtaataatgaactacttgtagttgcaacatgaatacatgtcacagaccttatactgaccctcaaaatctagacacagtacatactgtatgattctatttatatgatacccaagaacaggcaaaattcataaatggtgatggaagacagaaaagtaattacctctggatgaagatggggtggtcattgtctcggaagggacaatgggagcacttttcaggaccttgcaatattttatatcttgataaaggtggtggttatgccagtatatatttaatgtgaatagtcattgagctgcacacttaatattagcaaaagttaagcatgtcccacattatgcttacatttcaaagcttttattaaaaagtatatgcaaattttgtgattttacaagcttttgaaaaaatgtcacaggttgaatatcccttatccaaaatgcttggaaccacaagtatttcagattttggaatttgcttggattctagaatatttgcatacacataatgaaatattttagtgacaggacccatgtttaaacacagaatttatttatgtttcatatacaccttgtacacagagcctgaaggtaattttatataatttgtgcacaaatcaaagtttttattgggttttgactgtcactcatgctatcatgagttcaggtgccgaattttccacttgtggcaccacgttagcacccacaacgtttcagattttggagcattttgaattttcggattagggatgctcaacctgtatatacctacagaaaaacaaataaattataagcgtactgctggatgaattatcatcaagtgagcatatcctgaaactaccacccatgtcaaaaaatagaagccctctcctggcctttcctaatcactaccgctgctctcttctccaaatatctaacatgatagttttgactgtttgggctttttcttttttcaagctctatgtaaatggaatcagtcagtatactttcttttctgtcgagcttcttctgctcaacattatgattgtaagatttacccatgtggcgtgtaacagtagtttgctcattttcattgttttataaactgttgtataaatatgccccaaattattcattctgatgatggatgtttgagttgtttccagtatgggacaattacaaatcgctccctatcaggatttatacttatttctgtggactaaggacctacatgtgaaatggctctgtcatagggtagataccaactttatataccacaatttctgaaaacccatttcagcatttcttaatagagtagtgtcatagtcagttcgggctgctataacagaataccattgactgggtggcttaaacatttgttccttatagttccagagactggaagttcactgtctgggcaaagtactagtagctcggtgaggaccctcctcctggtttgctgagagccgtcttcttgtatccttgtgtagtggaaagcagaggggaccagcaagctctgctgtctcttccttttcctcctctgtttagagacaaggtctcactctgtcgcccaggctggagtagagtggcacagtcagggctcactgcagccttggatgtctgggctcaagtgatcctctcacctcagcctcccaggtagctgggactacaggtgtgcaccaatgcgcccagataattaaaaaaattttttttatacagagggatctccctatgttgcccaggctggtctcaaaactcctggactcaaggatcctcctcttcttcctcccaaagtgctgggatcgcaggagtgaggcaccacgcccagccctggtgtctcttcttataagggcactattcccatcatgagggctccaacctcatgacttagtcacctcccaaaggccctacctcctaataccatcacactgggattaggatttaaacataggaatctggaggagacacaaacattcagtccatagcaagtaacaattttttaacctcaaaaaatgaaactggcctaggtcttgcctgacctctgcgaattggggggaatgtcctaacacagctcagtcttcccctcttccagggcttcccacctcccatctgtcccacagggtcctggcctccaccttctgcgtactaccccactgcctcccatggcctcatcagcctcctccacaggaccatgagccccttgaggacagagacactgccttgcttgtcatttagtcccagcctccagcacagtgcccagaacatagtaattcttgataaatatttgatttaataagtgacagcatgtaagatccatccagccatctaattcctgggtgaagttgagaaatccattaaattttgaacactcatatatcttttatctttggtttcagatatcaaatggatccactataaaagtctttaagaagatagcaaattttacttcaggtaaccaatataatattgttaaccttttgttctcacccagcttcataaagtattgctttttgcctctctcagctgtattgtcacaaaggtgagattgagttgttgctatgtaattctctgaaagttgagaaaagtcattttgatctctttgcagtcctaagaatgtgatccctgcaagaaggaaaggaaactatagatggtggttggcctggactgcccagcactgaggaagtggctgcctctttatagccctaaactcagggcagaatctcatagctttttttcaaccctttagaaggatggggcctaacagaggagatccccctggcaaactgagagggaagagtacagacaatcatcacagagccccgaagcaagcgctgaacaaacaagataatccacttagaaggtccaagtctcctgtgatagcacttgcaaaattcccagaaattggagagagacaaactaaagggggaacttttatgggaaagtcaataggctggtctctaaagtgatcttctgcttccctgatagccctggggcaggaaattcctgttccaggtttgtctccagagaaattataccccagtcaagacaatcagctctcagcccttggaaaggttctgagctcctcccaaacaggctcctttcacacacacagccagaggtagggcttcctgacttctggattcactattagaaggagcagggagcatctggccagtgcaaacagggaatgtggggttcttgattatacagacaggataattgggtaggactcctttggggaaacccaccttccatcactatatggggctgtggtgaagccatcttgcagagatcattccagcttaagggggatggtgtctttgtgttgaaaagtggaagagcatggtttttaggtttcaaagattgggccttttgaagagcctattatttggggattgaatagtagaatcttaggtttggatctcttcgtgggccctccagtcagtcaacactgctgctagtttccattcactgcaactgagagccaccgtcttacaccctgctaatactctaaacctcctgtacctctgtcctatcatcagcccctctgtcaaaatcccaacgctggatgaacccaacgattatcctttcctgaccctacagctagggagccacagaagaaaggcacataatggcacacagtgggtcactataagttcatggtacccaacttgaccagggccctccacacagcctgctctcattgggttcctctgggcaattcaactctgtgttgtccataatgtctgccttctctcctcaaagctttgacccacacagctctcctctcagcagatgacttcaccctgcactctttacagagaaaactaatcagaagtccttcaacagccagtagcaaacctaccaacctacctgcacctgccttcttccttgatgcttgtaggctgaccttcttccattcaaggccagtctctcacctgtgctttgggtccaccatcctttccaaccttcttggtatccttacaccaccagtaatctcttttctcacctgtactttcttttcctctccatctactccccattttccattagcatttcaagatgtgctcgtctctctcatctttatttttaagacagtgtctcgctgtcacccaggctgtagtgcagtggtacaatcatggctcactgaagcctcaacctgctgggctcaaatgatcctcccacctcagcctcccaagtagctgggattacaggagtgtgctaccatgctcagatactctttaaaattttttgtagaaatgaggtctcgctacattgtccaggctggtcttgaaatctggactcaggcagtcctcctgccttggcttcccaaagtgctgggattacagatgtgagccactgagcctctctcaactttaaaacaaacaaaccaaatgccttacttcctctcttccctccatttaccactcccttaccctttacagccacatttcctcactctgcgctactcttgacttgctctgtgagcaccacctcattgtcctttgagatcctagaaagggtcagctccttcctacctttggaccttcctgcaatttgcctagctgactctatctcttcattagattcagctcaagcatcccttcctcaaaaactcctggactagatttggtctcttgttaattctttagcatataattctccttcataacctttatcacagttataataattgtgtacctagaagtttgatgtctctcattggccagaatgcaaattccatcagggtgggaactgggtcttattcattgctatatgcccagtagtccctggcacataggaggtgttctaggtacatttgttaaatgaatgaggcttgagcctctcctaccagcaagagatcagagatcactagggaatctacttcctcctccaatccctcacccgtcccatcttcacgctgttcttaagatcttaagatgcagcagggggaaaaatgtagctatggagagctcaagtcaaaaagctcaagtaacttcagtatacagcacaaatggggccttttaagagaaggccgattagcccatggttgctttttttaatggactgctttctctccctctttctctggcattcagatgtggagtactcggatgaccactgccatttggtgagttcaggctttcttgtgctcaccactgaactgcatgccttctgtagcaagagtggtctccttgggtaacgcttctgctgtcttcccttcagattttaccagattcggaagcattccaagatgtgcaaggaaagagacatcgagggaagcacaagttcaaagtaaaagaaatgtatctgacaaagctgctgtcgaccaaggtacacttactgttctgggagcactttatggctacctagggggtgtatgatatgtttgacttaatttccactgaagtgtgaaaatgttacaaatcccttgtgccttctagcaaagcaaaatgaaagtttaaattgtaaacacttcctacccagttcctcttctttttatacactacaaagataacagcactttacagatttgtactgtagtatcttcagtcagggatttaatattgttcccagtctctttctccaccatttcactattattgttattttttaggttgacagcataattattccttttggtttacttgttattatagatgagcaataaaactccctttttgaattgcgaataaaatgaaggggatgggaagggtcaatgactataaacctagtaaatcttaatttttgtttttcattttaaaattaagaattctgctcacacataaaagtgtcagatgtgaaagccggtggaataccaaaccgagagcaaattttactttatctggcttttagtggaattaacagaagtctgtggtgatcttttttttcctccccctctggaatgatgagcactataaatgctatgatctacacttggccccaggaacttgatgggcatgcttcttcagattataacaaagaatctgcttagagcttaggagatttgtttagtgggcagaggacagcccaagcctcttgattttctcagctgtcccatagagcccagcctatttggcttttgtgaaatactcaaatgctttggaaagtacacaataaaactttatgatagaaatatatgcaacaggaaaaattctgggaacagagcagcatcacttgagcttttccaggctgaacataactaataaaagccaaatatccatggcttcctggtttatgtaaacagccctacaactgacatttcaactgctagagatttctgatatcctcccagttgactaaacaatgttatcagcaagaagcttatgaaccaaatctaaacctgggcatggattttcaagacttttgacctatactgtgagcactggccacatttgacaattttacatttttctcttcagtttgtttttccctgttttgaacattattttctctgaatgtggatttgcttttgctattatgttttcaaaaccactaccacagtttttaatctcccaaatctgatgttgtctatctttcaggtggcaattcattctgtgcttgaaaaactttttagaagcatttggagtttacccaacagcagagctccatttgctataaaatacttttttgactttttggacgcccaggctgaaaacaaaaaaatcacagatcctgacgtcgtacatatttggaaaacaaacaggtgggaatgtaggtgattagtgactgttttcaagaatctgggacagaatattaactaaaagaaagacatagatagttatagaaggattcatttatctctatatcagaatctttgggcttggtaagctatcatgtcaaagtagtttcttattctgttactatttttaaacaataaaggaaaccattcctatgccaagaatcctgttcttgaagataaactgttatctttggtgcatgatactttgtctagaatgttaaaagaaatttaagttgaccagtaaagaatgagaaattaacatttgtggttttatatcatttttgcattagagaaaattttatgataaaccattttttgttcctaatcggttactttgcagtctccaagctgtctatactctgattctgtacagaaatttatcaagtgcagtactcagatactatgagaattagccaaaagtttgtgttttgttttatattttaatattttaccttaaggacaggcaaggcatccaaattttgcctcctcagtaaagaaatgtagctcatgagctctctttgaaatgctgtgtgcatgggctggataagactcagagttatgatgaagtagaacttctcagtgcaagctcaaggctttccaggcactgagggcagccaggtcactttaaatgagtatcaaaagctgaagttcctctaggtctaatctcccatttaatccaggcctatcccaattctctacgctggcttgctcccttctcttcctgtgttctagcctctttttttttgagacagggtctcactcttgttgcccaggctgcagtgcagtggtgggatctcggttcactgcaacctctgcctactgggctcaagcaattctcccacctcagcttcccaagtagctggaattacacgagcatgccaccgcactcagctaacttttaaaactttttgtgagatgaggtctcactacactgcccaggctggtctcaaactcctggactcaagccatcctcctgcttcagcctaccaaagtagtgagattacaggtgtgagccactgcccctggcctgttctagcctcttatctccagtccctgccactcccacatcaagactgggagctgagggccaccattccaccttgaagattatggcatctgagcaggggcagcagccaggacagtagagctgttgggagacctagcagcatatgggggaggtaatgagctaggccagagttgaaaaggagataatggaaggactttgaaccagtcccaagttcatgttcgggtatttgagtacctactatgggccaagcagttagttgctggagatatagtaacaaaacagatgaaagtccaggtcccattctaatagttggggacagacactaaatgcaatatgcaaacagtagcacattagcagatgatgagtgcagtggagaaagtaggaaaggaggctagtatgtgtcaggactaggtgatctgagaaggcctcacagagatggtgacacttgaaccaagtcttgaaagaggagagggcataaaccatgagactacctgaggcaagaaagtttcaggcagacagacgccaagagcacaagttgtgaggcacgtgcttgcttggcccatatgaaaaatagcaaggagaacaggagagttggaatgagcgcggtgaggagcagtgggataggagggccaggtcatgcagggtgttatccagagggagatggagagcctcagagggttggagcagaggagagacatggtctgattctgtgttgagaggactgctgatagttatgtgagaacaaactgtcaggagatgggaaataatccaggtgagagagattataatcaagagctatctggagaaaattcttgcccatggccactttcaaacttaccctcctctatccttcttttacagtagctctgccagttaaccctttcttcttctctccaagtgacgcttctgtctgttgcttggtatgtttggctaagcagagttgtatacttcaataacaaggacaaaaacacccgtttacaaactgtgataaacagaccattggcttcatgaatggccctatttgaaaagagattattctctctttgaacagccttcctcttcgcttctgggtaaacatcctgaagaaccctcagtttgtctttgacattaagaagacaccacatatagacggctgtttgtcagtgattgcccaggcattcatggatgcattttctctcacagagcagcaactagggaaggtaaggcccagcttgagtatttcttgtatgcagtcttatgagtttgacatacttgtctttctgataagcattcaaataataaacaattggtctaaactacaccagctaaaaagagatagcaagggccactgtcaatttgctgttatttaaaatctgtctcattatttttaatctaatttttttaaagtgaaaaacaaaataattagccccacccaactgcagaattctgcctgtgaaaaactttatcacaaagtatgcgttttgtttcctagaaaaatattctatggacactgataaactattaacccaaaatatgcaaccattgaaatttgcctaaatcaattctatttgaatatacataaaatgcctatttgaatataacacattgcttatgggacacaaaatcttgctcaagatttctaacaataccagtttgtcagtttctaatcaaagcatgagtactgttttcctatggttttctttgctgatcaatagtcccaagaactcaaagaaagacaaaaatcagagcaaacttcgaaagagatgttttggtcttatttgagcgctccaaaatatactaaactgagcaatatctgtgcctaatggatctttgaacactgaggaggagttcttgggcaggactttaagagtacctggaatgaatggagactgatgttccacaggtgcctcagactcccagtcataatctaaactctttatcagcagtatttctgcaaaacaaacctgtttttacttttgtcttccctagcattgcctagtctctcaaggtagaatcctcaacgttatctttgactcctcttccttccaacctctatccccaaattattggttaccacttacttctgtctcaaatgtctgtcgctccctcctccttccttagccttatcacttagccttatcccttcatcccgtccctactgggataactgcttcctaattggtgtccttgcccctgctgtccacctttccttctaaacttttccttttcactgtctctcaggtaatctttctaaaacataaatctgatgatgtcagtctgcttcttaaaaattgcaactatttcccattacctaccagctaaagtcttcacagtgccacatagtgcttcctgatgggcttcagccctctttgctggcctcgttattttcttgcacgccccacatacccactgtgctacagcttttacttttcccaagttcacaccatgaacttgttctcacacccctttgctcatctttcctgtctcacagtccctctgtctagtaaaatcctacccattcattcatcataaacattttattcattcgacaaatatgatttcctaatgaggaccagaaactgtaggagactcagatcagtctacatatgcctactttgtgaactttccccaatatatttcctacagcactttcttcatttgactaataaagttcatcttagcatgcagcacactgaaaggcacttaaatgtttgttcacactaaaaacagttgtttatgaattatgttcttgacacacttcacttaatcctcacaagtaccaaataaggtagttattattaccctcattttatagatgagaaaattgatgttctgggaggttacaagtcttgcctgaaaccacacaaagtagcagaattatgatttctgatttgtccaactctttctgtcaactactgctgctaattatttgtatcatagtaagcacttcataaatctgtctttgcaactagattgtaagcttctcaagggcagccactagtctttatcattgtactctcaatgcctgctccagtgcttaataatgtttattgaatgaatgaatgatagcatgatttctgggttccacttaaatttgacaaatgagaaaatctcaataatatctcagtctctaggcatccttcagaatgattcatcaagccattgattcagcctcatgggctgggacattagccctatcattaacttacctatcttccctgagtagaattttttaaagttttgtgaaaaataatgatttttaaaaataaaatcatatttaatttttaaatatcactgttataattacgtagaatcattcaaattgccagagaacctctgcaaaatcacacatcagagccaccaatactaatgaccatgtgcttccctgaagaaactggatgatgtctataatctaatgaaataaaagggacaagctggaaaatctgcctctgccaattacttaccagtttcatggttatataaagggctcaatcagacctacaatcaagtcttttgtaaatgccaaattcactggtgggtgaggatgagagcaaatgttttaattcaggctttttacaaccattagtaatgaactatgattgaaataagttccattgttacagtaactcaaaatcatgcaaaaataataattttagttcttttatgagaggaaggcagaatatattagcatttaatctgcctgaaaataacagtgactcaccagaactatctagatagcagtcagtcattcagtcaacaacatttaaggcctactgcatgaagccttgttagcaagaggtaaaactggttggtggtgggggttcagctacattggaatattataaattcctccatctttttttttttttttttttactcttttggtgatggttgctttttttttttttttttccccaggaagcaccaactaataagcttctctatgccaaggatatcccaacctacaaagaagaagtaaaatcttattacaaagcaatcagggatttgcctccattgtcatcctcagaaatggaagaatttttaactcaggaatctaaggtatcattagaaagcagaaataagcttatatttggttactttacgtcatttcagaatctctcaacaagtctttcttttagaaacatgaaaatgaatttaatgaagaagtggccttgacagaaatttacaaatacatcgtaaaatattttgatgaggtaagattttaaataacattgtttttaacctttgaatcaggcacaaggatgtggttatagcattctgtcagtttcagaacagctctggcatcccaaaaggccagaaagggaagccaggaagcctgtctgagatgggggatcctggcactgagccagaccctgtacatggctgccccccttacagttttatcatgctgcccacatttggaccagcctgaatttacatttgagttcatggggcctacagccaccctgactcaagttaactttgatgagtaagtagtggccctattaaatggggtcagcttatgcttgattgtaatttgctaaaaatgaaagctaagcttgttaaattgcctagattctgtattcaatcgttatatgaaattatgacatatttctaacttaagcgactatttcaataaaccattctcctttatgattaattctccttaatctgggtttttttctttggaaattcaaacagacacattcatcagatgctttgtttccaaacaaatgttaactcccccttccctgattcccccccaatcatgctgggacaggctatccatgtcaatggtgagaatagctcaccaattccatttgctacttgaagatgaagtgaagctctaaggtagggtagaggcaatgagttcttaaacatgataagcatccctcgttccaggggtcaggggagagaagggaagcacgaggagggactacactgcccagatgggagggaagggaaggatctgtctctgaccaggatgtccctgcctgctgcatttaaggagaaatacttgcctgcatgttggctgcccaggaatgcttgctgtgcttggaatggctgtgacataatgcataaagcagggcctaggaagcctggccccatatttgtaagcaaatagttggtatttcttgcgagcttctattttaagccaaggtattgttgatcctgtgataaggacttagcaaaacaacttgcaaagtgagtatgtaaatgatggaagaaaatgttggcatctgtttcatacagattttaccactcacagcatcaggtatgcaaaaaacagaattgtaacgctaaaaccacaatatctaaaataactgttctaattgtcaacagattctaaataaactagaaagagaacgagggctggaagaagctcagaaacaactcttgcatgtaaaagtcttatttgatgaaaagaagaaatgcaagtggatgtaagcactctggggcctggcttaatctggcaaagttcttcagacgacttgggagcaaaatggctgcttgagctactctgtgtcgttaatttgttgtttgcacataggttccactttgggcactgtctttttaagagaccaaggcacatgcacagcttttagaaagcataccaacccttgtgcctgtgtgtataccgtgggaacccttctgtaaatagagttgaagtggttgttgcaaacagcctccttgtttacagagaatacaaggccagtaagcgaatgtcagtattgtaactacagtctccacttaagcacaatgatataagtggttttgtttgaaaactacagctatgtagcacttgtgctacactgcacctctgcattgtaaagggatactgccagtgctcaaaacaaaatgtgaaatgagtcatttggaaacaaggtgggggtgttagggcaacctcgaggatttgcagcattgaaactttccccagtagttcttggaaaagctgaccgcagaatttggtagtgtacacttagcatttgtgagtgtgtgtgtgtgtttaaaccaaaaactaacagtgttgcaacattgttgaaagggctcgtgtttttcagtggtcatcaactgcactccatcaaactcacctccatttcaccaaggagctctaaagtaaggagagtgggctttatttaaatgaacagcattttaaccagatactttgtcctaatgtatgttccttttcttcatctgttttttcatactaaatgtatttgatagtggacatgttggatattatacaaaaaaatcattaattcatttctgttccaaaacctttgatcagaacgatctgtggaagagtaactccatttctatatgagtgagtgtctccttgctttagatttctggtgaaccctgtggttatgaatacttgtgtgtgatttaaaaaaaaaaagatacattttacattttatcgaattgctgttcacactggagtattatatataaatatatatatttgaggcccaaggcctgaaaaatattagtatacaacttggtatcttagtcttactatgtactttttgaaagtattcctcgcaggagaaagaatttaaaatacccattttattcatgcctttctttttaaagaattctctatccagttatactgtagtctttttagtgctgattttttaattcctgaatttttgctgctcatgaccagttttaataccactgtgttttccttctattaaaccagaagaagtaaacagcataattggcaactcttgagcttttcttgtggcaggcaccttttacccttggtgctccaaatcccccatctaggaaagaaaattttttcaagtcaaataacattgatcacatattccttgaaatcatttaccaacactgtatggagcattaggatttaaatatgaatttgtcttaaaggcaattcctttttgcttctgtattatctggaaaagcatgagagaggtgacacctcaacaaactgatcagagaaaataagcagttactaccctgataggcaccttcccaatcctgttgcttttgaccattgtctgtccaacggacacacctcaaacaaacaaaactaccaaatagatgacagatcagaataaaggtgagaggtctggtccccattgaaggctgctacagtcttcaaagaggtgaaggagttcataagagaacaacagtaggaaagttgagagccaagggtaggagagttgcccaaaagacttcccctactactttagggtactgaaaactcaaaggatcagctacagctttatctaagtatttactaaatgctacatgagggtgtccctgtccagctttctggcacatgagtcctgtgtggagagttacctcctcttccagggactgtgctgttgggaactttgggcaagtcacttacctctttgtgcctcaatttctgtataatatttctaagctacctcactgaggtggtatgaagattcactaatgtatgtagcgtgtttgtcaatcctccagtgaaaagcactatctagatcacattttggatcacattagccaaatgcagtaaatggccaaattagatgtgtgctgaagacaatcagtcactgggtctatattaaacagcaaccagagcaacaaatggcaaacaatttctattttcaagtttctttgcatatttttttggtgcaaaaccatttataaacttttttttctaacactagtgtctacagcagcattcaaaaaaattctgttaccttttctgtattaggatttaaagtctatttcttattgtatacctgattgaagctgttcttggagatgaatgttttaaatgtctatatccaaaaaataaacattttgatgtaactgtggactgtcttttttttttttcaattttctagttataatagtttttttattctaagtggctccgtggaaattatttttcagagataaggtgtcactgtatatgctgtgaataagcagctatattatgtagtaagtaaacctagtttgctaaatggtgctaaggactgctcaattacagtcctggccttcttcactatcaactgggacttttgactatgaacaccttgggataatgaacattccacttaatttgggagacttgagctttagcctcgttaacatgaaattattccagcagaattcctctaaaagatgtcacattaaaaaggcttccaatgggtgtagaccaaaaaaaatgagagcatacttagggacacaaaacacataattatttggttagatccacagtaatgggaagtaaagttaaataccaacaatgtttataaaaggacctgagttcaagttttataatcaatggcccccttgttaatacagccataggatttaattatttgcacttattctctattctaacaaagccaaaatcagtagactgtcatattgctaaatatatgctatatggttgatgtaaaattaaacacacgattaaaaaaaaattaagctctttaattatgtgcacacagattttagaaaaggtagccttttgtatatagatacctttacattctttaggctgacttttaaattgtcatcttttttcaactacagtttttgtatatagtaaaccagaagatgtgtatggaccctgttatggccaagcatctcaaagatgaagagagaattaatgatagttatatttcactcaaaatgccaaaaaaaaaaattcaacaaagtaaaaattttaaaacttgactctaactagttcctttttgttttacattctcaaaccattgtcaaatattctaaatatctctgagaatttctcttttaatgcttcacttgtataatcttaaaatcctgacagtcatacaatacagcatgtagtaggtaccttttcttgaggcacattcaagtgttttggcaaacagtaaaaagtatctaaatgccacaggttaaaatgtcaagttttactgagtcaccaacttcacctcttttgatctgcctgttctccaagaacatcattctccggaagatccaagttcctctagttgttttctttgtgttgtttccagttcttctagtcttttgcgaagtagagagagttccctttgatgttgttcctccttaaaatgatgtagagaaagcatagcaaaagaaactattagaaaaactgttaggtagcaaccttggactgcctcttttatatatgcctataacatctggcaaggaaatgctgaccactgtagcagtctaaaaacagtagcatgggctaaactaccatctagttttgcttctctcctgcctcaggctctagccttaagcaaaacccgtagtctgttcttctctaggtataaaattcaccagggagtgaattagaaaatactaatgcagggcccaggtatacttacatggtaactttccaacaacactggtgtttaacagcagtttattataaacaaagcacttggcctgagattcaattcagtgattaaaatcttctgtgcttatgttataaaacataattacttattaatactcccatcttctgaaaaagaatcaatctgattccttcaatacctcaggggcttgatacaatagaaagagcccgggttttggattcaacaggtttaggtttgaaactttgtcacttattagctatgaccttatgcaagtcacttcactctgaatcagtttccttatctatgaattaggaatagtaatatctgccctcaaagcatttttcgttagtattagacattgcacggaacatgcacagttcactgcgttagtaaattctcagtagtaattactattaacattatgaataagctacaaactctaggttactcaatgactcaatcaagtttcctcttttctatcgtccagtaagagatttcactctcagcaccaacactaaaggatcatgattcaaactgaattcagcaaatttctatgctaaatgaaagggaagaagttaaaagtagttttaaatgtttatgccatttttgtggtgaattttgagcactgaccaaagttataatttgagttttatcaccatatttaaacataaaaacctacaaaaatgtacgactttttttttccccctaaaataaatgctcatacctgcatatgaggaggaaatggtagttccatgcttggaaccatggctgatgactgaaagctaacaggattgatagatgctgttggaggcatgttaggaaccaaaattagacttcgaaattcattatgtcttctctgtatatcttttagtcttttttgaagccttgtatagtcttcaaaaggaacattttgtcttaaaaagaaaaagaaatgtttctttaacatggttataccctattgaagcacagtatgattcacagaatataattttaaactggaatttctaaattatgagatctatatataatatatagataaaaaatctgtttacctagaaagataaacagaaacatgacataacatcttaatcattagcaatcattagcattgcagactatcaactcattataaagttttatttgctaattaaagatctaaaatcttttgatactttggtactcactcctaccctcctactcacccccattcatgaatcctgaaactaaagggagactctaaaccaaaagagtgccttatcttacagaaagaatcaaataaaaatacagttcatccctcagtatacacatgggattagttccaggacatccctcatatatcaaagcctgtgcatacaagtcctgcagtcagccctgcagaaccctcataatggaaaagttggttctctgaactggtgggtttcacatcctgtgaatactatattttctatccatgtttgcccgaataaaaatctgtatataagtagacccatgcagttcaagcccatgttgtcaagggtcaagtgtaaagaaaatgctggattgaagcttacaaaattgccatttttaaataggtgaaatatggtcaaatatagagattttcatagttcaatctaattttcaaaatgtcagtgtaatattttagtaagaaatatatatttggtctttgcccttggttcctggcacacagctcctaaaactctgggaaactctgaagtgataagagtatcttttgtatattaataagataactggtggctgggggcccctgaatagcttcaggatggggcaggtcaccagaaagactgaggcatgattagagggttggaactttcagccccactctccaaccccaccccatgacatctgggaaggtaaaggactaaaggttgagttgatcaccaatggccaatgatgtaatcaatcatgcctatgtaatgaagcctccataaaaacccaaaagcatggggtcagagagcttctgggttgctgaacatgtgcaggtgtctgcagggaggcatgcccagagagggcatggaaactccacacccccttcctcataacttttcctatgtatctctttcatctgactgctcatctatatattttgtaatatcctttctagtaagctggttaacataagtttccctgagttctgtaagctgctctagcaaattaactgaacatgatgagcaggtcatgggaaccccaatttatggccatttttagccagtcagaagcacgggttacaacttggggcttatggctgcattctgaagtggggggcagtcttgtgggactgagccctctacctgtgggatctgatgctaaatccaggtagacaggatcagacctgaattacaggacacctagctcgtgtccactggaaaactgattactccatgtataggaaaaaaccccaaacatctggtgtcagaaatgttgtgttgactgtgtgagaataggaaaaacactggtttttcctattataaaaggtaatcacaaaggtgaagctacacaactttaggaaaaaatgacatggagaaaaaggctaactttccaggccttcacagatcatcatctttttggacacgacatccagtaatcaaatataatttcaaaatcactcaaaattctagatgatctgcaccacaactggccaatcttgaattgctaacatttcaatattaatgtttatggaagaggaagtaagttgaattctgttttagaaggactgagccaggaatggtggctcatgcttgtaatcccagtgctttgggaggctgaggcaggagaatagattaagcctaggggttcgaggctacagttagctatgatcgtgccactgcactccaccctgaaccatagacgaagaccccatgtttaaaaaaaaaaagaattgaaacaaaattcaaaattacaagcatgtttgtaatttacaaattactaccaaattaataaactaaaggcggcctcctactttggaatagagtattgtaaggctggcactaattctacagtctagaaacttctagaatgttctttaaaaaacaattgttcacctgttggtaataattgcacccaagaacaccagtgcacatcataaaacgtcactgcatgatattataggcagtttccattacagaaaaatctatacttgaatagccaaggcgctgaaggctaccactaattcactaaattaaaaagatttttcttaacttgaatcaaatgtgtcatataatgccactaccaacaacttaatatgacaaatctctgctttaaaaatgctgatgatcctgattatcagatgtgcttgaatgtgactgcaaaacccgaaactacagctcaataaaatctccacaccaggaaaccaaaactgacctttgattcaaagttgtaggcacaattttcagaactatgcaatagctacaactgtcttgtacagcagcaacaactaacaccactccttgctaccaaagccagtgacattttctgttagtcccaatcataaggcaaacacctggtatgtgacagagaccttttggtttaaagaaacattcagttagggggtaaaaaaaggatagtacattaggagttatcaagctgttttagaaatctttaaaatgtatattttaaaagaaaagaaggtacgttatacttagagacaaagttctatgacatcaaaataaccacatggggaagatacacatacaaacacattacctatttaagacctgattttctgtttccaattcttctttctttgcctccaagacttctactttctcttgtagtcttttcaatttgttttcatgaagagattttctctaaaaagagaaatatgaacaagtatgttaatacataatctcttatttgaacaaaactatatagaaaatattttactcaccaaaaactgtgtttagatatgaatgttttcagtgaatactagaaacaaaggttagtagacatggctcttactgaaaattgcaaagataataaaccacaaatctatctaatattctcaatgtgacaattaattatgaatgccaaacaaaaaaactgttatcaataattgctgcaaaaaaaaaatctacaaagggaaggagtcaaattttactactgagtctgcctgtacatctggtaagaaataatgagctctccattgttccagaagatagcatgtgtttaagagaactgagccaggtacagtggctcatgcctgtaatcccagtgctttgggaggctgaggcaggaggatggattaagcctaggagttcaaggctacagttagctatgactgtgccactccaccctggacaacagatcaagaacccattaaaaaaaaaaaaaaaaaaaaagggtggggagccaggcacagtggctcacgcctataatcccagcactttgggaggccgaggcggacagatcacaaggtcaagagattgagaccatcctgaccaacatggtaaaaccccatctctactaaaaatataaaaattagctgggcgtggtggcgggtgcctgtagttccagctactcaggaggctgaggcaggagaatcacttgaacctgggaggcggaggttgcagtgagccgagattgcaccactgcactccagcctggcaaaaaagcaagactctgtctcaaaaaaggaaaagaaaagaactgaagtaaaattcaaaattacaagcacgtttgtaagttataaagtactaccaaattaataaaactgaaggatcagaaagctaagataaatatggatgcatctgtttaaaagttgcctttctaaatcttaaaaggaaaaaatttaaactttacaatatacaaagggagaaattcctaagtaaatcttgtatggtttcattaaacaatacggaaaagtccaggtaaaatgcaaaaggagtgtatggaaaaaagtagtattttttttcagtttttatacacaggccttttgttttttaatagaaaaacacctaaaatgttaaaactcatttagtcgctacaaaccttttaggtattttctaactcttttttaactgaagtataatcttacagcaaaatgcatagaatagaaacgtaaagctcaaagaaaaaccacaaaacaaatgctggcatgatttccttgtaggtcaagagcactgccatgccagaagggcccctacctttcccccttccaatcactagccctgtcatcctctgaaagggtaaccaactaatttacttccaaaactatagtttacttttgcctatttttgaacctcatatacatacaatcatagtatgtagtcttttattaatgactttatttcactcaacattgttagtgagatttatgttacttacagatatacttcattcattcccacatattatattccacttacgattattgcataacctagtatattcactcagtacaccgttaagggttatctgcattatttccagttgggactattacaaataactctgctacgagcattcattctcatgctttgattgtcccacatcctccaacatctcagaaggcttccttatgctcctgtctaccctggcaaaggaaccactcttctggtttttatcaccataagtatttatttatgaatttataggcagttaaggagtccatctgtctatccatccacccattcatatgaaagaaatcataaatttatgctcttttgtatctggacttttttctcaacattttatctatatgactaagccatggttatgtattgtcacagtacttctttttcattgcaatgttgtcattcattgtacaaatataccacattttatacattttcctgttaatgaaaatttaaattctttccagtctggggatatcataaatattttacgaacattcctaaacatgtttttcgcagattaagtacctcattctcttcagtatatacctatgaatgggtcatagtgtatacatgttttagctttagtagatactgccagttttctaaagcagttttaccaattacatttccaccagcaatatgtgagagttctagctgttctacatttttgccagtacttggtatggtcggtcttttagcttttgcatcctgttttggtgaaatacagtatctcactgtagttttaatttacattttcctgatagctaaaggtattgagcatctttttttatgcatgttagtcatctggatatcccttctttgtgacgtgtccatcctagtcttttgtccattaaaacttttgagtaacctgattcctactgatttgtagttctttatatattcaagatatgaatcgtatgtcagatatatatgtattgcagattgaccttctccagcctgtggtgtcattttcttttgcttaagagtatcccttaataaaaagattttaatttaaataaaatcaattacatcaatcatgtattttatagtaggaactttttgcatcctgcttatctttattatcccaagatcctaaaattttctcccaagttttcatctagaagctttattttttttttttacctatcacacttaggtgtatggttcatttttatctatgttgtgaggttaggctgagtttaatctattgactcactactatttgaaggaacatcctttatcgaaatgcagtggtacctttagtgtaaacctatttctggactctatactgttccatttgcctgtttatccttatgccaataccacactgaattactgtagcttatatttagtgttgatacctggtagttttaagtcctctagttttattgttcttcaagattgctttgggtattctagtcctttgtactttcagatgaattttagaatctactttctaatttctacaaagaaacctgctgagattttgattagaactgcattcaacttatggataaatttgggaagaactgacaccttaatattgaatcttccaagtcatgaacatggtacagttttccctttaggcatttttccatttttcttagcagtatttgtatttcagtgtagaagtcataaacatctttcactagatttgttcctaggtattttaggtatttttatgctattgtaaatggcatttaaatattttctaattgtgtgtgtaaagaaaaataactagtatttgttacttgacttcgtacttagaaattttaaaaattcatattaattttaatagtttgataggtttgacttttatgcatgcacagtgacatctgtgaataattttaaattcctgtctactctttatgtccatttctttattcttaaaactttttttaggctcagaggtacatgtgcaggtttgttttataggtaaatagattatttcatcacccaggtactaagcctagtacccaagttattttttctgatcctctccttcctcccatgctccagtctcaagtaggccccagtatctgttgctcccctttgtgtccatgtgttctcatcatttagctcccacttatgacaatgaaaacatgcagtattcggttttccttttttgtgttagtttgctaaggataatggcctcttgctccatccatgtacctggcaaaggacattatctcattcttttttatggctatatagtattccatggtgtatatataccgcattttctttatccaatcttccattgatgggcatttaggttgattccatgtctttgctattgtgaatagtgttgcaatgaacatatgcatgtgtctttatggcagaaagatttatattcctttgagtatatttacccagtaatgggattgctgggtccaatggtagttgtttctagctctttgaggaattaccacactgctttccacaatggttgaactaatttacactcccaccaacagtgtatcaaagtattcccttttctccacaacctcgccagaatctgctatttttttattttttaatagccattctgactggtgtaagatggtatctcattgtggttttgatttgcatttctctaatgatcagtgacattgagctttatttcatatgcttgttggtcacatgtatgtcttttgaaaatgatctgttcatttcctttgcccacttttgatggggttgtttttatcctgtaaatttaagttctttatagatgctagatagacctttgtcagatgcagatgcatagcttctaaatatcttctcccattctgtaggttatctgtctactctgttgacagtttcttttgctgtgcagaagctcttaagtttaattagaacccatttatcaacttttgcttttgtcgtgattgcttttggcatcttcatcatgaaatctttgccagttcctatgtcctgaatggtattgcctaggttgtcctccagtgtttttatagttttggattttacatttaagtctttaatccttcttgagttgacttttgcatatggtgtaaggaagaggtctagtttcaatcttctgcatatggctagctgtttatcccagcaccatttaatgaatggggtgtcctttttcccattgcttgtttttgtcagctttgttgaagatcagatgattgtagctgtgaggccttaattctggttactctattctgttccattgatttatgtgtttgtttttgtatcaatatcatgctgttttggttattgttgctctatagtatagttttaagtcaggtagcatgatgactccacgttttttgttgttgttgtttggcataggattgctgtggctatttggactcttttttggttccacatgaattttaaaagtttttttctagttccatgaagaatgccattggtagtgtgatagaaatagcactgaatcaataaattgcttttgacagtatggccattttaatgatattgattcttcctatccatgagcatggaaagttttgccatttatttgtatcatctctgatttgtctaagcagtgttttataattatcattgtagagatcattcacccacatttagctgtattcctaggtattttattttgtgcaattgtgaatgggattgcattcctgatttggctctcagcttggctgttggtgtacaggaatgctagtgatttttgtacattgagtttgtatcttgaaactttgctaaagttatcagctgaaggagctttttggattgagactatgggggtttcctaaacataaaaccatgtcgactgcaaacatgaatagtttcacttcctctcctcctacttggatgccctttatttctttctttctcttgcctaactactctggccaggacttttaatactatgttgaatgggagtggtgagagagggtataattgtcttgtgctggttttcaaagagaatgcttccatattttgcccattcagtatgatgttagctgtgggtttgtcacagatggctctcacattttgtagtatgttccttcaatacttagtttattgagtttttaatagaaagggatggtgaattttatcaaaagccttttctacatctattgagataaccatgtggtttttgtctttagtcctgtttatgtgatgaatcacatttattgatttgcacatgttgaatcaaccttgcatcccaaagataaaacctacataatcatggtagattaggtttttgatgtgctactggattcggtttgtaagcattttgttaaggatttctgcatcaatattcgtcaaagatattggcctaaagttttcattgttgtgtctctgccaggttttgttatcaggacaatgctggcttcacagaatgatttgggaaggatttcctgctcctctattttttgttaacagtttcaggagaagcagtaccagctcttctttgaacatttggtagcatgtggctgtgaatccatctggccctgggctttttttggttggcaggtatttactactgcctcaatttcagaactcattattggtctgtacaggaaatcaacttcttcctggttctatcttgggaaggtgtatgtgtccagaaatttatctgtctcttctagctttgttagtttgtatgcagaaaggtgtttatagttgtctgtgacggttgtttgtatttctgtggggtcagtggtaacatcccctctgtcatttctaattgtgtttatttggatcttctcatttttcttcattaggctaactagtggcctaacaattttttcaaaaacgcaactcccgtattagttaatcttttgaatggctgttcatgttttgatctccttctgttcagctctaatgctagctttgggttggttttctcttggtcctctcattgttttagttgtgctgctaggttgctgatatcttttttaactgtttgatgtgggcatttggtgctataaatttccctcataacattgccttagctgtgtcccagagattctggtatgttgtatcttttttctcttagtttcaaataacttctcgatttctgccttaatttcattctttactcaaaagtcattcaggagcaggttaacttccatgtaaatggttttgagcaattatatttttagtcttgatttcaatttttattgtgctgtgtgtttggtatttcagttcttttgcatttgctgaggattgttttatgtctgattgtgtggtcaatttcagagtatgtgccatgcagcaatgagaagaatgtatattcctgttgtttttggatgtagagttctgtagaggtctatcagatctatctggtccaatgttaagttcacgtcctgaatatctttgttaactttcttcctcaaggatttaatactgtcagtggaatgtggaagtctcccactgttattgtgtgggagtataaatctctttgtaggtctctaagaacttgctttatgaatccgggtgctcctatgttgggtgcatatatatttaggatagttacgtcttcttattgaattgaaccctttaccattatgtaaacccgtgtcttttttgatttttgttggtttaaaatgttttgtctgaaactaggattgcaaccctggcatttttctgatttccatttgcttggcagatgttcctccatccatttattttgagcctatgggtgtcattgcatataagatgggtctcttgaagacagcatatcactgggtcttgcttttttatccagcttgccactctgtgccttttaaatgggggcacttagcccatttatattcaaggtcagtattaatatgtgtggatttgatcctgtcattgtgttgttagctggttattaggctggcttgtgtggttgctttatagtgtggctcatctgtgtacttaagtgtgtttctgtattggctggtaaccatcttttttttttaatgctctctctcagcagaatcatggtaaccatctttctatatttagtgttcctgtcaagatctcttgtgagatgggtctccatttaacaagcatttgcttatctaaaactccctcagtatttgcttatctaaaaaggatcttatttctcctttgtcgaggaaggttagtttggctggatatgaaattcttggttgaagatttttttaagaatgttgactataggtccccagtctctcctggcttgaagggctcctgctgagaagtcagctgttatcctgagggggtttcctttgtaggtgacctgccctttttctccaagtgcctttaatattctttcattttgaccttggaaaatctgatgattatgtgtcttggggattatcttcctgtgtagaattttgttctctatagttcctgttggtctctctagtgaggctgaggaagttttcttggacaatatcctgaaatatgtttcctaagttgtttgctttctccccaaccctttcagggatgccagtgatttgtagatttggtctctttacataatctcatatttcttggaggttttgttcattcttttctattcttcttttttatttttgtctgactgtcttactccaaagagccagtattcaagttctgaaattattcagcttggtctctctcttctgctgttaatacttgtgattgcattgtgacattcttgtgtttttcagctctatcagatcagttaggttcttttttatactggctatttcatctgtcagtgcctgtatcgttttattgtgattcttagattccttggattgggttttgccattctcctgaatcttgattatcttcatgcctattcatattctgaattctatttgtgtcacttcagccaactcagcctggttaagaacccttgttggagaactagtggccatttgacactccgaccatctgtgttgctagagttcttccgttgattccttctgtctgatggttccatctctgcgtgggggtgttcctttaactgctgggctgcctctgattgaagtggtcaggcaagctcagggtagttgtgctacagttccaggttgggtgaccctgcccagggaggagaagtgaggactgggacttgcatagagaacagtctggccacttttctgaggtaggtgctttgtgttgggcatccgtaccagcccctggtccccacagactctccagaacctggagacagtaagagtgagggctacaagacagcaaagatggcaacccatccctcccactaggagctctgtcccagacagtaacagagctgctactggctggatggccctggtggggatggctggagattcaggttgggaggacgtgctcagtgaggagatatagaatcaaggacccaaataacagtctggccacttttccatagggctgctacagtatgctgggggtccgctccaatcccttttcatcttaaattttccagtacctgaagatatcaacaaggaagtctgtgaaacagcaaagatggaggactgccttctctctgggaactctgtcccagggaggcacggacctgttgctggcagaacacactaacaggaggtggctagagacctcggttgggagatcctacctagtgaggagtaacaggatcagggacccacatacaaaagccgtctagctttttccatagggtagccatgctttgctaggggtccactccagccgctaatcacctcagactctctaaagcctgaagacaacagctaaggctgctaaacagcagaagtggtggtccacccctctctttgggagctctgttccagggaggtttgaaactgttgctagccaaaaaacactggtgcaggtggctggaaaccctggtcaaaaggtcctgtccactgaggaggaatgggattagggattcaagtaaaaaagcagtctggccactttttcatagagcagttgtgctgtgagggggtacctcgagaacagttgcttcagactctccaaatcccaaaggcaaagagataaggctgcaaaacagcaaagctggcaccctgcccctctctctgggagagccattccagggaggtttgaaactgctgctggccagaaaacactggttggggtatggttgtagacctcagtcgggagatcccacccagtgaggagaaatgagatccaggagccacatgaggaagcagcctgaccacttctccttagagctgctgctctgtaccaggggatcactccagtccctaaccaactcagactccctagagcccaaaggcaacaatggctaagaatgtgaaacatcaaagatgacagccccatccctccccctgggaactctgtcccagggtggcttggaaccactgccagctggaaaacaccaacaagggtgactagtgaccctggtcgggaggtcccccacccattgaaaagcagggtctgggacctgcataaaaaagcagtctggatgcttttccatagggtggctgcaatgaaggcaatagctaaggctacaaaacagcaaagatggcagcccacccctccctctgggagctccatctcagagaggtgtaacactgctaccagtggctggctagagttccaagccagtgggtcttatcctgcaaggtgccatggtagtggggcctgcagactgtcactgctctatcccctgtatacagcctctttcctaggggtatgtacaggggtctaacgtcctgcttggctggagttgcagttgcttttgatgggaaacctgggtatctaaagctcccagggctctacgtgtatctgagcggctgcattgctgagactccacataattctgtgtaacaggctgcagaccctggtggagtgggctcacaaggggatctcctgacctgtgggttgcaaagatccaagggagaagcgtgggtcgctggggtcactcactcactcaccacttccctgggaagaggaggctcctctggctctgtgtcactcccaagtggatgactgtcctgattgctcttctccattctttctgggtcaagttgttttcttgatgaatcccaatgcgtgtacctggatgcttcagttgaaggtgctgtatttacttactccttctatttctctccatgaaagtggcacacaccagctgcttctagttggccatcttgaccagcctccccctccatttctttttcttgccttattacactaactagaacctccgataaaatattaaacaaaatggtgatagtagacatctgttcctgaccttgggtaagtaaggggaagcagtcaatatttttaatcagtaagtatgatgttagctgcagaatttttatagataccatttataagattgaaaattcccttctgttcccagtttggcaaaagtttttatcatgaatgggtactgaatgttgtcaaattatgtttcacactagagatcacaatagttttccttctttgttctgttagggtgttgaattacactgaacaattttgcatgttaagccacctatattcccagaataaaacctaaatgctcatgctatattatcatttttctatatcactaaattcagtttgctaatatttaagatttttacatgtttataatgcaatttttcttatattgattctatcaggttctaatctcataagtggagatgtgtttcctccttttctatcatctggaagagtttgcgttaagattagtattaattcttccttaagtatttggaataatttaccagtgaagccaaatgaggcatttctttgtggaaggtttttaactaaagatttcatttcattaatagatacaggactatccaaatgacctaattcttcttgtattaggtttaagatgttcttaaagaaatgtattcatttattctaaattgcatgattaattagcataatagtttttatactattccttttgttttaatatctatatgcagatagttaatatctatagatagatatcccttttttcattcactacattgttcatttgtggctctaatctcatctcatctactttgtggggagtctgaggacaatcagtcttgccaaggctttatcaatttcgtaatctttttaaaaccaactcttggcatttctattttcctcactgtacatcttctgtctctgtcactgatttgtgctcatctcttgatgatggtgatgttgtttgctattaaatctatccattgagttaattattgttattgtatttttttagttctaaactcatcttttttagtgctgatctgtaacctggacaactaaaacatggtttccctgactcctattctgcccctctacacaacagccagagattcttcaaaaatgtaattcagatatcacttctcaattcaaaaacctccagtgtgttcctaccttaactgagaataaaagctgaagtcatggcataaatttggcctcctactatacctctttctattctagctccctgggcctcctgtgttccctcaacataccaagcagattcctgcctctcttgtacttgctattccctctggaacacccttaccttacatataacaacatggcatcctccctcctttccttcagtctctgctcaaatgttaccttaccagagaagccttgcctgaccacctacataaaacagcaccccctactcctgtcaattttctctcccttttttttttttgagatggagtcttgctgtgctgcccaggctggaatgtgctgccaccatctccgctcactgcaacctctgcctccagggttcaagcaattctccctgccttagccccctgactagctgggattacaggcacccgccaccatgcccggctaatttttgtagttttagtagagatggggtttccccatgttggccaggctggtctcaaactcctgacctcaggtgatctgtccgccttggcctcccaaagtgctgggattacaggcgtgagtcaccgcacccagcctactcctgtcaattttcctcttagtactcacctccacctgatagtatttctttctttattctatgtctcctaacaaactacaatgtaaactccatggtgcagggtctttgtttacttctgtattccagtgaatgagtaagtacctgatacataatagatgcttaacagatatgttgagtaaattggataaatgaatacagataaacctcgtagggaagacagtctgaccaaggatgttagtaataggaatgaaaagaaatatggggtgggggaaaatttgagaggcatcataaaggaagaattcataggctttatgagttcttattttaggttgaataatgtctcccaaaaattcatgggcacccagaatgtgactgtggtataagaagaaatatatttggtctttgtacccagatcctggtacaaagctgctaagacctatggaattgtataagtgataggagtggtttttgtataattcttagcaagtccccttcaatcatacctgagttgatgttaatgaggtaacttagagttgaggtccctagatagcctaaggatgggggctggtcaccagaaagaccaagtgattagatggtgaatgctttcaggttcactcccctgacccgtaagaaggggagggggctggaaactcttcaacaatgagattttgagagcttccgggctggtgaccacattgacttgctgggagggtggctcacacagagagggcatggaggctctgcaccacaatccccgacccccaacaccttgcccaatgcatttctcccatttggctattcctgacttttatcctttacaataaactggtaaatatagtgttttcctgaattttgtgagccattctagcaaattatcaaactggaggagggggtcatgggaacccctaagttagtcagtcagaatataggtgactcagacttgcaactggtgtctgcagttggggcagtcttgtgggactgagccgtttaacttgtgggatctgactctaactccaggtagatagtttcagaattgaatttttggacacctggttggtatccagagaacaaagaaatgattgctggtattggaaaacaccctagagtaaccttatttggaaatagggtctacaaatgtaatcaagttaagatgaagttagattggattcgagtgggccctaaatccactatgactggtgtccttacataacaggagtgaaatctggacacagagctacagatacacagggagaccatcatgtaaagacaaggcagagaccagagtgatgtgcctgtctaaaacccaagaactccaaggattaccagcaactaccagaagctacacaaggggcatgaaaaaagatcctcctccagagccttttgaagaaggatgctcctgctggcactctgactgtagatttctaggctccagaactgtgagagaataagcttttgttgttttaagccacaaggtttgtggtaatttgtcatagcagccctaggaaactaatatagtgcctgactaaatttggagataaggcagacctcaggatgaatcacaggtttgaagcctaagtgactggaagaataacttctactgaaagaaatgcaaagtccagaggtaaaattagtggaaaggaatgattctaatttttacttgagtggtccaacacaatcacaggatagtcaaatcgatgccttagtgttataaacaatatgacacaaaggactaatagaacaattaaaacaatatagatataagaattaaggctgggattccccttttaccaccctctagtcaaatccaattaactttttttcaatgatcatgttaatgaccatttatctttgataactttctttacctttggttcccataacatcacaatatagcttctacctctgttcaccaccacacctagctcctcgttctaagtaaacttagtattcttcagtgatctgcaaaatcctgagtttctaattatatttctctaatttgaattattcatctctgtacttcacattctattatttctagttacctatataatatctttacttaagagtctacgtcatgtctacatggatgcactgccatcatttcctatctgacatgtgttttttatctttctactcaactgacattcttcaatccattatcataactccacttacatcttctcacagctaaaatacttcatagttttctttcttatttaccaatatattctgcaattattttttcctttggaatacctctggcagtcacgctttaccttcattcctatattccaagccccaattctagacttcttacctcactttaagtttactataacagcttcctaactggtctccttgtcttcagacttttgtctgtctagcacagtggttctcaaactttagagtccacataaatcacccaggagtgactagtgggattatttaggtgtttcttgcatgttatcttatttctccagcaagattatatagttatcaaagccaaggagtaatcatggcttctatttctccccagtgtatagtgtaatctaggccacacaacatattcaatcagatattttgcaacttcaagactatgattcatctcttttttgaaaacattcataatagtatctgaccaagaattatttcagagacgtataccttagaataaaattaacaagttgtcatttcaggttcctcaagaaaaaagaaaaaaacccaactcactgtgttcacttcaagagatctctcttcaatgggggtggggggaatacactctctctgtatgtatcagtcacagaagggcatcccaactcaagatcctgttcaagcttttccaaacaaatcaacacaacaaaacatcatttacaccaaagactacttaaaaacagcagaaatgacaatctctgtgctcaggagcttggagctctgagtaaacacagacggcagcgagccatcttacccagcctcagggaaaaaagaacttttcacaggaaagcaactccaaaggattatttctgcactgggttcataatttgtgacttttgttacatcttacggcaaaaaatgctatgacttttggcattaaagaatctaagaagtctgttgcactcttatgaattatatttatgtaatctgatagccaaaatggtcaaatagaagcattatctttaacttgaatgggaaaagggtatgagttaaattaatttacagtgattattctgacataagaaacgactcatatggaccatagctatattaagcgaaaagttgtaaagtatttggaatcaaggaaagtaggaaattaaagcctaacagcgcagtggaaagagcaccagactgagaacagaaacatgtagattttagtcaacttttgattcttactagttaagtaatcttgggtacctcctactttaggttgctaacttgtaaaagctatttgaatgctaagatcccttccagtcctaaaattatacatacttatatactttttaattgtatttctaagttacacatgatgtttttctattttaattgatgtaaacttgtaagctcctagggcagtgtcccacatagtaggacaattctaggtcataatcattcactgaattgaccttaacaatttcactatgacttaaatcacaatccatagatcacattttaaaaagtaaaatgactatctactatcttcacactcatcatctggtagacatttcagtagaaaaaaaaattcatcctgtcacaatactaatgaaatgttactttgtagtgttttggggtttttttgtttaattattatttttttttgagatagggtcttgctgtgtcatccaggctggagggcagtggtgccatcacagctctttgcaatcttgaactcctgggctcaagcaatcctcccacctcagccttccaagtagctgggactacaagcatgtgccaccatgcacagttttttcatgttttatagagatggggtctggctatattttgtagatttttaaaaatataacctcctccactccttctggtatacttatgattagctgataatctcaccactgggtgtcacttttgcttcaaaagaattcaacccaaactaaccttaataattagaatttgatctgtaagatacttattcctaaagcctcaaaatttagctcttaaaatttcttgctgtaacacggcttcagatgtttctaggcttcaaacacagtgcaaacaaaaatcagtaggatttctgagttcataggtcataaaacaatcctctgaaatcccattaatattcatacacttttcagtacctacatcgacagaaaggaagaaaagtgacatatacagaaaaacaaacaagtgtgcatatttgggtataaaacactgggatccctatataataaatgctgtttttccaataatactacttctagcattatgagaagataaaagtaatattcagagaccaagaaagtagagaaggaatgacttttagactactcatgttgtcactccaaccatcagcaacatttggcagtgatatccaattacataaaaaggggtctaggaactgctgtgtggttttcaaattcagaataactgaacgatctacagttattttctcttatccaaatataaacagttaacctttccaataaacagatattaagataatggttcctgcacctagaagcattttcctctcacctcagatcttctctcctctccacaacaaatgctactattaggggaatttatcaaatgaagacaactcaaatcatttgtgggactttacatataacacgcacacacacacacacacactttatcatgtccctcctcttcctctaatcctgttgaaaagattaccatgtccttcccctcccttaatcaccaccataagtcatggttactaatgggacctgttatattattcttgggtttgctgaaatagaaaaaagttgtaagtcactgatttagaagatccatctagatacattatttccatgatgccctggattgtttccaagaaaacaaagttaggttctggagaaaagtatgcctgcaaaggtaaaacttaaaaaggatcacaatgctgtgggaactcctgtggcagtttcagaaaccaagggagtcccatttcctcctgctggagcaaagaaatacttgctcttgtatttctgaattggaaacaaaaaagccttttaaccacaaaagcaataaaacagatattaggtataaatgaaacaagcttaatcacactataatttaactggagaatgtgttaaatatgacttccatgggatggcctggaaactatcactctgaaaaacaccttctgtatggaaaaatgcatgtcagctcaaaacaactgacttacatacaaaatttagaaacaaacctgctggacagtttggattttcccaatttatttctgcaaggttgacagcaaaatgtcatgcttatatatcaaattaaacatatcactaaaatctcagattcaactatatactttattctcctataagagtttattaggatggacgcggtagctcacacctcttaatcccagcactttgggaggctgaggtgggaggatcacttgaggtcaggagtttgagaccagtctggcaaacatgggaaaccctgtctctactaaaaatacaaaaattagtcgggtgtggtggcatgtgcctataattccagctactcgaaaggctgaggtatgagaatcgcttgaacccaggggatggaggttgcagtgagccaagattgcaccactgcaatccaacctgggtgatgggagtcagactctcagaaaaaaaaaaaaaaaaaaaaaaaaaaagatttaattatattttactccatagaaatcaccttttttcctttttttttttttttttttttttttttgcgacagagtcttgctctgtcacccaggctggagtgcagtggcacgatctcggctcactataagctctgcctcccgggttcatgccattctcctgtctcagcctcccgagtagctggggctacaggcgcccgccactatgcctggctaatttttttgtattttttcagtagagatggggtttcactgtgttagccaggatggtctcaatgatctcctgacctcgtgatccacctgcctccgcctcccaaagtgctgggattacaggtgtgagccaccatgcctggccagagatcactttaataagaaccacttgcctttttctgggcaattgcagctcgctgcagtttctccttagcttgattgtacttttcttctctgtctgtgatacgctcatgaagcttatgcttttcttccaaccactgtatctgtttctcttccaatgtcctgtcagaagaatgtatgtaaaacatggaagttaaataagttcttaggattaaatagatattatcacaagtataagcaaactcactacctgtctgaccacattcttaattatccaactgcaggccctcctgtatggccacttgtttggaaatcccaccattactgagcacttcctatgaataaggcactggacttagaaaactatgtgttctttacaaaaatcctgagttaggtatttctgtcacctttatacttctgtccattttataaatgaggaaactgaggattagagcagttaacgaacttaagggctcacatctagttaatggcaagacaaacacttgataaccagatgtgaagtataataaccatcaaactacaaatatctgtcctcataaatttggtttaagaaaatcaagcctggtatcaaatcttaatgcagtatgtcttctgactagagtaaaatgcatataaatgatatcttaaaataacatcataacaacttatatttttaaagctattctgcatactttatatgatttttttagtattcttactataggcagtactaatgaaaataacaaaccctgagaagttagattacttgcctaaggtcatacaagattttaagtatcttagctggaactaaaatcacattccattgacccttagttcagctattttcttctatgaaattctatgaatattatttagaaaccaatgattaattacttaaatttgctagctatactgtcattagaattattaagctcatttcaatcaaacacttgagaaatccaagcacatgtttctgttttttacaaaataaaagaaaaataagttggatcaactgaaatgtcacatgctatggacatttatcttgcttacttccttttcttgaaattcaaccccatataaaaaagcatggacaaacctttgaatatgtaataatagaaaaactgaagaaatacagttttatgtggcatggtggccttcagaagaagaaatttgaaaagaataatgttttgtagattaaaataaaaacttacttacaaggccaacatgttataaagacaaagcaaatacaaaatagtacagtgttctaccacatctaaacaaatttttccagaggatataagatcttgaacatcaccacaatcattttatccctaccagttttactccatactgtctactagtaacaaattttaagaccaaaaaaaaaaaaaaaaaaaacaaataaattagcttttcaaagaaaatccaagatagttctaattcaaggaattaagttttgcacatcaaaaacaaaacaaaaaacccattctgttctctggcattcagaagaatagatttttgaagaaatgttttggtttaatcaatgaataaaaaaagttttctttgaggtttttcagaatactatactgtcagaattttaatgtcttaatttttttaaaaacaattcaagagtcagtatagttcattctataaaaacataaagtacattattacctcagtagaccattgtacactattaaagtgtatttgtaactagtttctaaaatataatcaacattggaatcattactaaaataagtacatgttatatagaaaaaagaaaaaatagtttgtacataaagagcaaactctacttttcagcttctagttgcgctttttcagcttggcttctaaaatttcggcattcttgttttaatctctccaccatttccttcagcatttggtttgaattcagcaagtcattctctgactgtgcaagtgaagtcacttggatctgcaaactactgatttgcttaaaagagaagaaagaagataaattaaagcccactaaataaatgcggtaaggtatgagagaagcagaagatactaagcatctccctttgcaaatgctccctcaagctggtgtgtccttggagatgacccctaaaggaaataacaaatagcagcacccaggagcatttcttattataatcagagactatcaagaactatattcctcagtcactgagtcccctccctcttctttccaaaatatgcaggccaggagaggtattgggaatggagagaagggttatcagggggattagcagtgagatgagaaaagggaatccagtgattagagtgagtctcctaccactctagccttctcctcacctcctaggaaaaaaaactgattttaaaagcaagtcagctgggaaagcagctaaaaaaaaaaatccatcctcctcttcccacataccctgagatcagcaaccttccagaagttctactctccgagcaatcaaaattgttcagtgtaaatgtgggaaggatcactcctcacattgtttttaaaaggtttccaaaccttctgtatgtccagtgctgggcagaagaaagatgctctgggaaatctaataaatgctatagattccttggcctctacagccatttaccaaactacataatgtcactcacagcttttttttccatcccaatttacctttatctgggagtactttttctcataagaagtctagttacagattaacaggctagaaagattcacactcttctaaattatatccaaatctctttatttgggacagttacacatacctcccccacaagctattttaccaattagtaaacaataaaagtccttattttcctttcacttccttttatctctcttagccattttctgaagacatttcaaagcaaagacagtcaagagacagggatcaaaagaacctattatgagattcaagggtaaaaagaaacaagattcttatataataaacaaaataaatgggtaataatctcattacttcctaatggtaacaaaacaattcagataggattctgaaggtccacagagcaatttttagcagaataaaactaaacggtatgtctcagatttctattttagaataaatttatccatgtagaactattcactctttatttttaactggagtggcaaatattaaatctgtattacagctgcttgaataagcaaccttcaaagagcttaatacctctccatatgcatagcatgacagaaagcccaaatgccaatgatactaaataacttctgagtatcaaacgttatgtccatctagttaagacttagaaaccataactgcacatgaaaagcagtaccaactcgcatatgagcatgaattctaaaaatggaatcctacttcataatttatagggaaaaaaacaacaacaaaaaagaaaatagaattcagaaaagatcactcttccatgttttacccaactttatacaaatctttcctgaacccaaataactttaattataaacacaaatttccttccataaatacaaatcttggatttcatagggatatagcaaaaaatacctcatgatataaagttacaagtcaatcacacaagtaacttaaaacctggatgatatttctattgagtttttaaaattctgaatattaaaatactgtccttataactgtaattaaaaattatcatgggccacagcatttaataaataaatatatatatcttaagaataatagcagttagccaaagaagcttattaaagtatagaagtttaaacattttaaaacattttatctttacatatcacctccaacaatatgttaccaattgtggttagattctaaaaatactgatggcaaaatttttttaaaatttgcaaaacataaatttaaagaagcacttgaaaaaataaaaggaaaatcttcgctaaaatcatacctgttttaggtcagaattttcatttttttccttctctgcattttcaatagtcacaatttgttgctgaagttttaacctaaaaatcacaacccaacaaaaggcattattaagaatccatgattcatttatttcactgaattaaagagtcattttattgaatgcctgtttgacaccagagcacaaacacaaccaaagattgagacttcaagaaactaggttgtgttcacgtataacaaaaatgtaaaacaaattactgctattgtgataggaaaatctacaaactaggggcatagagaggataagaaatcaagtctgtccaggggtactggggaacgctacatggataaaaacctgacaggtaggattttgatatacataaacaacagcctgaaaaagtggcctttcatggaaaattatagaatgtgttgctaaggtatcagaaagtagtctagtttaggagaggccaacttacatccatatagtattttacaatttgcaaaattctttcagacacacgctacttcattttccttctaacaaggctacagatttaaaagaaaactaatacaacacaccatcctgtattctataaaatatcttatggagcttttcatccctgagatgaatgaatacttacacatttgcagactcttcaaagggaataatacatctacagccagagccttaaaaagcagagcagctctagtgaccaaatgagtaacctcatgaggaagacattacactaattaggtttggcaggataggcccttcagcctcctccctttcaaaactcttcaaacgcctatctcaaatataattcacttggcacctatttatagcttggtattattagcatgtcttatctgcccaagtagaatgtgtttatctagacaacactctcaagaccctaggtctgtgctttaaacacaataaggactcaataaacatttgttggcagactgaacgaaccaacccaaatcatggattagctgtttaaatgtgtgagatgattggataatataacataaaaaacctgaagatatgacccattgcttcctgagacgtttacatacaaatgccagaaacgataaatctaaagagggccagtccttttccttttgctccaccgtcagtaccagtcacattcttatttcataattctagctacatgattactcattcaaactttctgtgcacttcctccattaaatgtttatgaatgttatcaactgggtgccttctttttttttttttaaataagagatgtggtctcactatattgcctaggctgggctcaaactctttggcttaagcaatcctcctgcctcagcctctcaggtagcagggtggctaacttggggcttttaggttactgacttataaaggtttctttccacaaaatcatgaagatgaaaatggaacagagaacactgtgggtcccagctcaggtccacagttagaaaacttaggccctaagtatatcctagctccagttgagaatctggatacaattggtaaattaacaagaaacatgacccagttaagaaagttatggcctaatgctttctatataggttacacagacatgaagagaaacaatagtgccctacatacaaaagctgaagccaaagaaaccaatggtagagtatctgaaaattcattaaaatatgaaaggatggggaaaacaactaaatgaaaatatgaactaagtaagagcaccattgtggtagactatagaagatgatatacaacaagaccttccttcaggtcattttgttgaagcagtactgggttagaatctaaaactcatttttttttggagaaaattagtccatgatttaagatcattacatttaggattctatgggataatgaatcttaagataaataagataggaataagactaatggtattaaagttcaaaaaggcagatagtttcaaaagacagtgctgtaaatttaggagtaaagtacagtatctctttttattaggttttgaatactcaaggtgtgtcacagtaagtcaaaagaaaatataccttataacagacgtacaaggaacagaaaaaactgcaattaactttcattagaggataagttaaggctacataaaagagatgcaatttgaactagatcttgaaggaaaaataagagtccgagatagagaaattaaagatacaggtgacgaagagtatagaggaagtagagagatgggattaaaagcactgttcacttaagaagtaaaggggaaaaggacattttcaaaatagaaagggaggagagaatggatgaaggtaccggaattataagatggcaagaagttgagaaaattcatatccttagcttatgtacaagtaagaacatcgaacagtttccaagctgaaaaggaagcaagggagccaggttaataggctggaagaaaaagagaagtccaaagactgctaatttcagtatcttcagtgacaggagcatggataagagaaagaaaagatatttatgtctttgaagtgatcagttctaggtgacgacaaggtccaagaagcgtctaggtgtacaagatgctaaagtagaataaagataaaagaatgccagagtgcagatagaataaactgtaaggctaaggtgttgggtagttcaacaatatgaatacatagtcaccaagaatgatggtaagagaaacagaaaacagaaaaaagttgagccagatatcaaagtcctcagcgactgttaaggaatacactgtaggtcattaactgcaagagataaaagacaggtataaaactggatgccacaaatatcaaagaaaaaaatcactttaaccatactcaaacaatgaactggaagcacaaacggggcttacaaatgctcatttctcttcttggtctcttgttgcaggagagaggaaggaaaagtaatttctacttaaaaggcattccaggttatatgccatgagaggaagaaagcagttttcagcagggggagaggcattaaaaaaatgttgagattgcaaaaaaagttattggtatcagaatagggattccagaggctacagtggaaactgttaaaagttttaatgagtaggtgatagggagaaatcagagggtgaaggatgagtaagttgggggaaaagttaactatgagatcaagtactttatacttttgaagtaattatgaaggcagaaatagtaggtgaactggagggccaagttacaacagaaaatgtagctataaataagtttaaatggaaactttggaataacattaagatggaactatttcaagttcccttcaaagtatagggaagtcaaccgtaaggatcatggtctaggtcttctgtggcaggcagctgatatactgatatatactatttctttttttttttttctttttttagagatggagtttcactcttgttgcccaggctggagtgcaatggtgtgatctcagctcaccgcaacctccgcctcctgggttcaagtgattctcctgcctcagcctctcaagtagctgggattacaggcatccaccaccacgcccggctaattttttgtatttttagtagagacggagtttctccatgttgggcaggctggtcttgaactcccgacctcaggtaatctgcccgccttggcctcccaatatatgctatttcgacattcaacaaatatttattgagtacctatacatgctaagcccattctaagtgttgtggatacatcagaaaataacaaggacagaatgcctacccttgagtttatactccaacagtgttgtctgatagaactttctttgatggtggaaatattctacaatctgtgccttccaatatgatagtcactagcaacatgttgctagtgcacacttgaaatgtacttcatgtgactgaagaaactgaattttaattttttaaaattctaatttaaatttaggtttcaacagtcatctgtgactagtaatatcatattgggcagcaaaggctctaatgtaacttcttggcttcatttaatgtgagtccctgctatcaaagggaagcaacatacagggcaaacaatagaagttgtatttttctactgtgatttctctactgtcaaagagtcctacaagtctcatgagaatggcagtagccttcttataccaaccttctgaaagcatggttcttgcttgtgagcactggaaattgacactggccattattagcaaaaataaactttcctgaaagaatataagaacccactcaaaagagaactagaaaactgaaaccaggatacaataattgataggaatcacaggcaaagacatgccacagccctgcctggtccttcaaacattgacacatatcctttcatcccttacttcacagtttaaattcttgggagaaaatgtgtccaatgggccaatataattcttttcaagatggagtctaagtagaaaggtggatatattaaatgatagttttttggtttgtttttaaaaaagcaaatatccaacactggcagcaaagaaatccaaactgatgaaatgtaaacgttcattaaaagctcaagaaaaaaacagaaagccccaaatgggaaataagagccctggctttaagccatgcaaaaaataaattaagggggtattgactacaggatatcataaatgttcagcttccctttcccttggttattgctattccccttggttatttgctattatatcaaactgcatatcatttacttcctcctccttcacccactccacacagagacatgggcatataaccttggctgagccagagtgcctgataccacggtcgcagtggtaggtccagggatgagcatgtgaactagacccaaacttgtctctagattttttttttttttttttaagacagagtctcactctgtcacccaggctggagtgcagtggcacaatcttggctcactgtaacctccgcctcccaggttcacgcaattctcctgcctcagcctcctgagtagctgggactataggtggctgccaccacaccccactaatttttgtattttcagtagagatggggtttaaccaagttggccaggctggtctcaaatgcctgacctcaggtgttccacccgcctcggcctcccaaagtgctgggatcacaggcgtgagccaccacgcccagcctcgactctagactttttaaacttgagtttgctaacaagaactttgtcctcttggcttcaacatatgttcccagcatcacagagataggacagcagacaaacgagagagataataagagaggagagagaaaataagagaggaggaataaaagaaaaggaggagaaaagtcactattatctaattgcatttgagttcctagatccaggtgtccctgaaaccagcaaaacccttatctttcccacaattgtgtaaaccaagaaagtcccttttgtttgcttgcattagttggagttgcgttgctgtcataaccaaaagttgactacatattctattatatttaaactcctttaatttttacatggttttaatttgcaaattgaataaatgtgcagcggagcagccttttgaaatacagtacttttataaaaataatttttattactcttggcactatgataagctagtggtaaaaaaaaaacactttcatcaaaagaaaagactggtatataattaataaaggatctgtcaaagcagtgattaatatgtaatagattaatatctacttatcacagatatatattatttgtaaataaatggatatttctgctttgcatgatttatactttccatttccttagtaagaccttttgcttcacagataagtctccaatctgtcacgggttatctaaataggaggtgctgcaattatgaccattttaatgaatgatcaaaatagacctggttgatgtagctggacttataaatcagtaaatcataactgtcaaggaaaaaataccacaattgttgaacattaaaaaaaaaaagccatgcaaatcgtgtgaatttaatcctgctagattttatgttggttactatgtctttattttaaaataagttgaggtcatttacacattgtaagtgaaactccagaggaatcaaagaaaaattatcaatgtgactaacagaatagaaaattattcacatttaagaaaagctaaaggaatgaaagctgttttatatagcaaaaaactaaaaaacaaaacaaaacaaaacctaagggtcaagttcattattgtgttcaagtaatgacagaatgctgaacattttatcactatggcaacagaaacccaaagcaggagaaacaggcttaaattctaacagaaaagattctaactggccaaactgtgggattatcataggataaaacattagagtaggatgcctggggagggtctacccctactttctggagactgtcaaagagagatttaaaaacgacctgtcttgaatatgtcctaaaaaatgtacccatctaaaagcaaaaggacagacaagattggttcttaaaatctattacagattcatgcttttagaatcacagccactaacaatttaaataaagttataaaacctaagtaagtaataagtatacctctgcctgaagtaattctttcctaagtaatgcagatcaagaactctgtctcaaaacatagcctaccacttaatgaacatgatttttaaaagccactcaaactttatataattagagacgtcactaagatattagaatttgaaaagcagacataaagcatttccaagtgttgaggataacagcagatgtctagctctgtgttatccatatattctgcaaaaacaatacagaaaaagcaaagagaacaaataaagccacacaaaaccatacccttagcataactggcagacagaaaatgcccaaaacctcaaagtaactaagtaaaatgaaggaaaaaataccaaatcccagcaagtgatctctcccattcccgcctgcacatctttgcaggcaagggctcactgcatgtgaatgtacttaattcgcccattaaaataaaatgtttaatttattaaaatttggcccacaaaacaagacccaactaaacgctacatataaaacacacatttaaaaagcaaaacgattcagaaaatttaaaaataagaggataaaagtataccaggcaaatggaaactatatgaaaacagaagtggtgatggtatcagacaagtcaagcaaaaaaaaaagacaaaaaaagcaatttttaatgctaaacgctacaattcacacttaaaatagaactgctatgaatatttatattctgtaccaaataccatgaaactcacctttatgaaacaaaaactacaagatatacaaagagtcacatacagaaacacagtaataataggagactttaatatatcattctttgtacaagacaaatcaagtggacaaaaaataagcaagtatacagaagacctaaacatcgcagttaacaaggcagatcctatgtgtacagacacatatgtgtgtatgtatgtctgtgtgtgtatgtatatatatatagaacttcatatatatatatatatatagaacttcatactcttataagactccatgtgtttacgtaacacaataactgacatatactatgggactaagtgactatagttctatagtcgctgggcatgtgacatgtccagaatgcgaacttaagaagacacccattctaagactcctgcaagtgcagggtcagcaccgtgagactgtcgccttaaattttttgcaccctgggtgcctcaattgctttaccctagtcctacccttgatagattaggttacaaagaaacatcagagtgttccacaaagcagaaagagtacaaacaatattgtgatcacaatgcaataaagctagaaattaacttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttttttagtagagacggggtttcaccttgttagccaggatggtctcgatctcctgacctcatgatccacccgcctcggcctcccaaagtgctgggattacaggcgtgagccaccgcgcccagccgaaattaactttttaaaaaggttctcctacctggaaattaaaaaaccttctgttatagactgaaacatgttccttcaagatatgactacatttcgagatagggcctttaaagagacaattaaggttaaagtcatatgggtgggccctaatccaatatgactagtgtccttacaaaaaggatagacaagaggggatgcaaaggcacagagaaaaggccatgtgaggacaaagtgggaagaaggtggctacctgcaagtcaagaagagaggtcttaggagaaaccaagccaggcaataccttaatctatgacttctagtctccaaaactgtaagaaaattaattcctgttgtttgatcacccagtctgtggtattttattatggcagacttagcaaactactacatcttctgttaaacaactctttggcagaaagaaaaatgcaaattaaaattagtgaatttctttaaaaataataattaaaacactatataatttatgggatacacgtaaagcagtgatgagaagaaaattattagcactaaatactcttaccaataagaatgaaagaataaactgtagtaaaattaaattctcaactcaaaaacaaccaaatgaacaaagtaaactaaaagaaagcccaaggtatacaacatgaccttagaaaactctaagaaatcaacaaagcagctattagaaaatatgtgactttagtaaagtcacaggattcaagatcaatacataaaagtaaactatatttctatatgcaacgaacaattaagaagtcaaatgaactccatttataccatatttagaaataaaattgaatcaaagatgaacatgatatatacaatgaaaactgcaacacactgatgaaagaaatgaaacctaaataaatggagagatgtatgatattcatggattggaagactcaatattgttaaggtaacaattctcctcaaattgacctaaaaatccaatacaatcccaattaaaattttaacaagaatttaaaaagataaaaaactgattaaaaaattaatatttgaaaggcaaaggacctagaaaagccaaaagaatttagacaaaaaagaaccaggtagaggacgtgcactacctgaaccaaacttactataaagctacagtaatcaaaatggtatgatactggtgtaaagacaagatcagtaaaatagaatagagtccagaaatagactcacacctgtaattcagtgagggaaaagatagtcttcaaaaaatggtgctggaacaactggatacctacatgaaaataaaaagcatatgtgtgccattaccttacaccacataaaagttaagatgaattagaccttaaaacctaaaggtaaaaaccaaatattaatcttttagaagaaaacaaatatctttttaacacagaattaggcaaagacttcttgaagagaacacaaaaaatacaaacaagaaaaaaattgataaagtggtgtagtattatgatgtatatatattggtttacatatacatatgggtttacattcatggttcctggctcgtaacttccatagcccttgtccacatttcctaagtgactaaaacaatacatgtatctttgttaccgtattaggccctttgtttatggctcgggaggcagcttcagaacagcttcagagtgataaaggcgaaagacagtctttggttataatactggggtgctctgggcctcagaaaacagaatctctctctgaccttctgtcctccttttacctgcgcctttttctctccaaggcaggccacacacactaaaaatatactccaatcttcccccatctttctgtcttggaactggtcataaaaaaatcctctgaattaccttacccgacagcaggtcataagacccgcatttctgaaggggtcctgccccttccttatccaggaggaaataatgctacacagaggggccaagaagaatctaaatgcacaggacttgttacaattctctgcacagtctattagtattagatcatgccctttttgtccaataagatttccatacgattgtccattcttcaatcatgtttatccaatgaagtctccaaaaaagactcaagaggacagggtaccgcaagcctccagacagctgaactcatggaggattacatgaaggtaaacaagaactcacccatgtgctaggagaatggcacactccaacttcacaggaacagaagctcctgagctctggacccttgagatctcaccctattatttctctttcttattgtttttttgagacggggtcttgctctgctgcccaggctggagtgcaatggccaatctcggctcactgcaacctctgcctcccaggttcaagcaagtctcctgcctcagcctcccgagtagctgggattacaggcacctgccaccacgcccaactaattttttttgtatttttagtagagacggggtttcactatgttggtcaggctggtctcaaactcctgacctcaggtgatccacccacctcagcttcccaaaatgctgggattataggcgtgggccaccgcacctggcctattatttcttcatctagctgtttatttgtatccgcagtgagctgagatcacaccattgcactccagcctgggtgacagagcgagacgccgtctcaaaaaaaaaaaaaaaatcctcttcaataacctgggaaacataaagtgtttccttaagcttgtgaaccactctagtaaatttagctgaaagagaaggttatggaaaccccaacttaaaaacctggtcgatcagaagttccagagtcctgaaagtgagactggtgtctgaaatggtggcaatcttgtgggaccaagccttcaacccgcaggatctgatgctatctccatatagagagcagtagaatcaaattagattagaagatgtcagactgctgtccactgcagaactgaatgcttgcttgttgatgggtagaaatccatacatttggtcacagaagttttctgtgttgtggtgtgaaaacacaggaaaaaacaccactcaggagttcaagaccagtctgggaaacatggagaaaccttgtctctgctaaaaatataaaacttagccaggcacggtgccatgcacctgtagtcccagctactcaggaggctgaggtgggaggatcgcttgagcccaagaggcagaggttgcagtgagctgagatggcaccacggcactccagcctgggcaacagagcaagatcctgtatcaaaaaataaacaaatatatatatatatatatacacatacacacacacacacacacatacacacacacacacatacacacacaagtaaatgaaaaggaaagtcatagataaggagaaaatatctgtaaaatatgtatctaagaaagagcttttatgcgtaacacataaataactattataaatcaataagataacttctgaatgtaaaaagtggccaaaatatttgaacagaaacttcacaaaagtagcttataagcacacaaaaagatgctaaccaccactagtcacagagacaataaaattaagaccacaggtgacatgttacaacatatccaattagaattattattaagactgaaaataacaagtgtcagtagggatgtaaaacaaacaaaatcctcatatattgctagttggaatgaaaaaacttctcaagtgtttccacattggaaaacagtatttctgtatgttataaaattaaatatatacttaacatatgacttagtaatcccatttctaggtatttaacaaggagaaataaaaacatatttccacacaaagacttgtaaatgaatgttcacagcagcattattcataatagcccccaactaaaaacaacccaacatttgtccaacaaaagaataaataaatcatattacgtttatacaatgaatactaatcagcaataaaaagacatgggctactgatacactcagagcatggataagtcacgggttgcctaatgttgggactcaggaaaggaggtcaactataaagagacataaagaaacttttggggtgatgaaactattccatatttttattatggtgaggattgtacaactgtatacaaaatggatgaattttattttaggtacattaaatgataacaataaaactatagaaactttttaagggcaaagaaccagaagataaaagcagaaattaatgagttagaaaatgggaaaccagtcgatctaataaataaaccaaaatcctaatttaaatgaatgtactgaactgtatgttttaaaatagttaaaatggtaaattttatgtatattttaccacaaaaaaaatatatatatatacacaaagcagtggctgacttgaccaagaaagaaagaaagcacacgtatagaacaaaaaataacaaaggggaaataagcattgaaacagaaaaaaaatttaaaaaaaagaggtctacttttcaaaaggaggagcatagtggccagccgtcagaagttgacaatgaccagttgagagcaatcattggagctgatcctctacaactacacaagaagctgccaaagaactcaatgtcaaccattttatggtcatttggcatttgaagcaattcggaaaggtgaaaaagctagataagtgggtgtctcatgaactgagtgaaaatttaaaatatcgtcattttgaagtgtagtcttctcttattctatgcaacaacaaactatttctcaagcagattgtgacatgcgacaaaaagtggatttcatacgactaccggcaatgaccacctcagtggctggatggagaagaagctccagagcacttcccgaagccaaacttgtgccaaaaaggctcatggtcactgtttggtggtctgctgccggtctgatctactacagctttctgaatcccagggaaaccattacatttgataagtatgctcagcaaatcgatgagatgcattgaaaactgcaatgcccgcagccggcactgatcaacagaaagggtccaattcttctctacgacaatgtccaactgtatgccacacaaccaatgcgtcaaaagtggaacgaactgcactacaaagttttgcctcatctgccatagtcacctgacctcttgccaactgactatgacttctttaagcatctcaacaactttttgcagggaaaatgcttccacaacgagcaggatgcagaaaatgctaagtgtttgtctaatcccaccaggtgtggtggctcacacttgtaatcccagcactttgggaggccgaggtgggtggatcacctgagatcaggagttcaagaccagcctggccaacatagtgaaacaccgtctctactaaaaatacaaaaattagctaggtgtggtggtgggtgcctataatcccagctactcgggaggctgaggcaggagaatcgctgaacccaggaggtggaacttgcagtgagccaagattgcgccactgcactccagcctgggtgacaagagcaagactctgtctcaaaaaaaaaaaaaaaaagaaaaaaagtttgtagaatcccgaagcatggatttttatactacaagaataaacttatttctcattggcaaaaatgtgttgactgtaatggttcctattttgattaataaagatgtgtttgagcctagttacactgatttaaaattcatggtccaaaaccacaattacttttgcaccaacctaataatacaccatattaaaagaatgaagaaaaaaatgcatgatcatctcaactgatgcagaaaaagcatttgacaaaattcaacaccctttcatgataaaacaaactaacaaactcggaatagaaggacactacctcaacataataaagccatatatgaaaaagccacagtgagtatcataagcaatggtgagagactgaaatgttttcctttaagatcaggaataaaccaagtactcccacttttgccacttccatttgacatgaaactggaagttctagccagagctattaggcaagagaaagacaatgaattcagcaaagtagctgaatacaaagccaacaaacaaaaattagctgcatctctatacactaacaatgaatactatgaaaaggaaaatgaagaaaataattccatttacaatagcatcaaaaagaatacataaaaattaactgaaccaaggaggtgaaatacttagaaaactaaaagacgctgctaacagaaattaaagaagatataaataaatggaaacacatcccatgttcataaattgaaagattcaatattgttgagatgtcaatactaccaaaaataatctacagaatcaatgcaattgctatcaaaatcccaatattttgcacagaaatagaaaaatctatcctaaaattcgtatggaatctcaaggcaacccaagtagatgaaataatcctgaagaacaaaactagagaactcatacttccttatttcaaaatttattgcaaagttataataatcaaaatagtgtgacactgacataaagaccaacatataagcaactggaatagaatacagaatgagtaaataaaccctcccatatacggtcaaatgatttttgacaagagtaccaaggtcattcaatgaagaaagggcaatgttgtcaacaaacagtgttgggaaaactggatacatacatataaaagaatgaacttggacctctctttatataggaaaattaatttaaaatagatcaaaggactaaatgtgcaacctaaaactataaactcttagaagatgggggaaaggcttcatggaatttgatttgataatgatttcttggatatgacacgaaaggcatagggcaataacaacaacaacaaaaaaaaacagacaaaatgaactccatgaaaataaatttttctgcaacaaaagatacttatcaacagagtaaaaccctacagaataggagaaaatatttgcaaatcatgtatctgataaggcattaatatccagaatatacagagaaaaactaaacaagaataaaaaataaaatttttaaatggacaaaaaacttgactagctgtttttcaaaaaagatgcatattaaaagatgctcgacatcactaatcattagaaagatgcaaatcaaaactacaatgagatacttactacctcacacctatcaggatggttactatcaaaaaaacatgaggaagacatcattaagatgactgactagaggaccaacactcttccacaaaggcccaaaataacaagtaaataactgcacttcaggtaagagtttctaagggagaacaacagaattcacatgaaagagaaaaaaaaaatccacttaatcatggagacttgagatggcagcatagagaagaaagcaaagcacccagccaggattggctcagaaccaagagagactccccattgtgtgagaaatggtaggtaggagttccttagcaatccctaataccactgtggacatgtgtaaacctagctacagaagagccctagagtcctaacaggccctgaatccggtacagggagctgcttggagtccacatggttacattgctccagagaaggaacacacactgggtccccccactccctgtgacccaagctgctacagcatggcaccattttgagaaccgagccaatgctgaaatacatgctgccatggggttcaacagacctggtatttccatatctgaagggtcccactgtaatcatgccacaatcaaataaaagggtccaacaccacaacctcagctacacagagcagtaaagccaaaactccagaacctgagctgatatagtagacctaaaggaacaagcaatctagcacagcagggaggccacctccaagaccaagggcactggtgcatgcagtccctagggtttaagaactagctgccagccactgccagcaatcccattcccataactggtgaagcagaaatgcaccccacatacctgtagggaccaatgatgggcccatatggcaacagccaccactggcaattccaccccacaactggcaaagccaccatacccaatgagcacccaacacccaaggcctgagaactgttccacctagaggcccctatcaacaccaaagacatgagattcattctacaaaaactcacagcagagaccactgaggtacttgcagacactgctgacacgaattacagccaaagatcatatggagactacattactgtactaatatagaaacaaagccaaagcaactacccaaacaatactgcaggacaaatatacaggaaaaagtccttctttacaaaagctactccataaaatagaaagagacaactattctaccagatgcacccataacatagggacacaagaaacatgaaaaaagttgggcgtggtggttcacgcctgtaattccagcactttgggaggccaaggcaggcagatcacgaggtcaggagtttgagaacagcctggccaacatactgaaaccccgtctctactaaaaatacaaaaaattacctgggcttggtggtgggtgcctgcaatcccagctacttgggaggctgtggcaggaaaatcgcttaaacctgggaggcagaggttgcagtgagccaagattgtgccactgcactccaacctgggtgacagtgtgagactttgtctcaaaaaaaaaaaaaaaagaaacatgaaaaagaaaacatgacacctcaaatggaacccaataatactccagtaatagaccctaacgaaaaagaaatctaaaaaatgcctgaaaagaaattaaaaataacaatgttaaggaaacttggaaagatacaagagaatacagatagaaaattcaacgaaatcaggaaaaaatgatatgaatgagaaatctgagagacacagatatcataaaaaagaaccaaacagaatccttggagctgaagaattccatgaacaaaattaaaaatacaatcaagaatttcaggaacagtctagatcaagcaggaaaaagaatttttgaacattaagacaggtcttttaaaataatccagtcagacaaataataataaagaataaaagggatgaagaaagcctatgagacttatgtgacaccattaagtgaacacatattcacattataaaaattccagaagaataagagatgggaaatggtatcaaaaacgttgtaaacaaaatcataactgtagagttcccaagtcttaggagagagatgaacatccaaatccaaaaagctcaaagaccccaaactgattcaacccaaaaaggtcctctccaaggcatactatactcaaacatcaaaaatcaaatcaaagagagaattctataaacaacaagaaaaaagcatcaagtcatatataagaaaatccccgtgagacaaacagcagatttctcaagagaaaccttacaggcaagaagagaacagaatgttatactcaaaagtagtgaaagaaaaataacttccattccaaaatactatacccagcaaaactatcttcagaaatgaagaagaaacaaagtctttctcagacaagcaaaaactgagacaattcatcaccactaaacctactcaacaagaaattcttaagggagtcctacaactgaaaatgaaaagacaatgactaacatcatgaaaacatgctagtataaaactcactagtagagcagatagatatacaaatgagaaagaaatcaaactttgtcactacagaaatccaccaaaccacaaagataaacaattaagagagcaagaaagaaacagaagatctacagtacaaccagaaaacaattaacaaaatgacaggactaagtccttctctaccaagaataactttgaatgtaaacagattacatcccccaattaagacatatagactgggtaaaggcataaaaactcaaagcccaaatataagctgcctaaacacaactcacttcacccataaagacatacatagtctgaaaacgaagtgggggaaaaaaaaaaaaacactccatgcaaagagaaaccaaaaatgaacagaagcaacttacttatatcagataaaataaactttaagtcaaaaactgtgaaaagtttgtcacactgtaaaaagaactgtaaaaaaaaaaagtttttaagctgtaaagagacaaggaagttcattatataatggaaaaaaaaacccaattcagcaagaggattagcaatagtaaatatgtatgcatcaaacaccagagaaccaagatatattaaagcaaatataattattatctaaggggaaagatagacaccaatgcaataatagtagaggatttcaataccccactctctgcattagagagatcacctagaaagaaacatagatttaaactacactgtagaccaaatggacttcacagacacttgtaaaacatttcatccagtagctggagaatgcagagtactcattcttcttcttctttttttttttgagatggagtcttgctctggcacccaggctggagggcagtggcacaatctcggctcactgtaacctctgcctcctgggttcttgtgcctcagcctctcgagtagcggggattactgtcacgcaccaccaaacccaatcaatttttttctgtatttttagtagggacaaggtttcaccattttggccaggctgctctccaactcctgacctcaagtgatctgcccaccttggtctcccaaagtgctgggattacaggtatgagccaccatgcttggccagaatattcactctttttatcagaacatggagcattccacaggacagaccatatgttaggccacaaaacaagtctcaataaatttttaaaaatcaatatatcaagtatattttctgacaacagcagtataaaactagaaatcagtaacaagaagaactctgaaaggtgtacaaatacatgaaaattaaataacatgctcctgaatgaccaatgagtcaaggaggaaattaaaaaattaactgaaggccgggtgtggtggctcacacctgtaatcccaacacttcagcaggctgaggcaggaggatcacaaggtcaagagatcgaaaccatcctggccatcatggtgaaaccctgtctgtactaaaaatataaaaattatatgggcgtggtggcacacgccttgctactcgggaggctgaagcaggagaactgcttgaatctgggaggtggaggttgcagttagctgagatcgtgccactgcactccagcctggctacagagtgagactccgtctcaaaaacacaaaacaaaaaaaaacagaaaaatttcttaaaaacaaataaataaaaataaaaatgcaacatacccaaaacctatgcaatgaataccacaaaagcagaattaagagtgaaagtttatagcaataaatgcctacatcaaaaaagtacagaaacttcaaatcaacaacataatcatgttccccagggaactagaaaaacaagaacaggccgggcacagtggctcacacctgtaatctcagcactttgggaggccaaggcgggtggatcacgaggtcaggagatcgagactatcctggctaacaccgtgaaaccccatctctactaaaaatacaaaaaattagccaggcatggtggcaggtgcctgtagtcctggctactcaggaggctgaggcgggagaatggcgtgaacccaggaggcagagcttgcagtgagcagatcgcaccactgcactccagcctgggcaacagagcgagactccgtctcaaaaaaaaagaaaagaaaaacaagaacaaacaaagcccaaagttagtagagagaactaaaacgtaaaaatcagtacagaaacttacaaaaagatgttgggagcaagccccccaaagtctggccataaactggccccaaaactggccataaataaaatctctgcagcaatgtaacatgtccataatggccataatgtccaagctggaaggttgtgggtttacaggaacgagggcaaggaacacctggcccgcccagggtggaaaaccgcttaaaagcattcttaagccacaaacaaaagcctgagcatctgtgtcttaagggcgtattcctgctgcaattaattcggcccatcctttcgtttcccttaaggggtacttttagttaatttaatatctatagaaacaatgctaatgactggtttgctgttaataaatatgtgggtaaatctctgttcagggctctcagctctgaaggctgtgagacccctgatttcccacttcacacctctatatttctgcgtgtgtgtctttaattcctctagtgccgctgggttagggtctcccctaccaagcctgtctcggcaagtggcgcccattcatgggggctcgaatccaggtcgaagggtcgccagagcgacggctgggaacagaaaactagctggaggacacccgagtactcttaaagcaatccctgtggtgagtaagaaggggagctctgaagcatcagggtaacaatgggataggtatggggtctggttcgtttcatcttagaactttttcacactgataacaaggaggaacaagagtatagtgaagtaacagaagaggttacagagcatgtttatttgccagctaaagctaaagcggcaaaggaaggacaggttcatccctacccttctgcaccccctcattattttttgaggaaaatgaccccccagatctttcttttccagaggacactgggtgaaaaatagctgccccagtgactgttcgagcagcgcctcgagcgatggctcttagttctattaggcaggaattcggcaagctagacaagagggtgatttagaggcttggcagttccctgttagaatacatcccccagatcaagagggaaatattacagctatatttgagccttttccttttaaattacttaaagaactaaaacaagcaataagtcaatatggaccaggttctccttttgtaatgggactgttaaggaatgttactgtttccagtcggatgattcctactgactgggacgctcttactcgagcttgtctaactcctgctcagttcttacaatttaaaatttggtgggcagatgaagcttccatttgggctgctcgcaatgcccaggcccaacctcaaattaatataactgcagaccaacttttgggggttggcggctgggctggtttagatgcacaactggtcatgcaggatgatgccatagaacaacttagaggtgtgcacattagagcttggggaaaaaaaatcacttaatgtggggaacaatacccttcctttagtgctataaaacagggaccaagggaaccatatgttgattttatagctcggttacaggagtctcttaaaaagatgattgcagatttggctgctcaggatatagtgttgcagttattagctttccacaatgctaatcccgattgccaggctgctctgtgacctatcagagggaaaacacatttagttgattatatcaaggcctgtgatggtatcggaggtaatctgcataaagctaccttgttggcacaggcaatggcaggactgagagtggataaaggaaatactccatttcctggagcttgttttaactgtgggaagcatggtcatactaaaaaagaatgtagaaaaaatcagcgagtcaggccaccagataggggaaaaaagaaaactgttgagccagaaatatgtccaaaatgtaaaaaaggaagacactgggctagtcagtgtcactctaagtttgataaagaagggaatccgatttcgggaaatgccatgagggagccgtctcgggccctgttctaaaccggggcatttccagcacaggccattccctcacccctgtacaatgtctgtcccctgccacagcaagtagttccacagtagatttatgctgcacaaaagctgtgagccttctgcctggggaacccctgcaaaaggtcccaacaggagtctgtggacccttgccagcagggactataggattacttttaggaaggtctagtgtaagtttaaaaggtgtacaaatacatacaggagtcattgattcagattataatgggtatattcaaattgttatatctacttctgttccctggaaagcagagccaggaaagcacatagcacagctcctgattgtgccgtatgtgggaatgggaaaaagtgaaattaaacgaacaggaggatttggaagcacaaataaacaaggcaaagcagcttactgggtaaatcaaattactgataaatgtcctacctgtgaaataactattgaaggaaagaaatgtaaaggtttggtagatacaggagcagacatttcaatcatttctctacagtactggccatccacgtggccaattcaacctgctcaatttaacatagttgaagttggtaaagtcactgaagtatatcaaagtagttatattttgcattgtgaggggcccgatggacaacctgggactattcaagcaattataacttctgtacctataaactgatggggaagagatttattacaacaatggggagcacaagttctaattccagaacaattatatagccctcaaagtcaatatacaatgcatgaaatgaggtatgtccctggtacgggactagaaaaaaaaattgcaaggtttgaaagaaccacttcaagtggaaaaaacaaagttcccgccaaacattagggaaaaatttttgatggcagccattgttaagcctccagaacctatacctttcaaatggttaacagatacccaatttggatagaacaatggctgctaagtaaagagaaactggaggctttagagaaattagttgctgaacaattagaaaatgggcacatagctccaacattttcttcttggaattctccaattttcgtaattaagaaaaaatcaggaaaatggaaaatgttcactgacttaagagccaccaattcagttatacaacctatgggagcattacagccaggattgccttctcctgctataattccaaaaaactggcctgattcctgcaagaagtagctcaccatgacaaagctgcccttgcttttatctctttgcaaatctaagaagggagacatgttgggagcaaccccccaaagtctggccataaactggccccaaaactggccataaataaaatctctgcagcaatgtaacatgtccataatggccataaagtccaagctggaaggttgtgagtttatgggaatgaggacaaggaatacctggcccgcccagggcagaaaactgcttaaaggcattcttaagccacaaacaaaagcctgagcatctgtgtcttaagggtgtgttcctgctgcaattaatttggcccatcccttcatttcccttaagggatacttttagttaatttaatatctatagaaacaatgctaatgactggtttgctgttaataaatatgtgggtaaatctctgttcagggctctcagctctgaaggttgtgagaaatcaggggatttcccacttcacacttctatatttctgtgtgtgtgtctctaatccctctagtgccgctgggttagggtctccccaactgagctggtctcggcaaaaaggagactaaaaaactataaaatatcaacaaaacaaaatgttggttttttgaaaaaacaaaattgacaaaacattagctagactaactaaaagtgagaagacccaaataaataaaatcaaaaatgaaaaagcagacattacagctgatgccacagaaatactaaagatcattagagactattatgagcaactgtaggacaacaaataggaaaacctagagaaaatggataaattgctaaacacacaaaacctatcaagactgaaccaaacagaaggaaatacaaaacctgaacagatcaataatgagtaacaagactgcatcatcaataaaaagtctcccaagaaaaaaagcccaggaccagatggcttcactgctgaattctaccaaacttttaaaaaagaactaatactaattcttctcaaactattccaaaaaattgaaagggagaggattcttccaaactctacgaggccagcattaccctgacaccaaaaccagacagggacacaacaaaaaaaagagcactatggccagtatccctaataaatacagatgcaaaaaccctcaacaaaaacaccagcaaaccaaatccagcaacacgttaaaaagattattcaccatgatcaagttagatttatcacaggtatgcaaggatggttcaatatatgcaaatcaataaatgtgatacatcgtatcaactgaatgaagaaaaaacgataatttcaatacatgcagaaaaagcgtctgacaaaaattcagctttccttcatgacaaaaactttaaaaaaaattaggtataaaagaaacatacctcaatacaatgaataccatatatgacaaaaccacaactaacatcatactgaacaaaaaaacattgaaagcttttcccctaagaactagaacaatacaaggatgttcacccttgtcaatcttattcaacacagcactggaaatctcagccaaagcaattaggcatgagagagaaataaatggcttcaaaataaaaaaggagaaagtcaaaactgtccacttgcagatgacattatcttatatatagaaaaacctaaagatcccaccaaaaagctcttagaacttttaattcattaaagtttcaggataaaaaaactcaacatacaaaaatcagtagcatttctacatacttaaactaactggaaaagaaagaaatcttctttattataattataaaaattaaaatacctatgaataaatttaacaaaggaggtaaaagatctctaaaaggaaaactataaaatactgattaaagaaattgaagacaccaaaaaatgaaaagaaatctcatgcttatggattgggagattaatattgttaacatgaccatactaccaaaagtgatctacagtcaatgcaatttctaccatattaccaatgaatttcttcacagaaattgaaaaaaaaaatcttaaaatttgcatggagtcacaagactccaaagagtcaaagcaatcctgtgtaaaaagaacaaagttggagctatctatcacactatctgacttcaaaatatgctacaaagctgtagtaaccaaaacaccatagtactggcataaaaacacatacacccacaaatgaaacagaagagagaagtcaaaaataattccacatatttacagataactgattttcaacaaaagcaccaagaaaatacattggggaaaggacagcctcttcaataaatgattatgggaaaactgcatatccaaatgcagaagaataaaactagatccatctctcatcatatataaaaatcaaaaacttaagtatgagaccccaaactatgaaactactacaggaaaacacaaggaaaagacttcaggacattgccctaggggaagattttacgggtgagacctcaataacacaggcaacaagttgggcatggtggcacgtgcctatagtctcagctacttgggaagctgaggcaagaggatcacctgagtccagaaattttgtgctgtagatgctgtagtgcgctactgcaattgggcattcacattaagtttcgcatcaggataatgacctcccaagagtagaggaccaccagaatgcctaaggaggggtgacctgacccaggtcagaaatagagtgggtcaaaactctacgctgaacaatagtagcattgcacctgtgaatacccactgcaatccagcctgggcaacacagcaaaatcccatcccttatataaatacaaaaacaaaataaatgaaacaactataacaacagaaaacgcaggcaacaaaagcaaacatagataaatgagatcgtatcaaaccaagtttctgcacaacaaggaaacaatcaacagagtgaagagacaacctatacaatgggagaaaatattaatacctgcaaactaatttttttttttttgagacagagtttcgctctttttgcccaggctggggtgcaatggcatggtctcggctcaccacaacctccgcctcctgagttcaagcaattctcctgcctcagcctccagtgtagctgggattactggcgcacactaccaggcccagctaattttgtatttttagtagaggcagggtttcaccatgttggtcaggctggtcttgtactcctgacctcaggtgatccacccgccttggcctctcaaagtgctgggattacaggtgtgaaccatcatacctggcccacctgcaaactatttatctgacaagggattaaaatttagaataaacaagaaactcaaacaactgcaaaaagccccaagtaatttcatttaaaaatgggcaaatgatctgaatggatcattcatgaaaaattgttcaacataactatttatcagggaaatgcaaatcaaaccacaatgagatttcatctcaccagctagaatgcctgtcaaaaagacaaaacaaatgttgtcaagaatgaggagaaaagggactctaatacactgttagtggggatgtaaattagtatagccattaagaaaaatagtatggaagctctacaaaaaaaactaacaacaggccaagtgcggtggctcacgcttataatctcagtactttgggaggccaaggcaggtggatcacttgaggtcaagagttggagaccagcctggccaacacagtgaaaccccgtctctactaaaaataacagtcaatcaattaatcaataaattagccaggcatggtggcacacacctgtaatccagctgctcaggaggctgaggcaagagaatcacttgaacctgggaggcagaggttacagtgagccgagatcacaccactgcactccagcctaggtgacagagtgagaccctgtctcaaaaaaaactgaaacagaactaccacaggacccagaaattccacaactgggtatatacccaaagcaaaggaaattagtatgtcaaagtgatatctgcactcctatgtttactgtagaactattcacagtaagcaagatatggaatcaacctacgtgcccatcaacggatggataaagaaaatgtggcatatataaacaatggaatactattcagccataaaaaaggatgaaatcctgtcattcatggcaacatggacaagtatggaggacaattgttaattaaataagtcaggcacacaaagatatatactgcatgttctcactcacatgtgtaagctaaaaagtttatttcatagaactagagagtagaatagtggttactagaggctggaagggtagtgaggagggaagacagaggttggttaacaaatacaaaattactattggataggaagaataatttctggtgttctacagcactacagactgactacagttagcactaatttattgtatatttgagctagaagagacgattttgaatgttcccaaatcaaagaacatatgaaatgtttgaggtgattgaatatgctaattaccctgatttgatcattacacattgtatacgtgaatcaaaatatcacactgtaccctgtaaacatgtacaattgtgtgtcaattaagttttttaaaaacatgaaataagtgctggtgaagatatggagaaattagaagtcttttgcatttttggtgggaatttaaaatggtgcagccactgaagaaaatagaatggcagttcctcaaaaaattaaaaacagaattacaatataagccagtaattcttcttctggatatacacccaaaataactgaaaccaaggtcgtaaggagatgtttgtacacacatgttcataacagcattattaatagctaaaatgtggaagaaatccaggtgtccataaacaaatcgataaatatagtatatatgtagaactgaaatattattaagccttagaaagtaatgaacattagggcaggtgcggtggctcacgcttgtaatctcagcactttgggaggctgaggtgggcaaatcacctgaggtcatgagttcgagaccagcctggccaacatggtgaaacggcatctctacaaaaatacaaaaattagccaggtatggtagcaggcgcctttaatcccagctacttgggagactaaggcaggagaatggcttgaacctgggagacagaggttgcagtgagctgagatcatgccactgcactccagcctgggcaacagagtgagacgctgtctcaaaaaaaaaaaaaaaaaagtaattacatcatgctaagtaaaataacccagtcaaaaaaaaaagacaaatactgtttgattccacttacaaaggtatgtagagcagtcaaaaatcctaaaagacagaaagtgaaatggtgattaccagggtttgggaggatgggctaaaggggagttattgtttaatgggtacagagtttgttttacaagctaaaaagaactctggagatagatggtaatgatggttccacaatatgaatgtattcaataccactgaattgtacacttaaaaatagttaagatggtagattttatttttacatgtattttaacaattttcaaatattggaaaaaaattaatggaatcccaataaaactgcaaacaaactttttaatggagctagacattaatattcaagttgatatgaaaaaacaaacatataattatagctaggaaaatactgagagaaaaactataaggactgagtaccacaaccagacattaaagcatactataaagcctctataattaaagtatcataataatggtacaggcgcctaaagttccaactacttgggaggctgaggcaggaggattgcttgagctcaggagttcagtgttacagtgagccatgatcgctcactccagcctgggcaacaaagaaagactctgtctctaaataaaaattaaaacaaaaaaaatttttttaatgtaaaatggcacatgaacagacaaccagatgagtgaaacagaatagaaagtccagaaatatacccaagtatatatggaaatttaaaatacaataaaagcatcatcatgaatcactggggcaaagacaggtttttaataaaagtgtgggacaatcaattagccatttagaaaaaactgatcaaatccatacctcacagcatacaaaagaatacacttcaaatagatcagagaactaaatgtaaaaaatgaaaccatacaagcaaaaagaagtgaattcctctttaacctcagttcagggagagagtactaactctgacttaatacccagaggcaataacagattaaatttgattacataataaaaatttttgcatggcaaaaaaataacggaagcaaaatcaaaggactgctgacacacactggcagaaaatatctgcagcataatcctaatatataaagaactcttaaaaagtaaggtaatttaaaaaaaatttttaagcaagggaaaaaaggccaaaaaaaccaagtataatagggaaagacaagaacaaacaatacatacaaaaatgatataaaaatggcccttaaacacatggaacattgttcaatctcatttgtaatatgagaaatgcaaattaaactacactaagatgcaaagtgatataattctcttggatggaaatttggcaatatctaacaaaactgcgtatgatttaccttttgacccacctatttacttcaggaattcaccctgaagatacacctccagaaaatgaaaatatttacatgtacaacattattgattagttgtaatcacaaaatactggaggccaggtgcagtggctcaacacctataatcccagtactctgggaggccgaggtgggcagatcacccgaagccagaagtttgacagcagcctggccaacatggtgaaaccccacccctactaaaaatacaaaatttagccagttgtggtgacatacacctgtaatctcagctactcaggaggcaggagaatcacttgaatcccagaggcagaggcggaggctgcagtgagccaagatcgccccactgccctccagcctgggcaacagagcaagactgtgtttgaaaaaaaaaaaaaaaaaaagacaaaatattggaaattaaatgaacataggagactatttcactaaacactgatagatacacatagtggagtgctatgcagccataaaaaagaatgaggctaatccctatgaactaatctgaagcagtttccagggtgcactgataagaaagaaggaaaaatacaatgacatctggtatttgtgaggaacaaaaacaaacaaacaaaaaatgtaggaagtctaaaccagaaactaatgagattaatctcacatggggcaggatagatgagaaaagatgagggaaatgggaacagggtagaggagatgtgggaagtggcatttttttgaaggttttgtttttttgtttttgtttttttttggtgtattatagttctgtcctttagaaccatgtagacattccaaatgcccaacatattaataaataaataaacaaggatgaggtatggactcaaaacagaatagaatagaaagaataaacctgctttataagtgaataacaaaccacattaaaggagaatttggtgagaaaaatcctaagtaactttggaaaataatattttgactatatactctaaggctaaagataaaaacaactatacacaaatattacatgtaagttaataggtttgtttttcattgagtgatgagttagcaattctaaaacaactttatattttaggactgaggaaataagtaaatatggtaggaataatgaatgccagttttctcactgtcaaaagaattgcaagtatgaaaagaggaagaccagaatgaactccacggtgctggaacagaactggaaatatcaatgtaaactcaagattattaatatagagaaaaaataaagaaatagatgtaaatgtgtaattttcagttcactgggaggacctagaagcaatgactctctagtaccaataagcatacctagagttgagattttggtttctaaatgccattctccaattaaaaaggaatcaaagcacctcagataaatgtttaattccagggctggggcagggaaagtgaaagagaatcacagaacatcctgtaatgacagaaaaaagtcacaataaatggtgggattatgtcaaaaggacatgggattcaacttgaaagatcttccaatagccaaatctgagaaaagttaagcaacaaaaaaaataacaaaatcttataatctatagaaaaaatatgaatgtataaatccataatgatataaatatatttagaggagaagggaaagcacttactttcaggagaattccaactaataaatgaggaaggatcatagaaatggaaagatcaccatttggcaaatgctagagttataactgtttcagataagaattatcaatggatactaaaattaatggaagattatataaaggcaaaatatgagaatatttacacagacttgaaatatcatatgggcaaccacagataattatatattacaaagggaaaaaatagtaattttataggggaaaaatgtggcagataccaccttaaccaagtgatcaaggttaaaatcaccagttaaggggccaaatcatggaaattcactgaggacacatgactttgatgttttgctaaaaatgcctaacctgaatttaaccatgaaaaatgcaatacaaaaccaaaatgagagaggatatacaaaatactgacaagtatttgtcaaagtgttcataagttccagattaaaagtaactaaatgcaacatgtgatcctgaattgggttttagaccagaagaaagacatcagtgggacaactggtaaaatttaagtacagttaatagattttataatagtaatgcctgatttcctgattatattcatgttaatttcttaatcttgattattataatatggttacataggtatttgtatttgggagatcagggtgaagagcacatgggaattctttgtactagttgtacatcattttgttaactctgaccttatttcaacatgaaaaactttaaatatatatgtatatataacctaacactctgaagctccttcctggtgatctcttctgccatctgtgaagcccgcaatttctcttcatactgatccttttcagattgcctccagacatcatgttccactttcattttctccaaatctgctaatctgttctcgagttctaacctaaaacaagagatcataattatgttacaagaactataataaagatgatatgacagcaaaatgttttcatttgcaaggatatttaagtcaaactaaggtaattaagtacttacttttcatcttgtaataccacaagtttttgataaccttcttctttggcagcttgtactttacgtattaattcacgatccttttctactaagagcactttgtgatgttcaacagctgctttgagaatttcattgtctgactgtaatcctagtgtttttcaaggagaaaagtgtactatattcaatgttattaagatgaaaaatcacatttaacagcaagcattcataagctggtaagacaaatgaatgtagaaagtctctacaaatatatattctcaacaatactcacatcattaataaacactcttaaaataagaatgaaacaggctaaaactcagagcaaattttcctgtcactgtttatttagtgcatacacatataaaaactttaataaaagctgtatacatttactcattcgaacattgagagttgagatcaaactggatgataaccagaggtttacttacttcacctctaaagaggttctgtgacctaagcctcatagaaaaagctggctgatagcagagtgaaataaatcacaaaacccttcaaaacctattgattctagcagaattgctagatctctagcagaagtataaataacatggacactttcaagtttgtacaatgaattcagaaatctttgcaatgaaatggcaaatactttgcagatggaataactaaagcaaattcacatctaactcaaagtgaaaacaaaatgcagcattctttaagttcctaaaaaaatttacttcttaactctatggaaatccatgagtcaataaatagaaattaacaattggaaaaaatcattcatagcagccagacacggtgttagcacctgtagtcccagctactgaggaggcttaggcaggaggaccatttgagcccaggagttcaaggctagcctgggcaacatggtgagaccccatttcaaaacatgaaaggcattcatcataaactctgtctgaaatgagttcaactacagatcaactcaagcatagctacaggccaaaggtaagcttatttaaatacttcaagttagaaacaacataaataatgaggaaatctgatgagacagatgttccaagattaaactggaacttaaaaataagcctactcggctgggcgtggctcatgcctgtaatcccagtactttgggaggccgaggcaggcagatcacgaggtcaggagatcaagaccatcctggctaacacggtgaaacgctgtctctacttaaaaatacaaaaaaatagccagcctggtggtgggcgcctgtagtcccagctatttgggaggctgaggcaggagaatggcgtgaacctgggaggcagagcttccagtgagccgagatcacgccactgcactccagccagggggacagagcgagactccatctcaaaaataaaaaataaaaataaaaaataaataaataagcctactctgcactaggctacaatgaactggcctgaggtctacataaaaaaatctttttaattgaaaaaaattaagcctggaacccaattatcttcctcacattctccagacttaaaatgtcctgggactaataactacaccataaatagatttaaaatttataaatcaggaagtatggcatcccatttacaaaattcatttatgtatccaataactatgataaaaacataagactgatttttttaaagttattaaatcttacaatgaacaaaacactcaacatataataaacatttcatatgtactccaaaattaaaactaaattaagttgaaaatttggaaataaaaattcagattcaactattttaataatttgagttcatatctgaaaataagcagcagcagcagcagcaagggaaatcacatattaccatccagttcactttgaatcttattcctttctctttctagctcactcttagctcttgctgtctccagtttgatgtctgttatttccagtttgtttgaatgtttaagttcttttacctgttgataattaaaaactgaaattactattggtcattttcttgccattcaatacttaccccaaaacataagtggaaacaagaaaacgctctggtagtaaagtagagtctaagtatcttccaagaagaaagaagtgtcagtgcctgcaacagtacttcaagtaaggagacattaagaaaatactgttctttcctaacagaacagaggcatttctttacgaatatctgtgtatggtcctttggcttaatcttgccttaaagacttaattacaagtatctaaaatcaactactcaatgattggaaaatctgcaggggaaaaaaccctgaaacttttaaaatttgttaatatttctaaaagacagggtcttgctatgtcatccaggctggagtgcagtggcacgatcatagctcatttcaacttcaaactcctgggctcaagtgatcctctctcctcagcattccaagtagctgtcaggactataggtgcacaccaccacactcagataatttttcaatttttttgtagcaatagggtcttgctatgttgaccaggctggtctcaaactcctggcctcaagcaatccacctgctttggcctcctaaagtgctaggattatagttgtaatccactgcacttggcctgaaaccttccttttaaaaagtgtccacagctggatacagtaacttgcacctaaaatcccagctactcaagaggctgtggcagaaggaagtgtttgaggcctggtgttggagaccagcctgggcaacatagtgagatcctttctctaaaaaaaaatttaaaaattagccagacatgacatgccccttagtcccagccactggggagactgaggtaagaggatcacttgagtctaggggtttgaggctgcagtgctatgattgtgccaatgtattccagcctgggcaacagagtgagaccttgtctctaaaaaaaaattaaaattaaatttaagaataaaaaatgtgctggggacaaagaaggtattctaggtagaaggaacagcatacaaaatgttattatatgtataacatcacatggtctgctcttaaaacaagctaagcattacatgtagagcaccggaagatgtgaaatctgtggaggaatggcagggaataaactttatataccatacaaaagggttgtttttcaggttagctgttgaaggtggcacaattaactaatgcgaatctgttggcttaagaaactgaaggtaaataaatcaattaagaggcaagaaatgaataaacggaggggggaaggaagaatcaattgaatctggtgacaaaatagtgtaatgtgtatagactgtgtctgtgtgcgcatgtgcacaagtattaggtaggggattgggggcaggaacaagtataaatcatataaattcattttccatagcccttctctttggtaaggagcttctaaaattagatatagtcatataataaggatttaatcaatacaaacacaaaggttagattaacccattttctgatatattatccaaatatataaaagtatggaatcagagtaggaaactacaaatacatacacatcaaatacagaaaatgtgagatggcagaaacaggaaaataaaagacaatttacttaagagtccaataaaaccccataaatactggagttgggagtcagacacaaatcaaaaaaaggtcctagagccaaagagggcaaggataagaaatagaagtgtcttattggaagatattccatcaacaaaaggtcctgaaaacgtttcaaggaatagtttcatgcaaaatcctcatccaaaggaaataaacagaaaagtgagtactgccttatgtactggtaactacaataagacatccctccaaattaactcgtagatttttaaatgaccgtacataaaatggtgaccctgtgctgacatcagttttgcatttttatttatttattttctgagacagagtctcgctctgtcgcccaggctggagtacagtggcttaatctcagcttactgcaacctctgtctcctgggttcaagcaaattctctgcctcagcctcctgagtagctaggattacaggcatgcaccaccacacctggctaaattttgtatttttagtagagatggggtttcaccatcttggccaggctggtcttgaactcctgacctcgtgatccatccgcctcggccttccaaagtgctgggattacaggcgttaagccaccacacctggcctgtggttttaatttccttttggaagttattttctataaaagcaagttttataaaatgatgtttacatgacaacagctgataatttgttttaatacttaaactttctgtagattggattttactacattataatttcatggacagatagaatttaaattataaatactttaaaattttgaagaaatatgattacaaagaaaatccaatcactatgacaaatgtaattataacctgctattatatactaactgtaaaaggttaagaatgacacagcatttcattaacaaacatactatagctgcatgaggtggaaaattagagccatcttatttcataggaagttgattcatctcatggtaaaagatctacaaaaacttatttcttattcatttcaccctgaaatttactgaaatgagacgacatttttaactaaactacaattattgaaactgaaagaacaccgaataggaagtcaagcaacaagtgaggtctgtcttcaggcctacttttgctgttaaaccagtggtatatgctcaagcaatttacctgtcctctctgcattcaaatgtactcatttatggatctaaagtttttctttattgccttatttctattatcctaacatcactgatgcatcacttatatgaacactgttaatttcctaaaaatatactaaaaggaattttacttaacgtatgaaaatgtattacccagtaatgacaaataatagcacttttctatgagtaatctgaaccaaattccaaatgttacagtaaagtttctttctgcccctagatccttggttcttaatcttctttgtgatcaagtcccaaatcctaggaaaattagggattttttttttaaataaaatgctcatgttaaaatgttgcataaaatttcaagcaattcatggtctcctaaagctccactggaccaagtcaccctgttcttcacagaatgtttgccatatagattctggcctttatgttgtgaatttgctttatgttttgacacaatggaagtattcagatattactaacaaaactttaataaatgtcaaaactggcaaaactgggcattttacagggggtcagtatctgttaaagtacacatactcacagaaagacacacaagagcacagcataaataagcaagaaatggaaatataattgacaatatgtattacctaagaagctctggatacagattccaaagagatggtacttaaatcttgatctttttcaaagttctgagatgtaattacccaattaatttaggtaaataaggacaactctgttgggtggctttcttaaaactaccttttattggcattctgaaaatgaaaaaccttatgagggaactagaagaatttacctcactgaatgtgaaatctctttaaggtcatcattttcaggccatctttggtaataccttttaatccaagacactgatactcacactgacataactttgttctaaaatctgacaaacatttatgaatttgagtaactaagacaaacacaccccaggtgttcctttgcactgcaaacaaccatttgctagaattgcaaaatgttgatgaaaacttcaagttgcaaagaaaactgtggcagtcatgtttgaaatattattttaaaatctacccttccaatggaatctttacatacaagacttcaaatgaaacttggtttgtttaaagttgaaggatggtatttaatactccatttatatgcaaaataaggcaagtgtgcctttaaaaagacaggcaactcttagcaatgtgtattaataaacaagcacagagaaataaatactatactagattgctgttctttcttcagcggagtaggagaaatcacctaggctctaactctaagaggaaagagcaatagggaagagtatatatatatggaaaaaaagaagaaaaatcagggtcagcacacaggtgagctagggagctcaggtaaaatgtactgcatgaaaagtattatacttggtggcccccccaagagagaagccacagcagaagccagcacatcccatgtcctattgcgacatctgtggttccaattattccagcagtgtagtctggctactcaggtcaagaacaatgtgctgcaaatactacgtactcaatattatttcacaaaattgaaaataatttatactggaattggaagaaaagcatggaaactccccatatcctgaatttacttgtgttttgtatctatttttttgtatactctatagttataagctttcaatgtgtatctgttgaatatataatctacttacagttaatcaggaggcaatcaaattatttcctagtagttcttacacagtcttagtaggctggaagggttcttacagatataaggaaattggatcctaatgatattaggtaacttgccttaggttacacatagttattgagacagtgagacacagactagtcaatggactaaaaattctgtattctttatgttacaatattttcttatttaaggatatcaccagtgtataatcactgctattatcattttcatcatcagctacatttaatttttgccacaactctgtaatgtaggtattagtcccattgcatagacaaaggcacttaagtttcagagagacagtgaactgcccaaggtcacacagctttttttagtaatgaaaaaatcagaatttgaatccagtctgttaaggagaatataaatgtagatcatgctgctactactaatttattcattgaagaaatatttgagtacctactatgtgccggcaccattctagaagctggaaaagcagtagtgatgaaaacaatgtccctgctctcttggagcttacattgggttgaggggaaggtggtgggaaagaaaaggagagaccaaaaaataaaaaccaaataactatatcagatagtattaagagctatgaagcaggtaaggaagacagagagaaagacagaggaagaaggaagatgctgttttacaatgtgaagacaaggaaagcctccctggttaggcaacatctaggtggtgaagaagcaagttatgtggatacgtgagggaagactgagccaaactcagacaagtgcagaaaccctgagcaagatgtgagtttgctcaaagagtgagaaggccaaagggagcaaagtgaacaggaggaaaaatacaggtcatggctgtgaaaagactgcaggatccagatcatacagagctctgaatgggtagaaagcagaaagaccagttagcaacctagcacagaaatggagcctagaaaaatcatggcttggactggaatagtcacagtggatgtcataagaattgatcagattctgcatgtatttggaaggtagaatgataaaggattaaaaatatttcaatacagagaactaaacacaaaatttgtcactgtacagtatcaagcattctaaagaatgaaatagaggcataagataacatactctactgatcaatgtatttatttcttagaaggcagaatgatataataaaacatttcagtataaagaaatcaattattaaaaataaaatttatcattatatactaacaaacattctaaagaatgaaacagaaacataaaacaacttactttactggacaatgtatttatttctcgttcagctttatgcaatttattaattaaaaaggtattttgttcactgcttgattgtagctctttttccaaacgttctgcccgtaaattagctgattgtttttcagcctttcatacaaacaaaatagtttaaaattcatcatttttcaagtatttcaaaatcaaataagcactatttaaaatacatttataattatactaaaattattcaaaacctcaacttaacatataccaatgtaacaaaaattttctcaaactaattggcagaattcaaacgaaagatagtgttccaggaaatatgcaacaaaggcatctagacaaacaacatatgaatgaccatcaataaaataaagtttatacacttctctcacgacagaaagtacctaaggcattcatttgatgtctatttactcttaacactgacttatttcaaacattttggaagtttccagtctataacagataagaaaaagcatattagaaactagaagacagggctcattgatagtaacaagtaaaaattgaaaatctaaaatcaatgattttaaaaaaagaaacagggaaagatatgatttcaaaatcctcagctcatctgcagactttttaagtacgagcaaagaggctcttgatctcatgacacaattaagattgttaatgaagtctgcaggttgtcaaaaaagtttctggatggtaatatcgatagtactctttcatgaggggagggaaactaaaatcttttttgaaaaaacatgtctattcaacataatatatatacatatatacacacacacacacacacacacacacacacacacacacacacatatatatatatatattttttttttgagacaaggtcttgctctgtctcccaggctgcagtgcaatggcacgatcttggctcaccacaacctccgcctcccaagctcaaacaattctcctgcctcagcctcccgagtagctaggacttcaggtgcacaccatggcacctggctaatttttgtactttttgtagagacagggtttcacccgtgttgttcaggctcatctcaaactcctgagctcaggtgatccagctacctcagcctcccaaactgctgggattacaggcataagcgaccacacctgacctcaacataattaaaatgaagacattttggcatttaaaggataaatttcagttttataacatctcatttcgtacatatagatgctgttcgacttatgatggggttacatcctgataaacccatcacaaattgaaaatacctaagtccataacttagactagcctaacttaagcatcctcaacacacgtgcattagcctacagttggaaaaaatcatttggcgacacagtactctgtaaagaggttatttaccctcatgaccacatgactgactgggaactgtggctcagtgcagctacccagcattaagagtatcacaccacatatcagtaacccaggaaaagatcaaaattcaaagtacataaatgcatatatggctttcacaccatcggacagtcaaaaaatagtaagtcaaaccaccttaagttggggaacatctagcttaaatgtggtaaggactatattcgacaaacaattagggaaaaaaactattttcttcatatatgaaataatactctctgggcacaatgatagccaagaaagttaaagaagaaagaaatgcttgctgtcatacgcttattttcatttcatctgacaaataataaaattaaatataggctcttctgaaaatgtcacaaataaatcttctgtcatcattcaacttgccctgaaaataatcactctaaaggacctcaatggaaagtttcacatcaggactgtatgctatattcaactgcaatcatctcacttattctgtcactgtgtaaaatacattaaggatggaaggatggcaacataaatagtctcacaatgaactgcttcatgtttaaggtacaatgatactgacaacttttaattcagaaaaccagtaaatactgacagagcgtcatgtaacaaaataaaaagtaacttctactcttcaaaacataccattgtactcctgtaccactggctggggaaaaaaaaaatcaccatcttggatttggatattgattttaactacaaattaaatgcccgctaatgtcccccccacccaaatcattttataactattccaaaggaaaaagaaacactttgaactatacaaaataaataaaaacaattaaacaggtatgtttgctacaagttaggcactaagaactaagaagaataagtgtatctgaataaaatggaaaccaagaattttcataaggcaatacccgtaggagtaccagtcaggtctgccaacacttatctttctctaatgaacccagggaaataattctgtaaaggcatgtatacctttacagttggattttactactctggcaagaagctgtcgtaagatacatcagtatggtatttctgttcaaacaggatttgtgactttaagacctcaaatcccagtgtaaggaatgtactatcttgaaagaaattattctttctggtttgagatgactttacgctcagaaactcaaatacatatatttttattttgcatattctattatgtggcattttaagagttaagacatttcagataggtgacttgactcccaaagaataaatacccctttgtaaatgtggtagcatacgtattgcttatgaatcaatagctttcttctttactaaaagaataaatactcttgggattacacaaatgcatcagcattagcttggggggcatacatttatgctctaaaaatcaaaggcttgtcaactgcactttaaaaaagtatgccatactctactgggaagtaattagaatcttacctccagggatctgactgtagcctgcatctcagccaactgccgcacctgtattctttgggcattttccacctgagcctcagaattctccttttcagcctttaattccgctacttcagcctctaaaccttttaatttttgacacaaatagactttttctcgagcaagttgttccactcgtttgctgtcttttgtgagatcaacattaagcagctggttacgtagttcttctttatcttcctccagtcttgcaatctaataataattttaaagaaagcatacaaggttaaattattaaattttcagtcatgaacatgctttacaagtcagtaaaattaaaaaatgcacaaaatcaaagctcaggtgctgaaacaaagtacaaaggaaaaaattttaagtatcactatctttttgttcttagtgggactcaaatgtgaggtcaaggactgtgtcctgttttccctgtatctccacgtggtgtctagaacagggcttaatcagttgctgactaaaatttaaaattataatactgtaagtactaaacatacatcaagtattttaaaattcatcataacattataggggttcatgaccaaaactctgactactccaaagcttttcctcacatgactgtaattcttgagctagtctatactaataaaattatctatgtcagggcaacttaattcacacaaaaactgcctgtctgtgtacataaaagcaaatgtgattgatgagagtttttaaatgatagctgagagtttattaaagtcctaattgtaatgatggcctagttcttagttcttagattcaagaagaattgaaaaatcattactccagggcaggtgttaaagtcactggggaacttgcagagcagagacaccagtggtcttgtcattcatgccaattatcactgctggacttcgtgggcctccaaatcagtgggtttcaaactgtttcctaacctctgaggcatttcagaagctcctcacctctggagaccaggggcaagcaatcagggtctagaactcattctttccctttcctgatctccccaactatctatcccctaccaccacccccaccaaatttctggcattaaccatacgcttctatttttagtctctttctggggtttcttcaaatgattcaacttaagtaaatgattcagctgggttttttgtttgttaagaagaagttgaaaaccactgctcaaaacaggacaagaggttgtttgtagccaggatgaacatcaaagactcactgtaagctccccggccctgcaaaaaaaaaaaaaaaaaaacaaaaaacaaaaacagaaaaaactaaagaaatgctccaaaaccttaggcaaaagtggtccaagaaacaactgtttgatcacagcactatcaatgaatctaaaaagtttaagacctccaccccagggcaggatctgttctccacacctgtaaaatgggaaactgaattacatgcactctaacaacctttttagttttaacacatagtgattccagtttgtttttggacatgctgaatttaaatgccaatgagaaatataggtagagctatccagcagacaaatattattttgcagagaataaaatttatccttgaaggcagctgtggcatttagagttaagtcctcaaaagcccaactaattagtatttctctcctatttttcctcccacgctttacaaataactattacttcctggtttggtcccggattacttttttatccactgtattctgtcctcagtttaaatgaagaacttgggctagctgatctttaagatactgtttaccttttacatgaggtaacctgatatggttttaatgtgctatattagaggtgtgatggctcatctaaggtcaggagtcaatgtgtaactcaagttcagacaatggtgccctttactgagtacttactatggatcaaatactgagctaagtgctctacatgtaaaatcaacattaacaataatttctcttgtagtccccattttacacatagggtcacacagttcacaatgttcttgacctgcatacttcccatattattgctttctttccacgttttgggaggcatctgtgtgatagctgaagtgatagttgaagctatgagactggatgacagctagctgatgactgaaaattagattccatgtttataactcctaaaccagacatatcaaatcattcttacaaaactgccatctaattttgctattcatttatttattcaggcaacaaatatttactgagtacttactaagtacccaaaactgttttaggtagtaaggatacaacccagcagataagcaaacacaaaacctctgctgatgcagagcttattacattcaatcactgccataacaccacttgtgtcccagacatttggcacagatcttggatacagcctcagctctttctttttccgccattctcaatcagacttacatgtcatcttccttgatgtcctcaatttcttgtgctctcaatctttcctctaaatttccaaagggctttgtttaaatttctcttttatgaactttatttaaatctgcctgtattgcagctacctctacatttactctattctattctaaatacaaacttacttgacagataagacaatgtgttaactaatattactttttaaaaagttattgaagtaaaggaaactaaacagaaacaatagggactaggaatagtgactgatttccttttcaaaaaatgatagcacttcaattccccaaggcacacaagagggaaaggtagtgttacctaattactccatccttctttgttgttattacctttacgatataacatagggatatgggtaagagaaaaggctctggaatcaaactgcctaggtttcttttttcttttggtattttaaagatattgctttactgtcttctggcttttattacttgtaaaaataagtctgtcgtcattatctgttcctctgtataagatgtcttttctttcttcagttacttcttttaaaattaaactttttcagataatggcaggttcacaaggaattattataaggattaatatagcgggatcctgtatatcctttaaccaagattcccctattggtaacattcctcttccctttttggggaagacattatgtagaattggtactgatacttctttaaacacctggtaaaattctctagttaactattcattttgggagttttaaaattacagattgaatttccctaacagtaataggtctatacaaactgccaatttcacattaaatgagttgtggtcgtttgtgccttttaagaaattgattcatttcatctgcattgtcaaatttattagagtagagttgttcaaaggattatctgatttcccttctaatgtctgcaaggtcatgagtgatactctttcattcctgagataggtaaaatttttatcttccatcttttttgttagttttgctaaaagttggtcaattttattgtcttttcaaagaaccagctctttgtttcactgattttctctattatttttgttttcaatttctgctatgtttattatttccctccttctgcttgctttacttttattttgatactctttttctaggttcttgaggtgggagcttacattactgacttgttccctcatttctaatgcatgtatttagtgctataaatgtttcttggcactgctttagctgtgtcctaaaatttttgatatgctgcattttcattttcatccaatgtattttttgaaatgtaatctcattgaaatgtttttctttgaaatttccaccttgacccataaatttttttaagtatgtcatttcatttccaagtgtttgaagatttccctgttattttctgttattaatttctagtttgattctattgtggtcagaaaactcactcattatgatttcaagttgtataagtttgttgaggtttatttcatagcccaggatatggtctatcttgtatatgttcagtgagcatttatatacattcagcgaatacttcaaaagaacatgtctgggtgttctccttgggtggcatgttttataaatgttatttaggttctgatggttgatggtgttattgcgttcttatttatccttgctgatttttaattgttctatcacttgttgagagaggggtatgaagtcaccaactataattatagatttgtctatttcaccttttagttctttcaatttttgcttcaaacattttgcacctctggtgcacatacatttagtattcctgtgtcttcttgctgggttgacctcttttgtcactatataatctctttctatataaatctggtatttttctttgttattttcctttgccctgaagtctgctctatctgatattaatactgatgctcctgcttttaattaatgattccatgatatagctttgtatatccttttatttacaaactgcctatactgttatacttggagtttcttatagacatcatacagttaccccttgacttatgatgcaattacatcccaataaactcatgaaaagtgaaaaatgcagtttatgccggcaacacagcatatggaccctgacttatgatggttcaagttacaacttttcaactttacaatggtataaaatgacatgcattcagtagaaaccatatgtcataaggagcaccctgacttacaatggagttacatcccaataaacccattgttaagttgaaaaatcatccaagttcaaacactgtaatctggggactgtcagtacagttaggtcatttttaaaaatctacactgtaaatatctgtattttaattcatgtattcagaccatttacatttattatgattgatacgttaagccattttggtctgtttcttctcttagtttctctgttttctttttcttgcctgttacatgaacatatttcaggattccattttatctataatgttttaaatgtatctccttgtatagctttcttagtggttgttctagttattatatttatgtaacttatcatggtctactgaattcattttgtcagtttgagtgatatgtagaaacttcacctccttttatatccctttgtccttgctcatttataatataattacctaaaatattttctctatatatttagaaccacatcagagttaaaatttttacttcaaccaccaaacaaaatttagaaaattcatgaagcaaaaggaagtctattacatatacccacagttctgtttaccatgtacatttatccttcctaatactttgagattccttctttttactgttttcttcctatttagacaaacttctcttttggataggtctactggcaaaaagttccttcattttccttcatttgagaatgtcttgatttcccctacattcctgaaggatatttttgctggatatagaattatgagttgacagtccttatctttcagcacttgataatgtgccacttccttctggcctctgatttctgatgagaaatgagctagttttctaattgttttccccaatgggtaagatataatttcttgggctgctttcaagattttcctatagtttttttttaaacctgactatggtatctcttgctgtgaatgtgttcagcttcttgaagctacatgtttgtgcctttaccaaacttggaaagtttttagtcattatttcttccattaccttctcaccctgccctcttttctcctttcagggacagaaatcttagatcttttgttatagtcctacaggatactgagaatctgtttatttgctttttaaatctattttctctagtctgttcagattgggtaatttctaatgttctacctttaagctcagtagttttttcctctatcccttccattctgcagttgagcctggcaactcaggctttcttagtcactctttcagttctaaaatttccaattttcttctctttattctctgtttctttgctaagtcttttgggttttgtttgtttgtttgtttcaaccacgtttataattcctcattgaatcattcttaccatggctgctttgaaatgtttgtcaaataattctaacacctctgcatctcagtgttggcatctattagtgtgttttacattcagtttcagaccttcctagttcgtggtgtgacaagcaattttcaatggaaacttggacatttggggaattaagttatgagactccagatcttaaacaaagtttgtattagctggctttttgtgatattgctatggtaggggatgggtggtgttgccacctcattactaccacgaggaggtagtagtcccgattctccactctacttctgttgatacccaaggtgggagggcttctcatgatacccataatgaacaggggtgggagttctggttccccattaggcctcaactgacacctccctggatgggaagcgtaggagtaatttattattgctcctcatgttacctccatcgataccacagggccagatgtggcctccattgataacacgcagctgggtagtggttaaagtcctgaccctgtactaggcctcctctgacatgacccaggatgtcatgtcagagcaggatgagggcagggtacctcattactgccagttgagagtggatgtccaagctcctcatactgtctctagtgacagcatggcagaggatgggagcccttgttattacccaggtgaagatgtctttgtctggttttggtattaggataatgctggccttgtagaatgagttaggaggcatttcctctgattctgtcttctggaagagattatagagaattaacataaattctcccttaaatggctgatagagttcaccaatgaacccacctgggctgcccagtcatttctgattggatgtcagacattgtgaatttaatgtttttttcagagctggattctttgttttcctttacttatttctgaatcttcattctggaatgcagctaagatatagtaatgagccacataatgaagtttcagtcaacaacagtccacatacatatgacaggggtcccatgagtataatattgtatttttactgtttaaaccttttctatgtttagatatgtttaggtacacaaatattaaccattatgttacaatgcctacagtattcagtacagtgatatgctttacaggtttgtagcctaggagtaataggctgtaccatataggataggtatgtagtatactgtgccatctaggtgcatatatgtatagtccatgatgtttgcacatgacaaaatcgcctaatgacacatttctcagaacatatccctgtcattaagctacacgttactgtacttagaaacagtctgatcttttcaaatcttacttttattcttgttaaccagaaccagaatagcctttagtctatggctaatttggccctgctactgaggcaaaatccttctgagatttctactcaaagtactatgcattaagagtatctttccactctgtctaacggaaaaataaattttcccagtcccatgtgaactctagagactgtcccacctaaataattttctttctctggccttgtatagtttcctccacacatgcgctaatcaatactgcaaagttaccctctgcagaactctggagctctgcaatactctgcttttcaaattctagtttccttggcctctcaaattctgaactccaactcctcagctcaaagatcatgtagctcaatttaggttttttatctctgcacagtggcctggaaactctccagaacctaagatggggcaatcatagagctcttatcatttgttttccttccctcagatctgccctgtgctgcctattttccaatgtctgaaaactgtggtttcctatttttgtcccagttttcagtaaacgccttaaagtaaattccatccctattccatcctagccagaagcagaaatccccagactacttagatttgaatcctgaccatatactagttgtgcaaccttgggccagtctctcagtgtttttatcttctcatttataaaatgaagatgattatctaactcctagcattgttgagatgattttttaaaagtatatataaagatactggtacaaaaacagacacacagccaaatggaacagaatacagtaaccagaaataaagctgcatatctacaacaatctgatgctcaacaaagttgacaaaaacaaacaatggggaaaggactccctatttaataactggtgttgggaaaactggctagccatatgcaaaggaatgaaactggatctctacttttaaccacacccaaaagataactcaagataaattaggaaataccattctggacattagccttggcaaaaaatttatgactaaatttatgaccctctaaagcaagggtccccaaaccctaggccatggaccattaccagtccatggcctgtcaggaatggggccacacagcaggaagtgagcagcaggtgagcgaccattactgcctgagctctacctcctgtcagatcagtgggagcattagattctcatagtggtgtgaaccctattgcgaactgcacatctgagggatctaggttgcatgctccttatgagaatttaatgccctaatgcctgatgatctaaggtggaacaatttcatcctgaaaccattcctcccagagccttggttcatggagtaattgtcttccacgaaaccagtccccagtgtcaaatggcaccagggactttggggaccactgctctaaagcaattacaacaaagacaaaaagtgataactgggacctaattaaactaatgagctttggtttggcaaaagaaactatcaacagagtaaacagacaacccacagaatgggagaaaatacctgcaaactatgcatctgacaaagttctaatatctagaatctataaggaatttacataactcaacaaggaaaaaacaaccccataataaagtaggcaaagtacataaacagacacttctcaaaagaagacatataagcagccaacaaacatgaaaaaaatgcttaacatcactaatcatcagagaaatgcaaattaaaaaacacaatgagataccatctcacaccagtcagaatagctattactaaaaggaaaaaaaaaataacagatgctagcaaggctgcagaaaaaagggaacattatacactattgatggctacgtaaattagttcagccactgtggaaaacagtttggagatttctcaaataactaaaaatagaactaccattccagcaatcccattactgggtatatactgaaaggagagtaaatcattctattaaattgacacacacactcatatgttcatcacagcactattcacaatagcaaaaacatggaatcaacctgggttcccatcaatggtgaactggataaagaaaatatggtacatatacaccacggaatactatacagccataaaaatgaatgaaatcttgtcctttgcagcaacacagatacagctggagactatcatccaaagcaaattaacaaaggaacagaaaaccaaataccaataccacatgttctcacttgtaagtgggagctaaacactgactacatatggacataaagatgggaacaatagaactggggactaccagagaggggagaggatgagggggaaagggctcaaaaacttcctattaggcactatgctcagtatctaggtgacggaatctttattaccccaaagttctgcctcagcatcatgcaatacacctgtgtaacaaatctacacatgtaacccctgaatctaaaataaaacttgaaattattttttaaaaaaagaaaagttaagtagaataaagtattacaagtagtgaaaagagaaaataatttggaaacttttttttacactgactttaatttgtgcttttgatgaaaatacatttcactttttacattttgaatacaattgcattttaattctgtgtgttattattaatggaaaacaaacatgtaaaaagcttctttacaagagtatagtgattttgctaaattgaaaaaaaatgtggctgggtgcagtggctcatgcctgtaatcccagtactttgggagtctgaggtaggtagatcacttgaggtcaggagttcaagatcagcctagcccacatgacgaaaccccacctctactaaaaatagaaaaattagctgggtgtggtgatgcacacctatactcccagctattcaggaggctgaggcaggagaattgcttaaaccaaggaggcagaggttgcagtgagccaagatcgcgccactgcactccagcctggggaacagagtaagactttgtcttaaaaaagaaagaaagaaaatgccatgaaataaatatgtaataatctttaaactatatataaagtgtttcactgaataaattaaaggtaaatgggtctcctgtctctatttctttctttcacttcttcaacttctgtaaattctgatttacaaatctgaaatcaacttaaaagtatctgtatatttattatgttaattggtaccatgataataactgtgaggtatgaatgatactaataccattaattaagtatctactatgtgtcaggcattatggtaagtattttgcacattaagtttcaagttcccagatcttagtttttaaattattacattaactttttatattacttaagaaaacaataggagacggttggtccaagatggccaactaggaacagctccggtctgcagctcccagtgtgatggacgcagaagatgggtgatttctgcatttccaactgaggtacctggttcatctcactgggactggtggacagtgagtgcagcccacagagggtgagctgaagcagggcggggcatcacctcacccgggaagtgcaaggggtcggggtatttccctttcctggccaagggaagctgtaacagactacctggaaaaacaggacactcctgcccaaatactgcattttcccaaggtcttagcaaccagcaaacaaggagattctctcccatgcctggctcggtgggtcccacgcccacggagccttgctcactgctagcacagcagtctgagatcgaactgcgaggcggcaccctggcagggggaggggtgtcccccattgctgaggcttgagtaggtaaacaaaacggccaggaagctcgaactgggcggagcccactgcagctcaacaggacctactgcctctagacaccacctctgtgggtggggcatagctgaacaaaaggcagcagacaacttccgcaaacttaaacatccctgtctgacagctctgaagagagcagtggttctcccagcatagcatttgagctctgagaatggacagactgcctcctcaagtgggtccctggcacccgtgtagcataactgggagacacctctcagtaggggccaacagacacctcacataggcaagctgaccctctgggacgaagcctccagaggaaggattaggcaacaacatttgctgttctgtgacgtctgctggtgatacccaggcaaacagggtctggagtggaactcccgcaagctccaacagacctgcagctgagggaactgactgttaggaggaaaactaacaaacagaaagaaatagcagcaggatcaacaaaaaggtcacctacaccaaaaccccatctttaggtcaacaacatcaaagaccaaaggtagataaaaccaaaaagatggggagaaaccagagcagaaaagctgaaaactctaaaaatcaaagcgcctcttctcctccaaaggatggcagctcctcgccagcaatggaataaagctggacagtgaatgactctgacaagttgacagaagtaggcttcagaaggtcagtaataacaaacttctccaagctaagggatgatgttcgaacccatcgcaaggaagctaagaaccttgaaaaaagattagatgaatggctaactagaataaacagtgtagagaagaccttcaatgacctgatggagtgcaaaccatggcacgagaacttcgtgatgcatgcagaagcttcaatagctgattcaatcaagtggaagaaagggcatcagtgattgaagatcaaatgaatgaaataaaccgagaagacaaagttagagaaaaaagagcaaaaagaaacgaacaaagcctctaagaaatatgggactatgtgaaaagaccaaatctacgtctgactggtgtatctgaaagtgacagggagaatggaaccaagcaggaaaacattcttcaggatattatccagaagaacttccccaacttagcaaggcaggccaacattcaaattcaggaaatacagagaatgccacaaagacactcctcgagaagagcaactccaagacacataattttcagatgcaccaaggttgaaatgaaggaaaaagtgttaagggcaggcagagagaaaggttgagttacccacaaagggaagcccatcaaactaacagcggatctctcggcagaaaccctacaagccagaagagagagggggccaatattcaacattcttatagaaaagaattttccatccagaatttcatatccagccaaactaagcttcgtaagtgaaggagaaataaaatcctttacagacaagcaaatgctcagagatttttgtcaccaccaagcctcccttacaagagctcctgaaggaagcactaaacatggaaagaaacaaccggtatcagccactgcaaaaacaggccaaattgtaaagaccatcgatgctatgaagacactgcatcaattaacaggcaaaataaccagcgaacatcgtaatgacaggatcaaattcacacacaacaatattaaccttaaatgtaaatgagctaaatgcaccaattaaaagacacagactggcaaattggataaagagtcaagacccatcagtgtgctgtattcaggagacccatctcacgtgcaaagacgcacataggctcaaaataaacagaaggaggaagatctaccaagcaaaggtagatcaagcaaaaaaaaaaagcaggggttgaaatcctagtctctgataaaacaaactttaaaacaaagatcaaaggagacaaagaaggccatggtaaatggatcaatggcaaagggatcaattcaacaagaagacctaactaacctaaatacatatgcacccaatataggagcacccagattcataaagtaagtccttagagacctacaaagagacttagactcccacacaataatgatgggagactttaacactccactgtcaatattagacagatcaacgagacagaaggttaacaaagatatacaggacttgaactcagctctgcaacaagcagacctaatagacatctacagaactgtccaccccacatcaacagaacatacattcttctcagcaccacattgcacttattctaaaattgaccatataattgaactaaagcactcctcagcaaatgcaaaagaacagaaatcacaacaaattgtctctcagaccacagtgcaataaaattagacctcatgattaacaaactcactcaaaaccacgcaactacatggaaactgaacaacttgctcctgaatgactactgggtaaataacgaaatgaaggcagaaataaagatgttctttgaaaccaatgagaagaaagacacaatgtaccagaatctctgggacacatttacagcagtgtgtaaagggaaatttatagcactaaatgcccacaagacaaagcaggaaagatctaaaattgacaccctaacatcacaattaaaagaactagagaagcaagagcaaacacattcaaaagctagcagaaggcaagaaataactaagatcagagcagaattgaaagagatagagacacaaagaacccttcaaaaaaatcaatgaatccaggagctggttttttgaaaagatcaacaaaattgataaactgctagcaagactaataaagaatcaaatagatacaataaaaaatgataaaggggatatcgccaccgatcccacagaaatacaaactaccatcagagaatactatagacagctctatgcaaataaactgcaaaatctaggagaaatggataaattcctggacaaatacaccctcccaagactaaaccaggaagaagttgaatctctgaatagaccaataacaggttctgaaattgaggcaataattaatagcctaccaaccaaaaaaagtccaggaccagatggattcacagctgaattctaccagaggtacaaagaggaactggtaccattccttctgaaactattccaatcaatagaaaaagagggaatcctccctaactcattttatgaggccagcatcatcctgataccaaagcctggaagagacacaacaaaaaagagaattttagaccaatatccctgatgaacattgatgcgaaaatcctcaataaaatactggcaaaccaaatccagcagcacatcaaaaagcttatccaccatgatcaagcgggcttcatccctgggatgcaaggctggttcaacatatgcaaatcaataaacataatccagcatataaacagaaccaaagacaaaaaccacatgattatctcaatagatgcagaaaagacctttgacaaaattcaacagaacttcatgctaaaagctctcaataaactaggtattgatggaacgtatctcaaaataataaaagctatttatgacaaacccacagccaatatcatactgaatgggcaaaaactggaagcatttcctttaaaaaccagcacaagacaaggatgccctttctcaccactcatattcaacagtgttggacgttctggccagggcaaccagacaagagaaagaaataaagggtattcaattaggaaatgaggaagtcaaattgtccctgtttgcagatgatatgattgtatatttagaaaactccatcatctcagccccaaatctccttaagctgataagcaacttcagcaaagtctcaggatacaaaatcaatgggcaaaaatcacaagcattcctatacaccattaacggacaaacagagagccaaatcatgagtgaactcccattcacaattgctacaaagagaataaaatacttaggaatccaacttacaagggatgtgaaggacctcttcaaggagaactacaaaccactgctcaacgaaataaaagaggacacaaacaaatggaaaaacattccatgcttatggataggaagaatcaatatcgtgaaaatggccatactgcccaaggtaatttagattcaatgccatccccatcaagctaccaatgactttcttcacagaattggaaaaaactactttaaagttcatatggaaccaaaaaagagcctgcattgccaagacaatcctaagccaaaagaacaaagctggaggcatcacgctacctgacttctaactatactacaaggctacagcaactaaaacagcttttggtactggtaccaaaacagagatatagaccaatggaacagaacagaggcctcagaaataataccacacatctacaaccatctgatatttgatacacctgataaaaacaagcaatggagaaaggattccctatttaataaatggtgctgggaaaactggctagccatatgtagaaagctgaaactggatcccttccttacaccttgtaaaaaaattaattcaagatggattaaagacttaaatgttagacctaaaaccataaaaaccctagaagaaaacctaggcaataccattcaggacataggcatgggcaaggacttcatgactaaaacaccaaaagcaatggcaacaaaagccaaaattgacaaatgggatctaatttaactaaagagcttctgcatggcaaaagaaattaccatcagagtgaacacgcaacctacagaatggaagaaaatttttacaatctactcatctgacaaagggctaatatccagaatctacaaagaactcaaagttacaagaaaaaaacaaacaactccatcaaaaagtgggcaaaggatatgaacagacacttctcaaaagaagacatctatgcagacaacagccacatgtaaaaatgctcatcatcactggtcatcagagaaatgcaaatcaaaaccacaatgagataccatctcacgccagttagaatagcaatcattaaaaagtcaggaaacaacagatgctggagaggatgtagagaaataggaatgctttacactgttggtgggagtgtaaattagttcaaccactgtggaagacagtgtggcaatccctcaaggatctagaactagaaataccatttgatccagcaatcccattattgggtacatacccaaaggattataaattatgctactataaagacacatcacacactggggcctgtcagggggtgggggcctgggggagggatagcattaggagaaatacctaatgtaaatgatgagttgatgggtgcagcaacccgacatggcacatgtatacctatgtatcaaacctacacgttgtgcacatgtaccctagaacttaaagtataataaaaaaaaatcagacatatgaaaaagtaacaaattaaaaaaaaaaataatcactattatgatgagtttcctctttttcccttttatgtactataatttatttttcctaaattaatgatggcatgttttatacaaaaatattttgtcattccttacatgaagaaaatatcacttaaattacttacatacttaaagttcatattttggctgggtgtggtgactcgggacgcctgtaatcccaacactgtgggaggccaaggtgggcagatcatgaggtcaggagatcaagaccatcctgcctaacacagtgaaaccccgtctctactaaaaacacaaaaaaattagccaggcatggtgggtgcctgtagtcccagctactcgggaggctgaggcaggagaatggcatgaacccagaaggcagagcttgcagtgagccaagatggcgccgctgcgctccagcctggaggacagagtgagattctgtctcaagaaaaaaaaagaagaaataaaccccagcatttccagggaaccaggggagttctctttttgccataggaactttggctcctcacctgacacataaagccaaggaagagcacaaccagtttgcgaagcatgatggaagaaactcagtgacctgtcattatggactgtcactttgatggtttttcacaggatgtagtgctcctcgtccctccctctctcctgagatcttagtattttgtctccactgaattaccattgattatttcactcagtctaccattataattacctgcgcctacaactctgtattgtcattactatttccagaaaatatgagtcctaatataataaaaacaaaatagtcccacttttgaataatgactatatatgcaacttcagcatttcacctgtatgaagtcccagacttaatatgttcttacagtcacatgaaaaagcatgacttttttttttttttttttttttttttgagacagagcctcattctgtcacccaggctggagtgcggtggcacaatcttggctcactgcaacctccacctcctgggttcaagcgattctcctgcctcagcctccagagtagctgggactacaggtgcgtgccaccacaccaggctaattttttgtatttttagtagagacggggtttcactgtgttagccaggatggtctcgatctcctgaccccgtgatccacccgcctcagcctccccaagtgctgggattacaaatatgaggcaccacacctggccaacactgtatttattcgtaagatgagatatgttctttcacatattatttcatatattctttttagtttataatatcatcagggacatgtgtattcctggagtccctctcaggaaaaactttaaaaatcttcctaaagtattcccctaagaaccaacacactaaataatattgttactttcatctgtgtaagtaaaaatgtgcaagtactgtgtaagtcctaattaacacaagaaaatccaattatttttattacatgaatcccttttacactagtttaaattgtaaaattggaagatgacaagattcagctctactttgaagttttcaaactaaatttgttgtttctataaagtatatttgaaactatttgctgtttcatgatccacaatcatctcaccaggttttactgtttttgtatatagaaaatgaagtatgaaggtgattgaacaaaagtaaatccacaattatacactcagtaatactgctcctacataatcaattgggaagtaaaatgaaagaaacttcagtcttatttttccaccctctactaattatggcttcttaacttgcagtttatcttcagattcttaagactatcataaaacatcacatatgaaaattaatgatggccagatgtggtagctcaccacctgtaatccctgaactttgagaggttgaggtgggaggatcacttgaggtcaggaatttgagaccagcctggccaacatggtgaaaccccatctctactaaaaatacaataattagccaggcatggtggcacctgcctgaatcccagctactcgggaaactgaggcaggagaatcacttgaacctgggaggcagaggctgcagtaagccgagattgcatcactgcaccccagcctgggcgacagagcaagactccatctcaaaaataataataataataatgataaattaatgactataccaaccccttaaaaattttaatgagaatcacttagtccttcataagtgaaaaatagattagtcatcagatttcgaatgcaggtttcactatttcaaaaacaacaaaactaagaaactagagaatacaaataatccttaccagataagtatcatcattagattttaaaaggaaagtacaaaataaagcaccactatatgaaaccttagggttttctcttcaatatactaaatcttcgttttaggctagaaatctttatcattcctattttccacaaatttttacatgcaattcctttaagtctatcataattatggattcaaaacccttcataccacatgtagtgtatatattaccagctatttaacaaaattgcagttgctggatggcccataatcagagtggcaacttcaaactgccggtcaccttcgaatgggtaaggtccaggttttgtgttgaccacacactgtcgagactcaggtatagggcatatagaatacgagtggtggactggtttgtgggtttgagggtctgggtggaagattacaaattcttctttgtgcaaagtgtaggagtacaacattgaacatggacttagcatatgtatggtctcccccactccttcttaagccgaagctggagagaatgggcattttgtaaatgttatggcatatgcaaatataatataatggcattaaataaaaacaataagggaactgactaaaacaaaacaggctgtgggctgggagttggtatatctgagttctactataacctggctgctgacattctctgagactttgaacaattcatgttgtgggaagtcagggaccccaaatggagggaccggctggagtcatggcagaggaacataaattatgaagatttcattttaatatggacatttatcagttcccaaattaatacttttatcatttcttatgcctgtcttacttcaatctcttaatcctgttatcttcataagctgaggatgtacatcacctcaggaccactataactgtgttaactgtacaaatttgattgtaaaacgtgtgtttgaacaatatgaaatcagtgcaccttgaaaaagaatagaataacagcgattttcagggaacaagggaagacaaccataaggtctgactgcctgcggggtcagacaaaatagagccatatttttcttcttgcagagagcctataaacagacatgcaataaggaagatatcgctaaattcttttcctggcaaggaatattaataattaataccctggggaaggaatgcattcctggggggaggtctataaacggctgctctgggagtgtctgtcttatgcggttgagataaggactgaaatacaccctggtctcctgcagtaccctcaggcttattaagattgggaaaccccaccctggtaaatttggggtcagaccagttctctgctctcgaactctgttttctgttgtttaagatgtttatcaagacaatacatgcaccactgaacatagagccttatcagtaattctgcttttgccctttgccttgtgatctttgtttctgccctttgccttttgatctttgttctcctttttgccctttgaagcatgtgatctttttgtgacctactccctgttcttatgccccctccccttttgaaatccttaataaatcttgctggctttgaggctcaggtgggcatcacagtcctaccaatatgtgacggcacccccaggggccgagctgtaaaattcctctctttgtactctttatttctcagccggccaacacttacagaaaatagaaagaacctacattgaaatattgggggtgggttcccccaataaattcacttatcttgtgccttagtttattcatttaaaatgaagaaaataagggctgggcacgatagtctatgcctctaattccagcactttgagaggctgaggcaggaggatcacttgaggccagtagtccgagatcagctggggcaacatagcaaggccccatctctacaagagtttttgtattttttgtttatttgtttgttttattagccaggtgaggtagtacatgcctgtggtcctagctacttgggtacctgaggcaggaggatcacttgagctgaagttatagtgagttattattgcgccactgcattccagcctgggccacagagcaagacctcctcttgatcaatcaatcaaagaaaataagacagtctagccccatctcactgactattgtaatagaagtgagataatatgtgaataaagcacttaaagccttaaagctataaagagttttttttaatgtgaaaaactattataaatatttatagtgttctggtactacactgtcaatggacacaaatgttccaaggttcatatagcttcttacagatgaaacactcatggcactttgctcactaataagaataaatcagtccgatccaaatagaacagttttagtttttattagatgcctagaacactgtaaatatttagtaattggtaaaggaaggtaagtatattttaactcttaattctaaataaagacaatgcaataaatttaaaatgtagatatgtttgtaaacagaatatttcacataactatagataccaacctattttttatgaatatggcaggataaaattagtattcctctctttcaatttgaaaaatattccaaaagcaacacgaccaatgaaaaacagaaaccccattttgggcaaaactaggagacaaaccacaaaacgagtagaaaggctgccaaaagcaatggagatgaagtgggaatgtatgctgtaggcagcataaagagaacattccagttgcaaatggcagaaaaaaacaaagtctatttcttgaagttgatgggtacactttaaggtataaaccccttgtttatatcaaagtgcacaggctgacagctagtgctttcccatatgtggtttggttccaagaagcagaaagaacaatgctaagtaaggaatcacactaactatatttgcagagagaagtccatctctgtggctacataagacaaaagactttgtacaatgaaactccccaaagttgtctatctccattggctggacaaaataaaggataaatagaatttaaaagatctacacccaaaacagaactttcacaaaaaaactgttgatacgaagctgatgaaaatcatgatgaatactccaccattaatgaataaaactatacaatcgactctaatttgaaatttttaaaaatatataattataaaattgtgttgaccagaacaataacaaagaaactcgtataatcaatcacttacctctgattcatattttatttttccttcatctaaaatacgtgcatactcttccttctggtgttcaaattctgacttgagaaatgtatgttcatagcgaagcttattatatacagctctatacttttctacctcctaaagggagaatgcatttatcatagatttataaacaaaattcgtactcactccaatagtcacttttacaaatataattttaaattacattataatgatagccactctaaaagtaaaaaataaatttaacagaaatacaaatgaatttggaaaggtcttcataacaagtatcctacatacagaagtagtacattcctgaaaagatatccaaaaagtaaattaccattcaattaatcttatttcttcactggttctcattatgataaagtgtatagtatgaggaaagtgttgatctctggacttaaataaaataacatgtaagaatgtagcacacctttcaaaatatagattttttaaatgtataatttagtataagtaaaacaaattcaaaagagatgtaaggttattgtaatatttagtacagcattttaacatctaattaaatattacaatgatagtttaactcaacagaccaacctgaagaatacgtgcagcatcatctctactgactaaccaggaacacatgcaattccctggagtgttctcatcctgcttcctaacagtactctatgaaagctgctggcattctgaatacccaacaagaaactcaggccacaaagcagaaagatacaggagacactaacaggaaattcgataacaaggaaagcatgtctcctaaaatacccagctcaccataaatctttagttcaaagatttctaagccagtttgtaaaccaagaaaatgggtttcattattttactgcagatatactttgctttgatttaaaaaaaaaagtttttattgaacttggtcacttatcttgggtctgatcttgtttatttacaaaaattaaacctactcccaaaccataatggcttgccattaggactgtattagaaagatcatattatcaagccagtaagccattataaaagacgattctacaactgttttgggcaattaccgcatcactagactacagctctccaaaggggcccattttgaaggggacaataatcatttgtatgtataaggccaggtatatttgttaaataaggtaacatatataaaatgtctaccaagtatctaatatacttgttatctgcagtcttatcctgtcccctttattaagcatttagtcatattatatcaacacttcaccaaaggagactagtctcaacctgaagtaaaactgtaacagatttttacttttatgaagtggcatgaaactcattctctctttcaacaaatattaattgagcacctactgtataccaaaatctgttctaggaacttggaatataacaatgaacaaaacaggtaaaggttcctcctctcatgcaacttccattctagaggtggtaaaacagaaaataaacacaataaataagcaaattatacagcacagtagaaggtatgtataccagaaaaaaaaataaaaaacagagcaaggtaagggggtctaaaggtctaagcagtaatgggaaaggcaggttgcagtattaaataggtagatgggagcagtcaaagtaggccccattgagaaagtgacattttagcagacttacaagagatgaagtttgccacgacgtatctggagggagagtattcaaggcaaaagagatgtgccaattaggctgggcatggtggctcaggcctgtaatcccaacactttgggaggccgaggcgggcagatcacttgagatcaggagttcaaaaccagctggccaatatggtgaaaccccgtttctactaaaaatacaaaaattagccaggtacggtggtgcgtgcctgtaatcccagctacttgggaggctgaagcaagagaatcgcttgaacccgagaggcggaggttgaagtgagccgagatcacgccactgcactccaggctgggcaacagagccagactctgtcgcaaaaaaattaaaaaagaaataaaattaaaaataaaaataaagaaacgcaccaattctggaatgccaaagaaacatcagtaggccaatgtggaaaaaggaaaggagatcagagaggtaatgggagttcaatcctgtgaagccttagaggccactgcaatgactgagtaaaagggggaactactgcagggttttggggtaggggaatgatgcttttcatcaagactttgatcccatgaggataaatgcatagtaaacaacataagttacttacttcatctagattcctaaaacgttctctcattggagtttctaattcttgttgtatttgggctcttagcaattccaatttttgtggagttaatatctaatatgtagagaaatgcaaacaatataaaatcacattaaaatcaagaattctccatatttcaaagcctctctcctaattatgacaatggaattcatgaaagtttttgcaatatagtttttttacagtgatcactatacaaatagaatcatcatttgaaataatactttaagaatctcaatttcaggctcttggagatgtcaaaaattccattaacatgaagtaaagacaattactgattattattgctattgttaggaataactatgttggcagctaagactatcatgttgtatacaatggctaatagtctagttattttccaaagcaggcaaaataaaggtgtaacaatttgttataccaaagagaacctttcagacttattttcaattagaaaaggctcatttttactctcacactgtacctaatttaggcttctccttgtcacactcttttatagaactcgtattttaataagtaattaaatatttatgtaagtcccatgtgggaaaacacagtctttattcaccgttgtattcccaatacctcccaccaatgtctggcacataggaaccactcaactatttcatgaatgaaggaggaacaaatactagttgtaaaaaaaaaaaaaaaaaatctaaagtttgcatgtatattaatttctataaaaatgataatgttcagtttccttttttatgaagagtccaaatattgtattcaaaatattacattttactgaatggagagcttactatatataaagcattgtacaatgcactgtaacctacataccatcctgttctaagcacattatatgcattactttatttaattcctacaacaatgccacagtatagctatgctgaggcacacaaggtatctaaataactttataaagatcacaaaaactcacatgaagcacatatctccccataaaaacttcaaactctggtgttaaaaataactcatacacacaaataactataaaagtaggcaatacaggcttaccagacaggtaaaaaagagaaaacacatttaggatagaaggcatgacacgtcaaaggaatgggaaaactaaagcttatatagaacccttatatagaaagcttatagaacccaaactcaagccaggtaacattttaatttgcctgggtgtcagagactgtatgggagaaaagtgattctcaaaggtgagttaaagccattttgaatgggaccacattaagtactacagaaaatttaaaattgtgggaccctatatgcacactggtagaaatatctaaacactgtaacatttccaaatgccaccttggagggctgcactctggctggaaacaaaaggaaaattaggttgcagccaaagagtgaaaggttcctgaataccaggtttagactcttattatttattcagtattcaatagtatttactttaaaaatttattttatttaaaatgaatatatacaattacataaataaaataattcaaacaaaagactaaaaagtcttctcacttcagtaatccaatttccttttattgaagcaatcattgtcaataacttatgtacccttcctaaaacaatctacagatacacaagcatgtatatcacttttgatttctatacaaaaaggatattgtacatatatttttctgtaccttatttattgaaggtttttaagcttaagagtgacactaccatatctatattttacgaagaagcaagatgaatcaaaagctttagtgggagagtagctgtagctgtgggaagaagaggcagtaaatggagccaaagaaaccagacagaaagctcatgtcataatctggtttacggtatcaagtatcaagtctgggtgacaacatcaagagtccaaactaagatgaggtagcaattaaaaggaagagattaataggtaaagcttacatggctcctgtttcaaatgatctaacttcaaaactaggcaagcaaaaccatgggaaaattaagaaaatctgaacaaaggtgggatattaaaaggtattaatgaataagtattttaaatatggcaaaggtattgtgattatgcttttaagacagactgcactgatttgttatagagatatatactcaattatttgttgaaagaatattatttgattcaaaataatccagaaacattgaggaaaaaagtggaagtgggtgggagaaagtagtagataaaacaagcctggctcagaatgaataattattaatgctggatgatgggtacatgggaatgcattacatgtttgagatttccaaaaccaaaagttaaactgaaagtaaaaagccttccactttcagccaagatagaataagagcccagattcgctctcttgcctgaaacaaacaaaagaacagacaaaaattaaacagtttgcaagacactagacataagaaagcaaaaggcagatccctgagagacacaaaacatagaagataagctttgagagttttcaggacctggcaccggaaaggatacctatgcagtcatgagggactccctgagttgaggagatgaaactgagcatccaaggacagtggggtggttagagtcctaagacagggtagcagagaaaagagggcacagaaagacaactatgaagacctacaaaaagtcttgactcattcagtagagtactgattaacacatgtgtgcaaggaaactacctaaggctaggcaaatacacacctgaaaggattagaaggatgaatacgcagagctcacaaagacctaagaatagtttctgttccccaaaaacagattaaaatcctttgtttcataaagaaattgttatactactcagaagagtcttgcctcagtggtgggaaataattagcactacactaaatactactctgctcccacttaaatcttaaaagcaagacccagaaagataaaactgtttccaaataatttaactgtgtcccaaaataaagctcaagaacatgtatcagaatataaaaatattgggaggtggagattgcagtgagctgagatcactccattgcactccagcctgtgcaacaagagtaaaactccgtctcaaaaacaaaacaaaacaaaacaaaaacaacaacaacaacaacaacaacaaaaatccagcattttaaaaacaaagttcacagtatctaacatccaataaaaatttaccaggcatgcagagaagcatgagagagagagagagagtgagagtgagtgtgtgtgtgtgtggtgggggcaggggggataaacttaaaacaggcccagaaatgacacagatgtcattaaaactttattgtacagttattgtaactgaattccatatgttcaaagaactagagaaaagactgaacatgttggatagagataaaaagaccaaggccgggcaaggtggctcacgcctgtaatcccagcactttgggaggccgaggcaggcagatcacgagctcaggagattgagaccatcctggctaacatggtgaaaccccatgtctactaacaataaaaaatttaaaaattaaccaggcgtggtggcgggcacctatagtcccagctactcaggaggctaaggcagtagaatggtatgaacacaggaggcggagcttgcagtgagccaagatcgcgccactgcactccagcctgggcgacacagagagactctgtctcaaaacaaaaaaaaaaaaacaaaattgagcttccagagacgaaaactacaatttctgagatgaaaattacactgcatggaattaatggcaggttagatactgcagaagaaaaaatcaatcaatctgaaaacatggcaacagaaactaaccaaaatgaagcacagagacaaaaaatactaaaaataaattaataaacaacatcagcaagctatggcagaactttaagtggtctaatattagaatgtaattaagagtctccaaaggaggtgaaagaggagaaagaaaatatttttagaagtaatctccaaaaattttcagtttgataaaaactgtaaacccatagacctatggaactcaataaaccccaagcactacagatataaaaaaaactgcaaagtatgtcaatcaaattgcttaaaaccagcaataaagagaacagcagccaaaaaaccagacaaagtgcactgcaaagaacaaagataacctgtgctcactaccctgtagagtgatgtagctgcacaatatccatgcagcttctagcattatatgttcaattacatcacagatgcctcttggaaacaacagtgctttaaatcctgtaatggtgtgcacctcaccactggcctgtgcaatctaatagcatacaacagtttaggggtcttctgatctgaggtctctgacaaagcatctctaactttttcttacctcctaggaatcttattaaaaacaaatacacacataataaattctctcttcctctgtctctccccatctctccctctcctatcccctatacctccaaagcacacataaaccaagacaccgactgaattagaggatttttcccatcccattttaggaaaaaatattctctcttaggctactttttgtttgtttgtttgttttggagagagaaagagtctcgctctgtcgcccaggctggggtgcagtggcacgatcttggctcactgcaacctccgcctccaggttcaaacaattctcatgcctcaccctcctgagcagctgggaagacaagcatgtaccactacacccagctaatatttgtattttcaatggagacagggtttcaccatgttggccaggctggtctcgaactcctgacctcaggtgatccacacaactcggcctcccaaagatctgggattagtcatgagccactgcacccagcagtgtcttagacttctaatggaatattgccactacttgtctccaaagaaacataagaatgctttatcatacaacagtctaggtgtcattacctattttaaatctataaaaacaaatctttaacactgcagtacttgccatttaataatctaaaataggccaatcttttacaaagaatactttaaggcggcaaatactgctatgccaaaaattcttaataaattaatgactgaaactgagtattatactttgatctgagcttcccagcagccaaaacaaaatgggaacctgtatactaggttatacagttttcattagcacaaaaagagtatattaatcattggtaaagtaatttccgttttattagaatatatcaaatgatccccatatttaaaaaggttttgctaacatggtacatagtaacacaataacaacatgtactgaccacttactagatcaaagtaccatactaatacttttttttgagtcagggtctcgcgctgttgcccagggtaaagtgtggtggtgtaaccatggctccctgaagcctcaaactcctaggctcaaacaagtctcctgactcagcctctctagtagctgggactacaggtgcatgccactatgtcaggctaacttattttactttactttttagagacagagttacccagttacgttacccaggctggtttcaaactcctagcctcaagtgatcctcctgcctcctgaagttctcaaggtgggagccaccatgctcagcctgaactaacactttctatgcactgtctcatttcatccttacagtcatcctatgagctaggcactattatcattaccattcactactgatgcagaaatgttctttaaatgaatatctcttatatctttttcctataaaagccaaagagatgacattaaatcttagaaaaagcatttttgtaggcagactagataatgcacgtatattttaaaaataatcatctttcataaaccttcattgaaatatttcttgatctttgttgaatttacttttctaaacttacaatttgcgcaaattgcaagcatccattaaacaaatagctaaattgcttcaaaatgtgtgtttatatgtatacatgatgtttctttagcttatttttgccaaataaatatcacacagaaactagatatgtttatcttaaaaaacagaagccttactagatatgtttatcttaaaaaacagaagccttactagataaattatatttgtgagcaaacatttgggaagttttcacatggaggaacatccaaagttaccaacagggaggctatagggtagatgacttcattttaataggagagagaaaatgtttaacatactttaatctataaatacaattggatcactttaaaaagttcaccaggttctctagcactgaaagcactgaagcagaaaatgaagagagtcctgtctgaaagatgttctaaaaaggattctgctttggacagtgtattcgtttcctaggttgccataataaaataccagaaacgacgcagctttaaataacagaagtttgttctttcacagttttggaggctattagtctgaaatcaaggtgtgttgacaggccttgctccccctaaaatctgcagggaagaaactttccttgcctctttctagcttctggagcacttaaatctctgcctccaccatcacatagtgctcctctctaccccatctgtctccatctctcttctcctctttttttaaggacaccagtaatattgagttaaaggctcatcatactccaatatgacctcatcagcttaactaattacatctgtaatgaacctacatccaaataaggtcaccttctgaggtactaggagttaggacttcaacatatcctggttggggatacaactcaacccataatagattcaaagaaaaactagatgattaccaactctaagatgctgaggctgtaggtatgtttgacacagacagtgcaatatatgaacaacaatcccaattcattcatttatttcaatttttcacgtcattcattcaacaaatagatgtttactaggcattatcctaaacactgaagacacactgaaaaaaagttcctgccttcatggagcctgaattcaaataaacatgtcataatctatgaatatttactatgtggaaagtatggcagtaaaaatgtagatgttatctcattagtcctcacaactcttgttaagcagaaacttttatccgctttaccacatgagaaaactaggcatagagacatagttacttgttgaagttatcatcttctggaagaactgtcccttttttttcattataaacatcctttttatctttagtgatactctttgtctggaagtctcttttatctgaattaatataactactccagccttctggatgtgctttacttactttctggatgtgcttggtacaaataatcacatttagatgtcactctcatgaaacagaataattaaatttgcaatacctgaagaatctctcaaatatcttgggttcagcattcacagcttccactcatacagggctctaaatttttgcaaaacaaattaatgcattgattctacaggcttaaattacatttccctcttcgatttacatttctgaggtttatatttgtatatttaaatgtcctaaatatacctaggaatgaaacagtgagcatagtggaggctccaagccaggcttagtggtgttcccagcaatggtagatttgaaaaagttattgaatgacaaacttacaaggcttctgtcaaaggatatctaagagttgggtgatatgccagactaggtgacttgaaagatgccttcttactctatgaacttctgactctaatattaataataccttattatttgtaccaatcagattgttaggcagaaataaatagctggtgctcttcagagattaaataaatatgggaaaatattattcgtgagaacctactaatctgaaatttacaggaaatttgactggagtttaaagtctggctttgctcaattttccagacaaatgaaaaaatgaatagcgtgaaaatgatctaaagaaactgtacttcagcactttggagacaactatcttttgctttacaaacccatttgtgttacaatgtacacataaattatgttcacatactgtttttacagtctcttttaagaagctctttaagaatagctgtccttttttagctttcagttataatgcatatacaaatactagtaactcttttaaaaaaattctttaattctgaatttttatcaattcaaactcactttttccctaattattcttaatggttaaatattatttatatcagaataggcaatataataccaatttacataaaataacagtttcatggctcccttacatggtagctaacattctaaaatatatgaaagaagattaaattgtaccacttggagatacagcaaagtaatcattaaggatatagacagaaattgccatattcaccaaaactacttacttccactacgtatctgactgcttttatactaactcaaaactcaaatatattttctcacctgcagtttcatttcttctaaatctttagttttctctactaattctcctcttagttcttcaagcaggagctgaagtttttcctgctgagtttgcttttcattaaacaggtgcttgagttcattttgtaactttacatgttcattctgcaacctggttttttttaaagagaattcaattttgagtaaatcctttctttctaattgcattactttatgtaaagtcaatcaacaccacagaaaaacaagaccaatatcacacattcctttaaacccacaagtatcttttatttacagagtttcatttaattattaacactgtagttttggaatgcaattttactttggtgggagatggggaacacatttagccatctggatacatttaatcttatacgtcctgctactttcaaaataaggcttataaattcataacccacttgatatcatacttagtttggaacaaagtaattttaaagtaaaaattttactatattaaaaaagttttaaatgtatacattgcaaaataacaaaattatactatattctatagcaaacattcagccaagataatgccaataactttttaaaaccaaaccccacttctagatttaagtaatttaccttgtgtgttcagccttcagtgtctgataattagctttatgatgctcacatcgtaacctttcatcaattaacattttctggaactccgactgagaacctgtcaatccactgtctccaccaggaggaaaattattgggaaaagtgtccatatcggtaaatgtgctgacaaccatgtaaaaataagttttggctttcttactgttttagttttctttccaagggtatttcccactcctttcttgctaaggcagaatctcaggaagccaaattatacctgcacagagaaataaacataattacataatttgcgatcagtaaacgtaagcctcctttaatgttacatatttttatcacttttattattcttttttttttcttttttttttttttttgagaggagtctgctctgttgcccaggctagagtgcaatggtgtgatctcggctcactgcaacctccactcccaagttcaagcaattctcctgcctcagcttcctgaatagctgggattacaggcgcctgccaccatacccggctaatttttttttttttttgagacggagtctcgctcgttcgcccaggctggagtacagtggcgctatctcgactcactgcaacctccgcctcccgggttcacgccattctcctgcctcagcctcccgagtagctgggactacaggagcccgccaccacgctcggctaattttttgtatttttagtagagacagggtttcaccatgctggctaagctggtctcgaactcctgacatcaggcattctgcctgcctcggcctcccaaagtgctgggattacaggcgtgagccaccacgctcagcctctccttatcatttttattacaaagcccaattctcagattttaatttgttcataaaacaaaatgcaaatataaagctgaatcacaccttgaacaattttctttacctccatgcagcttctatgcttctatgaccatcaaaatcacatcttcaagtattaacctagctccactagaagcagactttcccagtttaggtagtcttaaattcacaaaccagagtcatgtttcctgaagctaccacagtaagcttcaagtatagatcctggtataaaatccatactcccaaatcagaggaaaagctatttggaacttggtaactggctagggagaatcaaggtcttcaaaaggtgaccttcagcaagtaactatgcctatgattaatgctttgaagggtcttttacttgacacaaggcaagctgcacccagactacagattcacatgagaaatttgtcaacacataaatattgatcaactcctatgtgttatacactgtgttaagaaaactaaatctcacctatctccaaaagcactgactcagtattacaaacgtcactgtttatttcatctagaaataaaaaatgatgtttcaaagtgttcttataactaagaacaaaaattttaattaaaatagttgtctcctttaatttctttctctagtcccataatacatacacacacacacacacacacacacacacacacacacacacatacatacatatttttttcctgatagaatcttccttagccatgggttattacaaatcacttcttataacaaaaaaaaatctttgtcctatgcaaaccgaccattaaattattcagccttgcttgaattataccatctctgataaattagtgtgatatctacgtattacttaagacaatctttaaactataattgcagttgttttggtttcctctgaaattatattttaatacagagggaaaagtccctcaagaacactatactccttactcttagatttaacacgcactgggattcaatctttgtaaatacagaatgcgctatctgtagcagctaccacaaaattatcctgccaaaagtacacatttgccaaggaattaatgaattgcatcataaaactggcattcaatttttactctactgtgggtaaaatgctatcaaatagaatctcatgctccaaagaaatctttcatgaaaggaagagtcaactgatgtggcaaacttcactgttgtctcattttaagaaactgctacagccatcccaaccttcagcaaccatctaaatagttagcagccatcagcagaaaggccagacccttcacctgctaatagatgattactcactgaaggctcaggtgatcaatagcattttttagcaacaaagtactttccaattaaggtatctacattttaaagacataattatattgtaaacttaacagactacagtatactgtaaacataacttttccatgcactgagaaaccagaaaattcttgtgacttgttttattgcagtagcaatccaaataagttaaaataaggaaacactaattcctaaatgtaagtttagatttactcttgacttctaaagctttacaggaagaaaaaatatttgggggttaataaatatgtttggttccacattaaaaattattctgtggaaaaaatacatttttaaagattataaaatgtgtctttataaaatgttgatatgtgacagctcaaaattgcttacttcctaggttttcactaaaagttaagattactaagatttaactaaaaattaagattgctaagagttaaaattctagttaatacatagaattctgtatgcaaagggtacaagaaaaaaacaaaatttgtttttggtgaaaaaagtgttttaaatggcataaaaatgtgtttttatttaaaaagtaatttgtctaattcagaagttattgaaagattatttcaaaatatgaatttggaaaaacatgaaaacaaggcagaaaggaacaagtgaaaaacagacacaaaaaactatgagaatgtatttttggtaagaaaagagaatgacagtaatttttgtataaaaaaacttatgtggttgaaatgatagaaaaaaagggaagtaaatttttgtcctaaggtaaaatgattgtttcagtataaacaagagaaatataagacaaaactaaaggactgagcaagctgtagaaggtctgggcaaattatgaaaggtttgtgagagatgaatcttatgaaagaaattttatttgtgaacaaattggctaaaatgaaaagtaaattgtttataggtttgtcttaaaattgagtcctcatatcaaaagtacactgatacaacactaaaatttgatcttctcttttaaaacaagattttcttattgattgctctcaatgaaaaaataataaaagtagattttaaaaggcaaaaaacccccactatttaaaatggagagagaaattaataatgataaaggttaaatacaccagaaagatgtgacaattttaaatttacatgcacttactatggccactaaatagtaaggcagaagttgtcaaaactataaggagaaatagacaaattcacaatgataggaggagaatttcaccactattcttggtaactaatgggacaagaagatttaaaaaaataatcagtaagaacacagataatttaaacaacacaattaaccatgctgacctaactgacatatggaagactataccctgtaactacagaatacacactcctcacaagtatacacataacatttataaatgttgaccacatgccaggtatttaaaaaaaatttcaaacattttaaaagaccaagatcatacaagataccttctctgaccacaatgctattaaactaaactcaatacaaaaaataatcagaaaagccacatatgcttacaaagtaagaaatacatttctaaataacttatgaatcaaagaaaaggtcaaaatagaaattagaaaatatgtagtactaaatgaaaattgatactccattttaaaacttatggaataaaggtttctactttgaggaagatggaacagatatacattttccttttatactcattaatataactaagagtcctggatttaggtatatgacaaacgtaagactctgaataatggagactagaaggctgactagctatggacctgagaatgtaaggacaaatacagtggtgagtttatttccctgggttttctttttcatatatctcagacacagagctgaagaaactggcaaccaggaaacaccaattaattcagacaaataagtcttgaacaaaaaagcctactctctagccaaaggaacaaaaaagagggagcctagcaagataatatgtagacaattacaatctactctatccaaataccatacacacacacacacacacacacaaaaaaaaaaaaactgtagttccacccccatccacacaagcaaagattaggtggaagccaagctaggctgtaataaaataccctaatactgggccaagatggtgcacaagaaggctcaccagaaaacagaaacttccattgcttcctgaaccgtaataaagctcaatgatcctgcaatgtcagaggagaccacatggaaaacctaaactttcaccccccaccaagagtaacaaagaggacctccctcaccccactgaaatgctggcacagaaggcctagtggagacttatgacaggcagaaccaccaacagtaatgaggctaccctctccagggtatcagggaagatcacatggggagccagaactacagctacctggcaataacaaagacccctcccgcaacccccctcccaaaaaaaactaaggtgtcaacagaggccatcttagaaacctcgacttgctaggcactatggcttgtgactgcaaatcccagccactcagaaagtgaggtgggaggattggttgagaccaggagttcgagaccagcctgggcaacacagtgagaccttgtctcaaaaacaaacaaaaaaaagtcattagctaggcatggtggcatgtgcctatatgcccaggtacttgggaggctaaggtaggaggattgcttaagcccagttcaaggctgcagtgagctatgattatgccaccacactctagcccaggcaacaaagcaagattcccacctcttaaaaaaaaacaaaaacacaaacaaaaaaaccttgtacttccatctccacctggcaaaaacaaggtagtatgccctctttcctctaccagaaaagtgtcagaaaaagccagctaaaacaaaaagtttagatagaatccacaatattataatatcccaaatgtccaagtttcgatagagaaccactggtcggccaggcacagtggcttacacctgtaatcccagcactttgggaggccgaggcaggtggatcacctgaggtcaggagttcgagaccagcctggccaacatggcaaaaccccatctctactaaaaatacaaaaattagcagggtgtggtggtgcacgtctgtcatctcagctactcaggaggctgaggcaggagaacgcttgaacccaggaggcaggggttgcagtgagctgtgatcacaccacagcactcccgcctgggcaacagaggaagactccatctcaaaaatacatacatacatacatacatacatacattaaaaaaagaaatccactgatcatatcaagaatgaagatttcaaactgaatgaaaaaagataacaagccaacactatgatgacaggaatgttatggttatctgacaaagactttaaagcactgatgataaaaatgcttaaacaaacaatgacaaacaagcttgaaataaatgaaaagagggtcacagcaaagaaatacaagtctcagaaaagaaggtaaaaagaagaaccaagtggaaattttaaaactgaaaaatacggctaagcctggtggctcatgcctgtaatcctagcactttgggaggctgaggcaggtgggttacttgaggccaggagttcgagatcagcctggccaacatggtgaaaccctgtctctactaaaaacacaaaaattagccaggtgatgtggcatgcgcctgtagtccagctactcaggaggctgaggcaggagaactgcttgaatctgggaggcagaggctgcagtgagccaagattgtgtcactgcactccagcctgggtgacagactgagactctgtctttaaaaagaaaagaaaaaaatacaatgaccaaaataaaaatattagatgagctcatcagcagaaatagagaggaagaggaaaagaattaatgcactgggaagatacaactacagaaattactcggctgaacaatagacagaaaatagacatacaaaataaataagcagctcagggactgtcagaactaacaaaaaatacctaccattcctgtgcttggtgtatgattccatttatatgaaatatccagaatagataaatacatagaaggtaggctgatgatttccagggactaagggaatggggaaatgggagttgactgcttaatggttacaaggttttctttgatgtggtaaaatgttttggaactagataatggtagttgttacgcaatgctgtgaatgtaataaatgccactaaattatatactttaaaatagttaatgttatgctatattaatttcacctcaataaaaaaagagaaaaataaacctagcaaactagaaacttaaaagtgcatcaatctcatcaaaggtgtatataaaaagagtattttaaaacaccacacctgactttaaaatcttaaaacatctttttctgagagtgtgatcaaaacaagaaagtccattattgctacttttattcaatattgtattgaagaactagaacaaaacaaaggaatagaaggtataaaaactaaaaaaaaaaaatctttatatacacatgttctgattgtgtatgtagaaaatctaaacaaatttacagaaaaataattagaaaaagcaagttagcaagattggcagatagagcaatatacaaaaattaattgcattccatatgccagcaacaaaatattttttatttttttcaatagtgatattctttaacaacaatgtatgtttaaagacattcttaataatataaaaaatatcaaaaacctaggtaaaaagatgtgcaaactatttattataggaaaactgtggctagctactgaaacaaactaaaaaagacctaatagagatatggactaggtgtatggattagaaaacattctaaagagacaaattctccccaatctacagatgatgtgatatcaattaatatccaaatgagtgtgtctctatgtgtgagaaacttaacatgctgattcaaaaatttatgtggaaatacaaaagacaggccaacaacagtggaaatgattttaaagaaaaaaatgagaagactttactatatatcagtacttactacaaatatacagtaattaagatggtatagtatgccattggcttaattatagacaaagagaccaataaaacaggacacagcccataaactgacctacccatataagataatttagaacaaaggtggttttgctgaaccgtaaggagaagagagtcttcaataaaggccactgggacaactagataaccttgtagaaaaaaagaaacttgcgcctttctttttattacacactaaaattaattctagttggactgaagatctaaatgtgaaaagcagaagcacaaagttgccacaatataggaaaaaatattcagtaactcaaggcaggaaaaatagcacgtctaaaatctaaaaggtgattcccagataaataatgagaccgagcaccttttctttgtttactggccatttagatatcttcttttataaaatatccatttgcatcttttgcccaattttttctattgaattgtcttttcaattactaatttgtaaaaattattcataatatttaaatctcaatgagaaaaccaaaaagactgacgataagtctggagaggagaggaagcaaaggttgtagtgtaaactggcatattcactttgggaaaaaaactagcattatctactaaggttaaaaaaaaatacatatactatgactcagtaattcctctcctgggcatatatccacttgaaatgtggtatacacaggtccacaaaaagatttatatgatactgttcatagcagtattattcctaacaactgaaacctagaaacaaatccaatgaccatcaacagttgaagaaacgaatagtggtataatggaactagcactatactgcaataaaaataagctatagatcaagtttgtccaacctgtagcccatgggccacatacagcctatgatggctttgaacgcagcccaatacaaattcataaactttcttaaaaccttatgagagtttgttttgcatggttttttttgttttgttttgttttttagttcatcagctttcgttactgttagtgtattttatgtgtggcccaagataattcttcttccagtgtggcccagggaagccgaaagactggacacccctgctatagatactctatatatatagggtgaatattacagacatattgtccagaagaagccaaacataaaagaatatacactaaattattacaaatagattattacaaatatataaagtttaaaaattaaatacaagcactatagtatataggggatacatgcttaggtataagcatgtataaagaaaggaactatattatcattaaagtcaggaaaatattacttgatgaggctagtaacgttctacttcttgatttttgtggatatatggaggtttgctttgtaacttgctttgtaaatcactcagctgtacattgttgtgtacttttctatatgtatattataattcataattttttttgagacattctcattctgtcatccacgctggagtgcaatggcatgatcacagcttactgcaccatcaatctcccaagctcaagtcacctcagtctcccaagtagctggtactacaggcacatgtcattaggcctggctttttaaattttttttatttattttaatttttatttttattttgtagagacaaggtcccactatgttgcccaggcttggcttgaactcccacactcaagccatcctcccaccttgacctgctaaaatgttaggattacaggaatgagccactgcaaccaaccttataattcacaattttttaaaaagggacttagaagggagagtaattcaaaaattgggctcagcatcatgtcaaggactgtagtccttttcatttttcttccaacaaatcctgttggcttaattctcctcatggttgtgaggctaccacatggatatgtaatattcattttttaaaaatttattctactatttctcctttattcatgtgcttgtttatagtcctttaagtaaaatttacacataatgaaatgcacaaatattatctccatgcatcacttaacaaggatatgctctgataaactcattgttaagtaatttcattgttgtgtgaacatcaaagaatgtacggtacttacacaaacctagatgatatcgcctattatacacctaagatatatggtatatagcctattgcttgtaggctacaaacctgtacaacatgttactgtactaaatattggaggcaactgtacaaaatgaagtagaggttcctcttcaaagggactttccttccagtctaattgagaataaatagtagcctctcttagaagcaaaatttactcaaagacctgtggtaatattcttaaatatctgctagccataataaagaaaccaatatgctttgtgtgcttagcccccaccttttggcctagatatttgccctggcatgcctatataggcccaagcaagcattaggttatagcctgtttctcttccttatttggaggtgttttggcctttctcagcattccacaagttacttcctcctttcctttgttctcccctacctttacctcttttgggaggttctaagttgctagccaatcaggacaagaacagaatgtgaagtcccgttccagccaatggaaactggacacagccatagcatggacgcattagattataaatgaccctgtctcctttgtttgtatgtgctctcatggcaagactgctagtgagtggcaccctttctgcagaaagtaaattagccttgctgggagatcctttatcatagtgttgatttccgcgacactgaatacccatttccaacagcaactgtaacacaaatcactaggcaatagaaattttttagctccattataatcttatggtaccactgttgtgtatgtggttatatgcagcacatgaatgcacacaatttcatgagttcacaaaaggaagaattcaagaaagcctcaatttcatcaagatataaaacagtcccatcactccagaaagttccttcatactccttccccatcaccccacccacaagaggcaaccacttttgtggttattctcaccatagctccacctgatccagaacatattaaagtgaaatcatacagtacgtactctcatgtatttgccttgtttcacccaaatagctgtgagattcacctatgtttttgtgtatctcagtagtctgttcctttttaaggctaaatagcatttcatcatttaaatataacacatattgtttatccattctcctgctgatgcgcatttggttgtttctggttacaatgaatatagctgctatgaatattcttgtacaagactttctgtggacacattttcagtttgggggtgggtggtggtaaacatttaagagtggaattgctgggtcatggagcaggtttatatttaactttgtgtaagaaactgccaaatctttttccaacgtggttgtaccattttctattccaaccaaaaacatatgagaatttttttttttttctgagatggagtttcactcttgttgcccaggctggagtgcaatggcgcaatctcagttcatcacagcctctgcctcctaggttcaagtgattctcctgcctccacctcccaagtagctgggattacaggcatgtgccagcacacccggctgattttgtatttttagtagagatggggtttctccatgttggtcaggctggtcttgaattcccgacatcaagtgatccgcccatctcagcctcccaaagtactgggattacaggtgtgagccaccatgtccagccaacatattgagaattctgtttgcgccacatttttcccaataccttgtagctgcaccagaccaatctggttcaactttttttttttttttttgcaaaagaaaaaaagtttttttgatctccttgaatgtagcacacaaaaaaagtgatggctcccccaggctccatcagcaacagtaaagggcaggaacatagagatttctttttccaggcccaggcctgtgaaaaacgatggctaagtgttagtccttagcagggccgacggatggtctccattcctggttaaccctctggaatttgggagcatgagtatctccaagaattcatttctactcagtaaagatggggaggggaatcccactgttacttgttgaactggaaagaatagaccccatgctctgagggtgtgtccactgccacttggttctgttggccgctgctctcctcgactgaaacactggaaggaaggcacaggggtgtactgggagatgtaagctccttgcatagctgcagccgtcagcatatacatgcctgtgctgctgaggcagagatggcccagttgctgggtaaggggtcccatcatggaggcaggctggagagaaatgggatggtccatccctggtgtcagaactgaacctgaaggctgcatgaggtatgaatggtggtgcatccaggatgggttaggtacttgtagaggagatgtctgagtcactctctgatacgaagacacaggagaggaaaggtatggggagagtgcagaccgagcaagcatcctgttgggggtgatgttataaggggctgggtaaaacccattctgaagagctgtggtggggtcataggtcaaggccatgatgcccatgtctccattccttggccaagcccgtccattttgcacaaatattccttggttctgtcgtttctttggcccgccatcagcaaatttgcaaagcaagggatcggatggggctggtactccagggggtgtcttaatatattttccattaaagtgggtgatgatggcttcacacttctctgtggactccatccttgcaaagccaacacctctgctggtcccactggtatctcgaaggatacgggtggagataacctggccaaagggcttcagcatcccctccagttcctgctcatccattgacagtgggaggtttgagatgtataaatttgtggggtcctgttcctgttgctttaccatctgtgcctgtacaccactggccttcagtgctgttacagctttctgtgctgctgaagggctgtcaaaatctacaaagccatagcctttacatttgtttgtggtcttgtccagtacggccttagtggaaacaatcttgccatatggctgacacagcttgacaagatcttggtcagtagtgcctggttgcaatcctcggatgtataggttggttttgctcagctggtcatttccattgcttccactactgctgttaggtgtactgttgcttgggctaggtggtgccatctgctgagccaatgacacatatggcttcttgttgtttctattgtagccaaaagtagaaatcccgggcctggaagtcacggatagcagcattttctctttaatgttagggaacgagtgagagagagagagagagagaaagggagggggtaagaaagacggggagggagggaggaggggatcgagggaaagggggagagggagggaggaaaaaagggagggggaggagaaaggaggagaaaaggagcaggaggagagagatgaaggggggctgcctctggttcaacttttatgtaataaattgtgagttatttttcagctgccatggaccctcagctcacataacctgagcatgctcagatgagccaagactgcaatctcaggaggaacctaagtgcttggaccaagaaatggggactgaattaagaagcagacattgcatggcaggatccaggatccaatcagatcaagctctggcatcatcccatggagggatcctgtcagatcatgcctccagtaccacctcattgcaagatccaatcagatcatgccttgttatcctacacttataaaacctgactcaggcccctgctttaggaactatccccatgttctccttacttgttgcaagtaataaaatcctcatgctaaatcctctttggttgtgagcactgagttgatgatacctgccaagcaaccaaacccatctgtcgtgtgggtaataatgtgatgttgtgagtccctttaattgtagcccttctaggaggcataaagtggtatctccttatgattttaatttacgttttcctgaagcactttttcatgtatttaatggctgttcacagaccgtcttaatctatgaaaagatttttgctttaagaaccatcacagcaaagaatatttatgctgtagctggcaaaatgggagattttaatagctaatgtgtatataagaaatgaaaacaggccagtgcggtggctcacgcctgtaatcccagcactttgggaggccaaggtgggcggatcacgaggtcaggagcttgagaccatcctggctaacacagtgaaaccccatctctactaaaaatacaaaaaaaattagctgggcgtggtgacaggcgcctgtagtcccagctactcgggaggctgaggcaggagaatggtgtgaacctgggaggtggagcttgcagtgagccaagatcacaccactgcactccagcctgggtgacagagcgaaactccgtctcaaaaaaaaaaaaaagaaatgaaaacaaatctaaaatttgtctcattgcactaattaccatttagcttcctgagcacatactgctgttttctaccgccatggctttgtaaatgctaatttccttgctcagaaggctttttccatctctttgtattctgatctagtgaattcctattcagccttcaaaacccagctcaggaatgcattacttcctccatgaagtaaagaccctcccaaatagttcattattctgtgttttatcttgcattttagtatatacaacacatggaatgtaactttgtccatgacaagaaacatgtcttactcatgttcataatcccaacacctaaaaaaccacaggcacatattaagagctcaaaaataacaaatgaacaaataatgtgctcaccattctaatgctactttagcctcgattcacttttctcctccaaattcagaaacagtcttccaaacaatagtgggctgaatgctagccctcaaaatatgtcatttcctaatctctggatgctatgaatattaccttatatacttttaaaaaaagggtggggtgattaaattaaggatcttaagaggagaggcttatgctggattatgtatccaaaacaatcacatgtatccttctaagagagaaggagagggagtttgagactgaagaggaagaggcaatgtgaccacggagacagagactggaaagatgtagccataagccaaggaaaacctacagccacaaaaagctggaaaaggcaaggaaaagattctaacccagagccttcagagggaacgtggcttggccaacaacttgatttctgacttctaatctctaaaatgttgaaagaataatttttttgttgttttgagacacctattatatggtaatttgtaacagcagccacaagtaactaatacaatggctttctcttgtatttatatttacttataaaaaggtttatcaaactcaaaatttctaacacaattttaaattcctaccatggttagacttctttgatttcaatcagtcaatacacagctatcaattatctgcaagacacttacacatacattagatgcttgaaatacacaataaaacgtctcctactgtgcagtttactaaatacagaaattcatattgaaaattttttaaagtaaagtacagagttcaaacagcaataagtgaaaaaaagtgaaacattatctcgattggcctgttaatcagtgagcacttgttgggctagtctcagtgaaaggcagtttttaaaagactagtacaacctttttccaaattcttcatcttctctttgcaaccattacaaatacataatcacatccacgtgtccttcctaccacttcttttgactagtcccagctttacagacctccatatgacattttattttgcataggcactgtattttttaagcagtgagtagtacaatgtctgccccaaagtatggtaattcaaaatattcaaaaaagcacagctgctgatgctcatggaaagcttccaaaacacattccattaaaagcacatgctatgcctttgaatatttcaaaacaatgttttaaatactacatgccctcaaagtgaatgatgttttttaaaaaacaacattaaaagtctagggaggacctacaccaggcatttactttacttataaacaaaacattagaaatgaatttcttcaaaatccagagataatcctgcactagtcacccaaacagcctttggatagccatccaggatgtcttgcgtacaaaaaaaaagtcacaacttgacgccctgccagaacctgaagtgcagctgggagcagacccttcaaagccctggtaaggtgccaggctctgtaattgtgatttagaaagaaacaagggagagcaaggaatgagaaaaggaagaagatatgtattcaagtggttagcaatcaaccaccaagcactctaaattaaaatgttattctatttttacgattgtactgtctgcctctgcacagcttaattcacacaaaagaatctagaaagtaggacatagtaatgactcaacctcaaatgcttagtgtaaattaccaaagtctctgaaagttgtgatctgaaaggcaaagatgattcttgtccaaattcattttaacatttcttaatgtaaggtctgttacaataacatggggactttccagaagatttatgagcacttagcacctctgtgtgagttgtatattcttctttgctcacagtcccacctttcttctgaaatagaaaaggctacccataatatggctgctaatacacaataaagattatctactgatgcaacagcatatcctgaaaattgttttttaaataaatcctgatttaattttacttctatgagatttatgccgtaatctgaaaagttaaagagaaattgatacttaaaactgagtttaactgatattttactgcagttaacacaaacattctcttcattattttgaatctgtcacaaagcaagtataaaatttttcacagccagaaaaaggagataaataaaagccatcctcaagacacacaggttaatgttaaaaccatatactttaaaaaactgattaaacaaccaatatttattaagtgactgctataccacatttactgaatggtctacttacagtaaaagggttttgagagatataaaaaatatacagaccatcaagtcaagcacacttctcatgaggaaagaagagcctgcccatattcagagtactccatggatattttctaagtacctttaatatgctagacactttgttggatacaggaatacagaaataaataaaagaaaatccttgtcctcaaggagtttatgatggtcagtggaatatacttgttaaccaacaattgctgactgaataaggatgagagaaaatggactatttaaactttctggacttaaaatttttttaccatgtgcacatattacctatacaaagtcataaattcaggaagtttttaaattgtaaaacattaaggaattcaacaaagaggtgacaggaaacacctaaatcaaggaaagagagagaagtgaggcagcctgcttatccgagattagctaagagcctggagagaattcccagtcaggggaaagggtaaatgagagatgcccaggggtccacattcccaccatggatacttgcaatcctagccacagtagaggccctggaccctcacaggccctgaaactaacaaagggaactgcatgaagagtgcacaacagcattgctccagagagggagctcacgctggggcacaccaacctctccactccccatcccagtcctgcagctatagtaagacaccattttgagaactcagtcccaacagactgcaccttgtgcttgggcttaacagcacctgtctcttcacatccctggagtcccactgacatacccagcccacagctaccaccatgcctggttcctgatgctggggccaaagtgcacgcctctggctccaatctcagccactgcttccagcagtggagccaccactcattttcatgtgcccagagtccctcacccacagctgccatcactgtgctaccaggactaaggaataagcaaagcatgagcttccactgcccaggctaaagcacaagccaagcatgagctgccaccaccaggactaaaatgtgagtgaaacacaggctgcaccaccaggactgaaacacaagccaagtatggtctgccaccaccagggctaaaatgcaagtgaaatgcatgttcctaatacttgcctgcatatagctggtatcactgaaagcaactctgccctccccagcagtagggctgcagcacagacactgcctctcacaacatgaacattgtgctgggggcctaaggatcaccccaccccttcctaacacagccagcacctatacgcaccactggggagtctaaagacaagcccacctggcctcacccaccccccatgccagagcacacaatccagaggcctggagatcacacaactcagccaccattggcaactaaggactcttcccaggaacctgagattgggctcacccacccagctactaacatcacagcaagaaaatatcatacctccaaaggaacataataattctccagcaacaaatcccaatcaaaaataaattcacaaaattctggaaaaagaatttaaaatattgattttaaagaagctcagtgagatacaagagaatactgaaaaataacataaagaaatcagaaaaacaattcctagaatatgaatgagaaatttatgaaaaagataggtatcattaaaaaaaaagaatcaaattctggaactgaagacttcactgagtgaaatacaaaatacatttgaaagcttcaacaacagactagatcaagcagaagaaagaatctcagaacctgaagataggtctttcaaataacccaatcagacaaaaggtaaagaataaaaaacagtgagcaaagcctttgtgacatatgggcaccacaaggcaactaaatattctcattttcagagtctcataaggcaaagagaaaataaaatgcatagaaaacctacttaatgaaataacagataaaaacttccgaagtctagcaagggatttaaacatccagatacaagaggctcagagattcccaaatacagtgcagaaaggtcttccacaaagcacgttatagtcaaactgtcaacaatcaaagacaaaaagagaattccaaaaacagcgaaattcatttcacctataacaacacatagactgaaagtaaagggatggaaaaagacattctatgcaaacagaaactaaaagggagcaggagtaggagtagctatacatatatctgttaaaacaggctttaagtcaaaaacagtaaaaagagacaaaggtcatgatataatagtaagaggatcaattcagcaagaggataacaattctaaacatatatgcacccaacacaagagcacccagatatacaaaggaaacattattacacccagaaagaaatccacaaatagccatctaattttgacaaaggcactaaggacatacatttgggaaagaatgtccccttcaataaatggtgctgggaaaactgaatatccatatgcagaaaaattaaattggatccctacctctcacatatacaaaaatcaactcaagatggatcaaagatacaaacgtaagacccaagactataaaattactagaagaaaacatagggaaaacacttcaggacattggtctcagcaaaaatagtatggctaacacttcaaaagcacagaaaacaagaacaaaaatagacaagtgggactatattaaactaaaaagcttcaacacagcaaaggaaacaatcaacagagtgaagaaaaaacccactgaatgggagaaaatatttgcaaaccattcacctgacaagggactaatacctagaatatacaagaaaatcaaaacttaacggtaaaaaaaaaaaagcctcattaaaaagtgggtaaaggccacaaacatttctcaaaagaatacatacaaacgaccaatgggtatatgaaaaaattctcaacatcattaattaccagggaaatgcaaatcaaaaccacagcaacatatcatcttatcccaattagaatggctactataaaaaaataacaacagatgctggcaaggatgtggagaaaaagggaactcttatatgctgctggtaggaatgtaaattagtacagctactatgaaaaacagcacgaagatttctcaaaaaactaaaaatagaactagtatacaatctagtaatcccacaatggggtatttattcaaaggaaaagatatcagcatgtcaaagggatacctggactcaggttattgcagcactattcacaatagcaaagatacagaatcgacataagtgtccattaatggattaactttttcttttttttttttttgagacggagtctcgctctgtagcccaggctggagtgcagtggcgcgatctcagctcactgcaagctctgcctcccaggttcacaccattctcctgcctcagcctcctgagtagctgggactacaggcacccaccaccacgcccagctaattttttttttttttgtatttttagtagagacagggtttcaccgttttagccaggacagtctcaacctcctggcctcgtgatccgcccacctcggcctcccaaagtactgggattacaggcatcagccaccacccctggcctgaactgttttttttaaatgtggtatatatacatggtgaaatactattcagctatgagaaagaatgaaatcatgtcatttgtagcaatatggataaagatggagatcattacaataagtgaaataagccaggcacaaaaagacaaatatcacatgtactcatgtgggagcttaaaaaaagttgatctcatggaggtagagaataaaatgatatcaaaggccaggaagtatgtgtgtgggggaaggtgggataaagggaggttgcttaatgaatacagatatccagttagatagacaatacaagttctaatgtcgcagagcagagtacagttaataattaatttgaatcatatatatttcaaagtagctacaagagaggactttaaatgttcccaacataaatgataaatactcaaggtgatgaataccccaagtaccctgacttgatcattacacattctatgcatgtaacaaatacacatgtacctcataaatatgtaaactatgtgccaatttaaaaagagaggaacttcaaaaaaattataaaatattataacatatttaccagtagtatgaatggacaagggagagaaccctaattctgctagtgaagctgccagggaaaacttcacaaagcagcagctaaaattaacaaagggatgcaaggaagaaacatcaagtgcaaaataatggagattaaggagaagaacattagtggtggagggcagaggagaggagaacaccctggggaggtaaggtagggcctagaaggccacatgcagaagactggaatttattccatggtcttggagagccagtgaaagattttaaacttttagatggatagaagacattacggggtagactcacatttacatttcagaaaaataagtcgtttatttgcagaggatagatttgaggaggaagaatagaagaaagagaaaaagaaaaggagatcaaaggtccaggaaagtaataatgagggccttaactaagacagtagcagcaggtagtcaataatcttgaaaattaatttgaagccaggcgcagtggctcatacctataatcctagcactttaggaggtcaaggcaggcagatgccttgagctcaggagttcaagaacagcctgggcaacatggtgaaagcctgtttctaagaaaaatacaaaaattagcccggtgtggtagcatgtgcctatggtcccagctactcaggtggctgaggtgggaagatcgcttgagcccaggagggtcgaggctgcagtgagccaagatcgcaccactgcactccagcctgggtgacgaggtgagaccctgtctcaaaaaaaaaaaagaaaagaaaagaaaattaatttgggggcagcaagagcaggagttaataattagatacctatacccatcccccagcaaaaagtattttaatgtcactagttaaaaggcctatcaggaaaccaagataggaaagcaaagaataaacactaaaatggaatccagttaaagtgaaagaaaggttgtttcaaagattacaattacttcaagcactaatcctacataagaatgaggaatcctgtacactgacctttggcaaatgaatcttagtaaactgcaaataccatcactgtaaaacactcagaataactaccttttttccatagggatttcataagcagaggggcaaactctaaagctggctctgtcgggaacaaagacataaaataaggattttgttccttaaatgtccacctgctgctactcctcctcattctttccttcaaacaaatcatctctatagcaacacactcttaaagaatttgtgggtggaaagcatatgtttgtgcaaaaatatgagaactcaagaacatgagctattttattttttcctttaatacaagagatacacaatctattaggatacaactaaaaaataagagatatgaaacaaaaaaatgtttatacacaaaaaaatgtaaaaattgtacaaatgataacgcaaatgtttacatggaaattctttttataggttacaatgacaccttgtggtaagacttttcaagttatacaaattatcttagaaaatattttttacagcagagacgtaagaaaaccggtttagaaaataggaaagctcaaaaccatagtaatgagttaatgtgtacaagtataataatacatttgaaaagttaaggttgaaaaatcaaacttttaaaaatgtcacaatattaggtaggcaaaagcactttactaactgtaaatacaagttgaatatcccttatgtaaaatgcctgggaccagaaggatttcagattttgaattttttcagattttagaatatttgcatgtacataatgagtatcttggggatgggacgcaagtctaaacataaaattcatttatgttccatatataccttatacatacacatagcctgaaggtaattttatttttcccttgaaggtgcttaataaactgcgtgttgtatgcctgcattttgactgcaacccatcacatgaggtcaggtttgaaattttccacacggtgtcatgttggtgttcaaaaagtttcagatttcagagcattctggattatgggattagggatcctcaacctgtataaagcattatactagtcccttcacttgaactgaaattattaaatactcttccttattctctggtcccttattcccatcttgtaagaaaagtcaagctgcacctctcaaagcttcatctattactttatctgaatgacactgaaatttgcaccctagttcctaacctctctctgcttatgaatccccctctacttacatgttctctctataacagaagctcaaagatgggatttaagacagactacccaaaatatggcaccttggcatttgagaaaaaagcagaagcaagaaggtttatctcaccttcctctaaagtaggtcataagatcctcaatccagaggtgtcctccctatacctgtaggagagaagacacaaagaggaatctgaacaaacaggacttactaagtttcccccagtttgttactgctagagcatacccatttgtcctctaacgatacttctgcatgactgtccacaaaaaaacagagagacagaccctttgaaaaaagcagtttactgctgcaaatgccacaagacagccaaaaaactccaaagacaaaagacatgaactctcgggagctctatgggcctgtccatcatctgagaaaccccagtacttatcctgccaatgcagggcaagattatatcccccttctactaccgcagctgctcctctcttgaaattgccacttcctgactggaggccaaccaactcaagccatttcagcaactcctaacagaacaactctgttccaacggagaaaacagcagctaattcaactgcctgcaactccctggctaatcagaggtcctgagtctgtccacatgacaacttcaaccgctagcctaaccagcattcactctcctgccacctccactacagcaggtgctggtatccacagctgggagacctgaagacagattatatcacaagacaacttgcagacattcgccagcaccagcctggagcccagtaaccctgctgggtggctagacccagaacggtaataacaatcacctcagtctggctcctaggaagccccatccctaggggaagggggtgactccacatcaaggaatcaccctgtgggacaaaaaaaaaaaatctgaacagcagtccttcagttctagatctttccactgaaacatacaaataaaaaggaaccaggaaagtaattctggtaatatggcaaaacgaagtttgataacacccccaaaagatcacactagctctccagcaatggatccaaaacaagaacaaatctctgaattgccagataaagaatttggaaggttgattattaagctactcaagggggcactagagaaaagtgaaaaacaacttgaacaaataaaaaaaaaaataaaaaacaggatatggatgaaaaagtctccagagaaatatacatcataaaaaaaagacaaccacaacttctggaaattaaatacacacttagagaaatgcaaaatgcactgaaaagttccaacaacagaactgaacaagtagaagaattttagagcccaaagacagggctctcgaattaacccaatctgacaaagacaaagaaaaaataattttggctgggagcagtggctcagcttataatcccagcacctcaggaggctgaggcaggtggaccacaaggtcaggagatcaagaccatcctggctaacatggtgaaatcccatctccactaaaaatacaaaaattagccaggcacagtggcgtgcacctgtagtcccagctactcgggaggctgaggcaggagaatcacttgaacccggaggaggttgcagtgagccaagatcacgccattgcactccagcctgggcaacagggggagactccatctcaaaaaaaaaaaaaagaaagaaggaaagaaaaagaaaagaaaagagaagaaaaaattattttagaaaatgaataaagcctccaagaaacttgggacgttaaaagacccaacataagaataattgctgtccctaaggaagaagagaaatccaaaagtttaggaaactatttgagggaataattgaggaaaacttccccggttttgatagatatctagacatccaaatacaagcagcttggccaggcgtggtggctcatgcctgtaatccagcacttcgggaggccaaggcaggaggatcactcaaggtcaggagtttgagaccagcctggccaaaatggtgaaaccccaactaaactaaaaaaaaaaaaaaattacctaggcatggtggtgtgggcctgtagtcccagctactaggaggctgaggcaggacaatcacctgaacctggcaggtggaggctgcaatgagccaagatcgtgccactgcactccagcctgggcaacagggcaagacttggtctaaaacacatacacacacacaaacaaatacaagaagctcaaagaacacccaggaaattcatcacaaaaagatcacctaggcacacagtcatcaggttatctaaagtcaagacaaagaaaagaatcttaacagctgtgaggcaaaagcattaggtaacctacaaaggaaaacctaacagattaacagcagatttctcagcagaaaccctacaagctagaaggaattgggtcctatcttcagtctctttaaacaaaaaattatcagccaataattccatatctagcaaaactaaattttataatgaaagagcaatagagtctttttcatacaaacgaatgctcagagaattcaccactgccaagccagcactacaagaactgctaaaaggagttctgactcttgaaacaatctcaaaacatcaaaatagaacctttcttaaagcataaatctcacaagacctacagaacaataacacaatgcaaacaaaaaaaggtaattaggcagcaactagtatgatgaataaaatagtatctcacatctcaatactgatgttgaatgtaaattgcctaaatgttccactgaaaagatacagaggccagcacagtggctcacacctgtaatcccagcactttgggaggccaaggtgggcagatcacctgaggtcaggagttcaagaccagcctggccaacacggcaaaagcccatctctactaaaaatacaaaaaaattacccaggcatggtggcaggtgcctgtaaacccagctactcgggaggcagaggcacgagaatcgcttgaacccagggagcagaggttgcagtgagccgagatcatgtcattgcactctagcctgggtgactgagtgagactgtcccaattaaaaaaaagaaaaaaaaaaaagatgcagaacagcagaatggataaaaatctaccaagtatctgctgccttcaagagactcacctaatacataaggactcatataaacttataaggtaaaggggtggaaaaagatattccacgcaaatggaaaccaaacgtgagcaggaacagctattcttatatcagacaaaacaaactttaaagcaacatcagtttaaaaaggcaaagatagacattatataatgataaaaggattagtccaacaggaaaatatcacaatcccaaaaacatatgcacctaacactggagctccgaaatttataaaacaattactactagacctaagaaatgagatacatggcaacaaaacagtgagagacttcaatactccactaacagcactagacaagtcattaagacagaaagtcaacaaggaaacaacagactataccctaaaacaaatggacttaacagatatttacagaacattctacccaacaattgcagaatatattcttttcatcaacacatggaacattctccaagatagaccacaaaacaagtctcaataaatttaagaaaatcaaaattatatcaaatattctctaagatcacagcagaataaaactagaaattaactccaaaggaagcttcaaaactatacaaatatatggaaatttaaacctgctcctgaatgacctctgggtcaacaatgaaatcaagatggaaattttaaaattctttgaactgaacgataacagtgacacaacctatcaaccctctgcaatacagcaaaaacagtggtgctaagaggaaagttcatagcaatcactgtctacaacaaaaattctgaaaaagcacaaatagattatctaacctcacaactcacagaattagagaaacaagaacagaccaaaccaaaacccagcagaagaaaagaaataacaaagatcagaactaaatgaaattgaaacacaacaacaagaacaacaacaaaatacaaaagataaattagacaaaaagctggctctttgaaaagacaaaatcgacagaccattagcgagattatcaagagaagagagtagatccaaacagctcaattagaaacaaaataggagatatcaaaagtgataccacagaaatacaaaagattgtgcttttgtatggctactatgaacatctttatgcacacaaactagaaaacctagaggagatggataaattcctgaaaagatacaaccctcctagattaaactaggaagaaatagaaacaaactgaacaggtcaataacaagtagcaagattgaaacagtaataaacaaaaaaaatgccaacaaaaaaaaaaaaagtccaggacctgatggattcacagctgaattctatcagacattcaaagaagaattggtatgaatcctactgaagctattccaaaacacagaaaaagagggaatcctccctaaatcattctatgaagccagtattatcctaatagcaaaaccaggaaaggacataacaaaaaaagaaaaccacacaccaatatccctgatgaacatagatgcaaaaatcctcaacaaaatactagctaaccaagtccaacagcatgtcaaaaagaaaatacaccatgaacaagtgggttttataccagggatgcagggttggcttaacaaatggaagtcaataaatgtaatacaccatataaacagaattaaaaacaaaaaccacatcatctcaacagacgcagaaaaagcatgacaaaattcagatccctttatgattaaaaccgtctgcaacatcggcatagaagggacataccttaagataataaaagccctctatgacaaacccacagccaacattacactgaacagagaaaagtttaaagcattccccctgagaactagaacaagacaaggatgtccactttcaccacttctattcaacacactactggaagtcctagccagaacaatcagacaagagaaagaaatcaagagcatccaaagtggtaaagatgaagtcaaagtgttgcagtttgctgatgatatgatcatatacctagaaaaccctaaaaactcatccaaaaagctcctataactggtaaatgaattcggcaaagttttaggatacaaaattgatgtacacagatgagtagctctgctgtataccaacagccaccaagctgagaaccaaatcaagaactcaaccccttttacaatagctgcaaaaaataaaataaaatacttaggaatatacctaaccaaggaggcgaaaagacctctacaaggaaaactacaaaaaaaaaaagctgaaagaaatcacagatgacacaaatggaaatatatcccatgcgcatggatgggtagaatcaatattgtgaaaatgaccatactgccaagagcaatctacaaattcaatgcaattcccatcaaaataccaccatcgttcttcacagatctagaaaaaaaatcctaaaattcatatgaaaccaaaaaagggcctgcaaagcaatactaagcacaaagaacagatctggaggtatcacattacccaacttcaaactataccaaggctatagttaccaaaacagcatggtactggcataaaaacaggcacatagatcaatggaacagaacagagaacccagaaacaaagccaagtacttacagccaactgatatttgacaaagcaaacaaaaacataaagtagagaaacgacaacctattcaacaaatggtgctgggacaattgacaagccacatgtaaaagaatgaaagtggaatctcaactctcaccttacacaaaaatcaactcaagatggattaaagacttaaatctaagacctgaaaccataaaaattctagaaaataatatcagaaaaactcttctagacattggcttaggcaaagagttcacgaccaagaaccaaatgcaacaaaaatgaaataaatggatgggacttaatgaaactaaaaagcttctgcacagcaaaagaaataatcagcagagtgaacaggcaacccacagagtgggagaaaatattcacaaactatgcatcccacaaaggactaatatccagaatctacgaggaactcaaacaaatctgcaagaaaaaaaccaaatattcccatcaaaaattagggaaaggacatgaatagacaattctcaaaagatatacaaatggccaacagacatatgaaaaaatgttcaacatcactatcagggaaatgcaaatcaaaaccacaatgcactaccaccttactcctgcaagaatggccataatttaaaaatcaaaaaataatagatggtgacaaggatgtagtgaaaagggaacacttttacactgctggtgggaaggtaaactagtacaaccactatagaaaacagtgtggagattccttaacgaatgaaaagtaggctgggcgttgtggctcacgcctgtaatcccagcactttgggaggccgaggcgggtggatcacaaggccaggagatcaagaccatcttgactaacatggtaaaaccccgtctctactaaaaatacaaaaaattagctgggtgtggtggtgggcacctgtagccccagctactcgggaggctgaggcaggagaatggtgtgaacccaggaggcagagcttgcagtgagccgagatcgcaccactgcactccagcctgggcgacagagcgagactccgtctcaaaaaaaaaaaaaaaaaaaaaaactaaaagtagaactaccatttgatccagcaatctcactattgggtatctacccagaggaaaagaagtcattatatgaaaaagacacttgaacatgcatgtttatagcagcacatttgcaactgcaaaaatatggaaccagactaaatgcccatcaaccaatgagtagataaagaaaatgtggtaggtatatatatatataatgcaatactactcagccataaaaaggaatgaaataatggcattcacagcaactgagatggcattggaggccattattcacagcaaccgagatggaattggaggccattattctaactgaagtaactcaggaatggaaaaccaaacaccgtatcttctcacaagtggaagctaagctatgagaatgcaaaggcataagactgatataatggactctggggacctggggggaaggagggaggggggtgagggttaaaagactacacaccgggtgcagtgtacactgctcaagtgatgggtgcaggaaaatctcagaaatcaccactaaataagttatccatgtaaccaaacaccacctgttcccccaaaactattgaaataatgattttttttttagaaaaaacacggaaagaaaggtttccctgtttctttcagtcttcacttctgaagactcatataaagtaaaggtttcattaaataaatgtgtatgctttcctcttgataatctgtcttttgttataggggtctcagtcatgaatctagtaataggtgaggaaaagttatcacattttatccgctacatcaacttaacaaaaattcagttcattaggttcaaattttctacttgtctccttaaaaaagtcagttaccactatcctcctctcatttcctaaccactacccatcctctatcctctatttataacaaattaatcctactgattcttcttcatctgtttgttgaatttaatcattcttccccatttctagagccatcacactccagtgccgaatcttaaatattttacacttaacagaagcctcctagacagtgtcccagactttagtattttctcattcttacatagcctacaaatatcaccaaaacaatctttctcatacattgccttcgtcactataactcctatgataatccttattctttcctgactcaaatctaaatttcccagctaaactcacagccccgtattagccagctccctatacaaattcaaacattttgctgccccacaggacccctttgctagagtcaattaagtttacagacccccaggacccctttgctagagtcaattaagtttacagaccctcaaacacatttctctttgccttcacaactttgttcatacagttatgccaaattaaaataccttcttaaaccttgtctattaatccacaaatcacagagtcaaacctgaaaccctacagtctgcaaaatcacaaaactattttcggagttttagttgctctaaaagtgaacagaaagagtagcttttgtccatgtgctttataggttcctgccttccttgtgcttgccccaggatatttattctatataaacatatatttttttgagacagaacctcaccctgtcacccaggctagagtacaatggcgcaatctcagctcactgcaacctccgtcccgcgggttcaagtgattctcctgcctcagcctcccgagtggctgggattacaggcatgcaccacgcccggctattttttgtatttttagagatagggtttcaccatgttggcaaggctggtctcgaactcctgacttcaagtgatccacccaccttggcctcgcaaagtgctgggattacaggcatgagccactgtgcccggcctaatttattctatattctataatgtctgcacttttcccctccagatgctttataactatataaactacgttttccaaagaaactataaattcctcaaaggaaaaactacatataatcttctactgttttgttcatcttcatagttcccaattccagtaaactgttaatgacagtaaagtgatccacaaaatttctatgatgtgaatcctactctcccataggcttgtaatgtaatttcagagaaaccttggggaaggatgtcaccaagaacactgtttgctaaccaattatgcatgcgttatagttagttatcaagaaatttctacctcaggccgggcgtggtggctcacgcccgtaattccagtactttgggagaccgaggtgggcagatcacctgaggtcagaaattcaagatcagcctggccaacgtggtgaaaccctttctcaactaaagatacaaaaattagccaggcatggtggcaagcacctgtaatcccagtactcaggaggctgagagaggataatcacttgaacgtgggatgcagaggttccagtgagccgagatcaggccattgtactccagcctgggcaacaagaacaaaactccaactccgaaaagaaaagaaaagaaatttctacctcaaaagttaaaaattctggaggacagtctactaagcaaaagctttcaaaatgaatatatcttttcatttagtaattctaattttaggaattaatcctgagaaactaattagagatgcacaaacatttatgttcaagaatcttcttttatttgtcattcagtaaatgtttactgagtgcatcctaaattccaggtaggaatggaggatagaatcagttcttatcctcatggtactaacttaatagtggtgtttacaatggaaaaagagactattaaaaaagcaggtcatggccaggtgtggtggctcatgcccgtaatctcagcattttgggaggtcgaggtgggaggctcacttcaccccaggagttcaagatcagcctgggcaacatagtgagactctatatctattttataattgtttttaaaaagcaggttacaatagcaagaaatgccatatttgtggatcagaaaattcaatattgttaagatgttaatttctcccaaattcaatgcagtgtcattcaaaataccaagttttcatagaaattaacaagctgattctaaaattcatatggaaacacaagggacccagaagagccaaaaaaaaaactttgaaaaagaacaaagttagaagacttgcattacctgacttcacttattaaagtgccatagaaatgaaaactatgtagtattaaatcagtcacaaaaatccattaaacaaaaaagactgtccagaaatagagtcaaatagaaacagtcaattgatttctgacaaaaatgcagtcaattcagtgaagaaaggatagtcttttcaacaaatggtcctggaacaattgccttttccatacacacacacacacacacacaaagaacttcaagttgctccccacgccatatacaaaaataggatcaaaataaatcagaggcctgaattaaaaacctaaactataaacctcctaaaaaaaaatacaggagaaaatcattttgatcttgggttaagacttctcagatataacaccaaaagcacagtccataaaagaaaaaactgacaaactggatttcatcaaaatgaagaacttcaaaatccactactcttcaaaatccactgttacataaatgacaagatataccagactcaggggaaaaactgcaaatcataaatcttataaagcacttgcatccagaataaagaactctcaaaactaaatgataggaaaataaacaatcaaaatttttttaatgggcaaaacattcaaatggacacttcaccaaaaaagattaagtaaacatttgtttgtattttccaagtactccagtttcctcttctcatatcctaaagatgtgcacattagattcactgggagattgaaattgtcccagtaggaatgagtatgggtgtgtatttaagtgcaccacgcaatggaatgtcatcctgtccagggttggttctgtgccaggataggctctagccaccagaaagcctgaaccctagagcaggctggaaaatgaatgaatgaatgaatacaaattattgtaaaatgaaatttcaaataaagtatataatcatgtaaatgcatgacaatactatgtagtacaaaagcactcttatcaagcctgccatatttgtgattatttttgaactgcatgatagtaagaggtgtcccttatattttttgctttgcaaacatttatttcttgggttaacccaccaccactatgaccattgtcactcactggttcaccaaaaattaggtaagtaactatcttacttgttttttttactaatctttcttaaacattatagctcacatttatttcaacgtttaatgttggaagtgtcttgggtctttatttagaagtttgatgatgttttttgaccagagatatgccataggaatttaactattgtttttatcaattagtctagggtaaagttggtttcatgatacatcatttcacttaaagtcagtttccaagaacctatcaataatgttaagtgacggccgggcgtggtggctcatgcctgtaatcccagcactttgggagggcaaggcaggcagatcatgaggtcaggagatcgagaccatcctggccaacagggtgaaaccccatctctactaaaattacaaaaattagccgggtgtggtggtgcgcacctatagtcccagctacttggaaggctgaggcaagagaatcgcttgaacctgagaggtggaagctgcactaagctgagatcatgccactgcactccaccctggcaagagagcaagaccccacctcaaagaaaaagaaaaataaaaaataatgttaagtgacgacatactgtacacgaaatatgcagtgggagttctagaaggtcagtaaagagagaaagaggcagaaaagaagttttgaagaaataatcgccaaaaacttccctaatttaatgaaaaacattaattgacacatctaaacagcccaacaaatccaaagaaacctgcaaatgctgaaacacaaagaggaaatctttaaaaaggagcgagagaaaaatgacttcacatacagggcaacaacaatattattaacgttgatttctcatcagaaatgacatggaaaaaacaaatttttttaaagaaacacaaaaaactcaccactaaaaattctatattcagcaaaactgcccttcaaaaatgaagatgaaataaagacattttcagatagataaccaaagacgaagacaagtcgctgctgtgagacatgccttatgagaaataacaatggaagtccctcaggataaaaggaagtcacaccataaagtttaatctaggctgggcacagtggctcatgcctgtaatcccagcactttgagaggccaaggtgggtggctcacttgagcccagaagttcgagaccagcctgggcaacatggcaaaaccccatctctacaaaaaatagccaggtgtggtggcacgtgcctgtagttccagctacttgagaggctgaggcaggaggattgcttgaactgggtaagcggtggctgcagtgagccaagatcgcactattgcactccagcctggaaaacaggagaacctgtctggaaaaaaaagaaaaataatactctacaggagaatgaagctcattggaaactgtaattacatcagtaaatattaaagactctaaaaatataattattttcacttcatctcgtttaaagacataagactacataaaggaataattatagtactgtgtcgctgagtttgtaatacatacagctgtaatatatataataataatagcaccaaaaagagaaaaaacagataacactggaggaaagtttctataatttatcagaatttagtattattctgaaggagactgtaattaagttaaaaggcatattgtaatccctaacaatatagcaaaagaaatcaacagaaataaaaagatacactaaagaatatttaacacagaaagatggtaaagaaaagaggaaaaagcaaaaaacaaatgagacaaatagaaaacaaatatgaaaaatgcagatgtaaatccaataatatcaacaattacattacatgtgaatgaactaaacactctattcaaaggggggattatattacaatggattacaaaacctaactataggctgtcaacaagagataaatcttcaattcaaagacataaacaggttaaaattaaaaggatttttttaaaaaaatacaccatagaaacagtaaccacaaaaaaaactagagtggctatagtaccaagaaaaatagattttaagataagaaatattacagacaaaggaggccatttcataatgaaaacagggtcactatatcaggaagatataacaataactgtccatctaaccaaagaaccccaaaatacatgaagcaaaaaaagagataattaaaaagagaaataggtaattcaacagaaacagctgaagactgcaatgactgatagaaaaagacagaaaatctgcaaggatatagaagtcttgactaacctcatcaataaacttgacataactgacagaaaataccacccaatgattgcagaatatacaacctttttacaaacacaaggaaaattttccaggatacaccacatactggggcacaagacaagtctcaataaaatttaaaagattgaactcataaaaaatgtgtgatctgatcacaatggaattagtcatccgaacaaaaataaatctaggaacacctcaattattggtaaattttaaaacatacctctaaataacccattgatcaaagaagaaattgcaaggaaaaattttaaaatatatttcgaattgaatgaaaacaaaacacagcaaaccaaaatgtacagaatgcaactaaagcagtgcttagaaggaaatgtatagttttaaacatttatatgagaaaagaaaaaaggtctcaaaccaataatctaagcttccatcttaggaaactagaaaaataaggagcagaggggatattaaacccaaaacaagcagaaaaataataattttgtagtgtggaaatcagtgaaatagaaaatatagatatgaaaaataatcagtgaaataaaaggttggttctttggaaagatcaacaaaatcgaaaaaaaaaaaaaaacttcactatactgaccaagaaaataagagatacaaattaccaaaatcaagaatgaaagagggaaaattattgccaaccttaaattattaaaggatttcttaatacaaacttcgtatcaacaaattagataatttatatgaaatggactacacttcctagaacatacaaattaccaaaactctagaagaaagagaaaatctgaatagacctataacaagaagtgaagaaactgaaccaataattttaaatattcccacaaagaaatggccaggcccccacaactgcactaatgaatgctatcaaacatttaaagcagtaagagcaagatcacgagcaaccaacagactaatatccctcaggaacatatacccaaaattccttaataataatcagacaaaccatattcaacaacatataacagagattatacagcacggactgggcatggtggcttaagcctgtagtcccagcactttgggaggccacgcaggtaaatcgcttgagccaaggagttcaagaacagcccaggcaacatggcaaaaccctgtctctacaaaaaataccgaaaaaaaaaaaaaaagaaaaatagccaggtgtggtggcatgagcctgtagccccagccacttgggaggcggaagccggagaatcgcatgagcccaggagtttgaggctgcagtgagccaaaatcacaccactgcacttcagcctgggtcacagagcaagagtctgtctcaaacaataaaaaaaaaaaaaaaaaaaaaaaaaaaaagattttacagcatgaccaagtgtgatctgtcccaggaatacagggtgggtttaatctccaacaatcaattaatatatagcatactaacaataaaaatcatataaccatatcatcagatgcaggaaaaaacatgacaaaatctaacacccactcatgattaaaaacttgcaacaaactaggaacataagggagcttccttaaccttcttcaaagggcatctatagaaaatctacagctaacattatacctgatggcaaaaatctgcatgttttccccctaagactgggagtaatgcaatgcacattcaacacttctcttcaacatcttactggagggtctaacccaagaattaaagcaaaaatgaagaaataaataacattgagattggaaagaaaaagtatcgttttgagacatgatcatctatgtacaaacaatatgcaaaaattggttgcatttttttttagacagattctcgctctgtcttctaggctggagtgcagtggcacaatctcagctcactgcaagctccgcctcccgggttcacgccattctcctgcctcagcctcccgagtagctgggactacaggtgcccgccaccactcccagctaacttttttgtatttttagtagagacggggtttcaccgtgttagccaagatggtctcgatctcctgacctcgtgatccacctgccttggatcccaaagtgctgggattacaggcgtgagccaccaagcctggacgattgcatttttttgtgctaacaatgaacaatttgaaatcaaatcatgaaaactccatttccaagagcatcaaaattataacagtcttaggaataaatttaaccaaataagtgcacgatttgtacactgaaaagtaaaaaacattattaagagaaatgaaagatctaagtaaatggagagatattacatgttcatggattggaagactcaagatggttaagttagtgattcttcccatattgatggatagattcaatgcaaatcctacaaacatcagatgtgtttttgtagaaattaacaagctgatcctaaattgtatatggaaatggaaagagcatagaaccaattttgaaaaagaagaaaatgttacactacttattttgaaacttactataaaactgcagtaatcaagacagaatagtgttggagtaaggataggtttatagacatgagtcttggaataaattcttacattatagtcaactgatattttacaaagatgccaatacaattgaagggaaaagaacagtctttttaacaaatggtactggataatttggcattcacatttttaaaaaatgaacttagatcctcttcttacatcaaatgcacggttaattcaatatgaatcttatatttaaaggaaagagctcaaagaagacctttgggagctcaaagaaaaatctttgggaccttggattaggcaaaaagttcgtatacataacatgaaagtacgtgccacacacacaaaagaaatgacttcattaaaaacttttgcacttcaaaagacaacagtaaaaatatgaaaagccaagacaccaactgggagaaatatttgcaaatcttatctctgatattaaaaacaatacaaactttcatccagcatatataaagaactcttacaactcagtaagaccaaaaaaaaaaaaaaaaaaacccagctaaaaaatgggcaaatgccttaaacagatattccaccaaatggccaataaccacagaaaaaggtgtccaacattactgtgcagggaaatgcaaattaaaattacaatgggatactactagatactaactagaatggctataattaaaaagataataccaactgttggtgaggatgtggagaaactggaatcatcatacattgctggtaggatgtaattggtacagctactttggaaaacattttgacagtttctttaaaagttaaaaataagcttaccatataattcaacaattccactcctaggaatttacccaaaacaaatgaatacatatgctcacacaaggaattacagacaaatcttcatagcagcattattcataacagccaaaaactggaaaccatccaatgtctatcacctagtgaatgggaaatactattcactggttaccagtaaatgggaaatactattcaccaatactattcaactggtgaatggaaaatacacacgaatactatgcaacaattaaaaagaacaaaacattgatatacatacattaaataaacctcaaaagcatgaagttaaagaagccagatgcaaaagactactgtattgattccatttatatgaaatatgtagaaaagacaaatttatagtgatagaaagtagatcagtggttctctggggctgtgggaaggagttaccttaaatgcaaataagcttgagagaatctaggagactgataaaatgtcagaaattgccttgtgatgacagtcgcacaactctataaagttgctaaaaaccattaaattgtacacttacaatgagtggtttttatggtaggtaaaatatatctcaataaagctgtttaaaaagggctaggtagaagaaagaagttatctcttccaaactttggaaaatttgttgatagttgtagtaatcaaggctgagttcaaaggatgaccaagcaaaaagaatccaggttcttaaagattatcactaagccacttaattgacaatcttagaaccacctatctccagacttcttacatgtgagataatacaatttccttcttaaggctttaaaaaagaaaaagaaaaaagaataacgttgctaattctaagggacacaggacatgttcattccattacagaaaatttgtaatatcatccatagaggaagatatcaaagaaaaggcaggaattttggtggatcttgaaggatgaaagaatatgacgggggatggggaaggaaaagaagggtatgtagttcagaagagtcattaataatggcaaggataaaaatcaacaatgcccactaaaagtcaagtttacagcttaccttattttaatccatacattaaggaccaaaaaattaagtaactggttcaaaaagttacgcagctagtaatctaaccttcactctcaggatccaggctccaaagtacatactctttcctctgttacgctgctaaacaaggacttaaactacccccatttgcaagttcagatctttgtagagggcatctttatttagataggtttacatttataggactacacactcaatgtttcttgagcaacaatttccatttaatcaataaactaaatgtgatgtgcattctttctttggtttccaaaacgttaccctactctggttttcctaccttctttctcccccttcctattacatgctggtgttcacaagctctcttctgattctacacaactctcactaggaacctcatctatacctggtatttcaactaccactaacgttgatgactcttctctctctccaacttcaagaattgttttcctagttttctttgactaacttcctccgggccaagttgaatactgctctgtacaccctacaactacacttacaagattctaaagagacattcctcaatttttgtgtattctttctagttctaggccaggtattcttcctacatgccccaaaacacattcttatctatccttatagcatttaacatgctttattacaaattactaattactttgtccatttctcccatcagagaataaggtgcttgagacttagcactatgtcttattcacaatctccccagtgcctagcatagcatgagacacataataggcactcaaatattgattaaacccatatataagagaaataaaatttgctttaaattggaagcataccatttctgaaggaaactttcagagatttatgttttcaaatgagaaaataggccatgaaaggtgaagtgactcacccagtcaagccttggtctcctgaatcacaattctcttcccacaaaattacagtgcctaggccgggcgcagtggctcacacctgtaatcccagcactttgggaggccaaggcaggtgggtcataaggtcaggagatcaagaccatcctggctaacatagtgaaattccgtctctcttaaaaatcaaaaaattagctgggcatggttgcatgtgcctgtagtcccagctacttgggaggctaaggcaggagaatcgcttgaacccaggaggcagaggttgcagtgagctgagatcacaccactgcactctagcctgctgacagagtaagactatgtctcaaaaaaaaaaaaaaaaattagagtacctattaaattgtgcttagtgatctcagctttctatgaagctctagaagtaatacaaaaatgttataaagaaccatttcaacttcatccactccagctctggctggctatatcagttgtagagaagtctgttattacataatactttttctgcccagaataatctttaattgaaccagtattttcacgtgtccttcacacaaaaaataattcaatacatacttattgagacatgaagccagctgggattctgggtccggtgtggacttggagaacttttctgtctagctaaaggattgcaaatgcaccaatcagcgctctgtgtctaactaaaggtttgtaaacgcaccaatcagcactctgtaaaaacggaccaatcagcactctgtaaaatggaccaatcagctctctgtaaaatggaccaattagcaggatgtgggtggggccaaataagggaagaagagctaggcacctgagccagcagcagcaacccacacgggtccccttccatgccgtggaagctctgttcttttgctcttcgcaataaatcttgctgctgctcactctttgggtccacactgcctttatgagctgtaacactcaccacgaaggtccgcagcttcactcctgaagccagcgagaccacgaacccaccgggaggaatgaacaatgccggacgcgccacctttaagagctgtaacactcactgcgaaagtctgcagcttcactcctgaagccagcaataccacgaacccaccgggaggaatgaacaactccggacgcgccacctttaagagctgtagcactcactgcaaaagtctgcagcctcactcctgaagtcagcaagaccatgaacccaccagaaggaagaaactccggacacatctgaacatctgaaggaacaaactccggacacaccatctttaagaactgcaacattcaccacgagggtccgcagcttcattcttgaagtcagcgagaccaagaacccaccagaatgaaccaattccggacacattatcatgcatctctatgtggaaaacaatgtgaaagaagttataattcatcagtactctaaaaaatatccttaagagcatatattgcatgccccttaagtttaacaatatctgaaatagctgccttaaaacaaaatgcaatcacacttgagagaggctgaatatgaacatcagagataggcaatgcaacttcatcaggaaaatccctatagtccaatgctactgttttcaagggttgctatattatactgcaattgtgttactgggcaacaactcagaagctagaatggcaaattcactcaagaagtaactgaatcaaacgaatatttatgaaagcattctgagactcaacttcactttctatatcttcaactgaagtaactctttgttataagcattagatacaggatttttggtgagactgtaaaaactacatggacattttatagacatattttgagacagaagataggtgctttccaaaagggaatggccaggtttaggttcctactaactctgaattttaatccaaaagcaatctgaagtcacaatatacagaaggcaaataactgggcatttccttaatttcttccatcctggattatagctcagttaaaagaaatagtaggccgggcgcattggctcacacctacaatcccagcactttgggaggccaaggtgggtgaatcacttgaggccaggagttccgagaccagcctggccaatgtggtgaaaccctgtctctattcaaaatacaaaaaaaaagccaggtgtggtggcatgcacctgttagccccagccacttgggaggctgaggcaggagaatcacgtgaacccacgagttcaaggttgcagtgaacaaagattgcaccactacgctccagcctgggcgacagagcaaaactccatctcaaaaaaaaaaaaaagaaaaaagaaatagtactagacttgacagtcagtgatctctccatgacctagagagggcagtcctgatgaaaaaaatataattaataaactgatattctactaggaaccaggaaattgaccaaactccccaagcccactgaagaatagtgccagcattcctgagagtccttactgctggtattgccatgggaaattctcaaatactcactttctaggaacagaatctttatttctgattccgtgaattcccactcttcaatcttttttatagtttactgttgccatttccccttcacttactctcttctctcaacaaccttactttcatgatacttacaaaagtgggggaaagtagaaatgcctatctgtcattgtattagtccattttcatattgctataaagaactgcctgagattgggtaatttataaaggaaagaggtttaattgattcacagttccacatggctggagaggcgtcagaaaacttacaatcatggcagaaggtgaaggggaagcaaggcaccttcttcacaaggtagcaggaaggagaatgaatgcaggaggaactaccaaacacttataaaaccaccagatctcatgagaactcactgtcacgaggaacagtatgggggaaaccgccgccatgatccaattccctccacctggtctcttccctgacacatggggattatggggattataattcaaggtgagatttgggtggggacacaaagcctaatcatatcagtcatctttaagaaacatttattcagcaacttgtatttggaaaagactaaggatacagctcatcgagatctgaagtcctgcccttaataagcttacaatctagttaggaagtcaagaaagctaaaataatacaataaaaagtataagtatcaaataaatttaactcacaaatacatactattcctatgtatgtatgtatgaggtcatggtggagttgaaccttatagaaaaggtacaatttagattttaagaaagaagggaataagatcaggtcacgggggatagaaagatatgcagactaatatggaaaggataaagtacagagcaggtttaggggatagtgaagaaaccaatctgggcagagacaccttttccataaagaacatacacttgaaaaggcaaggtgagaggatttcaaataattcaccttaagtcaagaaacatgaacttgggttaaaaggaagttttttacacagatttacacacattccctaaaagcacataggttaaacaatgtgggcaatttacttatggaacctaatatgtatgacaaaattaaaagcaagctcatctacttttaggcaaagagacagtacctgggggtggggaaattctgacaattcactaaaattcactaatctttctgttaagatttcactctaagcttcttgaattagaacatcccatgacataatgctgatttctgattactaaggattatacgagtcattcttgatttgtctcctccatcttgcccaacttttgaatatttcattacttcaacatcagcatatagaaaaaaggaggagagaactaaaattaagtccatggattttagcaatacataagggtatctgacataaagaacattaaacttcaagttccaattcccattattaatagatttcaaagaagtcatttagtctcatcatgtctcaaattttctcacatacttgcttacttgaaaggttattgattgaaaagatcattcaaaaagtgctctaaaaactaacaacttgccataaaaattttatcattaagggttcaataagaggagacagtgaggtgactggtaaaccaaggattaaaaactacctgtgaataggccaggcacgctggctcacacctgtaatcccagcactttgggaggtcaaggtgggcagatcgcctgaagtcaggagttcgtgaccagcctgggcaatatggtgaaaccccatctctactaaaaatacaaaaattagcagggcatggtggcatgcacctgtaaccccagctactcgggaggctgagaggagagaatcacttgaaactgggaggcggaagttgcagtgagctgagatcccaccactgcactccagcctgagcgacaagaatgaaactctgtctcaaaaaaagaaaaaaaaaaaaactacctgtgaataatcagtgtttcattctcccagtgctgcatggaattctaaattgtatttcactattatttgagaatgttctaaatacagtccgcgcacttcatctgatctggaaagaaaacactcaaagtaaggggaatacccagcatactctgtcctaaataaccaaaggacaactcaaaaccatttgcaactctcaggagagtcctgtgtgacacttataatttaaagcattctggcctggtgcggtggctcacacctgtaatcccagcactttgggaggccgaggtgggcggatcacctgaggtcgggagtttgagaccagcctggccaacatggtgaaaccccatctctactaaaataaaaaaattagccgggcatggtggcacgcacctgtaatcccagctactcgggaggctgaggcaggagaatcgcttgaacccaggaggcggaggttgcagtgagccgagatcgcgctactgcactccagcctgggcgacagagtgagactcagtcataaataaataaataaagcattctaacaattctgaacaaactgagtttgaaatcaaacctcaatacaaaaggtgagtattaattctaaccacttacaggctaaattcataaatatggaaaattctaaatccaggtaactgtaggatagatacctttaattgtgttttagttaaatgtcagacttgtttacagacatgttgcttggtaacagaagcactgctttaacaacccactctgttttagagctgcttaaagtctgaacagattatgaagtatatatcatatacacgaaattcagacaagtctttccttatcctagagatctgtaagatttgaaagagcttcctcatttcagctaactaaaggctttacaaatacttagcagtggatattcttaagagcaaaatgcccattgattatggtcaaaagttggacactgaggattaaccaaagtatttaaacccagcatatgctaacatattttaggtgtttatctcagtaatgacagtcgacatcactgttcattcaaattgtcttcaaagccaaggaaaatggtagcatagctttttcatcgtaaattaagctggaggtacttaaacgtctggccaattaccaaactggctacacaaccaccaagccagagtgcatccaaaagctccatgaagagtttcacgtgcgtctctctgcctacttttctagcacgagcttccactactttaacaggaaaataaaaaaaggattcaagggcagtttgtggagggacaaaatgagtattccaaaatacaaacaagacaccgtccccagaaagagaggttacataccagacgcacgcacgctccttgcaacccgcacacggaaaacttaagtgaccgcagttctggccgcgctcgccaccggggacacctccacagctccaaccacaggcacccactcaactccgcttacggaggcattgggactaagggttacggtcctacagcggggtgtcggcccagcgagaggaagagggccgaacggacccctcgggctcccgtccctagggaaatgtgaagtatcccgggagaggtccgagggcggcggcggcggcggtgaaaagccccactcctccgcgtggaccgggatcctcaggggtgcggcgccaccccacgtgctgacgtatggcccagaagccgcctcatcgcaccgccccaccagcctggaggagcgggctctgtcccttggcccagcggcacgcgaagcaggaagtcccaccccccacgccgacgtcacccacgccaccgacgccggttgctgccggagccgttagagggaggagacaaacgaaccgaggcgggagcggccacgggtgacagcggcagcggcggggccgggctgcgctcccgaaggcgttcctggagggccctgggatggactcagagatccccagagccccaggggacggaaaatctagccccgggcacttgccttggagtctgagtgatgcgcgtcgttggagcgcgaagccggtctccctagcctccgcccgacacagcgtctccaggggttttcctccttttcgcgcctctccttccctcttccccacaccatttgagagcctcaaatggtagtcctgccgccacctctctcccttcgccagcctgccatcgtccccatgggtgcagatatgcgctcccgaagccgcctgcctgccgcgtctgcctcgggcatcagcccacgagtggggagtcggctcagcttgccacgagggaacctcgggttaggaccaatcgcccgggagagagccctcctcgcccccgcacctcctgctccaagtctcctgtcctggttatcccaagttcagggcccacctggggtcacatggggaactacttgtcttaaggctgtaaacaatagttggaagaggagttgctagcttttgagaacttccatgatcatccaaagtctgaaacaaagtaggcggtcagcctttcaaaatacgtgttggaagaaacagacaccttcccatccccagcgtttgttcagtgccttggttgggctttgattctcactgctttgtgaagtacagcttatttttacccccaagattatgattttcaggctgtagttattattggacaactgagaggtgattttgttgttgttgaaatgagggaaaacgggccattagaaaggaccgtgtctcttaagaggagggaaaaaaaggacagcgagttggtaatggaatgttgctggatggattacatagatgagacatgggagatagaatagagaatccagaaattctcatgtatgtgtgcgtgtttagtataataacagtagctcacatttgctgagcatttgtgtggcaagtactggagtactttttcaggttatcttatttaactctaacatttctgtaaggtaggtgcaattgttatctccatttcacagagttgcccaaaaccattacttttaaacgctggagccagacaactccagaaatctctgtggtagccagtaaactatacatgacaaattattggtcagtaggaaaaagatcattcgggaaatggcggtggctcacgcctgtaatcccagcacgctgggaggccaaggcaggtggatcacctgaggtcaggagttcgagacgaccctggccaacatggtgaaatcccatctattaaaaatacaaaaagccaagaaaaacaaatattcaattaacaaacggaaagttgtcccacttccaaacagttgttttttgtctatcattgttgataggggtgtgggatacaattactgtcaggcatttttggtgtgaaggtgaaattggtacaaccctatttaccaaaatttaacatatgcattagcctttgccccacagctgtctcatttccgaggcatataccctaaggaaaataagggattcataaggatactatttgccaccttttttaaaaataatgcttctagaaacaagtgtccatcactaggacactagttaagaaaattatgattggtacatgcaatggaatactcttgacccattaaaaactgatggaaagttctttatttgcattaaagtatgtccaaaaaatatagtttcccctcaggaaaaaaaaagcagaatgtagtttagcaagtacagtgctgtcctaatgtgaatatatgtgtgtacatatgttaatataagtgtacaaaaatatctggaagaaggtcagtcaaaatacaagtgttttacattttgtcttttggactttttatctggttggtgttttttgtaatttattattttacaaaaacaaagttgtgttttatgttttaattaaagctgtgccagtgaaaagggagccagttgactcttgaccttcacaagtaggtaaccatgatgaagtaactatgtctggggatctgagtctcagcttttttgtgtctataaatttgattatattcatttacctatagttggacaagctaacctaccacctggacatcatagttttgactccccaaattggactgggtatccattctatgtgttctctgtgtgcctgtcatggtatttgtcacactgtactgtaattccctctgtgccagtagattgtttgctcctgccatacatatacacatgcacatacatactttttctgctatatgttacacatttcttttgatttattatttgtcatctacatttgtatacagaagttttaattttcattagccaaaatgctaatgaaatcacatagatattaaagggatacttggaacaactttatgccaataaattcagtaacttaagcaaaatggacaaattcctaaaaaaataaataaataaattaccaaaaatgacacaaaagaaggaaaagaaaatctaaatgtttcagtgtctgttaaaaaaattgaatttataagcaaaacacttgccacaaagaaaactccgggcagatgactgcaccagtgaattttatcagacatttaagggggacaaagtaccaatcctacaccatttcaggaaacagagcagggagaaatacttctatactcattttatgaggcaagcataatcatgccaaattatttttcctgataccaaaatttgacattttgcaagaaaattatagactgatagtcctcatgaatatatatatatatataaattcttaagtattagcagattgaacttgcaatatagaggattacataccatgaccaaggagagtgaacttaacattgaaaaatcagtgtaattcatcacattaacagaacaaaagagaaaaaaaattgtttcaataaatgcagaaaaaggatttgacaaaattcaaagcccattaatgttttagaaaaaaaaaaaaaaaccaactctaagcagcctaggaatagaagggaatttcctcaatgatttgaaaaagttaatggtgaaatattaaatcattttctcctaagatcaggaataacaaatgtaagacaagaattttctgctctcaccgcttctatttaggaaattggaggccctaatcaatgcaaaaaagcaataagaaaaagcgtaaagactgggaagactcagatatcctgatttcagaacttgctatgaagctacagtaatcaagatagtactatactcttataaagataggagtacagatcaatggaatataattgagtccagaaataaagccttatatttatggtcagatgactttcagcaaaacaccaatacaactcaattggagaaagagtagtcttttcaacaaatggaactggtaaaactggatagccacatgaggaaaaaaattaaattggaactctacctcacaccatttatgactattaagatgaaccaaagatccgaacacaagagctaaaattataaaactcttagaaaaaaatataactaaatccttatcaccttgaattaggcagtggcttctttgatgtgacaaaaagcacaaccaagggaaaaatgaatgcattaaaattaaaacatcaaaatcaaaacctttatgcttcaggctgggcgccatggctcatgcctgtaatcccagcactttgggaggtcaaggcaggtggatcacctgaagtcaggagttcaagaccagcctggtcaacatggcgaaaccccgtctctactaaaaatacaaaaattagccaggtataatggcgtgcacctgtgatcccagctactcgggaggctgaggcaggagaattgcttgaacccaggaggcagaagttgcagtgagccaagattgtgccactgtcctccagcctgggtgacagagcaagactccatctcaaaaaaaaaaaaaaatgcttcaaagaacagtatcaagaaagtgaacagacaacccacagaatgggagaaaatattctgaaaatcatatatctggtaagggtgcactgttcagaatataaagaactcataattcaacaataaaaatccaatttaaaaatggacaaaggatttcaataaacatcaaagaagatatacaaatggccataagcacatgaaaagatgctcaatgtaattagtcattagggaaatacacatcaaaaccaggtgataccacttcactaggatggctgtaatttttttaacgaatggacaagaacaagtgttaggacatggagaaattggaaccctcatactctggtgatgggaattaaaaatgttgccactactttgggaatagtttggcagttcctcaagaggttaaacataagtttaccatatgacccagcaatttcactcttagatatatacctatgtaaattggaaaatacattcactcaaaaacttgtgcacaaacgttcatagcaacattattcataatgaccaaaagtagaaacaacacaaatgcccatcaactggtgaatgaatgaacagactatggtgtatccatacaatggaatactattcagccattaaaaggaatgaactactgattcatgctacaaattgatgaaccttaaacacattatatgctaagtgaaagccacattttatataattccatttatatgaaatgtcaataatgggcaaatccatagggaaagaaaatagattaataggggctggggactgggacagtggagattgactgctagtaagtatggagtttatatttggaatgatgaagatatcctgaagtaaaatagtggtgatggttgtacaactttctgaatatgctaaaaatcaccaaattatatgccttaaaagtgaattttatggcatgtgaatcaaatctcaatttttaaaatgggaaggaataagtacagttgttcccccttatctgctggggatacattccaagacccccagtggaaacctgaaacaatggattgtgccaaaccctatatacactctattttttttctatgtatacatacctatgataaagtttaatttataaattaggcccagtaagagactaacaacaataatgaaatagaacagttataacaatatgctgtaataaaaggtatgtgactggtctcccaagatactgtactattcttgcaataatgtgaggtgataaaatacctacatgacaagaggaagtaaagtgaatgaggtaggcattgtgacatagttttaggctactatggaccttgaacaccagcatcataataatgatgatcttataaccaagttggctactaagtgactaacaggtgggtagcatatacagcatggatatactagacaaagagatgattccaggcacgatggaacagagtagcatgagatttcatcatgctactcaggacagcccgcaatttaaaacatgaattatttctagaattttccatttagtatttttggaccaaggttgaccacaggtaactgaaaccacagaaaccgaaactgcaggtaaggggagactattgtaaaattatattcacagacaatatgattgtgtgcatacaaaaccctatggaatatataaaaaaggtaagagaggccaggtgtggggtgcggtggctcacgcctgtaatcccagcactttgggaggccgaggcgggcagatcacctgaggtcaggagtttgagaccagcctgaccaacatggagaaaccctgtctctaccaaaattacagaaaattagctgggcgtggtggtgcatgcctgtaatcccagctacttgggaggctgaggcaaaagaatcgcttgaactcgggaggtggaggttgcagtgagccgagatcatgccattgcactacagcttgggcagcaagagcaaaactctgtctaaaaaaaaaaaaaaaaaagtacaagaaatagtaacttcatttaacaagtgataagatacatgctcagtatagcaaaaatcaattctatatactagcaatagaaagtggaattgtaaacaataccatttataatgtatccagaaacatctgaaaccttggaataaacttaacacaagatgtgcaagatctctgtattgaaaaacaataaaatgagtccgggtgcagtgggtcatgcctataattccagcactttgggaggctgaggcaggtggactgcttgaggtcaggagtttgagacagcctggccaacatggcaaaaccccgtctctactaaaaatacaaaaattaaccgagtgtggtggtgtgcacctgtgatcccagctactctggaggctgaggcacaagaatcacttgaacccaggaggtgaaggctgcagtgagctgagatcgtgcaactgcactccagcctgggtgacagagtgagaccctgtctcaaaaaaaaaaaaagagcaaacacaaaacatggatagaagataattaaagaagacttaaataatagagaaatattttatattcatggatgggaacactcagtaatattatcctgtctattcttcctaaattgatttgtggattttccatatcagaattccagcaggttaaggaataaaaaactatgcattgagtacagtgtatactactaggttgatggttgcaccaaaatctaataaatcaccactaaagaacttatccatgtaacaaaaaccacctttttccaaaaactattgaaataaaaatacaaaattatctcacaaaaaaaaatccagcaggcttttttttttaggacaaaatccaaaatttatgtgaaaaaatgaaggatctagaatagccaaaataatctttaaaaagaacaaaattggaagacatactacctgatttcaagccttttataaagttatagtaatcaagactgttatttccaaaggataaactagtagttaaatagaacagattaaagtctaaaaatagatctatacatataaagtcatttcatttttgaccaaggcatcaaagcaattcaataagaaaaaaaattgattaataaatattactaaaacaactgtataactatttagggaaaacaaaaagaacttcaacctttcatctccatacccagaaattcaagatgcctcctaggcctaacataaaaccaagatccataaaacttctaaaagaaaacagaagaatctcttaataaccttggagtaggcagatatttattgcatgagacataaaaaacactaaccataaaaagaaaaaaattgaaagattggagtttattgaaatacttgctcttcaaagttaccattaagctacagactgggaaatattcactacatatgtatctggcaaaggacttctacaagctaacaataaaaatagttattaacaataactcatttaagctaatagcaaagacatgaactttcccttcatgaaagatatacaaatggttaataaatacatttaaaaattcctgaatatctgtcacagatgataagatcttgaagaaaatcctaaagatttcacaaaacagaactaatgaatgaattcagaaagtagcaggatacaaagtcaacacacaaaaatcagctcttactatttatacactaacaacaatctgaaaagaaaattccaaaagtatcattttgatgtatgataacatcaaaaagaataaaatgcttaggaattaaccaaggaggtgaaagacttacacatgcaagctacaaaacattgcaaaataaattaaagaagatataaataaatggaaacacatctatgttcatggattggagcagtattaaaatgtcaatactgtatgaaacaatcaacacattatgcaatccttattaaaatcccaatgacaatttttgcagaaatggaaaaatcatcctaaaattcatatggaatctcaagggaactgaaatagtcaaaacaatcttgaaaaaagaacaaggctcaagtactcacacttactgatttcaaaacttactacaaagctatagtaattaaaacagtgtagtattggtgtaaagacagacatagaccaatgaaatagaatggagagcctaaaaataaactccctcatttatgatcaaatagtttttgataagggtgccaagaccattcaatggggaaaggacagtcttttcaacaaatagtgctgggaaaaccagacccagaatgaagttgaacccttacccaacaccatatacaaaaattaactcaaaatggataaaagacataaacataagacttaaaactataaaactcttagaagaaaacacagaacaaaagcttcatagcattggatttgacattgatttcttggatattaaaccaaaggcctaggcaacaaaagaaaaaatagacaaatttcactttatgaaaattttaaaattttgtatatcagatgacactatcaacagagtaaaaaggcaagccacagaacaggagaaaatattttcaagtcatatctgataagtgattgatattcagaatatatagagaactcctaacaaagaatacaattttaaaatgggcaaaggaggccgggcatggtggctgatgcctgtaatcccagcactttaggagaccaaggggggcagatcagttgaactcaagagttcaagaccagcctggacaatatggtaaaaccccatctctaccaaaaatacaaaaaattagccaggcatggtggtgcttgcctataatcccagctactcaggaggctgagatgggaggatcacttgagcctgggaggcagaggctgcagtgagccaagatcacaccactgcactccaccctaggtgacagagcaagactccatctctaaataagtaaatagatggcaagggacacgaatagacatttctccaaagaaaatatacaaatggccaataagcatatgaaaaaatgcccaatttaactaatcattaggatgcaaatcaaaagtataatgagacaccacctcacactcattagggtggctactatttaaaaaaaatattagcaaggatgtggaaaaattggaatccttgtgcactgttgatgggaattaaaatagtagagccattacagaaaacagtatggaggctcctcaaaaaattaaaaatagagttatataatctagcaattccatttatgggtatatacctaaaataattgaaaatacgtctctccatactcagaaatggagctagaaaaaaaagagatttgcacacccatgttcacaaccagcattattcacaatagctaaaatgtggaaacatcacaagtctccatccacagataaatgaatgagcaatatagtatatacatacaatagaacagtggtccccaacctttttggcaccagtttcgtggaagacaatttttccacagattgatgggtgggggggtggtttcaggatgattcgggcacattacatttgtgtattttatttctattatgacactgtaatatgaaataattatacaactcaccataatgtagaatcagtgggagccctgagcttgttttcctgtaactagatggtcccatctgggggtgatggaagacagtgacagatcatgattctcataaggagcatacaacctcgatccctcacatgcacagttcacaacagggttcgcactcctatgagaatctaatgccgccgctgatctgacaggacgcagcgctcaggcggtaatgtgagcgatggggaatggctgtaaatacaaatgaagctttgcttgctcacctgttgctccctgctttgcagcccagttcctaacaggccatggaatggtactggtccatattattccacttatctgagatacttaaaggagtcaaaagtacagagacagtagaatggtgtttgccaggggctggtggggtgggggatctggggagttactgcttaatgggtatagtttcagttttacaagataaagagaattctggagatagatgctggtgatggttgcacatttatgaatgtacagtgtttaatacgatggaactgtacactacaaaatggtttttatgttatgtgtattttaacacaacaaaaaaatggaggaagtacttaatatctttgatcatcaagggaatgaaaattaaatctacagaggacttcatttcacagacattccaaggtgctgaaataaagtgtagtagcccaaacattaacaaagatgtgaaacagctggaacttacacattgctgatgtgagtgtaaaatactttggaaaagtacttggcaatttcttttcattgtactttcatctaccttattcatggctcatcaatttcacttagttacccaagagacacgaaaatgcaacttcacaagaaaacttacacaaagaatgtttagagcaaccttattcataataaccaaaaactaataacctaaatgtatatcaacaggaaaacagatacaatttaaaaatgatatatattcttacaacggaatacaactcagcaatacaaaggaacaaactgctggtatacctgacaacatgagtaagtctcacaaatattttgataaacagaagaagccaggcacaacagaatacaaaccgtattgttctatttgcatgaaatccaagaaagaccatctagttttagaaatttctaagtggttataggggacagtgattgaaaggagtccaagggaactttctaagatgatagattatattttgtttcaagtggtaattacacaggatatacagttgtcaaaattcatcaaattgagtaagatatgtgtattttattctgttaattataccaccataaaacatattttaaagtgctaatagaaatacttttctattcactgaaatactaatgtttgctagcaagagaactcttttccttatatcaagataacccaagaaatcagactagtaatcagaaagttggtgcactcatactcggagcaagggaaaggtcctagggataaatccaaactgcaaaaaaatttaatcagctctcaaacaataacaaatgggttactctactatggcagataaatgaaataaataattgctatgaattaaggacttcaatattgtgaagctaacaaaatttgtattacaggtaaatggaataatagggtttttaggaacccaataaggaaattatcatacaagtgtaattttaattttttatttcactgtacttcaatgtatacaaacaagtttcagggtgtttttttttgttttttggttttttggttttttttttgagacagagtctcgctctgttgcccaggctggagtgcagtggtgtgatctcggctcactacaacctctgcctccagagttcaagcgattctcctgcctcagcaccccccgtagctgggattacaggtgcgtaccaccacacccagctaatttttttgtatttttagtagacatgaggtttcaccatgttggccaggctgctctcgatcacttgacctcatgatccatccgcctcggcctcccaaagtaagtttaagctttaaatgaaaaaaagtacggacatttggagtatttgtgcaagaaacagaatgctttaggataaggaattcttataaacggtaggcattccagtattgcatttcctttaatactttgttgccagagccagaaataatgtaagaagaataagcttgtatttcagaatgtcaaggaaaaaaagctatatgtcatatggcttggtggtagacaaacctatttttgtcttaaaatttcatataccttctcctttaattatctcttctttcctcctttcctttttctttttcatcattctacttttattttctttccttctctttcatcttctttctttttctctccttttttcttcttctagaccgtatttcttagccttgttttcataattgatcccctaagcagccattttagacaccactttcctcattgctcctcccacccccatgaaatcttaaatcacagatatactgtatgtctgtttatgtactgtggctctttggagggccaaggaccattgtaatatctaaggttttttgcccccttgaggggtgatatctccccattaaaaataacatgttccaactaatgagttctttgaggggaaggatcatgtcctgtttaccattgtatgccttgtgcttaatataatgcttggcacacagtaggcaatcagtaaataaatgtattagatgaatatttattgaattaaagtgaaaatggtctctgctgtaaactcatcaaacaactaaacagctaaaattcttgaatcttttttagacaatactgtctactacttatactccacagtacctccgcatttgaagattgtcttcctgagactatatccatgtgacttgatggaatcttggaaagcaccttgatcacaaaagtaataaattcaaagccaagtccaagggtgagttacttatacagatggctaattttatctaccatatactgattttttttcctagcatcactttcagaaggtgatcatttcctaaatttttctctgaattgaggcttgcagcctctttgatacttacaactcactattcaaaacttatcagttccagttgacgtgcaagaattggattagggaatgagtagaaggtgacggcactataggaaaggagaaaataaatagaggaagtcattaaacttctctgttccttaatttttctttatctgtaagacctcttctagctctaaaatttgtgatcttgatttattctctgagtgagtggttctcaatagaaacattttattaaagaaatcagtggagggtgtcatcagttgcctcaagattggaaggacagtgctgccagcctttgtgggagaggccagggatgctagacatcctactgtaaatgggactttggtcagttcaggtccacagagaagcagacaccaagacagacatagaagagatggattgggggaaatggctgtagggaagaggaagcagttagcaggcagagtttgagactgggatgcagatctgacacccatgtcaatgtcatgagaagagggaggtggattcagtaggaacagccttagattataataacagctctaggaatgtcttggccaggccaatagggagccacagagcaaagactgaccatttgagggggttccaatttgaccagatgtggcctggctctattacccctgctgtgctcagccattgaggaagtttgggtagggtaaggccaaatcataaatgccatgatgaatctccaaggaataatactagaagactgtcagctagctacagtcctcacagcaggttctctctctctctctctttctctctctctccatctctctctctttctctttaaagcaaaacaaaaatgatactttactgagatacttttgcttgtaaagcaggagaacaagatgatatacataagtcataacatgtcaagacatgccaaggtgatgattttgatgttttctttatctttttcttttatctttttttaatccaggttaaagttggacacaaaatgagaagtttggggagataaggcttgggagttgagatcctgcatggaaaacaagatgaattaacttcccaggctgcgtaagtgttcacattttgtatcgaattatagcagatttgtttcttcttttgacctcaaaaaccgtttggaaaccttagggaaacttcatggcatcttttccattttgctgatggttgtcaggagggatagcaccagaccttaacagaggtggcttcaccttgcctagagcatcaataatcttatcacagattcacccctgttctttctcgtttagactctgagggtcccacttcattgtcaatttcatttgcagtcacaggtttagcataacagctaaccttatttttagttgatgatctggaacccttcacctgacttacaggcaaactcttgtgtattttttgttagaaaatcttcatatcgccattagcaaatgctgtactagtttgattacttggccattagctgcttctcaataggccaggttgggaggcattttcttggcatttttgttttgtatcttgagttttggaggtgaatcactgccatttttaatggatgctggaggcattttgtcaaaggattcctttttggttccttcatctttgtcatctgcttcatcttcatcagtattatttcctgatatttctgtaactttagaagcattttcatctatattgtcttcttcatggtttcctcaactctatttttcctttctagtccttccagcaggttctctgttgaacctctcatgttctgggagtagcttttctgattcctctggacctcacttcttgagggaaaacttagacaaagggggttattgggacaaaccataatccctgtcactcagttggtttcaaagctgcaactgctacttatcttcctcttccataccaatttcaagttctcctctccttcagcagtcacttccacagatcttagtggtgtaacctgggtgtgacccaaatcctcattcctgatgagaaatatatatttattggcaattacacatacctcatgtgattgttgtacatgtccttccacagttacaagtaagtctcaaaagactcccaagtggatcacctaggggctacatatttttctctgcccattgtgtaaaagaagcccttctgcttcctgttgatctaggtcagttacccctgccaagatggggattcctcttcctgcctgctggcaccttgacacaaagggtccaaaatgcccaaacagttgccatagcttgtagttcagtgggaccttccttgcatttcctggcaagaattcaccccactttggggaccaggacttctaaaccttcaaaacccagagttgcaggaacagaaagcacaaagttccccgatgagtcgtttgggtggatggtaagtagggccacttcttcttcctctgcctttttcctggacccatgtattcttcctattagggacagtgcctttagagctccctgatttagtatatatactgatcttgaaaagtggcactctgttcttgcagaatattgcctccaaatcggcactccagctgcaccttcagtaggttgcccagtgctctatcaggctggctgctccagatggtgcagtatgtgataaaaccagtagatcccttagtcattagttcatactcataccacctttactatgaaatggatcccctgtttggatcctgtgttgagttggatactatacctgtggatcaggccttctttaagcctctagatagtggtatgggctgtggctctgaagccaagaaaggcaaacccatacccagaataaatatgtatccctgtaaggataaactgctggccactccagaatggaaagggcacagtgttgttgacttgccaccaagtggctggtttatcttctcaagtaataatgccatatcagggactcagggttggtctctgttgctggcaaattagaccttcagagacaagtaggtatattggccttggtaagtaggaattcatgctcttgggctcatgtgtagccttcatctctgcactcacagtaggcagacttacatgttgcctacatgtgaaccaaagcagtattcctaggtatggaattcattgcttccagaacccaaaaaggcccaccaggcattgggcttcattatagtaggagatgcaagatgcagaaatttgccttttatcctggaggggatgtctccacaggccactgactactggaccttgaaaaaactttacggaagtcacaaattcttgaatcttcttaaaagtgtatctcccactctctggatacatgtcttaccaagacctctagtatacaagccacatcttgctcatcatgctcagtctgaatattgttgatataacatatcaatgtgatgttacacactggatgtccagacagtccagatctcttctgactgtattacaatagagagtagaagagttaacatggtccttggacaaagctggaaataaatattgtctcctccacatgaatgtgaattatttcttatccttatttctgattggaatataaaataatgcatccatcaaatcagtgtctacaaactatgtgactgaggccttattaatctgccttagcaattataccatgtccagcatagtttcagttgagagtactacttgtttaaacttgctgtggtagcctgcattcactctgtaggatacaaacgtggtactaatctcctgtgggacacaatgtcatttatattctatcttggctagggtgggggacagtttcaaaggctttcagttggtcttctcattatgatagctctttaacagctcaaggacccagtacttccactgccaatgatgtctgttgtaattatatactcagggacaaagaaatacctagcagatgggtcttcagacccagtgaattcactgtgtgcagactttagctaagactttattacttattctcataattttccacacacaggggaagccatgataacactttgggtctccagttaccaaagtcgacttagtccctaggcccaaagctcctctgaaatgactgggcactcccgtttcccagtgtaaatgccctacccaagtgtatgccctaactccttttggagaatgataggaggaatcattaaaatatctacttgccacaatgttgcagggtcctcctagggacctagctacctcctcagtcagtgggctctagatctgaaaatttgcttaagttcaggatgaacaacaaagacatttattgaaatgacctcccttagcctcctgcccctccattcttgccttctgcttgtacatgttaagcagcactcttaatctcttaatatctgcctattttgcccctaaagtaatgatgatctgtcgctggacccatcaactctatgactatgtccagttttgaataagctccaagagaggcctctcattctcacacttgggctctgtttgtaaacagccttcaaagtttctcattctctctccgtggggcatcaatacaacttagtaataaccactctgctcactaagatcttttaaatgcccaaatcattatacaggcaaggatattccctacactgagattttttcccagctcacaaccagtgaaaactttagcaattgaacttctaccttgtgtcaagtactatctgtgccccaaattccattcagaatgagttggccttaccagctgggtggtaagtgatggactctctaaaccctgtcttactatttgctttctgaggtcactcccagtagtagctgtcagtttgagtcttccatgaagcagacaccaagacagaattagatttattggggaaaatgtctgtgaaggataaaaagcaagagggagtaggcagaaagagcctccagagtgacacctgtgaatggagaaaaggaagaaaagaagaatagaaattcatggcataataggtgttaaaaaaagacttctggactgttaaaaaaaaaaaataggaagagccttaggctgtaatgcagttctgtgaaaataaccaagcctacagagagtcatcagaacaaagataacccattagaggagtcccacattgggcaggaatgatctgccttcaccagactcagtcactggctgaaagcagcggaggaagagccagaggaagagcgtgtactcagcatgaatcctgcaatgactccaaggtgtggcagttaagtggctgtccctaactacagtgtttaccgcaggttctcgaagagctgaccagtacactcctatagctgccacagcaacgctcacataacaaagaattgtactctatacctcatgattttcatatatctaggcagatactcatatatgtttttttaaaaacaaaacacaaaaacttttaccattatctggaattatccaggtctaaaacctattttagatacaaacaaaaggccaggtgtggtggctcacacctgtaatcgccgcactttgggaggccaaggcaggcggatctcaaggtcaagagattgagaccatcctggccaacgtagggaaaccccatctctactaaaaatacaaaaattagctgggtgtggtggtgtacgcctgtagtcccagctactagggaggctgaggcaagagaattgctggaacctgggaagaggagcttgcagtgagccgagatcgctccactgcactccagcctgtcggacagagcgacactccgtctcaaaaaaataaacaaaaatgattttgtacagttttaatatctaccgaatttttagtaatgcaaattccatgtaaatcaagagtaaaatgaagttcatgttatttgaactttaccaattgtttttgctattttgaaaaattaaatcacgggcaatgacaatgtcctgatatttgaatcaccaatacagtatgcctgtagctatatttgtgcctgtctcatgtatgtatatgaatatacctccttaaactatttcaaagtggaaatataaagaaaaatgacagttttcctttgaatgttgtcttctttaaaatccagccttactaatttcaagtatgtagaattttcacacattgatggtagaaatacaaaactgtacattttccataggaagaatttggcaatagctagcaaaattaaaaagttcatttactttttacccaaagtgcatcttctaggaatctaacccaaagaaaatataacaaaatatgaatatgcaaggatatgatggcaatatttgtaatagtataagacatctttcagtccaaatgttatcagcagagaatttggttgaatacactgtaatagatttgcacagtggagtactatgccactataagaaggactgagtaatatctctaaatattgttattaaacaatcctaggacataagttaaaaactttaaaagcaaggtactgaacagtggtatacagtaacttttatgtaagaaaggaagggaaggccaggcatggtggctcatgcctgtaatcccagcactttggaaggccgaggtgggcggatcatgaggtcaagagatcaagaccatcctggccaacatggtgaaaccttgtctctactaaaaatacaaaaattagctgggcatggtggcgtgcgcccatagtcccagctactcaggaggctgaggcagaagaatcgcttgaacctggtaggcggaggttgcggtgagccaagatcgctccactgcactccagcctggtggcagagcgagactctgtctcaaaaaaaaaaaaggaaaaaactacagagaaatcttgaattttagttatctttttattaatatactgatactgttatgaaaatatttttattgtatatatgggtaaagcaaataaatgattgtgttagtatcattaggaaccaaaaattttactgtaagaggaaagatatgcaagtataaaatcaaagacctaaaattcctatagtcttatatttaaattggaagcattagtatgttctcaagatttaattttctctttaaaaatatttatttcagtcaggtgtggtggttcacgcctataatcccagcactctaggaggccaaggccggtgaatcacttgaggtcaggagttcgagaccagcctggccaacatggtgaaaccccatctctactaaaaatacaaaaattagctgggcgtggtggcaggcacctgtaatcccagctactcaggaggctgagtcaggagaatcgcttgaacctggaaggcaggggttgcagtgaactgagatcacgccactgcactccagtctgggcaacagagtgagactctgtctcagaaaaagaaaaaagaaaaaaaatatgtatttcatagctctttccactgaaaaggactaggaataatagccttatagcaatgatctcccctaccactcaggttatggtctcttaaaaaccatttcccagtaaaaggaatcaagtctcctttgagaaatagttgactccagggttggtgtgggaaatgtataagatgagcttgaaatagctttcataaccaaaagtaagaaggcatcacgcactgttaaggttgtttcagaagaactcaggagccaacttgaagaaactccatctagtcaaacgtgagacaatttaagcatcataatgattactaaagtgaattgaaaatatcaaatatattaaaatccatagtgcatgacattcaaaagtaaacatttagaggatgtttcaaattcattatttgaagtctagttaacaaaggaattaaattgagcatttgctctgccttttctgtacaaactgtatttcctatacaaatacatgaaaaaaagttctttatatttcaggtaataaaatcaggaaatgataaaaattagaatatcatcattttttcatcccttaatgaaaaaaatggacctaggcaatgctcatcagtggctgctaggaccattagataaagggctgatgggaaacttttatataggctagattatgctttcaatacttaaacccactaactaaacttaactgaaaaagagaaacagcccagatattgatatgctttctgctatgatataatgggatgggcatagcttcatctatgaaatattccttccaaaaaagccaaacctgatagatcaagcctctagatctaacaaccagattacagcaaatacagaaaaaagaggaacatgacaaaatgacacacagggacacaattagcaaaatcctgaatgtgagatacaatgtgacaaatgcttcttcaacaaataaatggcaggaatttttttaaaaaggaatcattctagattgagggatatttaagaggcatatcaacctaatgcaatatatagaccttgtttgaactgatgcaagtaaatcaactgcaaaaagacatttgtgaaaatctgagaaaaattttaaattccatatatttgatgagattaaataattatagttttaagcttttcttaggtgacatagtagtatgtggttatattttttaaagttaaagtaattctttatggataaaatatatctgggtactatctgggatttgctttcaaataatctgagaaggtaggaatgttatctagatcagtagctctgagaccttagcggacctacagattagctggagagattgttaaaacatagactcctgaaccctacctcagagattctgattcagtggtctggagtaaggtcaatgaatttgcatttctaaccatcttccaggtaacactaatgctgctgatccagggaccacattttaggtagcattggtaagaatgaaaaagattagctattgataattgataatcgttgaagctggatattgtggaaacatgtagttcattatactactctctctagtatatgtttgaaatttttataataaattattaaatgtatattccaatatctgacaattatgtctgtcaacgttcccacgcatttatatactaccatatatatttttgttataaattaatctcatttatcctttataatatagtcagggcattacattgattttttaaatttatatatgtagtcaggttgcactctctgtatatttcatttgtggatgataaagagttataaaaatatttattttaaaatagaaatgttgagtctggtaaaggtgagaactgctaatttaagacaatctggagaaataaaagctatgtagaaaagcaagccctgctggctgaaaaggaggcttcagtggtaatcaaagcagaaagacctcaccagacctgccaggatttccactttcctaaaaaagagggttaactaatgggaagtattcttgaattctgctaggacatcttcttgttcaccatttggcactttctgactatttaagatgggaaaatgatcctgaaaacattcatctgtctctacccagcagcagcctagttattagcactccaggaacttgtcagagagctccgttttcaatagagagctgtccagtcccagaaaaaaacatagttgagaactgtttcagaaagatagcctaaggcagtggctgcactttggaatcatcaggggaaattttaaaaatcctgatgtctggatcctaccctcagagattctgacttaattgtgaagaataattaggcattagagattctaaactccccaggtgtggccaggtgggggcggttcatgcttgtaatcccagcactttgggaagccagggtagtggaatcacttgaaccaaggagttcaagaccagcctggacaacacagtgagacctgtgtctctacagaaaaaaataaaaataaaaattagccaggcatagtggcacacacctatagtccaagctaccccagaggctgaggtgggaggatcatttgagcctaggaagttgaggctgcaatgagctgtgatcatgccactgcactccagcctcggtgacaaaatgagaccctgtctccaaaacaaacaaacaaacaaaaaatataaacttcccagctgattctaatctgcaaccaaaacagaaccattgctctaagtttgaagtggtggttctcaaacttagatggaatcagaaccacctggagggtcataaaacacagaccactggcctcacctacagtttctgatttagtaggtctacagtggacccaacaatttgtatacttaacaagttcctaggtggtgctgatgctgctggtctggagaccacagttcaagaacataaagcttctgctgtacaccttaagtacaatggttgtctcaaggaaaagcacttgtgtaattgccagtggttgaactagtcactttattgaataccatctttatttgagagaatgctggcaaacagtgtttattcagacttgggtatttggaagacattttctcaaaaataaagtcagctagtcactgcaaggaaaacaactgagaaaattttttggccagtgacaaaatctaagctttcaaatgaaaattagaaattttcaacatttaaagacttttgtgttaagattggtagtgatattaatgaatgtgattttggatacagtgtaacgaaatgtgtcaacatttggagtatctggataactcagtgaaccagtatttttcaaatgaatgtcatgttataacattacacatgagtgacaaagccattcaaagggcaagttagacaaatttattttaatgtaatagtattatcatttcagattccatattacaactaacctttatttttaattttttaaaattgctttatttatttttgagacaaggtatcattctgtcacccaggctagagggcagtggcgtcgtgatcatggcccactgaagcctcaaattcctaggctcaagcaatcctcctgcctcagcctcctgagtaactgggactaacaggcacatgccacctgaccaggctaattttttaaattatttttttcgtagagacagcttcttggctatgttgcccaggctggcctcgaactcctgcctcagcctcccaagtagctgagattactggcatgagccaccactaactgcgtcatgggccgcaacgaacctttaaaaactagcacttgtttgtatcctgagactttgctgaagttgcttatcagcttaaggagattttgggctgagacaatggggttttctagatatacaatcatgtcatctacaaacagggacaatttgacgtcctcttttcctaactgaatactctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaaggttgttgaattttgtcaaaggccttttctgcatctattgagataatcatgtggtttttgtttttggttctgtttatatgctggattacatttattgatttgtgtatattgaaccagccttgcatcccagggatgaagcccacttgatcatggtggataagctttttgatgtgctgctggattcggtttgccagtattttattgaggatttttgcatcgatgttcatcaaggatattggtctaaaattctcttttttggttgtgtctcttccaggctttggtatcaggatgatgctggcctcataaaatgagttagggaagattccctctttttctactgattggaatagtttcagaaggaatggtaccagttcctccatgtacctctggtagaattcggctgtgaatccatctggtcctggactctttttgcttggtaagctattgattattgccacaatttcagctcctgttattggtctattcagagattcaacttcttcctggtttagtcttgggagagtgtatgtgtcgaggaatttatccatttcttctagattttctaatttatttgcgtagaggtgtttgtagtattctctgatggtagtttgtatttctgtgggatcggtgttgatatcccctttatcattttttattgcatctatttgattcttctaatgtacaaaaatcaaagcattcttatacaccaataacagacaaacagagaaccaaatcatgagtgaactctcattcacaattgcttcaaagagaataaaatacttaggaatccaacttacaagggacgtgaaggacctcttcaaggagaactacaaaccactgctcaatgaaataaaagaggatacaaacaaatggaagaacattccatgctcatgggtaggaagaatcagtatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagacatatagatcaatggaacagaacagagccctcagaaataacgccacatatctatgactatctgatctttgacaaacctgagaaaaacaagcaatggggaaaggattccctatttaataaatggtgctggtaaaactggctagccatatgtagaaagctgaaactggatcccttccttacaccttatacaaaaattaattcaagatggattaaagacttaaatattagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctacttatctgacaaagggctaatatccagaatctacaatgaactcaaacaaatttacaagaaaaaaacaaacaaccccatcaaaaagtgggcaaagaatatgaacagacacttctcaaaagaagacctttatgcagccaaaagacacatgaaaaaaatgctcatcatcactggccatcagagaaatgcaaatcaaaaccacagtgagataccatctcacaccagttagaatggcaatcattaaaaagtcaggaaacaacaggtgctggagaggatgtggagaaataggaacacttttacgttgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaagaatgatgagttcatgtcctttgtagggacatggatgaaattggaaatcatcattcttagtaaactatcacaaggacaaaaaaccgaacaccgcatgttctcacttatggatgggaattgaacaatgagaacacatggacacaggaaggggaacatcacactctggggactgttgtggggtggggggaggggggagggatagcattaggagatatacctaacgctaaatgacgagttaatgggtgcagcacaccagcatggcacatatatacatatgtaactaaccggcacattgtgcacatgtaccctaaaacttaaactataataataataaataaaaaagaagctcaaaaaaaaaaaaaaaaaactagcacttgtggaattctggtatagtacaaagaatatccacagttatctgaaaaggctattaaaatactcccacttttccaactacatatctgtgtggggccagattttctccatataattaagccaaaacaacatcataacagactgcagaatcagatgtaagaatcaagttgtcttctattaaatcagacatttaagaaatttgaaaaaaaagtgactatcactcctctcaataattttttttgtttgttttggcaaatagttaatattcataaagtattatttaggttaacatgtagtaaatgtattattgttatttttaaagtgaattaatattttttcattctcagttttaatttccaataatgaaaatactgctagttataggccatgtacacctaatttcattggggtcctcaataatttttaaaagcataaaaggggccgggtgcggtggctcacacctgtaatcccagcactttgggaggctgaggtgggaggatcacgaggtcagcaaatcaagaccatcctggctaacacagtgaagcctcatctctactaaaaaaaacagaaaattagccgggcgtggtggcgggcgcctgtagtcccagctacttaggaggctgagacaggagaacagcgtgaacccggacccaggaggcagagcttgcagtgagccgagagatggcagcactgcactccagcctgggcgacagagtggttttttatttttttatttttttttgagacggagtcttgctctgtcactcaggctggagtgcagcagcacgatcttggctctctgcaacctctgcctcccaggttcatgtgattcttgtgccacagcctcccaagtagctgggattgcaggcgtgcaccaccacacctggctactttctgtatttttagtagagacagggtttcaccatgttgaccaggctggtctccaactcctggccctacctgatccacccgcctcagcctcacaaactgctgggattacaggcatgagccaccacgcccagccttctagagttctaggagtgttctatctcttggttttggtggtggctatgtggatgttagttttgcagttattccttaaaatttagatataaattttatgtacttttgtgaatgttatgtttcataagatttttcaaaaattgcgattaaggaagttgcctcttggtatagcagaaagaattgggttttggaaataaaagatgcaagagatgcttatatattttggctactaataaagaaaggttttctgtatttgaaaaaaaaagattcatgattcaagttctctgtgttaacctactgtgcggtttgggggccaaaaaaatagttgtaatactaccttctgtaaagcataaactgtaaagtggtatgcaaatgttggccactattatttttttcttttcttttcttatttatttatttattttgagacagagtctcactctgttgcccaggctggagtgccaaggtgcgatatcagctcaccgcaacctccacctcccaggttcaagtgattctcctgcctcagcctcccaagtagctgggattacaggtgcctaccaccatgcccagctaatttttgtatttttagtagagacagggtttcaccatgttagccaggcgggtctcgaaccctcgacctcaggtgatctgccctccttttggcctccaaaagtgctgggattacaggtgtgagccaccacgcccagctgaccactgctattattgcacaggaacaacatatatatctgcttaaaagtttctctcctaattaacctgtttgtgacctttaagcatacttcatagaattcctgaaaccattatgtttttctttgttttttgttttttgtttttttacttccaaaatacttggggttaaatttcttacatggtgttaataactctgttttgttatacattacttttctgttatacattacttctccgaatagtatttaatcatctgatttattttctttaaactgcctcaagttatacgtgtcttaatatttatgacctcaaatactttgtagaaaaagaagaaatgggtaagttatatataaacagttaaggattctgacaggatgggagaaaacgtggcccttacatgtcttctctctaaaggttgtgaggcacattgtggcagtctcacttccccctttctgcagcacatcaccctcagataaataaataaagcagaggactttcatttccagccagttgtcatagcaacttttgactatccagagaagaaggaattctcatatcttaagccctgactccagaagagctaaaaagacacaaagactaaaaggaacattaaagaatgatttgcaagatgtgataaaattgaatatctgttattcagaacttttccagtatatgtatgtgctttttcccctgacatatttatatttcttcttatagaattcagaactcaacagcaatagactaatagctaccatttatcacttattacatgccagatgcatagaacattacatatattgttttttaatacacccaacaacactgtcggtgttatactatttttatccacattttacagatgaggagcttgagtttagatagatggagcagtttactcaaagtcacaggataagtgctcatcctctcagccttcaacacagttgatcacttcttaaaacattctccacttttctgcatttttctcctgctttattggccaaacacttttctgactctcttggttctgtctgatctgtaaatgatagaatgcctagaacttacactcttctctatccagttaatatcttcctttcctatggctttaaatgttttctatatgttgacaatccccacatggatatctccttcccagatattgcacatgcatttcagattctggtatgcaagtgttcactgacacttagatatctaataggtattttaaaggtaataaatctaaaacagttcctgtctgtatatcttacctatctcagtaaatgtcagcactgtctaacccagatgcttaagccaaaatccctaagagtcatccttgatttattttcccctcacacccccactaccctgtcccaggactgctaatgtataaataagtaatttcagaattatccacaaaatctatcttaagtctacttcatttcacctccattgccaccactttaatgaaggccaccatcttttcctggactcctgtctgagtccattttgtgctgctataacagaataccacagactggttaatttataatgaacagaaatgtattggctcacaattttggaggctgggaattccaagatcaagaggcaaacatctggcaagggccttcttgctgtgtcataccatgacagaagagcaaagagagggcaagagagagagtaaaagagggtcaagttcccccttttataatgaaccttctcccttgaaaatggcatgaatccattctctccaccttcctggcctaatcacatttcactgggcccatctcctaacactgttgcattggggattaagttttcaacacatgtttttgggaggacacattcaaaccatagcaactcctaaccaggaactttctaacccatattcctgcttccattctccaaagagcagccagaatgagcttttgagaccataaatcagatcttgctagcgttaaaggcttcaatggcttccattgctcttagagtatgatttgaacttctaactgtagtgtaaaaagctatgcatgagctagttaatgccttttgctccaggatactacagttgtccccctccatcattctgcattagccacagtgtcctcctttctttccctcaaacacgtcaagctttttttttttttttttttttgactcagattttgcagtatgaactaccttaaacttctcttagcttattatcctagccggctatttttcctccttcaggtttcagctcaaatatctccttagagattaccttatctaaagttgcctcctgttggggctctcagttaatcacatcatttttcttttcttttcttttttttcttagagacatgtcttaatgcttcgctgcattgcccaggctggacttgaactcctgggctcaagcaatcctcccgcctcaccctcccaagtaactgggactacacatttttattttcttaatagcacttatcaatatcagaaatctttactagtgtaagttccacagggtcagggaaacttgtctttttcattgctgtattttccaaacttaggagtatataggaggtgctcaatgaataatccttgaaggaaggaatgaaggaaaagggaaaaagtgagaaattcagtgctggaattacattccagggtgggtttactccaaaattgctttgacctaccttcctttcgatggggttcgggaaacaccaccccaacatatggtaccttcagaaaatctcagaagcaggaaggtcactttaccttcccctcaactttcctccgtgaagcgggttataagaccttcattccagaggcactcacccaaacctggaagaaaggaatgtccttatctctgaagacacaaggatacaaagaagaacctgaacaaacaggacttcctaagtttcctgcagttatcataaccttttgtccaatcatacttctgcagaactgtctgctcttcatcaaccctaagcataaaaatacacacatatccctgtttctttgggtcttcatttctgaaagctcctgtgtcacataaaacttatattaagtaaatttgtatgcttctctcttgtcaatctgtgttttgttatagggacctcatttatgaacctagctatgggtgagaaaagatttattctttcctacactatttttagcttttcaagatgatttctagctatgttagttgttttgttctaactgtagactgatgcctgaatccccccaaaacactgagtttgagatggggatgaaaggagacggctgtgaaagaatgcaattggaagggctctcaaacaactgcaaactctttaactttgggggaaggaagacaaaagaaagagaacaccatgccacagtttttacttcttcagaaatgaaagttaaattccttgaaagaactcaacatatgccccatcacatccctccctgccaaattcccatggtttttaggtaagttgttctcaagcaaaaatcaatattccaaaatgtgaactttggagtttgaatgcaaccataccagcccattgccgctcattctcactctttaattattggcaataaaattgtatctaaaaaacttatgaggaaagaagacagaagaaaggcgcaggataacaaaacctgaagcattaagatacaaagggcagcctgagcaaatcaatggatgtttctcacagctgatctctccacactagcccaaaattggttgtgaagtccagtcagttcctaggggaagaaagaggaaagatgatgcaaggatacttttccacagagaatatagttctaatttataaaagtttacaaagagtttgaatctcaaatatctcactctacttctggcaccaaaaggaagcatgccaaggcctaagagaaataaattgttataatttacatgttagttggctttcagtaggtttggctcctgagccttttaaatgtcaaggattttagcgttaaaacacttagctttcaacactttagaaactcccaatgctaatgtttttgttttgtattttaactaacaattctttggctgaagactttcatttttgaaacacttaaattcctaataagtaaaaacctggcagggggtttggagagtttgggccataatgatagactgaaaattacttttactcttgaccttcatattgacttgttgtgatctaacaaagatcatttatcttcctgggctttcaattttttcattataaactataaaaaataatatggatattattttgagatcatttatcttcctgtggtttcagttttttcattataaactataaaaaataatatggatattgttttgagatcactggagaaaatggacaagcccagcatggttatttgtagaggtacttatatcaaattcaattatgtaaatcctgtttttaaacaactttctaattctgttcaatatgatttctaagttttatacagtgaaaacaaaatttaacttgatagtctgtcaaaatctaatattatatctatagttttcttttgttaccagaaaggagtcccaacccagaccccaagagagggttcttggacctcatgcaagaaagaattcagggtgagtccgtagagtaaagcaaaagcaagtctattaagaaagtaaaggaattaaaaaaatggctactccataggcagagcagcaacatgggctgcttaactaagtatacttatagttatttcttgattatatactaaacaaggggtggattattcatgagttttccaggaaaaggatgggcaattcccagaactgaggattcctcccctttgtagactatgtagggtaacttcttgacattgccatggcatctgtaaactctcatggcactggtaggagtgtcttttagcatgctaatgcattacaattagcatataatgagcagtgaagacgaccagaggtcacttttgtcatcctcttggttttggtgggttttggctgccttctttaccacaacctgttttatcagcaaggtctttatgacctatatcttgtgctgacctccctatctcatcctgtgactaagaatgcctaaccttggccgggcgcagtgtctcatgcctgtaatcctaacactttgggaggccgaggcaggtggaccatgaggtcaggagttcgagaccagcctgaccaacatgtggaaaaccaatctctactaaaaatacaaaaattagccaggcatagtggtatgtgcctgtaatcccagctacccgggaggctaaggcaggagaatcgcttgaacctgggaggtggaggttgcagtgagccaagatcgtgccactgcactccaacctggtgacagatcgagactccatctcaaaaaaaaaaaaaaaaaaaagaatgcctaacctcctgggaatgcagcccagtaggtctcatcctcattttacccagcccctattcaagatggagttagttgctctggttcaaacacctctgacacattcaattagagtgaaagagacttagtaaaattgaaataacatctccagagttaattttcttttcttcttctgcacagaaccatccctatttactctgtatgaaaactttcattacctgatgctccactctcacgcctccaatcttgggtctacaagtaccacaattttatgtgaaaagacattttatatgaaaagacattttacgtaagaagaaatacaaacaccaagaaaacattaaaactatacgatttctctagtagtaggcaaataatgcaaagtaaaattagataactttttcaccttatcttttgacaaatactaaaattaaaattggcaaatatttaaaaattaaagtttcagtattgtctaaggtgtaaagacatagtttttcatatatggctgatgggagtgtaaattgttaagatctttttgagtgaaaacccctttgcaaaagtatgacataagagaaatctaacatggctgactccatcttgcttctagcctcacggactggctgtctttgctcatttctggaaatttttctttgggagaaatttagtttacagtttaaataataataacccttccccaaaactaaactgcccttgtaaaactaatgaaaggtcaccaagttagaaggacgagaggggcctgaattctaaataattactagccattactctgaaggtcatacgatttgcaacttttccaattactcttgcagataacatcattattgtagaccctaagattggtcttttgaaatgtcttttcagttttttgcatttctgacaagtggatggccccatccgaacttgtgactcaatcagtcctgtggcccccacccagaagcagatcagtgcatgaggaccattttccacaccccatgttgacatccccaaccaatcagcatgtctcctaccctagccctgtgcccaccaaactatctttgaaagactcctaacctctgaacctttagggagactgatttgagttataactccatctcccatgtagcataaccagcctcacatcaatcaaacgctttctttactgcaatgccatggtctcagggggtcgattttgttcctgcagcaggcaggaagaacccatcaggcagttacacgaggagcaatttggcaaaacctattataggtttaaaattttactttgagtagcttggtagtacacaaagatacaaatataaagtatcaagtgttggtgggaatgtagtcattggaacactcatacactgttagtgggactgtaaactggcaggaccacttcgtttttctgttttttggttttttgagacaggctctcactttgtcacccagactggagtatagtggcatgatctcggctcactgcagcctccacctcctgggctcaagcaaccctcccacctcagccccctaagtagctgagactacaggtgcacaccaccatgcctgactaattttttgtattttatgcagaaacagggtttcaccatcttgctgtcagaggcgtttaaaccacagcaactccatcttgaataggggctgggtaaaataaggctgagacctactgggctgcactcccagaaggttaggaattctaagtcacaggatgagataggaggtcagcccaagatacaggtcataaagaccttgctgataaaacaggttgcaataaagaagctggccaaattctaccaaaaccaagatggcaatgagagtgacctctggtcgtcttcactgctcattatatgctaattataatgcattagcatgctaagagacactcccaccagtgccatgacagtttacacatgccatggcaatgccaggaagttaccctatatagtctaaagagtggaggaaccctcagtcccaggaattgcccacccctttccgggaaaactcatgaataatccaccccttgttaagcatataatcaagaaataatcataaaattgagcaaccagcagcccttggggctgctgtgtctatgcaatagccattcttttattcctttactttcttaataagctcgctttcactttgtactatggacttgcctgaaattctttcttgtgtgagattcaagaaccctctcttggggtctggatcgggacccctttctggtaccattgccaagactggtcttgaactcctgagctcaagctatctgcctgccttggcctcccaaagagctagaattataggcatgagccactgcacccggccaggaaggatcacttgggaaaacaatttggcattatctactaaggctgaagatgtgaatgtcttataactcagcagttccacttctgggcatagactcaagagaaactcttgtacatgtgtttatatccacactgtttgttaagaccaagaaagaagaactaatcctaattgtccatcaacaatacaatagataaatacagcagtgaaaatgaagaaattatagctacacacaatgacatggatgatctcaggaatattgtgttgtgagaaaaagcaagttgcagaataatatatacagtatggttctgcagggtgccagactatgccacctcaaaatacgcctctttaccactggattatcttgagctaaacacaactgagaaatagtagatacaagtaaagctctttacctccctcttactacctaaaaatgcagtataaaattccccttttggaaaggaatttatatttataaagcaaatttatatttgtaaaatttgtctccttaccaggaagaaagctattcatagagatgacccttatcacctggatgactcttatctgcaaaacaagatagcctttatttatcacacatttcatcccctcactttcccataagcttgcctccctgacccagaaatcccaaaccccttttcctttgtttagcctaagatgataaataagcctcaatcatctaaccacatccttgagtctcatttcttatttaaactaatgtgcattaagtgtgtaatcaaaacctttttttctcttgctaatctgtgtttcgttattttaattcacaggctcagcctgttaggagggtagaggaaaaaggattcctcttcccctacaatttcatttgtataaaatccaaaagcacataaaactaattgcttgggaaaacagatgtgatggtaggggcaaagggaacattccttccacactccaaagatttgataattaatttttattttttatttttgagatggagtcttgctctgtcactcaggctggagtgggtgcgatagctcactgcaacctctgcttcccaggttcaagcgatcctcccacctcagcctcccaagttgctgggattacaggcatgcaccatcatgcctggctaatttttgtattttttgtacatatgaggtttcacaatgttggccaggctggtcttgaactcctgacctcaagtgatctgcccatttcagccccacaaaatgcttggattacaggcatgaaccaccatgcctggccaaggtttgataatttgagtctctggaataaactgacaacaaacagattaacaggagaaaaggcatacaaatttattatatgcacatgagccacacaaaatatgaaacttagagaaggaccagttgagctggctaaagtttatttttgtttgtttgtttttgagatggagtcttgccctgttgcccaggctggagtgcaatggcacgatcttggctcactgcaacctccaccttctgggttcaagcaattctcctgccttagcctcccgagtagctgggattataggagtgtgccaccacgcctggctaatttttgtatttttagtagagacggggtttcaccatgttggccaggctggtctcgaactcctgactttgtgatctgcccgccttggcctcccaaagtgttgggattacaggtatgagccaccacacctggccaaagttctatatgatatggaaaggaatagggggctgggagctcctgaaggatggtgataacaagctatgggagggtaagggggaaatgcattgtcaacaaattcttttttgttgtttgtttttttagagacagtgtctctattttcaggctggagtacagtggcatgatcatagctcactgcagccttgaactcctaggctcaggggatccttggactacagctaatttttcaacacccaactaatttaaaatttttttttagagatggagtctcctcatgttgcccagtgtcaggttccagctcaagctggggtctgaggggagtcagtgaacaggtggcaggtagctgaaagaacactcaggggtctgtaggcaagtgcaatatggctttattctctcgccttctccatcagcctttgtctcagctgcctgctctggccacagtccctctcagtgccagctccatggctcctgctgcccccacgcctgcagctatgctccctagtgtgggcaccacttcctggctccctcctgttcacctgcaaggcagccagctttatcaagcacgctctcacagtgtcagtgatacatctatgcacgtcacagataacagtgactcagaaccaggtgatgagtccatccataacatggttacataactgtgattatataatgcacgggattgtgcacctgcgctccaatccggctgtgccatgctgcactggatgtttacttcggcccactcttgactgtagtgcagccatttcccttacacccaggatgatctcgaactcctgggctcaagtgatccttctgcctcagcttcccaaagtgctgggattacagcctgagccactgagcccaaccagactgtcttattatgcagataaagtctctcaggtagcagccctgaaggtggtagcctctgataagagtttctccagcatggtgtcagaactttcttctcttttcctgtgagctagtcttctctggttaatgattgcattccttctggagaaacttcccttggataaaggaagatcagagcaaggccttccctgcattactgctctccaggtgctctcagtctgaagtctaatgcaacatgttttgttttctgagccccaacacaataaagctaaaagtagagtaacaataaacctaaattaaggatagttgttacctttcagagaagaaaaggaggatggggttggagagaagcacacagggtactttaaaggtaatgagtgaggaaagtgaaaatgacttggagaccattgaacagggcccagagacaaaaactccttatctgaggaatttagaaggcagcaaagaacacctggtgaccatcaaacaggccatccaaaggcaaaagttatctaggaaatttaaaagtaattaaacttcccagcagggtgcaatggttcacacctgtaatcccagcactctgggaggccgaggcatgcggatcacctgaggtcaggggttcgagaccagcctggccaacatggtaaaacccccgcctacaaaaaatacaaaaattatatttgggcatagtggtgggcacctgtaatcccagcttctcaggaggctgaggtgggagaattgcttcaacctgggagatggaggttgcagtgagccaagatcgtaccactgcactccagcctgggtgatggaaactccatctcaaacaataacaataataataataataataaaacttccctactatctaaagttggcatctggttccaggcctctttcaacttttattaagtaactagaatttttatacatcttgggaattccatgccgaaactcattgtgcaacccttgctgacgttaagccacccaaatgtctatacatgtaataatttatcatgacctatgtagctaatatggcccaaattacctttaagctcttaccttaaggtccataaaaggtcctaaggaaaatccaccatttcacacccagtcctcccactgaggcgccccgctgcaccctttagcaatattccttctttctaataaactttcctttttcaaacctatactgttgtcggtaagttgactacttcccaatggcggggctctgacacctcgcctggcactaataatgttttgggtttttttccttacatttggtgataaattcagaggtttttggttgtaaatgtgtttcattttacttcataaatatttttgtgtctagtcaatgtttaataaaagcaacttaaagaacttaagtgtccaacaatcagttatacgtcaacataaatagaacaattttatttatataaaactctatatatattatgtggataaacagcaatgaaagatgtgtacaaggacatataataatgtattaatcattgtatcacttagtgagtggatttggactgattttgctctccttgttttactttactatattgtttattttgtccatataaaggacatgtattttcttataaagaaaataaaactggttggcatgatgacacatgcctgtttaatcagcactttgggaggctgaggcaggagggctgcttgagtccaggagtttgagaccagcctgggcaacatggcaaaaccctgtctttacaaaaatacaaaaagctagttgggtatggtggtgcacccctgtagtcccagctactcaggaggctgaggcaagaggatcaattgagtctggggagttgaggctttagtgagccatgatcaggccagtgcactccagcctgggcaaagaacaagaccctggcaaaaaaaaaaaagaaaaaattttaaaaagaaagaaaagaaaggaaggaagggagggagggaggaaagaaagaaggaaggaaaggggaggaaagaaagaaggaaggaaaggaaaggaaaggaaggaaaggaaaggaactatttctttaaaaaaaaagatataactattaggatgttcacaacagttagatagatgtatagatagataaacatattgtgtaagaaagaattaaccttactcaaagtaaggtatggcctttgctgtcagcccctaggaggtaatctctaagcccttgggatgtcttgcctgatgaaagtgtccttgtttacttgggggccttgagccatgccagatagtctgattacaataatttgtggtaggggctttggggcacatgctatcagctcaacctccagagaagctggaggttaaggtcatccacatgggcagtcaactatgtctatgtggtgatgccccagtaaaaactttggacaccaaacttctctggttggcagtactccatgagtattgccacacactattgctgggaggcacaatggctggctctgactccaatgggagaggacatttagaagtgtcatgcttgaaactctcctgaactctgccccttgcacctcttcctttggtttattttaatttgtacacatcactgtaataacccataaccgtgagtgtagcagctttcagtgagttctgtgagtctttctagtgattattgaaactgagagtgttcttgggaatccttgcactttcatttggtgccagagtgagggtgatcttggggacacctgaactttggagttggtgttagaagtggaatttgcaagaatgactgtattagtccattttcacactgctgataaagacatacccaagattgggcaatttacaaaagaaagaggtttaattggacttacagttccacatggctggggacatctcacaatcatggttgaaggcgaaagacatgtcttacatcacagcaggcaagagagagaatgagagtcaagcaaaacgggtttccccttatcaaacatcagatctcatgagacttattcactaccacaagaacagtatgggagaaactgcccctatgattcaattatcttccaccaggaccctcccacaacaagtgggaattatgggagtacaattcaagatgagatttggatggggacacagagccaaaccatatcattccattcctggcccttgccaaatctcatgtcctcacatttcaaaaccaatcatgccttcccaaccatcctccaaagtcttaactcatttcagcattaactcaaaagtccatggtccaaagcaaaagagacaaagcaagtcccttctgcctatgaacctgtaaaatcaaaagcaagttggttacttcctagatacagtgggggtacaggcattgggtaaatacaaccattccaaatgggagaaattggccaaaacaaaggggctacggtccccatgcaagtctgaaatccagcagggcagtcaaatttgaaacctccaaaatgatctcctttgactccatgtctcacatccaggtcatgctgatccaagaggtaggttcccatggtcgtgggcagctctgcccctgtggctttgcaagctatagctcctcttctggctgcttccatgggctgtcattgagtgtctgtggcttttccaggcacatggtacaagctgtcagtggatctaccattctggggtctggaggatggtggccctcttcttacagctccatgaggtagtaccctagtagggactctgtgtgggggctctgaccccacattttccttctgtactgccctagcagaggttctccatgagggccccaccccacagcaaacttttgcacgggcatctaggcatttccatacatcttctgaaatctaggtggaggttcccaaacctcaattcttgtgtgcacccgcaggttcaacaccatgtagaagctgccaaggcttggggcttccaccctctgaagcaacagcctgagctgtaccttggccccttttggtcatggctggagtggctgggatgcagggtagcaagtccctagactgcacacagcatggggcctgagccagtccatgaaaccattttctcctaggcctctgggcctgtgatgggaggggctgccgtgaagacctctgacatgccctggagacattttccccattgtcttggggattaatattcagttcctcattacttatgcaaatttctgcagccagcttgaagttctcagaaaatggggttttcttttctatcccattgtcaggctgcaaattttccaaattgttatgctctgcttcccttataaaactgaatgcctttaacagcacccaagtcacctcttgaatgctttgctgcttagaaatttcttctgccagataccctaaataatctctctcaagttcaaagttccagggtctcactgtgttgcccaggctggagtgcagtggcataatctcagctcactgcaacctcagcctcctgggctcagatgatcctcccacctcagcctcccaactagctgggaccgaaggtgcacaccaccatgcccagctaatttttgtatttttttgtagagatagggtttccttattttgctcaggctgggctcaagcgatcttctctccttggcctcccaaactgctgggattacaggtgtgatccaggtggccgcagttccttattttcttgtctgtgtccataactcctcaacaatccctcccaactggtctataaaatcattttgtagacaaagtgatatttgtttgtttcttaaatatttctgcagaatggttttaaaaggctaaaagatttagttttagataaaaagatttacattgctcacatatcagagtatattaaatggtgtacagtgagaaatcactctttccttccccacaccattccccattcactttgttttcttcctctgtgagtagtgattataggttctgttgatccttctgaaaaatgtttatgcatatttaagactatatgtgtgtatgtgcattcagtttttccacaaacatttcacataaatggtagcatactatacacactctctctgcattaaggatctttctctatcaatacattaatatgtacataatatcttctgtgtgtgtgtgtgtgtgtgtgtgtgtgtgtgtgtgtgtgtgtgttgtgctgaactacactgtgttcaccattacaagggctttagtaagactgttgaaatgaataaaattacaatacagggagttgataataataagtgttgatgacatcaaagtgactaataaacacatgaaaatgtgctcaacatcattattcaagagggatatacaaattaaaagcacagtgagattttactacccacccactagaatgaataaaataagcaaaatgaaacatctgacaataccaagggttggagaagatatgttgcaaccggaactctcagacactctgctgagaatgtaaattgatagagccactttggaaaactgatcttaactactaaatctgaacatatgcatagcctatggcacagtaactccactcttaggtatgctaagagtagagctgccaacaggaatgctacatatgttcaccaaaagacatacaagtaaaggattaatcttgtccaaagcaatgtttggcccttgatcagtttctaggaggcaacctctaagcccttggaataagagcatccttacctggggctttgggtcacaccaaatagcctatgttaacaatgtcacttatagccagagtattgggccacatggcatcagcttaacctctggagaagctagagactaagagcagccacgtggttgttgccatttccatgtaaccaacccccagtaaaatccctggacaccaaggctaggggagcctccatgctaggttggcgttactccatgcatctgccactcatcattgccgacaaaagtaaactctgtctgcgggactccactgaaagagaacgactggaagctcatgcctgggaacttgcctggactctgtcctctgtgccttttcccactgctgattttaatctgtattctttcactgtaataaaccatcatcgtgaatataacagctttctttctgagttctgtgagtccttctagtgaattattgaacctaaggatagccttggggatctcccaaatggcaacaagaatgttcatagaggcattattcataatagacaaaacctggaaacaacccaaatgaccatgaatagaatagatgtatattcatataaaggaatattctacagcaagaaaactaactgcaacaacatgcaacaatattgatgaatcactcaaccataatattgagcaaaagaagccacagaaaggagtatgcagtatattattttatttatgtaaggttcaaaaattagtctatgttgagagaagccagaataaggttacctttgagatggggtattggctgaaaatctcaagcttgatacttataatctgtgcacttttctgtgtgtagattatgcctcaacagaaagtttacttcctacacacctattatcattgttaaaaaaaaaaagagtgagagagagagagagaagaggggagggggaaggaaactggattggattctggcaaggttgcagagtaactgcaactctcatacactgctaatgggaatgtaaaatggtaccactactttagagaatagtttgatagttccttataaagttaaacatacacttaccatatgacccagcaattctatcccaaggagttacccaagagaaatgaaattttatatttatgcaaaaacctataggccactcatcctcttcaaaaaaaactcgaagaacccaaatatccttcaacagatgaatggatacataaactatgatgcgtccacatagtggaatactattatactactcagcaccgaaaaggagtgaactattgacacatgcaacccctcagatgaatctcgtgtattaagtgaaagaagtcagacccaaaaggctgcacactataggattcaatttatatgacattctggaaaaggcaaaactttagagacagaaaagagactggtggttgcctggggtggggggttataggaggcattgaccacaaaggggcacaagagaattaattatttgggggtgatgataacattttgtaacttgactgtggtggtagtgattacacagcagaatgtgtcaaaacttaaactatacactaaaaagggtgagtttcattatatacaaagtgtacctcagtaaaactgacagatatataaacatgtttaaagcttacttttaagtaataataataataggtgccacgagagatgtaaagaggaaggagactatgaaaaatttatttcccagtgagaattagagaattgtcacggaagtgttcatatgcatgttgagcctcaaatatacatgaataatatctggggagtgaccatcttgaagaactaatttccaatttcaaattcatggaagaaagtatcagagaatcatatttctgtacttttgccatagcaccttccactgagccacaaaccaagtagatctaagagccacttagtctcatctgtcatggcacacctttgggcgagagtcacactgcctccacctgagaaacagctccaagcccagaaaacaaggggcttagagagtcagaatccttaggtctaccagggacttcaaaacttcctccacaatatttgtcctttcagaataagaggaaataatccattaataattaaagctaacacttatgtagcactgactagatgccgggccctgttccttaatttcatatatatatatatatcaattcttacaacaactccatgaggtaggtagttttgaaaacaaccccattttacagatgggaacctgaagaacagagtggttaaggaacttgctcagggtacaaaattagtaagtggtagaggcaaaattcaaatctgagcattctggctccagagacatcttcctaatcattgcagtctagtcccgctccgtgcacagttagggtaggggttgggtggccagtatatcctagtccaagtctctcaaagtataaactgccattcactagtgtgatggaatcaactgaatgggttgtgaccagcttttagaaagtggaattgaaaataagtaaatatattttggaatgggatgaatagataatatcagagtacattccagatatatgtactgagtcactatataggttgtatttattactgtgtgtcaagatctgaaaagtttaaagcactttccaggtccaccctcagaggataaaagctcaagatgtcctaagcctgaaatccaggctatctcttctccaagaacgtcagtcctcccccatgatacatccagcagtctccctaatgcttttgggtcttgagggcagagtcccacaacctttggccattgactactgcagaggagtaagctgggtgtaattctgctcaaaatgagagtcaggctaagccccggctttagtagtggccagaaagctaaagtcattctctgaaacagaaaatgtggattctttgcactctcgccaggtgcacgttataactggtggggaagctccagctgaaatgcctacagccctttgaactaaagtgctttacattccctgtcttctcacaaggaggaatggtagaaatataggtgacaggggaccggtatcactgagcaccatgatactgttcactggacacctggtggctcaggtgtgtaggagacagcggcagtgtctgcagtggcacattgaggctgcaggaagaggccatgcctgacccaggaggccactccctcaaagcctccagcagccaccagaaataggagagacttgtcttgctcagacacaggatcctcatgcgtatctgggccacagcccaaagtactgacagtctagctctccaatcttctcatgtgcacacctaggtaccttcgagggcatatgactgtgtcatacctggttctcgggcgttcatttcctcatagattgtgtttttcagggtgatatttgcctggcatgcaaccttctacgtggtgatccaggggcccggacgcttccattctgtgactgtgccctcctttagggtctctaggacctctgagtcctctgcattcagcctgcagatggagaaagagtggagaagatatgcccttgtcttaagctccttggctatttattgagaacatagcccctttcaggtgcaaagcaggagctgagaaatactgcctccagctgggctactgtttccagcatcagctgtcctctgcagtgagagtgtcaggaatcttcatctctgcttcatggaccaagaaccactgtgtcccataccaccctgggaatgatcccccttttcttgcagaacaactaagctgcctcctccaccctttatgagggaaactcttaatgatttcctaactatgcatattgtagctggtaagtctcttcctctagaaaacatagggaaaaagccacaagttgactctcaaagcaagactccccttctgttttctatggtatctgaacattaggaaatagtctagaaggatgccattgctagacactaggaacacagactcggaaggtagggttaggcgaagagtttcatcttttactttacaccattctgtatatttggtttaaacactaatgagcaaaagaagtattaggcagcatagctatttatatgaaattcgagaataggccaaacaaattgattatgataaaaatcagaatagtggctatctctggggaggaaatgggttttgactgggaagaggcaggaaatgttctccatctcagtgtgagtgatggctacacaggcgtccacacaggtaattaaccatggtctacacttaaaattagcacagttcatgttctttggcatatatacattatacctcaatttaaaaaaatatatatatattagtttaaaaattccctgccctaatttactccctgtgttagtgtgtttgcattgctataaaggaattcctgaggctgggtaagttataaaggaaagaggtttatttggctcacagttctgcaggctggataaggagcatggtgccagcatctgcttctggtgagggcctcaggaagcttacaatcatggtggaaggtgaagggaaaccagagcattacatggcaagagagggagcaagagagtgagggagcaggtgccagccttttttaaacaatcagatctttttttttttttttttttttgggatggggtcttgctttgtcacccaggctggagtgcagtagtgcgatcttggctcactgcagcctttgcctaccgggttccagtgatactcctgcctcagcctcacaggtagctgggattacaggcatgcgccaacacgcccagctaattttcttttctttttttggggcgggggatgaagtctcgctctgtagcccaggctggagtgcagtggcatgatcttggctcactacaacctccacctcctgggtcccggttcaagcaattctcctacctcagcctcccaggtagctgggattacaggcacacaccaccatgcccagctaatttttgtattttcagtagagatggcgtttcaccatgttggccaggctggtcttgaactcctgatctcatgatccatccgccttggcctcccaaagtgctgggattacaggcgtgagccaccgtgcctggccttaaacaaccgaatcttgcatgaactcatagagtgagaactcactgaaggacagcaccaagccactcatgagggatcggcccccgtgagccaaacacctcccactaggcccacctccaacattggaggcccacatttcaacttgagatttggaggggacaaaacatccaaaccatatccccccccaaacttttagtggcccctttttaagaatcctgttggagacattgatgatgacaggcaaagtgtttccctccccttccacccccataaattaaactctgccttgggtccattagatgtccctgcagttgcagaaaactgtacagaaaggagcaggcccaacatggtctcaaagagccccaagttatcactgaaaagaagtgtgatgtaatagaaagaactcgaacttgggagtcagccagctccgtgttcaaattccagatctgccccttagctgcaagatctaggcaagtgacttaggctttctgagcttctgtttcctccttataaagtcactttcatgtggttgaggtaagaggtgaatgaaatacttctgcctcaaatactccttgatgaggtgatatagtttggatctgtgtccccgcccaaatctcatatcaaattgcaatccccaatgttggaggtagagcctggtgagagagaattggatcatggggctgtgtttctcatgaatagattagcatcatccctgctgattctgttctcatgatagtgagtgagtttgcctgaaatctggttgtttaaaagtgtgtagcacctcccctctctctctcttgcctgtgctcctgccatgtaagacacctgctgctcctttgccttctgccatgactgaaagcttcctgaggcctcccccaaagcagaagctgctatccttcctgtacagcctgcagaaccgtgagccaataaaaccccttttctttataaatgacccagtttcaggtatttctttatagcaacatgagaacgaactaatacagaaaaatgagggatgaatctgatgtgagcaatgcatatttgagatcgaccatgtccagcccttgctctgtgcatggcgtgaagaaggaggggctcgcgtttcctgcccttccacagccatcagcagggaagacaaagtggccaagagatgctcacttctctatggaagtgtcagctgccccatgaccagtgatgtctttgccaagtgataagtcaccgagctggaagtggctgagcagaatagtgctaagagctaagagtgctaagcagagtcagtcaatccttgtgacaccccagcttccccattcagtcactaagagacccaaggaaaagattctgcctccctgtgctttagcctctttacctgtaaggtgagaacagcaagaccaccgaccaaatacactaatacccttaaagaattttggacttggcacagagtcagagctccacaggagcttcacaataaggccactgctttttgcaaacatctcccttgtcatcctgacattgcaaaggccacctgttggctgtggcctctcccttccctgtctctgtcataggcctttttctgttctgtctgcggtagcttcgccacagccttagccatagcagcagttgtttgttttgtttgtttttattgtttgaccaacatctacccaatccccccatcccctagcccctgtaactaccattctactctctgcttctatgagttcaactttttttcagattctacgtataactgagatcttgcagtatttgtctttctatgcctggcttatttcacttaacataatgtcctctaggtttattcatgttgttgcaaatgacaagatttccttcttttctttacagctgaatgttattccactgtgtatacatgccaccttctctttattcattcatccactgatgaacacttaggtcgtttgcatacattgtgactatcgtgaatagtgcttcaatgaacatgggagatatctctttgacatattgatttcacttcccttggatatgtactcaaaagtgggattgctggaatcatatggtagttctatttttaatttttttcaggaatctccatactattttccataatggttgtactaatttacattcccaccaacagtgtacaagggttcccctttctccaacacttgttatcttttgtttttttgataatagccattctaacaggtgcaaagtatagttttaatctgcatgtgcctgatgattcgtgatactgagcattttttcatatacctgttggccatgccagcagtttcccagttacttcctactgcctgtactttttccttttctagctattatcacatatttcttcagttcataaatatagcattaaaaaaatcatgggctcctttcctctcccatctggcaccactgtgatgtgtcccccaaggaactggagtctaggcccgaatgcagtctaggataaggaataggaaaatgaattcttttgttataaccttttacttgatgcagtttttggagaggaagcttgtcactttctgcttcctgcagctctgtgtcagggctgtgatttcaggcctttttaaggctgcaaataggcttgacccatctggcaaatctcaaagtcaactttccctatagtgtgccagcactctgaactggagttatttaaattcaaccttctgcctgacctggaggagaaaaaataaatagcagagtgttgctttatgggttcaaactaagaccccaatgctgaggatgagatgatgtaaacaggagggcctgggagaggagatgtattttctcccaggtcatttgcacattgtttaatgtgccagaagaaataatttggaagaaccttttgaacctgaaagaatgtccccaaagtaagtgggtatttttaaaaactctgtatggccttctcctcatttaaaatttcactgctctctgggaggcagaaaaaatcttttacccatcctgtatcttcttttttcttccttgctgtcaaaatcaaactcccattatagagtttgaaaatgccatatatttgcttcctccacctctcttgcagcccagcatgggcacgtaacctaatttcaggcaatggaatttggagaaatctgataccaggggttctaaggaaggtttctctcctaataaataagaagcccatggaaagccttcccttcttatttgttgaacaggtggctgcctgtaacgtcccaggcacatcttgtctccatcctttctcttaaatgtgggaaacttcttctggggtcaggcctacctgaccctgtgcccactcttagaaatctcagccactcacatggctttatctgtgtgatattgtgaaatatctatttggtcttcatccagcttctaaaatccttgaaatctccagaatggtaacagtgtcttttgcataagaagatggcttcaggatgagggctggtcaccagaaaaaccaagacatgaataaagggttggaactttcaaccttacatcctgacttccagaaagcggctgaaggtcgaggttgatcaccaatagccaataatgtaatcaatcatgcctatgtaatgaagcctccataaaaacccaaaaggacaggtttcagatgagcttccagatagttaagcatgtggaggttcctggagagggcatggaagttccatgccccttcccccataacttcccctatgcaactcttccatttgactgttcatctgtaccctttgcaatatccttcatactaaactgagaaatgtaagtgtatttgtctgttctcacgctgctaataaagacatacccaagactgggtaatttataaagaaaaagaggtttaatggactcagagttccacatggctggggaggcctcacaatcatgacagaagacgaaggaggagcaaggacacgtcttacatggcagcaggcaagagagtgtgtgcaggagagctcccctttatcaaaccatcagatctcatgagacttattcactatcatgagaacagcacgagaaagacctgcccccatgattcaatttccttgtaccaggtccctcctaccacacgtggggattataggagtgacaattcaaaatgagatttgggtgggggacacagccaaaccatattagtaagtaagcatttccttgagttctatgagcagctctagcaattcaattgaaccctaggagggggctgtaggaaccccaatttatagccacccagtctaaagcacaggtcacagtctgaggcttgcaactggcatctgaagtggggggcgatcttgcgggactgagccctcaatccctgggacctgatgccatctcaggtagatagtgtcagatctgcaaatgtgttgataacagagtatgcttatttcagtaattcagcaaacatttactgagcacctactttatgccatgttctaaaagcgaggacaagataggcaaggtctctacatccatgaaacttacaatctaataggcttctagcacaataactgtctccacttggcttttctgtttggtgtcctaactattcctgacataacacatctaaagttaaactcactctcttttctccgaaactgacttctctatttctggtcatggatcccaggttcaaaatcatgacatcatctttgtctcttcattcacccttgttgccagcatacctcatttctatttagtcattaagtctactcccaataagtgccaggagctggagctacaaagatacataatggtccctgatacatacacatatatataatcacaatacagagtaagatgtgcaacaatagaggtccatggtagatgagaggggaaagtgcctcaattcttgagaaagccaggaaaggagaaaacgaggagagtaagaagagacaaaactgaaaatagaatcttgcaaaaatactaatatttacagggttgaacagtgtcagatgggcagagaagtcaggttatgataaggcctgaaaatgtcttgtggttttgtaaactaggaggtgatcttggtgagaacagtttcagtggagtggcgggttagccactccaagaatgaatggaagatagtgaggaggactggtttaacatttctagcatctattcttccttctgggaacattgtcttgagtttcctttggggccacccctttccctctctaaccatgctcaggtggaggtggccccaccactagatccagggcccagccaacaaaatcaccacatatccatgcccattggagatttgttcaggggtggaattatgaccaagactgggccaatgagaaatccattgctggaactctcaggaaacaggtgctcttgttctacaccagtttgaagctcaggatctcaccttgtcagagctggactattgcatcagtccttttactagtctccttgtcttcgaattcttcatatcaaccaaagcttccaagctcttcttttcaacactgcttttacattattcaaaaactattgagcacccaccattaaattcatggcacttagtgcttcatattccattatctggagcaagtctacctttccttgtacctccctgtcatcaaagctttacatatctttcctactcctggactgcctacccgtttcctttctactatttaaatccatctcatctttcaatgtcctagctcaaacgtcatcttcctccatctggtaccagtatcacttgacagcaatttttggaaaatatgatttattgtctagttttattacctctcattttacatctttagtttttttctctcccaattaccttgcaggaaatatgaaggcaatagccatgtcataattattggtatactgtgaggcattgataacagagctctgtacagccaacactcaaaattttcacagaataatgaatagacattttcggttcagcagcaggtggcaagaaatggagattaatgtaaagctaccatttatatgatgagaagagatgtggtcagcagtgaagagagggaaaaaaaatttaatggatacaaatagtctggtcaagaagatagagctaggagcattgtaagtggaaaatttttgtgcaaagtcaaacttgacaaggcaaggagataaacccaaaacaacaggatgggggccacagggacaagctctgaaaatgctggagtgtctgtaatccaaagggtggtgagaagcgcaaagagaagctaagtgacttcaaggatcagcatagccagtgacttcagcagcaaggactcacatgactcagagcaggaagaggttgtgaggaccctgggagatggcacttattggacaaatagtacttacattttatcactctctttaactccctccaaagctcctctagaagaatgaagaaaagctgggtgtggtggcgcgtgcctgttgtcccagctacttgggaggctgaggcaggaggaccacttgagcccaggagttctgggcagtagtgcgctgtgccgatctggtgtctgcattaactttggcatcgatatagtgacctcccaggagcagaagaccagcaggttgcctaaggaggggtgaaccagccccagtcagaaacagagcagatcaaaactcctgtactgatcagtagtgggatcacgcctgtgaatagcctgggtaacatagccacgtcccatctctaaaaaagaaaagaattttttggccgggcgcggtggctcacgcctgtaatcccagcactttgggaggccgaggtgggcggaacacaaggtcaggagtttgagaccagcctggccaatatggtgaaactctgtccctactaaaaatacaaaaaatagccaggtgtggtggtgtgcacctgtagtcccagctactcgggaggctgaggcagaagaatcgcttgaacccaggaggcggaggttgcagtgagctgagatcataccactgcattccagcctgggtgacagagcaagactccagctcaaaacaaaaaaaaaaaagaaaagaaaagaaaagaaaagaaacgaattttaatttatttaaaaaaaaaaagaatgaagataagctctcagaaatgacttccccagggatgtggaatggtgatgagaaaccactgttgacaaggtcccaggagacacccacgttgcaattctcatggtcatctccagtcttcaccttccttggtgatctctcttcctgaaacattctctgtcctgggcctctgggacaccccctttcatagttctgctcctaaggaactgttccctcctcctcaatctcttctattggatcttctttatcttcctgacttttgagcaccagagggtcctagagcttcattctcaggctctttttgtctagatttgcagtcaggtactggggggagtctcatccagattcagagcttgaaataccttttatgagttgatgatatccagttttgtatctcaagccataacctctctcttctcccttaaattctagaatcacaggtctactgtccattctatatctccacctggatgactaatcatcattccaagcttgacagttcagaagtgagcttttacccctctcccatcccaccactgaactctactgtgcttccattcttggccatttctgtaaattactacgccactctaacagctgtcaggccaaactctttgaatcaacctcgtctgtactctttctcatacctgacatccaatccattagcaaatttggtcagcgttgccttaaaaatatatcttgactctgaaatgtgtctcttcactgccaccattaccaccctagtccagtctactctcatttctgacctggactataatcatgaacttttaattggtctttgtgctttcacctttgtggtcgcctccagtctcttcccacagagcagccagagttatccctctgaagtgtgagtaaagtctcattactcatcagctcaaaaccctctgtattagttagggctctccagagagacagagcaatgggatatatatagatgtagatacatgagaggggacttacgaggagaattggttcatgttattatagaggctaagttccactatagacggtctgcaaactggaggccctgggatgccagcagtgtgactcagtccaagtctgaaagccttagaactagggaagacaatggtgtaattgtcagtccaaggctgaagccctgtgaacctggaatggctgctgatatacatgctggaatatcctaagaccagagagtctgggattctgatgtccaaaggcaggaggagaagagtgtatccagctccaggagagagaatgagagacaaattcccttttcctaggatcgtgttctatctgggccctcagccagttggatggtgcccacccacatggagggcagatcttcccgacttagtccactgagactcacatgccaatctgctctagaaacatcctcgaagacacaccccaaaataatgttttgccacttctctgggtattccttaatccagtcaagtcgacactctaaattaaccttcacgtcctccgataaaagtctgacacatgttacttcatggatgataccttgaagacattaaccttcaaaactaagtgaaataagccagacatcaaaggataaatagtatatgagtccacttaaatgaaatacctagaatagtcaaacttatagaggcagaaagtaacatagtatttaccaggggctgcctggaggggagaatgggagttactgttgaattggtacaaagcttcattttgggatgacgaaaaagttctggagatggatagtggttacagttgcataataatgtgcttaatggcactaaactgaacaccgtatacttaaaataattaaaatggtaaatttggccaggcacggtggctcacgcctgtaatcccagcactttgggaggccgaggtgggcggatcacaaggtcaagagatggagagcatcctggccaacatggtgaaaccccgtctctaccaaaaatacaaaaattagctggatgtggtggcacatgcctatagtcccagctactcaagaggttgaggtaggagaatggcttgaacccgggaggcggaggttgcagtgagccgccgagatcgcgccactgcactccagcctggtgacagagtgagactctgtcaaaaaaaaaaatttaaaaaaaggtaaatttaaagttatatatatattatcaaaatttaaaaacaaaaaattctgtaatggctttccatctcactcagggtcaaatccaaagtcctcacaaaggccttttaggccctgcatccttggacctctgccacccctcaacctcctcttccaccactctttgcccctaccataccactctgctgcagccacactgaccttgcgattccccagacaagtcaaggacactcccgctcaaacatgcctagcactgtcctgccttaggccttttcattggctgttctttctgcctgaagtatttttccccctagaagtttgcatgcttatctcttttactttatttagttctctactcaaaagtcactgttagagcagtcattccatagctaacatagcacctcataacccctccattgttcacaatcccttacccagatttatgctttaaagcacttatcacagactgactcttttttccattcactcagttattgtcacattctccccattagaatgtaagctctctgagaacaaggatgttgtttgttccactgatagatcctagtttcctagaaccatacctagcatacagtaggcactcaataagtatttttcttgaatgaataaatgaatgaatgacattcttagcaagtgccaaaagatagtatctgtattagtctgttcttgtgttactataaatacctgaggctgggcaatttatgaagaaaagaggtttagttctgcaggatgtacaggaagtatggtgccagcatctgctcagcttccagtgaggcctcaaagagcttttactcatggcagaaggcaaagaaggagcaggcacatcacatagtgagagagggagcaagagcggtggcggggtataggagatgccaagctctttaaacaatcagttctcatgtcaactaccagagagagaactcactcattatcatggggatggcaccaaaccatccatgagggatcagcccccatgatccaatacctcctaccagaccccactttcaacactggggattacatttcaacataagatctggaagggacaagcatccaagccatatcagtaacccaaaagactgtttaggtaactgcctaatttctggataagtaaaaataattctcttggaagaggcatgctgaacccagttgcttttgtattttgttttggggttttgtttcttttactaattctgaaaaacatgttcatgacaaaaacacagctaataccaaaaagtaaagaaaaaaataaaggacactcaattccacaattactactgtagatatcagaaggttttattcaagttttttaatgtatattcattcttcttagcctgagggctcataaaagcagagcctgaggcaaggattacagcactgatactttaattgggaagtgcaagcacagggttgaaaggagaagagaaaaggccaggcgagacaaggaaagatgcaaacatgattgtgggatgttgattttcaaccctacttcagaactgggaagaaaaggatgggaataagggaaatcaaaatgccacaaaactcactgcttttattgaaattcagctatttttcttgaatcaacattctctggtcaatgctgacaattgtgctagctttcttcttgttgctttcatggtggagagaatttttggagatccttactcttccatttttctctgacataactcacacagttttatgcatttttttattacacatgagcattttccatatccttaagtattctccaaaaagatagaggttaatggatgtatattatcgatatttatttaatcattcttctatattgaacttttacattatcttctagttttctccttatagataataccttgatacatattctttgaccatatcttggattactttcttgtgctaaattgatagcaatggaactacttactgaattaaagactatgaacatttttaagctgtctgagttaggtagtaatagaaagttaggttgattacagaggagatctaccaaaaaaacaacaaaaaagtaaactgcaagtaatagaaaaactaacaactaggatttattacttacataaccaagaaatatgaaggaagatagggagatataatcaagaaattagactttttatttttttgctccaacttcttcagaatgttgacttttcatccaggtacttatttgcctcttggcagcaaatgtctcccagcatcacactgtcacacaaaattcaggaagacaggggtatatgaagccaggacagtgagagaggctctttacataccactctttaggaaggaaaatgtttaccagaaaccccccacaggagaattctcctcagggcttatttccaagtactgagtcttgtggtcatcattaactgttgggtaggctaggtaaacaagtatctggtcttttccacattcaatagtgaaattagacaagatttgatataggtgttgaattggaactgtattagatagcaaaagccacaacagtgctgtgtaacaaaccatcccagaacttaggtgtaaaaaacagtaagcatttatttcatgttcacagtttggattaattgaagcctgtctgatctatgttgggtttggctagccttgtctgtgggagggctcaggtctgttctatgtgtgatcattattgggttttttttttaatttactttttaaatgtttacaatttaataaatctcttcattgcagacatgtatggctgtttggtagtattcagaaacatcacagcaatggcagtttttccaattggtgtgtagtcctcaataattatatataaaattgctgtcaaatcagtaagactgcatttatgcatgcatcattttcaggattgttagtaacctgggcataatttccccaaataactttgcctccttgcatcacaaggcccaattcgctcatatttacttcaatgacagtacctttggtaataacatcgaaagttgtatacagtggggacaaggggctcttctttacaccaagtattcgtaggcaaaaggtggctttcatttcaggatgtgttacatgggctttcttgaaatgcaagcccattggcctgatgaatctttcatatttaggtggttttcttgtaaacccatctccaacaaagcagactttagtaaccatcctcttccatgccttcttctttctctttcctgttcgaataacttttaatacttctgtttctccctgggcacgtactttaggcagagggacttcccattttcccactttctcttttcgtttctgtttaatcctattggaaagtactttagctcgagattgttcctctctgtccagcagataggcaggtactgctccctgtggagtcttttcatcattcttttgtttgatgtttctcttttcatgcatcttgatagtcttttcatttgtattttctcagcatggcgctgtttatggtaaagcttagccttcagaccaatcattttctttcccttctttgaacattcatgagcctctcgactttccttctttccctttttctcatggtaatccaaatggtatccatagtgtttacagtgtaattcaatatattcgttctgtggcatggtgacagccacagagctgccaggagcagtccctggggtgcgaaaacgctctccatttttgggtctcagagacccacgagcccacgccgcacaggccgggacaggaaagcattattggttttgtttttactttttattttaaaacaaaatataaataaagaaaacagctgggtatggtggctcacacctgtaatcctagctacttgggaggctgaggcaggagaatcgcttgaaccccagaggtggaggttgcagtgagctcagatagcaacactgcactccagcctgggtgacagaacaagactctgtctcaaaaagaaaaagaaagagaagaaaaaagaaaaaaaaaaaagagagagagagagacagtgtctccctctgttgcccaggctggagtgcaggaacacaatcatagctcactataacctcaaactcataggctcatgtgatcctctcctcttggcctcccaagtaggtgggactacaggtgcacaccactatatccagttatttttatttttttatagggatggggtctccctatgctgctcaggctggtctcgaactctgagctcaaacaatcctcccacctcagccttccaaataattaagattacaggtgtgagccaccacacctggcctccgtcatctgctagtggttacccagtagtatagtttatataggaaagtcaggataacgcccaattcctttcctttatttatccattttttgaaataatgaattaattgttatccttcaaaggagaccaattttttattactatgaattcagaaatgtaaatatattcgatgtatttcagttcattccaattcttgtccttattgaagctaaaattgtctgatttgtggccactaggaatctcttcaagttgacgcctgagtcattttgaaatgaccctagtagttgatagagtccttgctatctggtattacaaaatgttctaggttaagtttgtactttttttggtttgttttttgtttttttgggtttttctttttttttttttttttgagacagagtctcactctgtcacccaagctggagtgtaatggcatgatctcagctcgctgcagcctctgcctcctgggttcaagcgattctcctgcctcaacctcctgggtagctgggactacaggtgcgcaccactacgcccagctaattttcatatttttagtagagacagggtttcaccatgttggcaaggtgggtctcgaactcctgacttaagtgatcctcccgccttggcctcccaaagtgctgggattacaagcgtgagccaccatgcccagcctagtttgtacttttttttgccacaggtttggaatcagtcatttatccaagaagctctggttttcttttagtgaaaagtgtaatttctttatcacaagctgggctccagggatgccctatgttacttggtagacttgtcaatatatgggggctattttagtaaacagaactagagaatatattttgaaggtaaaaaacatttcatgacttgacagcgatatttctaattcacactcaagtctacagtgctatgccttaacattttttttgtttgtgtttcttatagagagagtgtctcgctatgttgccctggctggtcttgaactcctgagctcaaataatcctctcgcctcagcctcccaaagtggtagaattacaggcatgagccaccatgcctgggcccttaacttcttttatattgtctctgcaactccttcttccacaccaagaatcctggttctggttcttagaacaggagaagtgatggaatattccataactgctcatttactttatcctacattatatacagaagagtttcaaaataacaatacttacaataaccattacaaattatgactactgacatttttttaaactttttcataccttattcccactcttgcctcattttttaaagttatactcgatctacattgtcaaggcacataatcatcacatattattctttccctttttactctcatttagtcttcatctacaagtacctatatatttaatacttaccatcagtccttataccagagactgtctagtcactttggttgtctaaagcttattctgtaacaggttcctcaggaagtacgcataggaacaatattccctgagtttttgcatgttcataacagcttctctgtgccctttatacttaaagagttatatgtctttccttgagagtcctaagtgtgctattccattttcttctgacaccaaaagtctaataataatcaaaaagtctaataaaaatcttccttcccttataacctcatgttgtttttgcctagatacttaaagattttttttcctttttctttaaaatccagaaattttactagaatatgtcttagtattggtcattcaggttcactattctcatatggaagtccccttccatcctcccttcttctttctttctttccttctttccttccttccttccttccttcctttccttcctctctctctctctctctctctctctctctctttctctttctttcttgataaaatctcactctgttgcccaggctggagtgcagtggcatgatcttggctcactgcaacctctgcctcccaggttcaagcaattctcctgcctcagcctcccaagtagctgagattacaggcatgcaccaccacactcagctaattttcatatctttaggagagatggggtttcaccatgttggccaggtgggctcaaactcttgacctcagaagattcacctgccttggcctcccaaagtgctaggattccaggcgtgagccaccgcgcccagcccatagtctcttttaatacgtaccttcaaatctattttatttaaaatttctttcttgaattataacacttaatatttgattttcttgctttggttttcttattcagacacttttgttatccacatgttggttctttgcctatattcattcaatagctgtattgttcctcaatctttctctctctcttaggttctttttgattttttaaatattttccttacttttaccttctgtttctcttaaggcattgtctcctatgtttatttactgggtcccttatagttgagtcttcatttattttatttttatatttttcttgagttctgtcacttcacttctgagttttcctaattctgattatgttgttctttcatgttttgtatcattttcttaatgtcttccagcttattttgaaatagagcattatagttgcatttttctttttaaagcaaatctttctgatctgctttcattacctgtagggatattattttgctctattctcattttccttacaataactttgcatgaggtttgaccgcaatactttattgttgcttatttttatatggatttaggtttcttgagcttttagattgaggctttgttcagaataactgttacaactttacaaaattacctattctgctgtgtttcatgtagtgcaaaaaaaaaaaaaaaagcagcttgctttataaggtttcctggagattctcatcacttttgtctaccttctttccttcatctctgtaatgcctattctgttcaattttaattctagtcccagtagtatctttagggaacaaacctgtcctaaaagagattcctacctggtgggttttgagagttcacaggggccggacttctccatacctttcagacctcactgaagggctccccactgctctcaccagcaaattggaataggcaaaaccgtttcagctactcttccaaaattggcctgctgagccttccagtgaatacctgtagtatattttaggggtttcctgttctcaggtttgttaaatgcctcattactctcctctgctttctcctgcccagatgaggatgccatgcaggtcttgtgactatcaattatttattcttgcctgcttctattttcagggttcaaagggataccttctcatttggtttggttggaaatgtctgcagatttttggttttgctatgagcttgttccggctatttttatgtgagaattaggaaagtttcaagagcaattctgccaccaccattccaacttcccaaacccacgttttcactctagagcccatgttgaaggggcaggactacataggggaagctctttttgtggtaaagggagaaatgcaacagaacaaacttgacaccagaggatgtttaaacctctgtgtgcagcacacatttgttaactttccactggccaaaaacagccacaaggccaaccaccacatcaatatgcaagaaaatagactcttcttctagtgggaggaactacaaaatcatgaaaacagcacggatataggcagcaacaaggaattgagaataatgattcagtactccacaccaaccaactgcatctgccccaaagccattttctaagtcttgctaaattattttccagaaatggtttgttaattagacttccacccatacataagagagtgcccttcattactgaacattttttaattgctaatttaaactgttaatttaataagtaaaaaatatcttagtgtcatttaatgtttaaattgcacctctttttttttgtgtgagctttaatacttttacattcacttattagttatttgtctttcttccttaatgacttgactgcttatgtcttttattcatttcattgtggcagttggtgtttttccttttaatttacaagacttcatttcatattaaagattttcatctttattgttcctatttcttacacatatttactccaatttgtcatttctcttttgtatcatttttctaattctgcataacaaatccccttaaaacttagtgttctaaacaacaacaaaaaagttactattgcttacaagtcaatggagcagcaggccatatctgataacttggatcaggcttggctgatctcagctgggctcattcacgtgcgtgggtcagctagtgccatggctggggaaaggttggtctaagatggtctcactcacacgctggctgttggcttgctgtccactggtgcaatggggattagtggaccctgttactaccataccttttgattgaatttgtgttgtttttggtatacatttaaaattttgatatattcaaatttgtcattttttcctatgtgatttctttatcgtttttatatttgtaaaattctttcccagtccccaaggtctgataaatatgtacttaagttttcttttacgatttcattcttttatatttcattcttttatctcttatacctctcttttatccatcagaaattgagggatgtgaagcataagagagaaaaagtggtatcttttcctcacccattgctaggttcatggctgacactctcataacaaaagatgcattaacaagagagaagcataatttttttttttttttttttttttgagatagggtctcactctgtcacccaggcttaagtgcagtgacgagatcatggctcactgaagcctccacctactgggctcaagcaatcttcccacctcagcctcccaagtagctgggactacaggtatgtgccaccgcatccagcaaatttttgtttctgtttttgagacaaggtgttgctctgttgcccaggctgaagtgcagtggtataatcttggctcactgcaacctccacctcctgggttcaagtgattttcctgcttcagcctcccaagtagctgggattataggcacaagccaccacgcccagctaccttttttgtatttttagtagagacagagtttcaacatgccggccaagctggtctcaaactcctgacctcaagtgatccacccaccttggcctctcaaagtgctgggattacagcacgtgagccaccacgcttggccaaatttttgtatttttttttttttttatagagacagagttttgccattttatccaggatggtcttgaactcctgggctcaagcgatcctcccatctcagcctcccaaagtgatgggattacaggcatgagccactatacacagccagcagaacatatttatttaatataaatgttatgtaacacaggagccttcagaaataaaaacctgaagaattaggaatatttgtgtatttgtatggacagtcgtgcagaagtatgattggaggacaatctaatggtaaaaaactggggagggccaggcacagtggctcacacctgtaatcccagcactctgggaggccgaggcgggtggattacctgaggtcaggtgttcaagaccagcctggtcaacatggtgaaaccccgtctctactaataatacaaaaattagccaggcatagtggtgcatgcctgtaatcccagctacttgggaggttgaggaaggagaattgcttgaacccaggaggcggagttcacccagttgcagtgagccgagatcgcgccattgcattccagcctgggcaacaaggagaaactccatccaaaataacccgctcccccgctccccacaaaaaaactggggagaatttagcatgatccatttgttcagattcttcttggcaccccactgtgacatttcttccctctgggtatagggcaagacacctgccacatgaaggtcttcggggagaagggagggagaaagtcaaagagtgacttttctcggttttatggcctgcttcacggaaaaagggttgaggggagttctagtttctgtggccttgcttcaggagagagggggcgggggaaggtcagagagaccttgctactgtgatttttttcaatttccttcagcttaaaaaatactcagtatgccaaggtgtcatattttggggtattgtgttttgagcctcatcagaaacgggaatttaaatggctgtttttccacatgtagttaaccaattattcaagcactgtttatggaatactttgccttttctcatgaattcgagatatcatcttcatcacagagtgaattatgattcatccttgggtctgttctggactcctgcctttgtcccatggatgtgtctatctatgggttcttgtactgcctaaatctatagtcaaggagtggcaggaactcagggttgaggtgagattatcaccattatgactacaatttaagttcgtttgtatagcccttctgaagcccagagctcaagctgagtgctgaaagttcaggagggaggccaggcgaggtggctcacgcctataatcccagaagtttgggaggccgaggcgggcagatcacctgagctaagagtcccagactagcctgggcaacactacgaaaccccatctccaccaaaaatacaaaaacatggctgggcgtggtggcatgcacctgtggtcccagctactcaggaggctgaggtgggaggatcacttgagcctgggaggcagaggttgcagtgagctgagatcacaccactgcactcctgcctgggtgacagagtgagacctcatctcaaaaaaaaggaaggaaggaaggaaggaaggaaggaaggcaggcaggcaggcaggcagacatggtcgaggtagaggtggagagtgggggtgaggagaggtgtcagaggttgggagtcggtattgatccagacgtctcagggggcagaagtctctgagcagaggaagggcacttaagatgaatattctaacccaatacttgtgtgggagcagaagaacgaactacaattacaaatttgatgaaaagagaaactcttggctttccccaccattatctgaggtacccaagacacttctgcaagactgaagtcccaaagaaccatgtgatcatcccacacacataggaactaactgtgcagtgtaaaaaggcaggcttgtagtctttcacccgtggcagaacatatatttattgattcacctttgagtaacaggtttagtaaagattgtcaattctctgggaagataaacatgaagtaatttttttaccccaataaaatcaatcaattatgctctgtggaacctctctttcccactgggtagcaggctccattagctacatatatcccagtctgattctacaacttttcattttagttatcacaacagtttctctccagttattaagattcaactctgttcaatgtaaaatttcattcttatattggattcaaagctttcctcctcgcctctagtgcagactagactcatggctttaaaagatttgggagtggcggggtggagacatggtctacttctctcccacccgattcttgcctgtgctttcccctgtagctttgggggaaaaggaagaaaagagaaagttgaatatgttcttttgtgattgcctatggcagaattgttggtctccatggcttagcaagtggtccccaagacttgccctggcactaaatgcccaagcagctcccaggggtcccttgggacatgtggccttcctcttccagctgaccccagctgatggcctcgtgcaacatctctccaatgcctacttctctttgcccaacacgtgaccatcctctgccaagtccccagctccaaaacctgagcctgtgggcagactgatacattctttgtaccttttagcaaccaggagcttgagagaataattctactcatacctcacatcatcccattacatttccattttatagaaacttccttctgaccccagtgccagcttcctatagatctcagagctgtcgatggcccctgactccacatactagtgtgggctcttgatgatccaaatgtccccaacatagaagtcatattatatgtactccggccagttgagttatgaagcatttgtctcaccctaagatcttaagattcaatcgagatatgaagtcacctctctaaggccacccaccaaatcagcaccatgttcaaattagaatgtaaagtgtcagaatctatgagcaggtttttttccattgggctaggattgcttaggcttctaggaaaacaggagctaagtccctgggctttggggtcagatggctctgtctgaggcctggttgaaccacttcctagctgggtaaatgttgttgttgctgttgttgttgtgtgagagagagagtctcactctgttgcccaggctggagtgtagtggctcgatctcagctcactgcaaccactgcctcgcaggttcaagcgattctcctgcctcagcctcccgaatagctgggattataggtatgcaccaccatacccagctaatttttgtatttttagtagagacagggtttcaccatgttgcctaggctgatctcgaactcctggcctcaagtgatctgcctgcctcagcctctcaaagtgctgggattacaggtgtgagccactatgcccagctcacctagctgggtaattttgaacaactttcttagcccctcatagtttcagtttcctcaactgtaaaatatggataataataatagcatctactttacagaatcgttttattgcctagatgagattctacaagggaagccccagtgtctggtgcctaaggagttctcatgaatggtagttattgttctaaaaaagagagcatcctcaggctactgataattcaaatctgtccaaatgtcgctgcctcgcagatggttgaattgtgtgtcgttggggttaattcccaagcaacgtacccagtgtgctctgttgcctccacctctgtggggactgtcccactcaggggctgggacggcatgggggcagatgtgaggagaagcttctacagctactgtgtgtgcataatcacattaatttgcaaaaaattaaaaataaaatagaaaataaattggctgggtgcagtggctcacacctataatcccaatgcttgggaggctggggccagaaagttgcttgatccaaggagttcaagaccagcctgggaaacatagtgagaccctgtctctaccaaaaaaaaaaaaaaaaagaaaaaaaattagccaagtgtggtggtgtgcacctgtagtcctcgttactggggaggctgaggtgggagcctgcagtgagttatgatcgtgccactgcactcctgcctgggcaacagagcaagaccctgtctcaaaaataataataataaggctgagcacagtggctcacacctgtaatctcagcactttgggaggccaaggggggtggatcacctgaggtcaggagttggagacaagcctggccaacatgataaaaccctgtctctactaaaaatacaaaaatgagcaaggtgaggtggtgtgctcctgtagtcccagctactggggaggctgaggcaggagaatcgtttgaacccaggaggcagaggttgcagtgagccgagtttgcgccactgcactccacccagcctgggcaacagagtgagactccctctcaaaaaaataaataaataaggccaggtgcagtggctcacgcctgtaatcccagcactttgggaggccgaggcaggtggatcacaaggtcaggagatcgagaccatcctggctaacacggtgaaacccggttctactaaaaatacaaaaaattagctgggcgtggtggcaggcgcctgtagtcccagctactcaggaggctgaggcaggagaatggcgtgaacccgggaggcgaagcttgcagtgagtcaagatcgtgccactgcactccagcctgggcgacagagcgagactccacctcaaaaaaataaataaataaataaataaataaataagaataataaagaaaaaaagaaaaaacaagtgaacttttttttaatgttttccagctgcagaggccatgtactagaaaactcttgaaatattattcagtgtttctcaatacttaagctgactgccttctgacaaattgccaagtagtggtcagaatttaattcacaccaaaagagaacacaaagattatgagacaattgaccctataaaaatgcattcgtggcatgctctttagtcactttgcatctgctctcaacccaccctccagggctcttatgtcacacttatttccagataaatggcccaattagaaacctattggctaaggttgtactaaaggcaatgaccctgcacaccagaatctcgtccttcttaacatcacccttaagccaaagcacagtggcgtgtgcattctcattcctggacaaactctgccccctggcgctgactcacacacttgcgcaccggcgaggagggtctcctttgttaggtttcctcatgggacagggatagaagagcctgtcacccccacctgccgtctccccaaacccctaattgccatcagtctgctccacacagataatccaccaaaaggctccgagtttgtttctgctccgtgtatttgaaatgagtctaccacatcaatctcattctgtgttaaaaagtgtttctcagcagatgagtagggataaaatctccatgggagaaagtgaaggagatgcctgatctgtccagggcttcccgggtcagtggcgcttcggccagaagccaggcagcaggccttgggcaggtggctggaccccttctgtgccacggtatctttgtctgtgagatgaggggggcagtccccaccatactgtgtttacacaatagagggagaatttaggtggtgactgtgctgtagtaaaaagaacagagggtgtggaaataggggatttgggtctaaactctggctccaggccagatgcagtggctcacactataatcccagcactttgggaggctgaggcaggaggatcgcttgagcccaggagtttgagaccagcctggacaacacagtgagacctcatctctacaaaaaatacaaaattaggtgggcgtggtggtgcctgcctgtagtcccagcgactcaggaggctgaggtgggaggatcacttgagcctgggaggcagaagttgtggtgagccatgatcgtgccactgccctccagcctgggtgacagactccctctcaaaataaatacataagtaagtacaataaataaattaattaattaattaatttcagctctagctgtggaaccttggactagaaattcactgttctcactgttctctagaaattcaccattcccttgagtttcctatcttataaaatgggatagtgacttgccctgctagtcactttctcgagaagagacacctccaactgcagcgggtgtggcgcagcctttccctccaggctccaggagcccctgcctcccaatcggaaggagagttgtttcagatgaatattcctaggttttagcccaggaggttgagtcagaatcctgcctcagaggcgtggcaggagaaacaaaataatgaacccccaaaggtgtccatgtcccggttcccagaacctgcaaatatgtgaccttgcatgggaaaagggcctaacagatgcgactaaattaagaatcttaagatggggggattatcctcgattaccccggtgggcccactggatcatgggggtcctaacaaagggaagagggaggcaggagaggcggagatgtgatgaggagaagggattggagggaaacaccacgcactgaggatgaaggtggccttgaacgctggaaaaggcgaggaagagatcctcccccagagcctccaggaggaactcagagctgccaacacctcactcccagccctgcaagacccactttaggacttctgacctctaaagctgtagatgattaatccgtgttgttttaagccactaagtttgtaattatttgtttcagcagctctgggaagccaatatggcgccatggaggggctcctagatctgcatttttgagtgactcctggtagaattgttaggcatgctaaattttgagggctagaggtgtagtaggaagagactgaggaacaggaggtctgtatttctagccctggcgtcatgagctatgtgacttcggcaaagtcactgcctcattcactgggcctcagattcactgtctgtaagctgaggcagttggctacagggggcagaggggaagagatctctggctgcagtattctgagaagctgagagaaaacagtgaagctctttgaaaacagtgaagtctggccagtgtagatcttaggactgggatttcctagaagaaagagatactggtaattcttttaacagctcatttttatacctctcttcctgtgtgccaggtcttggtctaaacccttcccttccatgaactcctgtctgtgaggtcatcttggcacagcaatcagtcttctatgcgatgaataattaactgctctgaggagatgatttcaaatcgggagtcagatcaataagctactaaggggggatgggcgggtgggcaccatcttcagctaatgaagggggcgattccctgtctccgctatgaaaagaaaaatgtcacagacattacatgccgcctgaggggtatggatagaagggggaaggggctgcggttgccaggcaaccggctcatcactaatcatgcgcgtaaaagccttgggcctctgttatgagcacagctagtgggccaccctccttctctccgccccctgcttgacagctggccttgggttctggttccagacacttagaccctgaaacaggcccaggtccccctcagtatccccgggtcgattctgttgctagaaagcaaactgggagagcaaagactctttgtgtccactccagacgacaaaggtctggcacccatattccaggacactctttcctacaccatggccttttgaatgagctgtcaccccagaggcttacttagatttgaggaaaatcccttcctgacccctccattcaagggaggctcttgctgtttgccgtgtggatactgagcaaacacgtgggtccccaggctggctcttgatgtgctctgtaaacactcctctctggatacagccaactgtccaattatgcaggagtcaacccgcttcccctggggatttgttgtcttaaagaacgaggacccactgtgactagaaagttgacatagcacatgtcacacagagaaagtgcacccccggtggaagccggggttccctgggggcccagccgtctttccaaacagaagggcagaaggctgtttgatctgtgaccacttctggaacatataggctcaggaacagccaatattagaagagatgtttgcatctgtttccttccaagacacacaggctctctaagagaaaggaggatggcttttgtgctacggggacaagcgctatgtttgggacgtggtactagaattgtcaaagggctgccttgtcccagaaagttatttcagagagaagtcattacacccattggctaaaaagagacaggcatcactgagaatgttggatgtcccaacccatttctcttctacagttcacaccacccccagcaggcccaggcagcctgcactgtgcccgagaacagttgatgcagggacacattccagcgccggcctcagtccctttccctctccctgcttcagccgcactggcttcctcactcttcctcaatcatacctatgtcagctctttgcacttgctgtgtcctggatacttgcacccctgatatctggatgacacgagactttccctggccaccaccccatgtaaataatagatacgccaaccccatttaccctttccatgtgccatttttaactttcttcaagcactgcacctctttttctttctgtgtagcggactgtttgtccatctatcttacttgtttattgcctgtttcattctctagggtgtaagttccaggagggcaggacacttgtctgctctattaactgctgcacccctggcacctgccactgtgctcggcacaaggccagccctcaactagcatttgctgagttgattaggattcctgtgatccactctgtaccaggaagacactgggctctttcttacatcctcacacccagagcctctctctggaggcagtggatgtcatgagtttccgatagatccttacagatacttcatgcttattcagaaagatacacacacagctacattcttcctatcttttttttttttttttttttttttgaggcagagtcttgctctgtcacccagcctggagggcagtgcaacaatctcagctcactgcagcctctgcctcctgggttaaagtgattctcctgtctcagcctcccaagcagctgggattataggcacccgccaccacacctggctaatttttgtatttttagtacacaggggattttgccatgttggccaggctggtcttgaactcctgacctcaggtgatctgcctgcctcggcctcccaaagtgctgggattacaggcatgagccaccgtgcccagccccacctgttctttttaaagcgtagtgtactttatatatcttctatatattgctgttttcacttgtatatcttgaagattatttcatgtccatttaaacaaagctcccccattcttctctatggctgagtaatattccaatatatggatatctagtaatttatttacttggccactctagatggacatgtaggctatctcccatcttttgttattacagagtgttggaaacaatcttgtatatacatgtcatgtcattcatatgtgaccatacccataaaatacattctaagaagttaaactgctgcatcaaagggtatatgcacttataatatgaatagaaattgacaaattgctctccacagaaattgtatctctaccactaccagtgatttttaaattttttatttttgaggcagggtctcgctctgtcacccaggctggagtgcagcagtgtgattatagctcactgcagcctcaaactcctgggctcaagggatcctcctacctcaacctcccgagtagctgggactacagctgtgcaccccaatgcctggctaattatttttatttttttattttttattttttgtagagagggggtttcactatgttgcccagggtggtcttgaactcctaggctcaggcaatcctcctgcctcagcctctcaaagcttttggattacaggcttgagccaccgtgccaagccccaccaacaatttatgagacactttgtttccatacatccttatcaaactttcttttatctttgccagttgaaaagtgatattgcggccagacgtggtggctcatgcctgtaatcccagcactttgggaggccgaggtgggcggatcacctgaggtcagcagttcgagaccagcttgggcaacatggtgaaactccatctctactaaaaatacaaaaaatgagccaggtgtggtgacaggcacctgtaatcccaggtacttgagggggctgaggcaggagaattacttgaacccaggaggcagaggttgtagtgaactgagattgtgccactgtactccagcctgggtgacacagcaagactttgtctcaaaaaaaaaaaaaaaaagtgatattgcagagtaattttatttttcattttcttactcaaagatttaatatttttacctatatctaggaggcatttctatttcctttcttatgaactacctaattttctattagattttgggtttaaaaaatcaatttataggagtgctgatacattaggaaaattattttttggctatgagttacacatgttttccctatgtgtcatttgtccttgcataaaaatcattagatgttttctgcctcatagtttttttagtctaatgtattcatctgtgtatgtatgtatgcatgtggaactgccacttttaaatttgctttttaaatactttatcatatgtcattatccttttagctgtattattggaaagtgcatttttttattagttacatttaaattggtgcttcctggatggggtttgagtatacactctcaactcttgatgaattgaggggctaccttattccttgaggactcttgtgagatctgggaggcacccaacctgtgattaccctcatccatttgatgctggctcttaaaaatctcagttacagagagtgacatgtttttgactctttttcaggattctggaacataccacctgttttagtctttaatcatctctccactcattacaggtgcagaaggttgaagcagctggaaacatctgttcccagagaaaaggagcccctctctcctgtcactctccatgacaggaacccatcatgcagtatcaacctcaacgagcctgtcctcccacactcagcttttcacatcctccatcctcagtgtccccacctgtctccctctctacctgcttgccatgattcctcggctctcagcccctgttctagggaggctggccacctacatctcttcactgtagcctgcgtatgggagctattccagttagtggggcctgaataatggggtgctcttttaaagacaatgaatgcaaaattgcaggccaggcccagtggcgcatgcttgtaatctcagcacttcgggaggcctaggtgggaggatcccttgaatcaggagttggaaaacagcctgggcaacatagcaagaccatctctacaaaataaataaatacataaagcaggcatggtggtgcacacctagctacttgggaggctgaggtgggagcatgtcctagctacttgggaggctgaggtgggagggtcatttgagcccaggagcttgaggctgcagtgagctataattgtaccactacatgtagcctgtgtgacacagtgagacctcaactcttaaaaaaaaattatgaatacaaaattaaatatcaaaatgaatagaattagaaaatacattataacaggccgggcgtggtggctcatgcctgtaatcccagcactttgggagaccgaggcgggtggatcacgaggtcaggagatcgagaccatcctggctaacacagtgaaaccccatctctactaaaaatacaaaaaaattaaccgagcatggtggggggcacctgtagtcccaactactcgggaggctgaagcaggagaatggcgtgaacccgggaggcggagcttgcagtgagccgagattgcaccactgcactccagcctgggcgacagagcaagactctgtctcaaaaaaaaaaaaaaaattaaaacaaatcacaaagcttaaaagcccgcaaataccagaaaaatacaaaatatagaaaaataatatgagtttgtgttaatgaattatctgacacacttctacagacttttttcattcctttttggatgcatgctctttgactgtctcttcatgtgacaagaagtttgaaataccattatccataaagggaatagaaagagatttcaggctgttttctagcatggttgatagtttagaaaagtttattttagcttcacaatctgttattggtaatgtcttgctaagacatagtccaatacattaggatataggaatcacgcaattttacacaaaaacatactcactatttgctttaattctgtgggtttattatcaggttccacagaaatcctaataaatttaaatttgtacaatttccatcaaaaaatgaaaaaaaaatgtataatgtgtctagatagctttatctagtatattccagacaggaaagaatttcaattctgaccagaaataaagaatccaactgtccattttacaagtttgatgattgtaagaatttttcaacagactggcctttggccccgttcatttccaacttgtttctcatccattccccatgtgtttctggtggccagcactgtggggcacattcatactccaatatgacctcttgccctgcaccttcttgttatgaggctggatgggtcagtgcagaaagagcagagcttttctctctttttttgagacggagtttcactccgtcgcccaggctggagtgcagtggcacaatctcatttcactacaacctccacctcctgggttcaagcaattctcctgcctcagcctcccgagtacctgggattacaggtgcctgtcaccacacccggctcattttttgtatttttagtagagatggggtttcaccatgttggccaggctggtctcgaactcctgacctcaggtaatccacctgtcttggcctcccaaagcactgggattacaggcgtgagccactgcgtccagccgagaaagagcttttctaaaaaccatatctataccccaccaactagcaaacttaacaaaatgactataaatatatcctatttaacacaaattaaacatgtcctcgacttgatttcttcatagctgtttttttaaatgcacatgttcacttcagggctaggtatggggaagatttaatagagtcccctctattgaaatggaaggaggctgatgtggtcttaatattttgttttattttattgtattttatatttggggaatggggtatcactatgttgcccaggctgttctcaaactcctgggctcaagcattcctcccacctcagcctcctgagtagctgggaccacaggtacacaccactgtacctggctagttgtggtcctaataattgcaactaatatatcttctaaaaattctgcaaagtgtatgaacacgactcccatctagggccttagagggactcacataaggtagtagccctgaagctcaagcttcattaggttcaagataactcatctctgcttctgctgtctccgcactcccgtactgtctaggcttcattcaaaatagctgctgtatatgtcaagatgattttgatctgcagggacagaaacccaactgaaccaaaacaactggaggatatactgacccctaaactgctggctttgggaacaattggaaccgatgataaaaatgccaccagaactatttccttcttgctacacctcagtttccatctccacaaatgcagatgaaaacttcaaccttacaggaggctggacctctgccagtccctgactcaaatcgcactgctttgccactccagggaaacccctccaagggccacattggccagtgtgggccatgtgaacactctcatggggggctctgagggacagcgcccactaggtcttcaaggttggagtggggaagaaggaagatgtgctgtggtcaaaagaacaatcccttccctgtccctgcccaagatgtccatgtcctaatccctgggattttgcaaacttgattaagaatcttgaggctgggcgtgttggctcatgcttgtaatcccagcactttggaaggctgaggcaggcagatcacctgaggttgggagcttgagaccaacctgaccaatgtggagaaactccatctcttctaaaaatataaaattagccaggcatggtgggtaattttgtgcctacaggctaattacacacctgtaatcccagctactcagaaagctgaggcaggagaatcacttgaacccaggaagtggaggttacagtgagccaaaatcacgccattgtactccagcctgggtaacaagagggaaactccgtctcaaaaaaaaaaaaaaaatcttgaaatgggcagatgatcctggattatctgggtgggcttaatataatcacaaggatcctgacaaaaaagaggcaggaggccaggcgtggtgatgtgcacctatagtcccagagctttgggaggccaaggcaagaggatcgctggagcccagcagttccaggctgcagtaggttataatcacaccactgtactccagcctggatgacagggtgagaccctgtctctgttcaaaaaacaaaaagacagaagaaagtcagagacagaggagacataaagatgaatgtgaaggtcagatcatgtggggccatgagccaaggaacatgggcagcctctataaactggaaaaggcaaagcgctagatccctcctgcagcctccagaaggattgtagctctgccagtgcttcattttagaacttccagaactggaaaaaaatgaatttgtgttgttaaaaccaatacatttgtggcaatttgttataatagcaacaagaaatggatacaggtgctaagaagatagcaaaatgcatgcccactgtaccttctctctcctccttcctggtcctatctatctgttatgggctgaattgtgtccttccaaaattcacatgttgaagtcctaacctccagtacttgggaatatgatactgtttggagatagagtctttaaagaggtgattaaggtaaaatgaggtcatagaggtgagccctaattcaatatgactggtatccttgtaagaacaggagattaggatgcagacaggtacaggcgaagaccatgtgaggccacagcaagaaggtggcccccaacaagccaaggagagagccctccaaagaaatcaacctgccgacactgatctcaaacttctaacctgcagaattgtgagaaaatcaatttctgttgtttaagccagctagtctgtggtgttccttatggcaaccctagcaaactaatacatgatccttcaaggcagaggtgaaaatctgcctcctttctcaaactgcctttgatcagcctgctcccagagcagccattgtctcagaatacctagtggccaagagtttaacccaaggatcacaaactcaaatgcctataggggccaggaagaactaacatgagtgaagtgcttgactataagaaactgtatttgccaattgatatggtttggatccgtgtccctacccaaacctcatgttcaattgtaatccccagagttggaggtggggcctggtgggaggtgattggattataggggtggatccttcacgaagggtttagtaccaacccttgggtgctgttctcgtgatagagttctcatgagaattggttattctcaacaggttatttactggttgtgtaaccagttacatgagaactggctagcacttacccacctctctctcttgctccttctcccaccatgagatgcctcactccgcccccttcatcttctgccatgattgtaagttccctgaggcctcccaggagctgatgccgtcatgcttcctgtacagcctgcagaaccatgatccagttaaacctctttttaaaataaaaataaattacccagtctcaggtatttctttacagcagtgtgagaatggactaatctaccaattaaacataatcagtatacactatcacaaaaatgacattcactccctatctccctgtctgcttttagttttgccacattttatcaaggatgaatacaaggaaaatcctctcttcctgaccgttcagtggggaaaagtggcagtgctggggtgagaggcacctgcttttattttttgtgttaaggaacctacaggagaggtgcgagctgagctggaaattgcaggccctgccctgtgccaaggggcagttgctacttagctctagccaactgttaccagggacaaggacaggccagaccagccagagttttccaatttttcaaaaaaactgaaaatatacatttttaaagtgaaatttgattttaagacattgataactaattttttaaaaattaactgtgttggccacctcacatccattacaacggctactagtaaaaaacaaaaccaaacaaaaacaaaatagaaaataagtgttggtgaggatgtagagaaattggagcgctgttggtgggaatggaaaacggtgcagctgctgtagaaaacagtatggcagttcctcaaacatttaaaaatagaattagcatatgatccagcaattccacttctgggtatatactcaaaagaactgaaagcagagtcttgaagatatatttgtacacccatattcatagcagcattattcatgagagctaaaatgcggatgcaacccaagtgtccattgacaaatgaatagataagcaaaatgtgacacacatatatatatatcacatgatggaatattatttagccttacgaggagggaaatgctgatatatgcaacacagatgaatcctcaggacattctgctaaatgaaataagtcagtaatagaaggataaattactgttcgattccattcgtatgagctgcaatacttagtcaaaaccacagagacagtgaaatggtggttgccaggaagtgggtggggggcaagaatggggaattagtgattaatgggtacaaagtttcagattcgcaagatgaaaaaagttctaggctgggtgcagtggctcacgcctgtaatcccagcactttgggaggccgaggtgggtagatcacctgaggtcaggagtttgagaccagcctggccaacatggtgaaacctcatgtccactaaaaatacaaaaaattatctgggcacagtggcaggtgcctgtagtcccagctacttgggaggctgagacaggagaatcgcttgaacctgggaggcggaggttgcagtgagccgagatcgcgccactgcactccagcctgggtgacagagtgagactccatcttaaaaaaaaaaaaaaattatgaaaaaagttctggaggtagacggtggggatggctgcacaccaatatgaatgtacttagtgccactgaatttcacacttaaaaatggttgaaatagtaaatttaatgttatatgtattttaccagaattttaaaaattggaaaatgacaactgagctggctaagattgttattttgaaacaagacacattttttaaggcctagcttcagctcatagtccaccagtttgcaacctctgttttaacacttccttgttttctagtcatttcatgtgttcatgtcttacccaactagaaggtaaaattccctggaagtaggaactgtgtcttaaccttctttggtatctttcaaagtgggtacttggagctttgcagtgggcaaatcacagttgccctgctgaatactggatgatacccacacactcataactaattattagacactgccatgctgtacacagagctgtggccacatgggattaattgtaacatttcaagaataagaagagagcttttgaagtacaaaaagaaattcattctgactagcaggtggggatggtgtgtcaggagagacgagggtgaagagggcagggagacgggaaaggggccttataggccacaagaaggggaaatgggaaattgccacaggctgtaagcagagggtgacgagattggattggattttgagataaatcataaaaactagagcctggaacgcccctgctaagagattcaggaaaatggtaaatgccgcttggcaacagctctccagggccacatgtgaacacaaacacacttgtttgtgttcagcgaatgaggaggttggggacatagggaagaactaggggaactcggggggcttcaacaagaggagtgaggcaaatgcacacccccttcagagcaggggctgtgtgcgcacgtgtgtatgttgcgtgtgtgcagttagagtgggggtgattcttaggtgggtctaggcaagctgacaccctaagttgcagaccatgggcagcagatggaggcgacgctaaagtccagccatcagaccctccgtgctcccctggaacacctgtaggaaaccctgagaactccaactttaaagggatccaagacactgtagccagcacagtaacccgtggcaacccctagaggttgctataacctcagcaatggggagcgttataccgaaggaacctgccggttccccagacacaaaaatggctgaaccttggtgatcacagcacatgaccaggaaccgccaatacactcatggaactgtcccgctgacaatgtctagagggaaaatgccctgtcctctaacacccttctctgagggggaaaaaagccacattagaagaagtgatatgaccaaaagacaagctttctccaaaggccaatggccttggaatgtttattaagtgttttgtctgtttgctcaagtgctatccttcaacaccgggactagaaacaatttcttcagaaataactaaccagccacaattagtaaaacttcataaagcctggagaatactgtcatcagaagagctacatttggggcagtctggggaagggtgaagtgtgaggatggggaccattatctccagaggtctagtgattaagaactgggtgactctggacagctggtcccagggactttgcacttgtggtggaggctgaattcgtcattcccaatccggatgctatgcaatcatcgtcaagtactccaatccatctgcatgtctgaatatggatggggatgctctgcactgtccccatcggccgctgggtcctccactctctctctgctctggatctctggatctcatctttctacttcctctgcaggtggcatcatggggactgtctggtgactcccctaagcaaccagcatcagacactagaaacttccagtcaagtctcctggtccctgattccaaccagacgaccacatcttcaccccaggatggactttagacctcagcagcagagacagccatacttcctgtgtgacactggggcaaccacgtttctcacaggcccccaggtggggctgagatgagagcaggccatctgaaggtgcacaaaataggcaggatgggatggaggccaagaacatcccagtgaaatgggtgctcccaatttgcatttgggaaagaagggctcccacctttcccaagccctgcatttcacatattttgcccctattctactctacactcaacccccaactctctgagttccactccacatgaccccgcccccatcttaacttgctgtgtcctcaccctactccacagatccctgcctcccgtgcctttgctccaggtgaggccatacacttggcggaggcctatttgctgtggccattttgacccagggaatgtctgatgtgaccatttgaaaacactctccacaaaattgctcgaaacactgttttatattaaaaattcaaagcaggcctaagtgaaaaagacaaacaagggacaagggatgtgggcctgatgactactgaatgtactacttagtaacaataattaaaaactaaatatttaatagtttggctttccccccagctacctaaaaaaaagcaaacaaacaaaaaaactgcctctcagactaaaatagctgcttcaagagcgccacatcaacatgtgataagtttgctcacattgttaccttcatcttcctactccctgtgtcaattacaaatggcttatgatgcaactaatggccattatcaaaggcataaggaaagacatttaagacttcacatcacaagaagtctccagacagatgattcccagcattgactcaactgctcaacggggctcacagagacccagctcctgtccggctttcttctgccatccttagctgcttggcttttagttctcattctcatcacttcatggttgcaagatggctgccacggttccacgcatcacatcttcacacaaggcaggaaaaaagggaaaggggcagtagttaaaaggctgttagagtgctaggtttcctgtttaagatagcgtcccccatggcagcgcaggcctggaagcttctgcaagccctagcgctgctgccccgcttcctggtggccaggtcccgggcagttcaattaacctccagaagatggctgagcctgcaggaatgccagagcaagaaactgatgtctgataacagagtgacagttcaaagattctttgtagcagacactgcgaatgaagctcttgaggccgctaagagactaaatgcaaaagaaattgttttaaaagcccagatcttagctggaggaagaggaaaaggtgtcttcaatagtggtttgaaaagaggtgttcatttaacaaaagaccctaatgttgtgggacagctggctaaacagatgattgggtacaatctagcgacaaaacaaactccaaaagaaggtgtgaaagttaacaaggtgatggttgctgaagccttggacatttccagagaaacctacctggcaattctgatggaccagtcctgcaatggccccatgctggtgggcagcccccaggagggcatcgacattgaagaggtggctgcttcaaacccagagctcatttttaaggagcaaattgacatttttgaaggaataaaggacagccaagctcagcggatggcagaaaatctaggcttcgttgggcctttgaaaagccaggctgcagatcaaattacgaagctgtataatctcttcctgaaaattgatgctactcaggtggaagtgaatccctttggtgaaactccagaaggacaagttgtctgttttgatgccaagataaactttgatgacaatgcagaattccaacaaaaagacatatttgctatggacgacaaatcagagaatgagcccattgaaaatgaagctgccaaatatgatctaaaatacataggactagatgggaacattgcctgctttgtgaatggtgctgggctcgccatggctacttgtgatatcattttccttaatggtaggaagccagccagcttcttggatcttggaggtggtgtaaaggaagctcaagtatatcaagcattcacattgcccacagctgatcctaaggttgaagccatccttgtcaatatttttggtggtatcgtcaactgtgccatcattgccaatgggatcaccaaagcctgccaggagctagaactcaaggtgccccttgtggtttggcttgaaggaaccaacgtccaagaggcccaggaaatactcaacagcagactccccattacttcagccgttgacctggaggatgcagccaagaaggctgtggccagtgtggccaagaagtgatgtctttgtcctgatccgatggagaaacaaagccatttttccataaaaagggatggttcatcattgtgaaagaaatggttatctcgttggggaggaaaagggggggtgaaggcaagaatcactgaaaaatcttaaatctgtgttttctggaataagctatctagacagcctaaatctgattttagtctttataaaaataatatctcgtattctcatacttttctgtcactgtaagcctgcccagtaggcagtgttttgcagactttggggagcggtctatgtgaccaaatattgtgtgtatagacagaatttgaaatcgggtcctgcttcatttacaagaattttggtgggcatctaatcctacataatgaaaaagaagaacagaccatttaaaaactcagacaagattatatttaatatattaattactaaaaaggcacaagattacactgaacattagctactaaaaaggcactgccaagacattcaaacaaatagctattacacactgcagcagattttacaggtttctaattccaacatatgtttgaaaaatccatgagtgttccaaaatatacttaataatggaaggtctgcattaatataccatccatgtgtttttaccatttggtttaatattgaatatactgtttacctcacactaaaaataaaaccagaaaccttatttgtgactttggagtggaagcttccatttttgggtcaaaaatgaatcctgattcttatggaaatctctgttattaagtcatttcaagatgagacaacactgaagatcaaattgtgttgggtatcagtatcttctctcctcgtttatctcttacacctcatcctcccaggatctaccagttgatggtagaaagatgggaaccttatctgaatgttttttttttccatgatgtccaattttgttgtgggaaaggatttggataaagtttttgtttaaattttggtagatttttatctatacaagtttaaataaaattatgttttgtaagttgtaaaagaaaaaaaaaaggctgttagaactgtcctgggaagaactggaccagaactagtgcagctgcggttgagatggagagatgatgattttgagatgtatttagaaggtagaattgacatgggttgatggtggtaatgacaaggaagatggttctgaggtttctagcttgggtggtggtggtgccttttaatggaaataaagagtacagaaagagcagacttggtgtaagggaaaaaacaatgaccttggtgttttcgtttgaggttctctaggaacatcctgaaccaatattatataagaaatttaaaatatagatccactgcttataaaagaggtagatgctactagctatgtaactgtagtagtatttgccacacaggcggcagctgggtccacagagggtgtgtaggaaggacggggagccacagaaccctgaagagtggtggagaggtacacggagacctggagagaaaacaccctaagggattaagcttcaaagaacaggaagaggtctccagtgttgaccaatctagaaaccaagtaaggccaggctgtgaaatgcatgcactggttttggcaattaggtggtcgatgacctcattggatgcaattcttgggagggaggtactgattctagtttacagtggtttgaggaaacttaggcagtaaggaagtggagacgttcaggaaatgtgctggagggatggacatgtgaccaagttctggctcaagagtcataaagttggtctttcgggggcacttctagaagagattttcctctctgtaaaagggaaggagagcctgtctagcatgtttttctgtgtgaggatgtgatgcctggatccagggcagccatcttgtggccaggaggggagacattactgatagacggaggccagtagagcaagagcaagaggacggctgagcatggtccttggccttcactgagctaataaatcaaccctgcagccacctgcctcccaacttctttttaggtgagaaaaataaaccctcggccgggtgcggtggctcatgcctataatcccagcactgtgggaggccgaggtgggtggattacctgaggtcaggagttcgagaccagcctggccaacatggtgaaaccccgtctctactgaaaatacaaaaattagccgggtgtggtggtgggcacctgtaatcccagctactcgggagcctgaggcaggagaattgcttgaacccgggaggtggaggttgcagtgatctgagatcgtgccactgcactccagcctgggcgacaagagtgaaactccgtctcaaaaaataaaaataaaaataaacctctgttgcttcagccactttagctctgcttgtaactggaatgtcaaggacacagctcattaggtgtgatgaaaatgaactctactgttgctcccattggccctggaaactcttcagtggggtgatattcccctactggatgaaaactctggcaggtccatgacttttgtcctcaccctcaggtaacagataacccaaagtcactttccctagccaacagatttgcagttgtggaatcagaatagtacaagatgaataaaagcctgaatctgattttgcatcgtgtctccgttccatcaccaggcctgtctcaggcccacagcctgaagtgtaaagaggccatggctggtgtttctttctttttctgcctcatgcttcttctccttccacccaacgctcacccctacgaggctgctagggtgtgcttgatcccttagggccagggcgtgggaaagacaaccggtagagtctttcctaagtgggtactgctaaaagccagctggggtctctgttgtgacccaactgatttttttctcacggatacttctgcaggctcttaggagattgctactccgggattccctgcaggtctcttgaggggatgcatctgtcctggggtctcctccctcagcctcacaggggtgctgtgcccacttcccactttcttctgaggggatcccctgccctcattggactagcagcatttctctcctgagtgctgcatgccagagccggagaagcactcagcatcacagtggctgcctccagcataggcctcctgtctggcagccacaggtctcgatagctctctcacttgtcagtcaagaagtaggtctcaatgctctgtctgagacctgccttaagttgagggcagtaaaacctccatcctgggcacctcagaagaaatctgaagaaaaaaaacagttgaagaatcttctctttcccctctctcaatcctgaaaagggtgaggagttcaggaacacagggagaggccctcaaacctgcgctttggaaattctacctatagtgacttggctttgaaatgttatcttctgtgttttagcatcttgggcaaaactggtttaatcacccacctctggaatgcttttttttttttttttttttttttttttttttgagacagagtctcattctgtcccccaggttggagcacagtggcacgatctcaacacattgcaacctctgcctcccgggttctagcaatttttgtgcctcaacctcccaagtatctggaattataggcatgagccaccatgcctggctaatttttttttttttttttttttttggtagagacggtgtttcaacatgttggccagcccggtcttgaactcctgacctcagatgattcaccagcctcagcctccgaaagtgctgggattacaggcgtgagccagcgcacccggccttggaatgcttattattgagaaaaataaacctctattgttttagccagttttggctcaacattctattactagccaccaaaagcagctgaactgcttcactgtgctgggttggcttcatgactcccctggcacaataaagacaaagcccatcatttatgatagtaaaaaactgcagatacccaacaacaggagatgaaaccaatgaaacacatacatgatggaaaattgtgcaggcacttcaagtgacaacttataggaaaaagttcatattttgctagattatatacatgcagagcaaaaagactaagaggaaatatgtaagaaaggtaaaattcaatttggttgagaaatggagtaaacatatattatatatgcatagaaaatagctggaagaatacacaatacacagatatcaacagttgcatctggggaggggtcttggggatctgggtgggaaggaaggttacttctgaatttttcaaccatgtgcacatattcttttttttttttttttttttttttttttttttttgagatggagtctcactctgtcgcccaggctggagtgcaatggtgcaatctcagctcactgcaaactccgcctcctgggttaaagcaattctcaagcctcagcctccccgagcagctgggattacaggtgcgggccaccatgcctggccaatttttatatttttagcagagacaaggtttcgccacgttggccaggctgttctcaaactcctgacctcgtgattcgcctgcctcggcctcacaaagtgccgggattccaggcgtgagccaccgtgcccggcatgtgcatatattcttttctcaactgaggaaagtagtagtttcgtgggtagggttgggtggtgaaggttgtttttgtttaagttcaacgtttttggagggaaagggataataatggttttctctaggtggaagaattaatgcggatttttatctttctctgtctcttctatatttccccaaatgtctccaagtcattttgtattactaaaataatcaggaaaaaacccacaataaaatgctcttcctttccttgttccctttccttccagaataattcagttttaaagccattagcagttagttgaacagagtaaggcagggacccatggtgggaggggctggtagcctagagcagggtggccgagctcaggcatggggaggaggacacaggggagggggtacccggcagagtcatcaatccagaagggtggaagagggcttccttgaatgggcagcctggagcatgtgtcaaagccagagagggtggcagggaggtacatgcactggggccaccagcaaggttgtcttagatccaagtagggcgaggcagtcagcactgttagtacccaaccatcacccacatggtggagatgtgggcagcagagatgggaaatttgttatacagagggagtggagaaaatgagtaaatatgttagagacaatggaagtccgtgctttcactgtaggagaaagaagttacaaatatggaaaggagagcttgaataaacccagaggtgttgattggtattggaggtattagtgcgcactcatgattttcaatatagacatagatgcagaaatcagcagagatttaaatttttatataaatgcatataagtatataaataaatacagacattgtcttagtcagctcaggttactatcacaaaatacactagattgggtggcttacacaacagacatgtattgcccatagttctggagactgggaagtccgagatcaagatgctggctagggccctcttcctggcttgctccctaccttcacactgtgtccttacatcatgggacagaaagagagaatgagaaagagagactgctgctctttttttttttttttttttgagacgaagtcttgctctgttgcccaggctggagtgcagtggtgcaatcttggctcacagcaatttctgcctcccaggttcaagcgattctcctgtctcagcctcccgagtagctgggattataggcatgtgccatcatgcccagctaattttttgtatttttagtagagacgcggtttcaccatttggccaggctggtcttgaactcctgacctcaagtgatccacttgccttggtctcccagagtgttgggattacaggtgtgagccacctcgcccagccatgccctctcttcttataaggccactaatgccatcatgaagaccccaccctaataacctaatttaaccttgattaccttccacaagccccatttctaaatactatcacaattgggactagggcttcaacatatgaattttgggggactcaaagattcagtccataacagatgtctatgtatgtacctgtatcattacatactatacacacatacatatatccatatacaaaatgtattccctaccctgtctactatgacgacctgggagtggtgatgccctaatagcagagcaaacctagaatccagatcttggctttaaaatgcagttttccaccaaatgcaacccaggctccttacaagaacggtcagttctaggtctagggcaaggaaagtacaacatgagcctggagcacgtgcttgctcaaagaataatgaggacatggcaaaaggacacaaaacattgcttaaatgagttcccacagctgtacagggttcaacttgttattaaaatgaataataatcatggattacaaccctttgaataaaataggaaacagtgattccatactaatattagcaaatagatgaataaattgaaagtttggtgagaaatgggaggtacaacatacttctccactaaatcctcattaattactcatggggacaaaacatctttacagtgaaggggcctagaagacaccttaattatcaaagcaaaatcatcaataatgggacaaatggaaactgagctctatgtgacaggatgcaatgagaacagtatcatttctgtgatgttctggccaaagatggataacttgagtttaatcacaaagaaacaccagattgtgggacattatacaaaatgactggcctataatcttcaaaagtgccatgatcatgaaagtcaaggaaagatgggaggaattctttcattcaggagacaaaagagataactaaaggtaacctgtaattctgaactaggtcattttgctgcaaaggcaattattgggacaattggtgaaacttgagtggggtctaaggactggatgtcagtaagacatctatttaccttcctgattctgacagctgtattatggttttgaaggagagcgtctttatctgtaggaattacacgttagagtaactgcatgtgaccggatatcaggttggcaactgatggttactctcaggtggttcaggaaaaatataattctttgtacagaacatccaacttttcactaagtttatgatcagttcaaaatttttaaaaatttaaacaaataaattgatttacatatagaactgaacatctctaaatatatagtaaacgttattacatattatatttttatttatgcattaataatgtataaatataaagtactaaaacctgggagcagatctcaacttccttatgcccaatgggaatcttcaagcccctgaagttccaaagaggttccaaagagagcgagccaggccttgggaggctgcataactataactgaaggctgggtccctctctataccttctgaccatcctattctgagaagatggctttcaaacatcctagaaaactcaaaatcagaaattctaaatttctaatattctgtccctgggctctctattctgttccattggtctatctgtctgttgttacggaaggatcatgctgttttgtttaccacagttttatatatattttgaaatcaggtaatgtgatacctccagctttcttctttctgttcaagattgctttgactatttgtggtcttttgggatcccatatatatttcataagtgtttttttatttatgtgaagaatgtcatagatattttgattggtatttcattgaatctgtagattgctttgagtagtatggacattttaacaataataattattccaatccatgaacatgggatatctttccacttatttgtgtcttgttcaatctcattcatcagtggtttctagttttcagtgtacagatctttcacctccttaagtttattcccaagtattttaatttttggtagctattgtaaatggaattttcttaatttctgtttcagataatttgctgttagtgtacagaaacactgctaattgtatagtgttctcataaatcactgaaatcccagaaattctgctaattcaggatcccaaaggcatgccacagattgtttcatgtccctggaagtgacttgatggtttggcatcagacagaggagggtttgatttccaattctaccatttctgtaccatttctcaccctttcagcaccattgcctcttgttccttcatgtgtcaagtaagaagatgacagtagcttcttcttagggctgcagtgtagatgaagtgagataatatgtaaagccccttagccctctgcctggaaaatgacatattccatgaagaggaacttgttccctttatcatttagaagttctttgtaagtcatatttccctgttttgactccagaaatgtggtcataatttcaataaaagtggaaagtacctaaagtcagcctgggctgggctctgaggtgtgctctttttttagccagggtggacttcagactccagcaaattttatgagattagctttatagcccagagttcctcctagtgtggggtgaggagagaatgggaagggcatggtgaggtaaaggtcagtatcagggaaactgaagtcaaagaaagctgttcagaagtggcagcattctagttagatatctttatccctttgcatcgggggggtttttggaaggttgtagtaaacccaaccataatcaacactatttattgaacaccagctgtctaggtacggcagataagaaaaagacacactcccagtccaccaagtgctcacaatctaggggcaaaggaaaatagccccagtagatatcttttttttttttttttctttttgagatggagtctcacagtgttgtccaggctggagtgcagtggcaccatcccagctcactgcaacctctgtctcccaggttcaagcgattctcctgcctcagcctcaagagtagcttggattataggtgcctgccaccacacctggctaattttttttttaaatagagatggggtttcaccatgttggccaggttgatctcaaactcctgacctcaagtgatccactcgccttggcctcccaaagtgctaggattacaggtgtgagccactgtgcccagccagatatttcattctcacagtacctgggctgctttgctcattgcattgattaaacaccacctacatatgtgcctgacacttggcaaggtcctgtgggaggacgagatgagtgaaagagcaagggcatgctctggtcacaaggaactcactgtttacttcaggagcagacataaaagaaacacttctcaataactaggaaaaaggtatttagacagcatttctttacagaatacagagtcaggaggagaagaacatgagggctttgcagagctgacatctgaaagggtcttgaaggagaagaaatgtgattgcaggcagaggaggtgtttgtgtgtcacctaagggcatgaaatagcaaggtgggctcagggcttgaggcgtagagcatgcaatgggggtggggggtgggagatgaggctggggcattgcatggacttcagtacactgggaacctagtgggcttcactcagaaattcagacacgaccctctgggcaagagaagccactgaaaattttaagaagtggaataagatgatctgatttgcattttagatcacacaggtagtttacatggtggatgcattgggtatgggcaaaactgaagacccgggaccacataggagactgttacaactctcctggggggaaataatggtgccctgaaccaaggtaggaaagagtaaggtggacaagttttgggtgtctttagaaggtagagtttgacacgattagatggcactggttagaaagagggggaatggctttaagatttctagcttgggtgggtgaataaatggatggtgttggtgcctttatggaatgaggtagtgtagatagagcagatttgaagtaagggcaaaaaaatgaggttggttttatattttgaggtgctctaaggatgtctatgtagagatgaaggggaaatagaaatatggtctgtggctcagaaaagaggcaggtactcactacatagaggcagtggaattagtcttagagatgatggctgaatcacggggagtctgtgcaaagggggtgagatggagataatgcagccaaagaagactagagggtggtcaagaggtggcaagagaaccagagagcggcatcaaggaaatacccaacaggctgggcgcagtgactcacgcctgtaatcccagcactttgggaggctgaggtggacagatcacttgaggtcaggagttcaagaccagcctggccaacatggcaaaaccccatctctactaaaaatacagaaattagcggggcgtggtggcgcgcctataatcccagccacttgggaggctgaggcaggagaattgtttgaaccagggaggcagaggctgcagtgagccccactgtactccagcctgggtgacagagttagactccatcaaaaaaaaaaaaaaaaagagagagaaagaaagagagaaagagggagggagagagagagacagagagagagagagacagagagaaagaaagaaagagagagaaagaaagaaagaaagaaagaaagaaagaaagaaagaaagaaagaaagaaagaaagaagagagagagaaagaaaaagagagagagaaagaaagggagaaaagaaagaagatatccaagggaagcaaaatgtttcagatgggagggagcaccgcaaagggaaatgactagaagtttagtaaaaacacaggctgtgaagcatgcaccagaagtgcaaatgggtcctcggtgaccccattgagagaagttttaggggagtgctgggggctgacactagtttttagtggattaagaaatcctgggagagaggagtagagactattcttttaagaaacgtgatagtgacagggaagagaaggaatagtgagctgaggaaatgcaggatcataaaagtgggtttaggacagcagcagctggacatctgtgtatgctgaaatgaacccactggaaaacaggtgctgatgaaggaggtgccggctctcagaagaggcaggaggcccaggtgggagtctgtcttggacagaggcctggagtggtatgaaggaggggtgagccgaggggagagctgaggcctgatgaagtggggaccctagccctctgcagaagggaagctattcggcaagggggtgccagggaaggcagcggcttcctcagcacttgctgcgggaagaaacactgaagtcccaggcttccaggtaatgctgttttcatcagcagagccccgctggcctgagctggaattctgactgagcaggtgacatgggcaagggccgggggtgaggcacagagtctgctgcggaagcatctgcggggtgcagtagccagtagaggcggccccgtgtatgcctcggggctgggcgtcccgcagagggggttactcactgctgactcagccccaggtgctcatttgcatgttactcatttcaagccaaaaacactggagcaggagtacaggagcatctcatcccctttccaaacagaaccaccccaggtcttcccagcgctcctgctgctgtgccgagtctctctgacccagaaatatttctactttggaagagtctactaagctgtgctgtatagctatctgtgaaattgagctgaaaaattcaaagaaacactcagaaaattcattttctctgtaaggatatcaaggtaagtttaacatgccaagagcctgggccttcccccttccaaatattatcttattttcacctgacttctcccccaccagaatgtaacctccaagaggatagtaacattgttttgtactctgtgcccagaacagtgcacggcatgtagcaggtgctcaataaatggattaaattctgtaatcccagcactttgggaggccgaggtgggcagatcacttgaggccaggagtttgagaccagcctggccaacgtggtgcaacctcgtctttattaaaaatacaaaaaattagccgggcatggtggtgcctgcctgtggtcccagctactcaggaggctgaggcaggagaatagcttgaacctgggaggcggaggttgcatgagcagagattgtgccactgcactccagcctgggcaacagagcgagactctgtctcacataaataaactaattaattaatgcattaaattattgaaggcccttgggcaccccaggccttcaataatttaatgcatttattgagcatctacgatctcatctaacccctataatcctaggcagttaacagtttaggaaggggagattctcagaggtgaaacaccacccctcccatcccctcatcctcatttaatcaaattgccagtaaggggaaagcccccgagtttcgagctgggcttcccacatgtcatggagttcagaaatgcctctatcagtttatcaggtgctcactcctgtgaaactgattcatgctaacggattcactctgacaagaatatccccgagaagagaaagcgaatgtagtgatttacattcaagcatatacagctgccaaggagctgaaacgttctgccctgtcggacagctcagtctgtccccagtagaaagagttcactgaggctgccaagcagtcgccagcttggcttggagcctgcacagagtcgatagcctcagggaggccatgaacaagctctgtgaaccagaaacccagaagaccgagtgcagctggccaggcaggatccccgcctgctctagggacacagctgccactctccagctcacccagagagccagccaccggccccctgcaaccctctaccttctcttttgagaatgattgcttattgactgaatgggtcacctccattccctctcattcatggtttccatggactttcctttttcttttctttttttttttttttttttgagacagagtctcactctgttgcccaggctggagtgtagtggcgtgatcttggctcactgcaacctcttcctcccgggttcaagcgattcccccgcctcagcctctggagtagctgggaatacaggtgcgcgccaccatgcccagtaattttttgttgttgttgtatatttattagagatggagtttcatcatgttggccaggctggtctcgaactcctgacctcaagtgatccacccgcctcggcctcccaaagtgttgggattacaggcgtgagccactgtgcccggcctccatggattttcttagtcaattgtttgttgttgacaaggcatagcaggaagtcaccttgcaattctgaccatgtttggggacagccacctttctgaatccaagcatgtctttgggtctctgcttgcttaagccactgtgtgtggggatgtataaacttctacctgtggcctaagttttggggtcttacagttcactgttcccgggagctacaagacctgggcatcaaaacacagaataaatatgatgaaggaagagaattcaaaaccactttgggaggaaacccctggtagaaggctaggctagcactgttgcttgtgacattgacagtccaagaatcagagaaggatccaggcctccaagagcttctttggcaaatggggtcccttactgctagtacagaccagaaagtacatgactttattttatttctactactcagtggcttattttaaagcacaacgggaaaaaaaaaaaaaaggaaaagagaaaaaaagaaatccaattctcaatgcctaagccagagcggagtaaccaccaacaaaacagctgttaacatggctgacgcatgttcctgttaactgctttagtcaagttaaaggcctggcaagggagagattctggctggcttagcaaggagagagatttctgaggtagccaccacagatggtagcagatgtcacgcagcctcagagcagaagccaccagagacttcactgtcttggagctgagcaaaaaagctgagaaacactcagccacgtcaacagccaattacacacctcaagaatctcaggaagccagggagtgtgtaaaagtttctataattaattgctttccattctctttatccacaaatctgtcagctcatggctcttcaaaaatcaaggatgctagcttcaggtatctctgccctcaccttgtatggccagcagcatgaagatggaaatgcacaatttgtaaccacattattgattgctatagtcctaggattaaaagtgatccctgactgacaagaagccagttgttcaattccttctattatagtgtagggtagcggtcacccgtaaaggctagagtcacacaagcttggggatcccccagtacctgctgcctgatgctgctcactattttccctctctgaacctcagtttcttcatctacgaagcagaaataatagtgcctgtcttgttgggtgttggaatgattatatttgatagtgcaagtaaagcacctggcacagtacattgtacacagtaaatgtcaaagaatgccaggtatcatcccaaatctatgaatgcccagaaaggtgctgtttggtattgccatgttccttacatgacccacaaatttctacatctcataatcatacctatttagaaaataactctgtatgtggggctgcagatattcatagatttaattgcaaattttaaaaggctattattgttattaagactttaagttactttgtcaaatggtgactatggacctcctcaaatgtacaagataacttcttttttttttaattcttttttttttttttttttttttgagatggcaggggggttctcactatgttgcctaggctggtcttgaactcctgggctcaagcaatcctcccaccttggcctcccaaagtgctgggattacaggcatgagccacagcacccggcccaaaataatttcttacattagaaatccggtggggcatggctgctcatgcctgtaatcccaaaactttgggaggccaaggtgggagaatcacttgagcccaggagttcaagaccagcctgcacaacaaagtgagatcctgtctatacaaaaaataaaataattagctgggtatggtagcactcgcctgtagtcccagctatttgggaggctgaggcgggaggatcacttgagcctgggagatgaaggctgcaatgagctataatggcaccactgcactccaacctgggtaacaaaatgagaccctgtctcaaaaaagaaaaaatccatacattactcaaaactggtaaatactgctttattctatagcactatgcttaatgaagcttgaaaccaactaacataacttttccccatttctttttttttttttttttttttttcagggaaacacagaattggtaaggtgttttccctaatgcaacatttaggaatatgctgggctggacacatatttcattcaatcacttccattgtctgtattcatcctcagacatcaaatgacaaaagtgtgcaaaataacagttgttccccataagatttccaaatattcagctatgctccattttccagggcacagaatgggctactgtagttaagaatttttctatcatctgagagttctagttagtctgtctgtacagggtgagtgaccaaagtagaaaactggtcaggacatgaagtgaagagggctaaaaaggcaagatgagaaaaacagagtcgtgaattcttcaccagccaagacctcacgaaaggctcgtgtgtctgggcttccatcccacccgctgatagaggcagtcccctctcagccgcggcgctgcttctgtggtttcagttacccgcagcccaccaagatccaaatatagcaaatgaaaaattccagaaataggccgggcgcagtggctcatgcctgtaatcccagcactttgggaggccaagtcgggtggatcacctgaggtcaggagttcaagagcagcctggacaacatggtgaaaccccgtctctactaaaaatacaaaaactagccagacggagaggtgcatgccagtaatcccagctacttgggaggctgaggcaggggaaccgcttgaacccgggacgcggagtttgtagtgagctgaaatcgcaccactgcactccagcctgggtgacagagttgtctcaaaaaaaaaagaaaagaaaagaaaggaaaaattccagaaataaacaattggtaagttttcaactgtgcgccattctgatctggcagtatcctgtactgtcgcaactgggacctgaatcctccctttgtccagtgtatttatactgtagaccaagcttgtccaacccacagcccatgggatgcatgcggcccaggacggctctgaatgcagcccaatgcaaatttgtaaactttcttaacacattatgaggttttttgtgattttgttttagcttatcagctgtcgtgttagtgtattttatgcgtggcccaagacaattcttcttccaatatggccccgggaagccaaagaattggacacccctgtagacgcttcccgactgtgagtcacttagcagctgtcttggttataagatcaactgcttctgctcaagtaatttttattttactttactacagtacatggtcataatcactctattttattattagtcattaatctcttactgtgcctcatttataaactttatcatatgtatgtataagaaaaatggtgtatacagggctcagttctatctgaggtttcaggcatcccctgaggataaagggggaatattgtaggaatagcgttggtatctgtactactggactggttcataggagttcacacactgtgaaatcaagtgcattgtagacaccaaagccccagacaaactggagacagtgcactaaaccgactgctggagtcaggcgtctgctccctcctgtgctgctgccctgtgccccccccggattggcattgcccttggtgtctcattccagcttatgaaggctgtgctttgtcctcgccatcacttcccctttttcaacacaaggacatgtttgctagcatcttagcatgactgtgaataaactactcttccttctgccggggctcaagcaatgggccacacatcaccaacttcctacgatatatagaagacttgagattcatttaaaaattgactacagcgggagaggaggatgaatagatggagcacaggggatttttagggaagggcaactattctgtgtgatactgtaatgggggatacatgtagtcatacatttgtccaaacccacagaatgacaacaccatgaaccctaaactatgaactttggataatgatgtgtgtcaatgcaggtttatcaactgtaacaagtgcaccattctggtgggaaatatcgctaatgtggaggggaagctatgcctgtctaggggcaggggttataagggaaatctctgtaccttctgctcaattttgctgtgaacctgaaagtgccctaaaaaataaaatctattaaaaaaattggtcacacacacacatttgctactgagatgggctccaacaaatgtgaaaatttaagaaatctacctctttatttaacaccaaagctaacatcaagtgtttatttaaaaaaataatggcacctgctttggattcattgatgacaccacaatggggtgaagatctacagggaatttacaattttaggctgacatgaaactaagtagtaactcacaaaatggaaattctgcaacaagcctcacaataaacatttccagtttctactttcagagttgctaactactgcctaaacatatcttaaacacagagcacgttttgttgaaatatttctcttaggacaaacacagtagacatgctttaaataaattaaaattgcaacacataaatcattcctaaaacaatcaaggtgcattactttctagcttcttataaattaaactgtactgatttcaggaaactataggttagttctgtttcatatcttttttttttagcatcttatctagttttgatgtgaataagccaatttcattctttgcagtgatttatctttttaaaccaactcgttcctttgtgcatgtgctaaccttaaaacacctcttcatataagccctgaattttaagtggtgccatttcttcctacccccagcccactcctcagaattacagaaatatgtaaaataggttgtttaatcacacatgttcatatgaataaatatatttaaatgtttttccaaaccaatacaactatatctggattcactgcaaaaacattcccattcaatgcaaaataatttggtacaatccgaccaaaaaagacaaaagtaattagttgcctgagggaagctagttcctcattattactgagcccataattaaacctgatatgctagagaaatggcaaggcaataaacacagagtggggcaatatttaaatgaaaacaagagtgacagagctggaaagagcgaaaaccacatgaatgctaattgacagagaaggataacagcctcaccggctgaaatgaaagacggagtttcggaagatttccttctgtgaatagctgacaaggatcacgcaggcaaaaatgctaccgttccaagctacaaacttgggactaatcccatgttcattgtccaaacccagcaacggagtacttttttgctgtttcattatggatttccattttttttttttttttttggcagttgggggtggggtgttctggtttaatcatattcagagtttgagcttgaaataaccaactcaagacccacaggagactatgtcaccagataaacccagtgctagaatccaatgtccagcatcttcaaccactcaggagtgtttgctgagagaccaggtggtgcttacccacccaacaagcactttccatctttgggtttgcccaagatgtttaccataaatgaaaggggtggggaaaggattatagttgacacaaacataaattaaatatccaattccagcatatgttacagctacatcactatttttaattgtaatatttctaaaatgtcatttaatctccttacacattgaagagaacaaacagtgggagtgtttattccttaagagagaataaactgcagagattaaaagtttccttcgagtgtatcatcttattaaaaagtacaaagtttcatgaactttcaacaagactgcaaaataaatatgccaggtaggttgagcctatccaagtgaaaacaaggttatttgacatttagtgagagtcaatgaaaatatgaattatttcaaaggaattcatgatccaggtaggaggatttagatcctacggtatgttagaataaagctagtttctagcagattctgttaacagctccagactagaggggacggagtgtgctgctttccattctcttctctacttctgtcactggggagaagatacacggatcacaggtctgagaagtgtgcattaaagcacatttgctaggctgagcactggaatggtgtgggctggtgtgaaaatgaagcctacgtcttcttggaccctcccagagcccttcacctcaagggttagacatctctccttctctaaactaacagcagcactcaatccctggtgtgtccgaagtggtgcttggaaagattcacagataccaagaggggcccacccaggccccagcttgatttaggagtgtaagttacactcagcactcagcccacgctgagtctgatgcccacaggtaaagggtaatgctggccatcgaaatacaaaagctaaaggaagcacaacattctctctgcctccctgccttgcacctggcctccttatctgtctcccagacttgaaagatcagtgtatacacatcaacgcggtagaccagggggagtctgacaatgaaaggagagacagccatgagatcagggtgggactggtaagggagctcttctctgaatccaaaatactttatcaccaaagatttcatgaaatgacatttattgtttaaaaaagcgtgagtctggaattagatagtggtgatggttgaacaagtttgtgaatttactaaaaccactcaattgtacgcttaaaaaaaaaagcaagcttgagctgcctaagtcccgctcacacacactggacttgtactaaatgctcaacgattccattctctcagactatggaacattctgtcacatttttttccttcaggagatttccctaagaagagctgtttgcaaaatattgcacttaatttgaatccagggggacctgatgtctcctggaagaaaacgtacactcacatgccttcctgcctgcagcagatggcgggagtggtgggacaaggggctcaacagcagtttccatgaacattgtttccatcttcctctttgttatacacacagagacacagatttaaaggaaagtatcatctgggctgaaggcggtgaatggtatcccccaaacagggatgtgaacttttgaatgttttcagctcagaggcagtatggtcgtcctaatacctcaggacttatgttcagtgagatgttaagagacaggtggcaaccttggctcaaacactggacttaatttattttattcttgctagtctttcacttctcaaagacgatgctctcaatcttcatccaggtgaactgctcccactaatctagccaccattcagtcacaccctacgtcctcgtttcctcatgctttcagcgttccgacacctcagtgcacttgaactttagaggctatggttcggttgtccttcaaggaaaaaactgcaacatgaccatcatttgttttcatttcctgagtaagctttgcagtccctcacagacctgtgaataagatgaatcacataaagtgaatcatatcctccaggggggcttatcacaatcaagatttgccaaaaaacagccaggcatggtggcttgtgcctgcagtcccggctgcttgggaggctgaggtgggaggatcccttgaagcaaggagtttgcaaccagcctgagcaatatttagcagagccctgtctcaaaaaagaaaaaagatttgccaaaacacaaaccttcagagtagtgctcacaggattccaaattaatgttaaagtcacagtctgatgagggatttgaaaacattcctgcacactctgaaggctgggcatttgctagccagttgagacaaaatcaggtgttggttgcctgggtatgagaaggtgaaagccccattcataaatccctatgccttcccatttaaagtgtaacaaaacccctcaggtagacttgttggataacaggtgtgtgataagatttccacgttacagggtcatacacgactgactgctgtggacactgagtacatgacgggacctatggtcccctggagagaagcagggtggatcacacggggaccataggccacagtgtttaacactgcccaagcctgtgattcttcattccctgaatcatgcatatccttgctttttataggactcacagaaaacaaccattagcaattgtgaagctcaattctgacagagacttaggagagagacctctttcttcaggatcaccaattatgccaaggtctcaatatacagaggtttaccacgctgggctggtcaggtgggcaggaaatcggtctgattaaggcagtgagcaaggtaggagagctctgaaacagattcgtgttaacgaagtacaaggactgagttggcaactgctacggagttaagagaattgtagttatttacaccacacagtcctagtttttcttacacacgagtccgcacaatcattcactgtaaaatttggtagtatgcacagagttttctttaaaataaaaacttgaaagaacttgaaggcaggaaccagtggcttcatcttggtattatcatcctttctatggcacacaggatatggtcccagtttttacaaaatatagcaagaagagtcacggcaaagaaggtgccaagaatgtggcagcgactcttcatcatgggtgagacgaacttcgcgatggtggacacacacactaagatgacagtcatgaaggccaggatcacgttgatgcacctccccaggagaactttagcattcacggtgtctgtctgcagagcttgctgctcttgctggtggagctccagcttagaaatgcgagtctggcaggattccaaggcttcctgtgagcaagagggagagcaagggtcaaacggtgttgggatggtgagcaacacgtgagtgctcgctcagctgtacacaaaagccccagctcagaaagcccaatgcccaggcggctgcaaatccccaaaccgatgatgatggtgatagacaaagatgtggaacaagaatcccaggctcattttctcctgttgttcacgagtagaagagcatgtggatacaaccacaaaataccataaatgaggaagtatggctaagttttttgactttacctgttttttttgagatgtagtcttgctctgtcgccaggctggagtgcagtggtgcgatctcagctcactgcaacctccgcctcctgggttcaagcaactctcctgcctcagccccccaagtagctgggactacaggtgcgcaccaccatgtctggctaatttttgtatttttagtagagatggggtttcgccatattggcaaggaaggtctcgatctcctgacctcgtgatcggcccacctcggcctcccagaatgctgggattataggtgtgagccaccatgcccagccgacttcatcttttttttttttttttttttttgagacagagtttcactctgtcacccaggctggagtgcagtggcgtgatctcggctcactgcaacctctgccttctgggtttaagcaattctcctgcctcagcctcctgagtagctgggattacaggtgcacgccaccacgcttggctaatttttgtatttttagtagagacagggttttaccatgttggccaggctggtctcaaactcctgacctcaagtgatctgcctgccatggcctcccacagtggtggaattacaggcgtgagccaccatgcccagcctgactttacctatttttgaaataaagtgatataaaatattggtgcctgttggtgccatcagggacaaagcagagaaggagggaggttccactttgtgactactccacctttcagccaaggagtgtgtgggatctccaatggtcagtccttatttccaccgctcaaagatttttgtccatcagttagagattggcggaggaaggcgagagaagggaggggaagggactggggctgactgtggggcaactgtgctttcacctgctctctgaacgcggtgttactcaggacaccatccgaggctatctccctggatctcgtccatgccaagtcttcaattactaagacacagatggctacaagtgtatctctaggccagttcttcttctgagattgactcacagatctccatgcctctttgacatctccatcagagcttcctgaaagcacctcaaatgcaacacgtacaaatgtggcttcatgtattgcagctacccaacacctgcagtcaaccctcttcccttccagtgtccttcttctcagagtacagcaccatgatccacccagttcctcataccagaagcctaacgggcataccctgatacccttctcatccaacccgtcgcccagccacggaggcaacatccagtttctagctcaattggtccggttctctctccacccggtcagcaccccaatctaagtcaccgggatctcctgcctgcaataaccttacacgaatttccctatacactcttttgttccccacccttacgaatccattttccacacagccacccaagcggtcttttaaggatgcatatttggtatcactccttttcataaaacctttacaatctttaatatggccttctgaggccttgcaaggccaggttcagctccctctcctccctcacttaatgacttcatgccagccgcttgccctgtcacagtactctggccttttctaagttctttttttcttttaagagacagggtctcactctgttgcccaggctagggtgcaatggcacagtcagagctcacttcaacctcaacctctggtctcctgcctccattcctcctgaatgactggaattacaagtgcgagccaccacacacagctttattctaagttctgaaaaggagcacagactcacctcagggcttctgcatattcagtacactctgcctgagacatgtgcctcccccactccatcccttcttcacccgtggatctcccactcattttttaggtctcgccttgattgccacatccctggggaagcctttcctgatccatgagatgagatcaagtctcccttcagctctcctccccaaccacaagacatacgctgcctgaggacaggaactagcccatcttgcatttgctgtcctctccagcacagagccagcgccaggcatgcagcacgtgccacacactggctgaatatgaaagagacagctaggtgccagtaagagaatgtgaggcttgatgggtacagtggcgcatgcctgtaatcccagcattctgggaggccgaggcgggtggatcacttgagatcaggagttcaagaccagcctggccaatatggtgaaaccccctctttactaaaaaaaaaatacaaaaattagctgggcatggtggcatgcacctgtaataccagctactcaggaggttgaggcaggagaatcacttgaacccaggaggcggaggttgcagtgagccgagatcacgccactacactccagcccaggcaacacagtaagacggtctcaaaaaacaaaaaaaaaaaacagaatgtgaggcttgagagagaaaccttcaggcctgctgggtgaaaaggatctaactagaggtagtacaatgtgcccctctctgttctaactcatttgcccatctgtgtttgctcaattaaaatatagtcaccttttcaggttttaaacaagaataatggctccaagattgatttgcttttcttctgctgaataactctatgggccaaagaacaggttctctgttactatagtaacttctattatactaggctaccaacgaaaaggataaaacttcttcagatcttacattctagaaagtgctggctttcagcaataacaggcatgtactagaaatcatgtgttcttttcaactacttgggtccaaggtttcctctattttaggcataacacagaaaaggtgatggaacaagacaaaagaccaaccttttaggaaaatccatgaatctttgattataaaatgaattacgtgtacaaatagaccgatcttagaattgtcttacaactgctgtcaattttttttaaccaaaagaaaaatccaagaaaattaagggtgaattccaaggaatttgagtcacagcagccagagtattcagccccacaatttttggtacttccttgggtccagtaattaacttattggggatgatgaccataaaaaggggttatcttgaaacatttctaactgggaattcagggtttaaaaaaccactcagttgtttaaaacaacaaaaccctgacatccctgcaggcaacagcctccctgtctctggcagcccattccctttgtgtaaccgtgcctgtaagaacaaaacaaataagaaaaaatgatgaagtcaaaaggcccaactgctagaagccctgaggattgtggctactcccggatgtaataaaaagaatggacagtatttattttttgactgtttactatgtgccaggcaaagatttcaatactttacatgattattccatttaatcttccttgacaaccttttgaggtagagctcattaatatttccattttattaaggaggaaactgaggcacagagcactaactcatccagggtcacacagcataggtgaggagggccaggattctaaccaacgtgacagggaagacactccagtcattcacacagatgtcctctttacacttctgagtgagagatgaaaccagaaaacgtcgaaatgaacctctctggatttttaagttccctttgtgtggtccctccttcaccactaaaatatgtttgttaaaacacagaagaacaatattaacccaaactatcccctaaataagaaaaccatgcattcagataccacccagtgacacccgaaacatgctctaaaatagaacgacttcgtgaagcaattgtactgttcacttggcaacatttttatttgttttttggagacaaggtcttgctctgtcgcccagactggagtgcagtggtgtgatcacagctcactgcagccacaaactcctccctcgtcggcctctcaagtagctaagtttataggcatgccaccatgtccagctataataattaaaaaaaaaatttttttctaattatgttggccaggatggtcttgaactcctggcttcagatgatccttctacctcagcctcccaaagtgctgcgattataggcatgagccactgcactcggcccacttggcaacaattaacgtttaaatgggttcaagtttctcgaataagccagtggtgaagcaaagtctcttaatccagaacagggccagaaacctcccaagtgtcttttgagatgcggtctctgggggcagaatttcccatcagctctgatgtgttggttcccagaactgtcccaagtaggcatctgggattagcacaggctcagccctcagcagagtggaataaaaacgtggccagttgaaactccaggtcacacattgcaggataaagcactatctttatgtttaattttctcccttgtaaagtggggcttggacttacagccttcagccttcctagagctggagaaaatgactactgtccacagagaaaattcataaaaatgaagctgggcattgcttgaagagtacttttttaagagacacagggcctcactctgtcaccccccaggctggagtgcattggcacaatcactgtaaccttgaactcctgggctcaagccatcctcctacctcagactcctgagtttctgggactacaggtacacactgccacacccagctaatttaaaaaaaagttgtttttagagatagaggggtctcactatgttgcccaggctggtctcaaactcctggcttcaagtgatcctcctgcctcaacctaccaaagtgctgggattacaggtgtgagccaccagccctgggcaatttttttttaaaggcaatcaaggagcctggggttgtttcactacgtgctaggatcacattaggaaatactggagcacaactttgtttatattgatcccattatcctttccttccatccacccagatcctacccattccttccagtcccgccttctctaggacattcaattacattccttccttaagaatgacttgcaagaccttgtttaggccacttaacctctctgtgcctcggtctccatatctgagaagtggggataataacagaaactaccttaaagtgttgctgagaagtaaatgggaaaaaaagaaacctgtgaagtgttttgctagtattgagcacacagtatgtatcgaagtgctttaatttcttacaaatacgaatgctattattaattaattaattaatttattcattttttgagacagactctcactgtgtcgtccaggctggagtgcaatggcgcgatctcggctcattgcaacctctgcctcccggattcaagcaattctcccgcctcagcctcccgagtagctgggactacaggtgtgtgccatcacgcctggctaattttttgtatttttagtagagacggggtttcaccttgttagccaggatggtctcaatctcctgacctcgtgacccaaccgccttggcctcccaaagtgctgtgagccaccgcgcctggccatgtgaatgctattattttacagatgagtgaataggctcaagtcttactcagggccacacaactgatatgacagacgtgggactgaacgtggaaatgttttgctactacatgactgactgctcccatggtccacagcttgctagacaccacatggctaaatttctgtggctcacagagtccgtgtcgtgtaaattggccaatgtttgtgctgtcttgagttctttggcagttgcgctatcccacactctccacctaggcagtgagctgcttgaagccagagattgtctcctatttttacattttacagttttggtggtgatgggcttgaggtggataataaatacttgttcattgatttaggcataaagtataaagaatattgtctcttagccaggcacggtggctcacacctgtaatcccagcactttgggaggctaaggtgggcagatcacttgaggtcaggagtttgagaccagcctggccaacatggtgaaaccccgtctctactaaaaatacaaaaaaattagccaggcatggtggcatgtgcctatagccccagctactcaggaggctgaggcagaagaatcgtttgaactcgggaggcagaggtcgcagtgagctgagatcacccactgcactccagcctgggccacagagcgagactcacctcaaaaaaaaaaaaaaaaaaaaaagaaaaagaaaaagaaaaaaaaaagaatattgtctttttacttagtaatgtctataacatgaactagtggggttaacgtggtacagataaaatgtttgtgcagagaaaacattttgtgccatgtgccagaaaccctctaggacttaggcataaacatttagactgttaaatgaattaaggctcgggaagagcccaggcctgtgtctaatcacaaagggaaaggtacctggatgtcccgcgagcgctcgtaggcctggtaggccaccttctcctcaatgctggccagctcctgcttcaggttggctgtctcatgctgatgcaggtccgtcaggtcatgcagctggtcctccagtcgctcatacctttaaaagagaggagccgattcccagtgtgacctttcacagcacattgtggaacgatgtcctttttatcttcctgcgccagtaccttttggcttgctctcattccctgatgggctgtttttctaaaagagtaaggctagctgtgggaattgagcttttggataacactgagtcccagctctggaaagatccagtctctggggtcttgactctctgtccttgccactgaaggtgcacacgggtcagactagcaccttagctagctgcagtgacctcaagatagagctcatcagctgatgcacttgccagggccaggcaggagacagggctctgtgggatcctgctaaaggagggccaggacctctggtgtctgtggtgccttttccctattctgccctgacactgctgttggggttcatggccagagagcccacagggaaagcaccatgcttttagtatcaccttctactctggggtcaactctactatttcccagcatgcaaacacgcactgattatggatttcagctcttggaacttaactgacaatacaaaattaagcttattacaaattatagatggttcatcatgcagtgtttcaaaatgtccaaatctaaaggaacagaagtacaaagattctcattcctgtgccctgcccctctcactgaagattatttttctcatatttgaaaccttagctgggtgcagtggctcacgcctgtaatcctaacactctgggaggccaaggcaggtggatcacctggggtcaggagttcgagaccagtctggccaacatggtgaaaccccgtctctactaaaaatacaaaaattagctgggtgtggtggcacgtgcctataatcccagctactcgggaggctgagatgggagaattgcttgaacccagaaggtggaggctgcagtgagcccagatcgcgccactgcactctagcctaggcgacagagcaagactccatctcaaaacaacaacaacaaacaaaacaaaacaaaacaaaaaatcttatactgtgtattttgaaacaggatgtactgtttggagaagatgcattcattagactggaatgactttgatcaacgccaatttcagatgcttacataggtcacctgacagaatcattttataaagaggaccaaagagcttcatccagatttaatgcttattctcaggcatgacttctcagatgtcaaatgctgctactgctgtgaataagcctttaaaggtctcttcagtaatacaggtggtgactgtaacacgcgggtcacaaacgtaaccacaggacagatgcaaacagaaaccgtcctgaactcacataaatagggatctgtaacttgggagaaaatgtgcatctagaaagtgctatatcccagactatttcgatagaactgacgttcatactctggaaaagctgtgacttaaaatataattcttgtgtgacaaagattccaaagatgcatatggaaagatttttgtttcataaaattggagaattgaaaaggccacatttctaaattaatacagacataaaatcatacatcaattataaaacaataagtaaactaaatttaaacttttaatgttatagtatgtaataggcattttactattttatctacctttttagaagttaatgtattattaactttgactaaaaaacttttgaagtatctctttattggaaaaaatggggaaaatgaccttatatttgggcttacacactttgtgttaataagttataagcacctaaaagccagcctacaaaacatctactttaaaattacctaatataagccaaaggttttgaatgtatactttaatcttaagatgactttggaaagttctttattttactttagagtaaaaagtttaatgagcaaactacagaacataaaaaaatacattacataggctgggtgcagtggttcatgtctgtaatcccagcactttgggaggacaaggcgggcgaatcacctgaggtcaggtgtttgagaccagcctggccaatatggtgaaaccccatctctactaaaaatacaaaaattagctgggcgtggtggtgggtgcgtataatcccagctactcgggaggcttaggcaggaggatcgcttgaaaccagaaggcagaggttgcagtgagccaagatcgcaccactgcactccagcctgggagaaagagtgaaaactccatctcaaacaaacaaacaaacaaacaaacaaacattacataaggacttcaagattgatgtgccaaataagattaactttgttgggtaatgagtaagtgtgtacttgacagttgttatggagggaaatcaaatatagatctctgaattagcataatgacactataacggaagtctactgaatcagcatcttaagatgcacgtgagttgttgcctgtatccaataatttaaggacccacacataaatccttctctaattgtcagctaaaagccacaaattataaacttagaatcatgaaggatggaaattattgggtatcccttatctgaaatgcttgggaccagaagtgtttcagattttgatttttttcagattttggaatatttgcatatatatacggagatacctcaaaaatgggacccaagtctaaagacaaaattcatttgtttcctatgcatcatatacacatagcttgaaggtaaaagtgtaccatattttaaataattttgtgcctcaagtttgtgttaagtatttatttgtggaattttccagttgtggcattgtgctgacactccaaaagtttcagatttgggaacattctggatttcagagttttgcatgagggatgcatcaatacattagggatgtattgattgctaaacgccctttaatccatatccatatttattgaaaatgtaaccataaggcattcttatttcaagcaatctctctgcagtaactcatccttttaaaagaatgccacacctatcacgtacccactaagtatccgtggtaataaaaaagttttcaaaatgaaaaaataaaataacataaaataaaaaaataaataaataaaaaataaaaaacacgccaatggaatactttgaaatacctgtatctttcctcttgcagggtctgagaaataaaaccatattctctcttaaactgcaccttcagtgcctcgatgtcctcagccagctgagcttgggtatccttgatctccctcagttcctccaggatcacggcgagcttgccctggctgtccagtgtgctggctccaccagccccaaacgactggtttccgttactgtcggccgagcctgacgtgccactcgaacattcatcatcactgccatacttgggtttgttcacgatggtagcgctgcccccgtaggccctggcactcgcctctggcctaaactcctctaaggaatttttcaagtgagcaatgttgtcggcgctgccaaacttattccggatcaggttggcaaactctctggacttattgaaaacgaacacaggtggagtaagtgagacccctggcatgcccgatttgctgctctccatgcaatggggggcagttcgagatttcacgtgggcatctttcaaagagcgatgtatatccttcaggtggtctttggaaatgtcctttgagctcctagaggctccattctgctcgatctctctgagctttcgatgatactgctctaacttcttctgcagctgggcgatggagtgagctgatttctgattcttcttctcaaagacttgcttgatacgtcccgcctgctgcttgtctgcgttgttcactagtttcagatactccgcaacattcccatcgcgcgatgtttgctcaatttttatctgctctgttacctttagaattttttgcttcaggctgtctgcagtgagtttgaccttgtggaagtccaggatgccatccgggacatcaaagttgaggttggtgtctgacccccctcggcgtatgttcaggggcaggcttaaggtattcatgtcatgacgttctacctgaaagagacaggaaagaagcacattaaaatttgaagtcaaagagataattactgtgacagaatctatgcacatacaagatacatacatgaagtcccagtttttcgaactacaagtgtcacgggataaaatccccctgctgtcccctccagttgaacatagaggcagcctggctccttcctgcatccatctacactaagtagctgtgagattcagatctcccagggtatccactttttttgtgtaatgagactgtaacctggctcccagggtagaaaacgcaaaatagaatgaggtcaccagtcagtcccggtctcccaaagtgcccaggtaactggaatgcctgccataccacattcactgggaacttcaccactatggggaacgcatccaactcagaactcactcacttaatagaaggagaatctttttttttttttttttttttttttttttaaaaaagaaagatggggaaaaatagggaaaaagatacgagcaggtacatccatcaaacaagaacattattttcttaatggaatcattaaatagatgtgatagaataatatggtacaagattaactttaataattgggtaatacaacagtatttagatatggaaacaacctcaaaccacaccacagtgatattaaaaaaaaaaaaggccggggggtgggggcgtggcgctgctgggcgaggtggctcacacctataatcccagcactttgggaggcccaggcaggtggatcacctgaagtcgggagtttgagaccagcctggctaacatggtgaaaccccatctctactaaaaatacaaaattagttgggcatggtggtgggcacctgtaatcccagctactcgggaggctgaggcaggagaatcacttgaacccggaaggtggaggttgcagtgagccgagatcacaccactgtactctatctagactgggcaacagagtgagactctgtctcaaaaaataaataaataaaataatgagaaaactaagaccacataaaatagttttctcactcaagggccatttagggaaaagaactgcaacgcagcattgagtttcctggtgaagggggtggcaagtttgtgctctaaaaggaaaaggcagaagtagaccatatcccagggtctatggatgcctctcatgggttgtctcacttcactaccatgccagacaaagaacatgctagattcataaacatgtagacaccaagggttaaggccaggatttgaatccaagtcatcctaactgtaaccctctttccatgtcaggtcactccattgttgatgttcctggaggatgaaaaacagctctttgtagagttcaaacacaatctacaaacaagtcttaagatccaaactgaagcatctcatttgtcaatatccctttgattagattaatgacttgatatacagtcttaatagaaatcaaatgagaagcaagacaatattcagcatgttacctttttttttaaggaattagtgggctgacagcaaaaaaattagtaaaaaattaatgaatctcccactaagtgatatggtttggatctgtgtccctatccaaatctcatgttcaattgtaatccccagtgttggaggtgaggcctggtgggaggtgatcgaatcatgggggcggatttctcatgaatggtttagcaacatccctctgctgctgttctcatggtagtgagtcctcctgagatttggttgtttaaaagtgtgtagcacctcccgtctcttgcaggcatcctcctgctttcgccgtgggaagtgcctgctcccgctctgccttccaccatgagtaaaagctccccgcagcctccccagaaccagaggaagccatgcttcctgtacacagcctgcagaaccgtgagccaattaaacttcttttcttataaattatcaggattcaggtatttctttatagcaatgtgagaacagactaatgctctaggtgatccagacttgaatatggaccatatccaacaacgggtattaacacttcaccacgttataaatcctgcccagtgctttattccagaggagggagcacagcagcacagtgggacaccatcctagatgggcgggtcaggcctcctccacaacttacaaacattcgttagcattagctcttagcccctctcttccaatgcacaattttgtcatgaaggagagacactggttgctttatctggcagaggagcaccatataggaaaagctggagggaaataaatgcccaatcactacaagactagaaaacaggatatatgaaaaaaggataaagaagttgtgacttcacctggtcaagagggaaggatggggatagggaataaagaaggtatacaacaatctttaagtcctagagggtcgaccacaggaagctcaaggaatctagtatctgtggctcattagtggacccaaacaggaacaggttcaaattatagcaacagagaatgcatgaaacttagaaaatgtttattttgggcagatgggtaattaatggtaactgtacaatcactgaggctaaaaatttgattttgctggagatattatatctgatcatgctactctatgtcttagaaacttcctttggcttcctaatggctactaaatgaaataatataacctggcacatcatttcatttagcaggcattaggaaggaccttatagggctataaggccctagcccacctttcaggcgtcacctcacctgaaggaccccttaagaatatcttacaacctaaattcccagaatgtatatgaattttctatggattttctcatatgcatgatattcacaatgcctgccacccatttactcatgcttatcaaaatcctacgtattctttaaaacccatttcaagggccaggcgcagtggctcacgcctgtaatctcagcactttgggaggctgaggcgggtggatcataaggtcaggagatcgagaccatcctggctaatacggtgaaaccctgtctctactaaaaatacaaaaaaattagccaggcatggtggcacgtgcctgtagtcccagctacccgggaggctgaggcaggagaactgcttgaacccaggaggtggaggttgcagtgagccattgcactccagcctgagtgacagagcgagacaccgtctcaaacaaacaaacaaacaaacaaaacccatttcaaatgccccttctgccatgaagcttttcccagtcccagtggaacaccccctctccattctgtgacatgcctgttgctctgtgcttgtcttgtggcacttcctgactcctcctttgatcaccacccatgcactttaaccccctgcagactgcaagctcctttggggaggcatgatgtcatagctgtacctaacttgaagttcacgtacttccctaggaggctgtcaataaatgtttgtctactgaaccaaagtgccatcattctttattccaaggagtctgccctggaatcatttaagacacctttccattgagccaaaaaatcacctcagaagttctgctcgcatagccctgacaattccaggtgaagatggcttcccaatacctggataataaatctggcaccatttgaaactgattcaactaaacagagatttttttccgagtatcaatgtgcaacaagatacacaaatacaaataaggactttaaaactttaattgaagcataatttatactcagaaaagagcacatgtaataagtacaaagtgaaataagtactcgatgaatttttacaagctgaacacattgtgtgaccagcagccagttaaagaaatagaacagaagcctcccttgtgccctccttcaatctcaacgacatcacctccacctccaggggcaaccatgatcctcacttcaaaccgcatacattagttttgcctgttgtatacatgtattcttcttgtcatttttcactcagcactgtttgtgagtttcataagaacttggttttgccctcctggagctcacagataagacgagatgaagttatttaaaatctggctggcattctctattgagaagtccacaacaacatctagaggtagaaaggttttcatattttaccttaccaaaccgagcagtaaataaacacctgttcttactcctttaattctcaactgcatcagggctggtcatccaattctgagtctcaaggcaaagcctcatgctctcacagacctctcgttacaggacagccttgtatgcacaggaatgtttatgcacagatggccaaatgacttttggcttactttatgatttaacaatgctttgcatgttctcaagagtccaggttggcgaaagcaacagcatttaaagccccaaatcaatcgatcttactgcttgtcagcaaatctcagttaaaaatgtttgatgagggtataaagttggaactattactgggctgctccttttgcccttttataaccctagctagcactgcatgggataattgagagacagctacacctatcattgttagatgcctgtaaattccctgaacacaaactgaaattacatgtgcgtgctaaaagaaagctgccagtcctccacccttcgtttaatccagacttggcactgaccctatacaatacactatacattgcagcttggtttcagggttaggacgcaggaaggacaaaggtttctggttatctagactcagtgtacactgtgtggatcaggacactgtgtttctgtttgggcgctgacatttactatgtatgtgttcttgggtaaactgagtcacctctacgggcttccatttctgaatctatagaacaaggagacagaaccagacaattcagaactaatactgcacaactccatcaagtgtaatccaagctatcattactgtgagacagtactgcatcataaaaagcccaagggctccggaaacagactgctttggtttccatcttggcaccactcttaagagctgtgggaccttggaaaaatgacttagcctctctgtgtctcagtttcacttctgaaaatggacataatgattcttcaaagagttgtgaggaataaatgagaaaatgtatgtaaagtgttcacctcttcaagtgtgacctcctggcacactgaatgatttcaacaaatgtttgttactgttatcattccaatttcattctaaaatgtacctaaattcaatttcatttaaaaatgtatgtaaaaactgaaagggaaacaaactccaaagtgttaacaatgctgacctttgcaccgtggggttatgcggggtcattcttttgtattttcaagtcttttaaaaataaaatgtactactgttttggcagaaaagactttgcttttaagaatgactgctagcctctttcaattcttccagaatacttggctgttattactttagatgaaaggcagatccgcctactgaaacgccattcctcattgtgttttctttccggcactggagacatttccactgtcaccccaatgctctggaacaaaggctgaggaaaagcctgagtcccggacagacgtcaaaatctaaccctgcaccacctctgcaatgaaccaggcctccagcacaacacaccaagttagctcaccttactcaccggacacgggcacagcaactcagtcaccaccagtgcggcttggacacactgtgcaggattcacggaaggctgtctcccaggacactctgtattaacccgctaaagctccagagggagatgaaccaaaaaggaagggtaccaacacagaggcacaccacccaccccccagcaaacagaaccagaatgtagggctcctgtggaccctggaacgacagggactgaggcaggagtcctctgaggttctggaggccacagagtagccacaatgtgtagggatgcagagctatcacaacaatgtgacagatgacaacggcctgcttagtctcaaggctgaagacaatgaacctttgcttaaagaaaggctgtttgagcctcaggcattacaagaaaagggtcagatccttcaaatgggctggcatttccaaggcaacaggtatttccaagtacatgtgagtgaagatttatgcataggtccacaaggacctgcacgttcaatacctgaaggcttttacaagtcttcgtggccttggtatgtaagtcagtatcactgacattttttactattaatcactttagctgaactctatttcaggtctaaagtctaggccaaccttgtccaatccacggcccagcatggctttgaatgcagcccaacacaaattcgtaaactttcttaaatcggtatgagattttttttttttttttttgagacagtctcactctgtcacccaggttggagtgcagtggtgcaatctcggctcactgcaacctccacctcctgggttcaagtgattctcctgcctcagcctcccgagtagctggaactaaggcacatgccaccacacccagctaatttttgtatttttagtagagatggagtttcacaatgttggccaggctggtctcaaactcctgacctcaggtgatccgcccacatcggccccccaaagtgctgggattacaggcatgagccaccacgcctggccagtatgaggttgttgtttttttttagctcattggctatcgttagtgttagtgtattttatgtgtggcccaagacagttcttcttattccaatgtagctcagggacgccaaaagattggaaacccctggtctaggctgctcctatgatatgccacccagaatgtgctaggctttgccatcgtattaatgtcaaaatctcagtggctataaaagaaaggcttattccatgcaaatgctagaaagttggctgtgagtcagtgaggggacccaggttacggtggggcctctaccgtctggacgttctctaaaagacagagaactcattacactgaccctacctaacttctaggggacaggggagtataatcctattacatgcccacgaggtaaaatatcatgttagtgacatgtgtagtacctttcttaattgttaaaaactctctgaggtaggttctactattattactattttataaactagtcacagagaagttaagtaaattgcctgggggcacacagccagtaaccggcagagccaggctggaaattctggctgtctgtctccagtgcctacctgcctaaaaatgactgaatacttttattgtgaatcaggcactgtgctaaagattttttaatgcattcatatattcttcacaccaacccttttatgagaaaaccgagacttgtaaagggtatgtttcttgaagcccatgaataataaatagcttaggtggggctcaactcaggtttatgaaatatgcaagacttagcaagatctgtaccagctcagccccagatcccgcgagaacctctgcaatgcccttaacatggtcatccattgcatggataatctgggcttcgtttagactactctgtcagaaaattctccctcaggctgaacttgaaataatcgtggctgtaactttgtgtccacagctctggagccacatcagtcaggtctgatatagtctataaaatctattcttttttttttttttttgagacagtctctctctgtcgcccaggctggagtgcagtgtcgcgatctccgctcactgcaaattccaatgttcaagtgattcccgtctcagcctcccgagaagctgggattacaggtgagtgccaccacgccctgctaatttttttttttttttttttttttttagaagagatggggttttactatgttggccaggctggtcttgtactcctggctttaagtgatccactttgttccatattctaaaatataaacagtgatttgggccaaataactttatgaagataaaaaagcttactgcttgtattggaacaatgcctacgcatttacaatcactaagaggagagagagaatgagattaaaaacagaagataaaaataaaagataaaggacctctggagaaagaagccctgtccctaagggcctagcaagtgaggccatgtgggaaaaggcaaacagcagataagccctggatctgcctggagggaagggagagtgcccttctctgtgctggctgatacagctgggagaccgatgtggggctcagcatggccccacagtggggtacctttgtgtgttctcccagaagaacaggagcttttctatcagaaacaagcggggttgtgtcctcacgcttccggagactggagttgctcctgtgttctcaggagaggcgggagacggcgcagggtctgaaacatgggggacgatgtgcacccgcaacaaactaccaacactggagaggagcccctggatgttatcgggctcagcctagatgagtgagtttatgtgaaaatgagaaatgaccgagagcttcaaggcagatcacatgcttatgatcaacatttaaatatgatcttgggagatgaggaagaaaccgcgactactatagaaattgatgaagaaacatacgaagagatatataaatcaaggaaacagaatattccaatgctctttgtcctgggagatggtcgtgctggttgcccctccattgacagctggatgaaacaatttgtcctgtatggaaaatacgagacttcgtacagtagcctttctaaatgtacaaggcattcaaaagagaaacctgcatacattctgatattaagaaataattctggggattctcccactcctgaaatgaattgatttgcagataattcacaacttcttaagctaaatggcattttaacttttctaaagctcttcaataaatatgaccaccaagatgcagagctctttttcaggacttgttttgctctgttatccttacagacaatttctgatttttttttttctttaaattaaaattggtgtttcctcgtaggaaaaaaaaaaagaaatatataagatacagtggctggatgcagtggctcacacctgtaatctcagcactttgggaggggagattgctttagcccaggatttcgaaaccagcctgggcaatatggtgaaaccctgtctctaccaaaaaaaacaaacccaaaattagccaggcatggtggcatgcacttgtaatcctgactactcgggaggttgaggcacgagggtcaagagcctgggaggtggaggttgcagtgagcatgaatcacgccactgcactccagcctggcagcctgggcaacagagggagaccctgtctctaaataaataaatatacatatatgagagatacccctagcccatctccctcttgctatcctggggtcacacttgacatgcacttgcaaaatgtctagccagagtcagtgaacagggaagctaactgaaccaccggatcccagcatccttgctaacagagctaacctatactagaaaaataactccaggggctggataaggctccttgttatctgttactagaaacatattactaccttcatgggacacctacacagaatattcaatacctacatttgctagaagaaagctgcactttcccccactgtgtgctggaggggaaaaatcttaaggaccttcatatgatatccagaaggacattttattaggagagtgtcttagtacagtgtttgttctaacttgtttagacaaggaacatttcctttcatagttcaggtctgacaatagcacactctgaactttaaataagtgcaccgtgtacagcacgggaactgagtcaatagttttgccataaaggttttattcctcgcatccccccttcttcctctcttggcatcactgacaaaagaaattctgtagcctcaagaatcctatttccggccgggcgcagtggctcacacttgtaatctaagtactttgggaggctgaggtgggtggatcacttgaggtcaggagtttgagaccagcctggcctacatggtgaaaccctgtctctactaaaaatgcaaaaaaaaatgagccgggtgtggtggcaggtgcctgtaatcccagctactcaggaggctgaggcaggagaatcacttggaccccggaggcagaggctgcagtaagccaagattgcgccgctgcagtaagccaagattgcgccactgcatttgagcctggacaacaggctccatctcaaaaaaaaaaaaaaaaaaaaaattctatttcctgagagcaggtaaagtaaaatctcattactctggaattagggatcatttggaacaggagctagaatacacatatctttcatggcccaatcctttctccagacactgcaaattaatagtgtaaaggagattaggcagtgtttaagagtctcaaaaacaaattcttcaagcatcctcaagcactcacaaacacctgatactgtaattagagataattatcttcggccaggcgcggtggctcatgcctgtaatcccaacactctgggaggctgaggcgggcagatcacctgagctcaggagttcgagactagcctggccaacatggcaaaaccccgtctctaataaaaatagaaaaattagtcaggcatggtggcaggtgcctgtaatcccagctaatcgaaaggctgcggcaggagaatcgcttgcacctgggaggtggaggttacagtgagcagagattgcaccactgcactccagcctgggagacagagcaagactctgtctcaaaagaaaagaaaaaacaaaaagagccaggcatggtggcgggtgcctgtaatcccagctactcaggaggctgaggcaggagaatcacttggaccctggaggcagaggttgcagtgagccaagactgtgccactgcattcaagcctggacaacaggctccatctaaaaaaaaaaaaagaaaagaaaagaaagaagaaagaagaaagaagaagaaggaagaagaagaaggaagaagaaggagaaggagaaggagaaggagaagaagaagaagaagaagaagaattctatttcctgagagctggtaaagtaaaatctcgtcactctagaattagggatcatttggaacaggggctagaatacatatatctttcatggcccagtcctttctccagacactgcaaattaatagtgtaaaggagattaggcagtgtttaagattctgaaaaacaaattcttcaagcatcctcaagcactcacaaacacttgatactgtaattagaaataattatcttctcattaagcctctaccaggaaacagtggtaatctcctttgagttacacgcacttaaaaaatgtatctttcttcaaaacagcttataaatcacacttccaataaatacaaactaattctttacaaaattagtctgacctggtaaagatttgtacgtactaaatctacgtaagaattaaagggggagaaaggccagattcagcaagaatgtcccttgaaaagtagaagggaaggctacagtgatgaaaatagaccaaccttacatgagcaccaattgcaaggcaaggacagccacagtccctggggaggaaactgtggagggatgtgaggcaacacccaaaaaaggcaacttctaagaggagcagggagtctctggggaccctgtgtaccttgaaaacgagcaagtttgggaaagggaagtgtacatttatttaatatctgccccttacctctccaggcctgggaactaagaaccatgccttttaaatttaaatatatatatatatatatacacacacacacacacagagtgagagagagagaggtctctcactctgtcacccaggctggagtgcagtgataccatcactagctcactgcaaccttgaactcctgggctcaagttatcctctcaccctaacctcccaaagtgttgggattacaggcatgagccaccgtgtctggcagaaccaggcctaattttaggactaaacacagaacaaatgtccactgaagcttttagttcctaactcagaaggagagaaggggtgagcaagagctgctaggcactaaacttaaggtcttttgggggcagttctggaaaatttcccatccatgcttgttcattcccataggtttctggcagtgtctgtcagtaaaacctccccaggaagaggggaagccagcaaggaaggggatgtgggaatatcgagtttactctgggagaaccgcccccaggaaaaacgagtctctgaggcccttagtcagagagcagagaaaagaggccaagcctgggagcagagggtctgcctactgccctgccctggcagcccagtcttctacatttcccatcacattcattcaccacctcacttacccctaaaacacacagggtgggccttcttagaagggacctgtacttagtgtaagtttctaaacgatagttacaaatccagcacctgtcttgcagagtctttcggcatctccagcctgaacgaactctatcaggccatgctgtgttcattataggcaccctgcacaaaagggaaagtaacttgtctcctaaagtatagcttcctagataagtaagtgaatataacaagggtgtgcagtgttatctatcagataacaataattgtttccctttttgcctcggatgctaggaaattcagaatcaaacgtagagtaactgttagatctggtgatcagcctatatgttttccccttctttttcgacttttggatattagcactactctaactatattttccatgtgtcttatcataatcataatcttagtggaaagaggtgggtatactttaacctgcttattaagaggctaggtatgtcatcttgcccagagatgaacactataccagcattcctatgtttaatagggggaatgtggtcaaccatacccagctcatgaacctgcactgcgacttccccatccccattcctagagcatccagagaaagccacataatggtcacaacttggctcatgtcctttgaaaagttgctatgtaagactgagccaggaaatagcgtttggtactggagccccaaagtgcattcccaaagcatatgcaagcctcataattaaatttttctctgagggtgagggtttcatttattttttggtagtataacaaatactggagggaaaaacatgtactggatgatttgcagtatagaattttcttataaatggatcagaatactactagctatcagacagggcttagaaataagtagctattcaagagtagaagaaaaactgatcaacagtcatttcttcgccttttgcaatgctgaagctaattttgcacagttttattttttctaatatatgccagcagtattatcaccaaatggcaattagaactaaaaagctgcctttagttgtatcaaaataatatagcattccacttaaagaaaaaaaaaatgtccatgaaaagtacattcaatcgatattttggtacagtatttctggcatagaaaaacagccttactttgaagttgtgctcggccttcaaatgaggccctcaacataaaaactgatttccttgggttgaataaaatcatcttttcaaaagataaatcagattataccctgttctctcccaaagatctttaatgttccctaaagtgtgaaatacttaacaaagaatttaaggctctgttgatcagggtcctatcctagtcattttccagcaggtccatccatcctgatgttttgagtacatctatgtatagcccctagggtaaggctggacctttatatacactctcctttaatcctcatatctccatgtcattagctctgccttgcagatttgaaagggggaggcatcaaataagttatggtgacagctaagaagacacagagccaggatttgtactaatgtctagtttttaaccttcatcttattccatgtgtgtgacgagccagtcacacctgaacactgcatgcactttgctatttctatgtctgttcctcaccctagcatggtctccttcccaattcacctttcaaggaccaagtcaaacgatgtctcttccacagaggttctcccacccccacgcccagctaggattgactgcttcctttgtgcttctccccatttgcactgactcctcatacagtgcttattcttccaagtatgacaggtatttgaataacacatttgttcctccaacatttggatgcctccttggagagaaggatcatctatcatctactaggccacctgtgtctgctccacactctttcctcaataggaccttagtgcttattaagtgaatcagttgttgactagcagccaactagggcagccagttgtttagggacaagtggctgccctagttgtttacatttgctcagctgtttgcaatgagatcaagaagaacctgcaactgaggttgtgctgggttgctttcaaaacagaccgaaccacgaatggttcatggcttgtgacacatgtgagaggtcaaataggaaactgatgtttcatggctcttcactgctccaagcagaatataggtaatcaattaccaaatgataaatattgccagccatggtggctcatgcctataatcccagcactttgggaggcagaggcaggaggatcactggagcccaggagtttgagaccagcctgggcaacacagtaagtcactgtctctattaaaatacatatatatatatatatatatatatatatatatatgtatataaattagccaggcctgctggcgtgcctgtagtcgcagctactcaggaggctgaggtgggaggactgattgaacccaggagtttgaggctgcagtgaactatgattgctcccttgcactccagcctgggcgacaaagccagactctgtctctaagaaagaaaaagaaaaaaaaattaagatctcccacgtacagaatatgcaggtatgatcctttcctccctaagggaccttttccctgtagggaccgttgtaattgtggcagacaactcaggtgcctcctcctttggacacacccatatgttctgactcaatccattatttgtgatggcttaaggaagcagtcttaaataatttctcaggccaggtgcagcagctcacgcctgtaatcccagcactctgggaggctgaggcaggtggatcacctgaggtcaggagttcgagaccagcctggtccaatatggcaaaactccatctctactaaaaatacaaaaactagccaggaatggtggtgcatgtctataatcccagctactcagtggggctgaggcaggagaatcgcttgaacctgggaggcggaggttgcagtgagccaagatcgcgccattgcactccagcctggacaacagagagaggctctgtctcaaaaaataaataaataaataataaaaataaaataatttctctaatgcaccaggaaggttctgaaatgtagtttcttgtcacttaggaaatcacaatttgatagaacatgaacacagaaatgaaggaattcttttaccctccaaagtccaagaaggcaacgacttgtttaaaggacacaagcaggcctcaagaagaatggctcaagagaggacagaatcttgccaggatcattcaagtttatcagaaaagagaagccaccagttactaaagacttatcagcatcaaataatttcctaaatgtttccggtaccttattttatttttcctttcaagaatctgatattagaattaaaactcccatcttctcagaaaagtgacttactaggactcaaagctaataagtggcagagccatgtgattccagcccaagtgcacctggctccaggaatatcctaccttttcttgagctctttctgtgtacgccaaaccatttatcatacatatacctgtttcctttaacccctaaagcccctcaaatctacttagtttactcaaatcattgtgctaccattaaatatgcaaatgtgaaaaatatgtatgatagagaaacagaagaacaaaaacagactccttcagactccttggtgccacgaggcaattactggagatgttctcaatttggcattcataagttctcaattttggcattcataagtaggagaagaaatgaccttaaatcccaagataccttgcataataaaaaaatgtgggttacttctgttttacccactaccaaagatcctcaaggccagcttatacataaactccctctttggctaaagctccagcaggttctacagtcattaaatgctctgccgtcaataagaggaggctttcttctcccacagccacagacgtttaaaggctccaaagattcgtgtttcaggcagagaacagtcctcctctaagatcatactgttttgtgatctgggataaaagaaacgacaaagaaataaaacaaatggtgggctgtgattttaaagataaacactgtatcatgacccttcttagaacctaagtctgtatttgggttggctgtatctccaaaacacaggcaacagacttccaggacccactcaaaacactcgcagcaaccaggtagctcagacctcatgggaaagctctgattccagagccatgtatcctaaataaaggtttgcttccagggtggtagcataagttagtggttaaaggcacagatttcagagccagactgcctaggttcagcactgccatgtgaattgcctcgtcttgggcaagttactttctctatgctttgattttctcatctgtaaaatgaggacagcagtatctactagttcacagtgtgactgtgaggattacaggaattcatgatagggtcttgtacagagtaagtgctataagtgttggccatggtttattaaacctaacataccccagataggtgggttcttcagaagactccagagccaagaacagtgatgctgctgtcaccatcattaagctctttcaacagaagccaatcattgtccccgccgcccccacatgcacggagtatttgtgtgtacacaaactgctgcttatctatgcatcttgcagcagaaaggagggtggaaagtggagaacagggtctcaaattcataccagaaggtcccttaagaatcaagtttcaatgaacctgaacaggaaagataatttttaaaagatacccccccccccgcccacacacacacacaagcctaagatactgctttacagagtcttacctagtatttaatttgacttgtataaaggtactttatgtaaaataactaaactttacattctcaacagccagctcttaatgcttttataattgtcatgagttttctatattgctattttcagtaaaactaggactctgaagtaagaccctaaagacagatgtctaacgttttccacctccaagtctttaagcaaaacaagagaaaatcgtattagaaagacatatctaatgattataacttgctacttcctctataaaacctccttagcctactttttgagagtattatggcatgaccaggcacagtggcatgtgcctgtagccccagctacgcaggaagctgagccaggaggatcgtttgagcccaagagttggaggccagcctgggtaacacagcaagaccccatctctaaaaaaaggagtggtggtgggggaagagagagagagggagagagagaaaatgaatgaatatgaattatgcttggaagcttgtttttacagatattatgttgggggtttggggactgggttatacttaattccatgaccttaggggtaaacagcataattattttattgatgttctctctccttcatctcttctttaaaactgtcaccaaattctggtttttttttttttttttttttggcttggtggtttctctccagattgacccttccttgctatcctcagggccatctatcttaatccacatcctcatttcctatctcacctatagcaagggcaacagtttaactgggtttccttgttttcagtgttctattccttccatctagtctataggaagtcattacactgatcttctaaactcccacttccatcacactaaaacactgcttaagatgttcaacgattcttcctttaataaagagattggattcctccccttgctggtacttaagccctgagtaatttttcctattcaacttccaatgtcttcctccttccttcaccatccaccaagtggatctcagcactgtggtacatgaacatatttctggactttctgtttcacctcaacacttacaccattcccttccggacacagcatctcaaggcctctgtcatatccaaatcctaccattccttcaagatctcttccatgaggcctttccaaaggacttcttctccttcctgatccattttggctcttatatatactgttaggtgggttcctctttgttttatcatctttgctgggttttttactagttactgaaagcattcactttctcaggtaccatacaacactcagcacagaacgcgcagtatcactgagcagcaaatacctatatacgaacccaatttctctatgtcataacccagtatattacaaattctgaatgagacatccaagaaagaaatacatgtttaccaatatatacatacttatgtatgtgcacatatacatgcacacacctaattaaaacaaaagttttgtaaaatactacttatctttactacacacaatgtaactgtatttacagctacctaattttctggacaactggatattagaaattataattacctttgttaattttattatgtagaaaaagtccttgtttgcagatacatattagaaacaaagtgccctggccgggcgcggtggctcatgactgtaatcccaacactttgggaggctgaggcgggcagatcacttgaggccaggctttcgagaccaggctggccaacatggtgaaagcccatctctaccaaaaatacaaaaattagctgggcatgatggtagatgcctgtaatcccagctactcaggggattgctgaggcatgagaatcacttgaacctgggaggcggagattgcagtgacccgagatcatgccattacactcactacactccagcctgggcaacagagtgaggctgtgtctcaaaaaacaaaaaagaaggctgggcgcagtgactcattcctgtaatcccaacattgtgggggggcgaggtgggtggatcacatgaggtcaggagtttgagaccagcctggccaaccctatctctactaaaaaattggctgagcatggtggtgcacacctgtaatgccagctaattggggaggttgagacaggagaattgcttgaacccgggaggcagaggttgcagtgaaccaagattatgccactgcactccagcctgggtgacagagtgagacctggtctcaaaaaaaaaaaaaaaaaaaaaaaaaaaagagaagaaaaaagaaagggacctggtgtctgtatatcacttacttttaacaggttacaaacacaaacaaagaaaataagaacattttaaattgttgaatctgggtaaggtagatgagtatttgctgtgatgttccttctgcttttccatataagaatataaagtgatagttgttactcatcaaatttatttcatgaccataatcctgtttgaaaaacagtgtgttataattagaaaaaagacaagccacttgtccctgtgtttgttaatcatacttaaggaaggctctaacattctgaagaacgttctgtggttacttcctggcctataaaggatttaatgttccattgctgagtctactaatctctccttcaaaatcctttctacaaaacttctgtgaatcattacgaccttagcagaaaggtataagattagggattggttttttagttgcagagatcacagactcagaacttaccctaagacctcgcatactgagaacaatccttgtggttttcacagggctttaaaataactaaatctaggaacatcaaaagtttaagacagtgcgctaaagctgaaagtaccatagcaaacatgtgcactggttacattttccccttccttttcctttaagaataggttttaataaaagacgaagttccatgaacggtcagtaacatctcatttaattgacactaagggaagtattctagatgagtgaatgaaacttgtagataactgaaactccaagtcttgctaattagagatttctagattttcttctttcttttaatttcttttagagacaaggtcttgctctgttgcccaggctggcttccaactccggggctccagtgatcttcctcagcatcccaagtaaccgaggctacaggagtgcaccatcatgcccaggtggatttctaaatttccaagattgttttcctgttgactatggacatccacataatcaagtttgaattgtgacacagcaacagtgacctcaagaagacaactgaactagatcactcgggggacctgggatccaattaaccttaggtcctcgtaaagaagcaaggtggctgaactctgcaaactctaagggccttgcagctctcatatgcagcagttctgttactattaggtctgtaaggctggcatcctgcacgcaaaatgccaatagccttgttcataaaattattagcacagaccaactgacacaaactgagtattactctttataatgaatcttattttttatttttttgagacagagtcttgctctgtcacccaggctggagtgcagtggcgcaatctcggttcaccgcaacctctgcctcccaggctcaaacaattctcatgcctcagcttcccgagtacctgggattacagacgtgcaccaccacgcctggctaatttttttatttttagtagagatggggttttgccatcttgtattttagtacagacggggttttgccatcttggccagggtggtcttgaactcctggcctcatgtgatctgcctgccttggtctcccaaaatgctggtattatgggcatgagccatccctttataatgaatcttatttaccaaaataaaatttaataagcaacaagtcgttaaaaaccatatgcaacaaaaggaatgaaaaattgttcaacacacaacccagacaaatctcacgtgtgtaatacttaatgaaagaagccacacacaaaaatgtgatggtgtatgattagcgtgctgcggaggtgagaagagtggttaccctttgcggggaagtaggggtacggagaatgattcaccagtaggtggcaccagggagcactggggtgctaacaacattgatccaggtggcagtcactcaggacatacacataggtaaaaattatccaactgtacatttaagatgtatacactttactgtaagtgaaacctcaaaaaagtaataagatgcaaaaaaacttagataacaaaaatgcaggagctgtcaaaactattatctttatagtacctgtaacattacaaatgcacaatgaataaatgttaacatacagtattgctcaattctagcaagaaaaaaaaccacttaaatttcattagcatgtcaacctgtaatgcattttgtcagctctttaacatttttaaagtttcccaaactttcatgacactgtctcataaatatttgtttttagaatactaaagagccaatgaaaaagagcagaaatccacacgtgtactactagcaaggcattaatatctgtggtttaactgaatacatcagatttagacataaaaatatgcaatttagaattctgcaaaatgcagcaaaatcctaataccatgttgatccagattgctaatgccttgttttattacataatagtcatttagaaagccaatgtttctcaatgaggctgaatttaactaaaagcacacaaagtacaattagggcttgcttacttagaccaaattgtttttatgatagctaatggaactgattaatttaggttgcaaaccaagccccctaaaatacagaattgctacttgaaaatgtttttctgggcatcttttgtgaactaagtcctgtgctgaaagaactggagtcagagaaatatgataagctctgccctaagaggtcactcttggggcagggaggcgtacagaattaaaaaatgtaacaaggccaggcacagtggctcactcctgtaatcccagcactctggggaccgaggcaggaggattacttgaacccagcagtttgagaccagctagggcacaatagtgagaccccatctctaccaaaaaaaaaaaaaaaaaatgctgcgtgtggtagtgtctgtggtcccagctacttgagaggctgaggtgggaggatttcttgagcctaagaggtcaagtctgcagtgggccatgattgtgccattgcacttcagcctaagtgacagagtgagacttcatctcaaaaaaaaaaaaaaaaaaaaagaagtaataagtactataggaaccaaggggaggaaataagcagggggcttcaatgagaagcttctgagaaggtgataattgacttagaggcagctcaaaaatctgctgagagcctagcaaggagcacattgtatctgcagaaggaaaaactagaatatgtatttaggaaactaaaagttggagtgtctaaaattgagaatggctaaatgggtcattctaaatcaaggcatgattgagggctggggtgaaaaagaggtgcatggcaagcattcctaaagggaggcggcacaaggctcagaagaacaccgacaacctgcaacaggctctgcaaaccatgctaggctagacacctgaccatgcagacaaggggaagccaggaattttaaagcaggtggtgtttttataatcatgaaaataaaatacggagacatagagaatttggaatatcaaaaagaaaaggaggcttatcttaaatacagatactgtttaggttcttattaattttttaaaaatacagcactgtgactatactacacagagggattttggatttagttcaggtcacataagaatggttcattcatgaatctgtgtaattggtcatgacatgcgtatacacttgttgcataccaacattaagtaagcgtctatctgggatgctgggatcatgtaatttggacttttcctttttttaagcatcatttgaagctaaggatagctgagttcttacctaaaagaacactgtccatcacatatggaaaatcaggcattttgcctcataaatacacaattcataatttattccatctccactcatctctcttctacaggctcaatactattcaaactccaattattatcacagccttggtactttccatcgggggctagataaagaagagcaaagttttcacctacgatgaacaaaatggcaggacttaaagatgactttcctgaagagtgcaatgccttctgtcttttatttatggactgaaaagagaaatccctcaatgtacacggcaaatcacattcccctcactctaagccatacttacggaagacatcccagattctcctgaatgcaggaaagtaccacggttacaccaatctactccgtcaaaccaggtactaactatgactaaaattatatgtggaaaaaaaaaatccaaatgagattagtaacagaaaacaaacaaacaaacaaaaaaacaagtatgtgtgtaggggggtggatagaaggcagtcttgaaagcgtcaatgctagacgctttttttctctttactgggaattgcaatcaaccaaaccatgggtctgtacctgacctagagcctttaacaatgcaacaagactgtgagaactctcactcagggacacctgctcttagcctattatggaactactgcctgtgtgcagaagtatcatttggaaacatgaattttatgctcaaagggtaaaatgcccaagaggctttactcatgccaagttccctaagaaccatggggcttctttttgccttgggaaaggaggtgaacttttttcttattcttttttttttttttttgagacaatctcgctctgtcacccaggctggagtgcagtggggtgatctcagctcactgtaacctctgcctcccaggttcaagtgattctcctgtctcagcctcctgagtatgtgggactacaggtgtacaccaccatgcctggctaatttttgtatttttagtagagatgggtatcgggggaaccagccccaatatttcaaagtaggttctattttccctaagtgtcagccggtctgagaaataaagagaaagagtacaaagagaggaattttacagctgggcctctgggggtgacatcacatattggtaggaccgtgatgaccccgagctgcaaaaccagcaagtttttattagggattttaaaaggggagggggtgtacgaacagggcgtaggtcacaaagatcacatgcttcaaagggcaataaagatcacaagacaaaggcaaaattagaattactgatgagggtctatgtcctgctgtgcacgtactgtcttgataaacatcttaacaggaaacaggtgagagcagagaattggtctgaccaaaatttaccaggctggaatttcccaatcctagtaagcctgagggtactgcaggagaccaaggtgtatttcagtccttatctaaattgcataagacagacactcccagagtggccgtttacagacctccccccaggaatgcattccttccgcacggtattccttgctgggaaaataattcagcgataccctcttacttgcacatccatttataggctctctgcaagaagaaaactatggctctattctgcctgaccccgcaggcagtcagaacttatggttatcttcccttattccctgaaaatcactgttattctgttctttgtcaaggtgcactgatttcatattgttcaaacacacgttttacaatctattgtacaatagtggtcctgaggtgacatacattctcagcttatgaagataacgggattaagagattaaagacaggcataagaaattacaagagtattattacagaagtgataaatgtccatgaaaccctcacaatttatgttcagagattgcagtaaagacaggcataagaaattataaaagtattaattttgggaacttataaatgtccatgaaatcttcacaatttatgttctgcccatggttccaggcggtctctccattcggggtccctgacttcccgcaacagatggggtttcaccatgttggccaggctggtcttgaactgctgacctcaagtgatcttcccacctcagcctcccaaagtgctgggattacaggcatgagccaccgtgcccagcctgaaagaaggtgaacttaattagatgccaaggattgctaactacataacagtatttacaatgtggtacccttgattaatctgactcagtccacctaccttaatcagcatttcgaaatgttaggggaccatctgttcatgaactgagaacattatgaagtctctcattcaactcaggatatcaccctgaacttgatgaactaaaatttatttgatttctatactttaatgactctgatgtcattcattgctttcaatgttatgactgatgttttaataaggccattgtaaatataccataagtaccacaatctctgtgtcagagaaacactttgcttgattgcttttcttcctggataaacatgtagtgaacaatcagtgaatatatacttcatattataggattgactcaaagagttcaataatatctaatcagaggcaagggtatgtttattaagggacacatccttcaaaggaatcaaactttatatataaacagaggtaaagtgacaagcgtaattagacaagaattaaaagacaaacagatttgggtaacatcatttattttccacttatatagcatctttcattaaaaatgtcaataaatctttccaactgttcttgttcccacctaggatatgatgatctgaaagtcttacacatctgttctgaatttcacactccataactgacagctattcagtctttgggactcatcactcaatctcccctctcccttgcctcccacatactctaacatcagacctttttgctccctccaacacctgacacctgcctggtctaggtctgttacactgcacacctggaccatgcagcaatctaactcctctctctccaggttgatcctctcagtggtcaccaccgtagactggctacaggatgaggtttaaactcctgaagccggaagccaaagtcctcattatcttgactcaaacctgtctctgtccagatcctgtactctcagcctcttagctggaccacatagttggatccaggtgaactctgtccagctcaagcagagcatgccaaggtcattttacctaactcacttcaccctttattcaggagtgccacatgtatgtagacgttactgtgccttccacctccaccatctactctgcgcctgtatgtgcacatcagcatgacagatgtttgacacattttatttctagttctcacctcattatactagttatgtttagtgtatcaaacatatcaaggaatttgggccaggcgctgtggcccatacctgtaatcccagcactctggcttgagcccaggagttcgagaccagcctggacaactaagcaagacgacccctgatgccctccagtctctacaaaaaatttaaaaattagctgggtgtggtggcatgcacctgtagtctcagctacacagaaggctcaggcaggaagatcccttgagcccaggagttcgaggttgcagtgagctatgatcacaccactacacaccagcctgggtgacagagtgagactgttgtctccaaaattaaaaaaagaaaaagaaaaaagaaatcaaggaatttgacaaggtcacaaactagggagtagcaagccagggtttgaacccaggtgtgattcaacagcctgtgttctttctaaaacctggggcatcctcatccccagctccctatttaccaaaacccagaggttccttcagagtctgctcaatttcacctctcccacacagtcacttctgatcaccccaagtccagtaatcagtggttactcagaacttctgctgctctgacctcatattcttagcaacttgattttttgcagccccagagcctcatattaacagtctcttgaacacagcaggcactcaactatcttacctgagtgattttgctattttcatattattttctatgggtaaaattatgtatcaggtaagataacttcagtaactgaataaaatcagtttcaataataagggcacatctatggtctcctaaactaagaacagagggcagggctaattcaacggcttacagatatcaaagacccaatcgctctccattttttcactacactatcctcgggccatttgcttctgctcacatggaggcaagagagctactgtagttccagaaatcacgtgtagacagtttctggctatagatgaggatacttatcttctttcatattttattaggaaggaaaacattttccagaagctcctcaggggtccctttggccggggctgagtcccatgtccatgccctagttgcaagggaggctggggaggcagcagataacattttcggcctccactccaggaacaggctctgccagccagggagaaagggaaggaaaagagtgtttggaaaggcactccacagggtttgcaaacaccacctcgaatggatattatgcaacgacctactctgtataaggaaaactcccccatccaaatagattatcattagaaagccttgctaatcaggttacaaacaaataatccagttaccatagagtgtatttgcactggaggtagaagaaagggaatcggaaccttctttagccaccaagtgtaaatacattccttttccccagtgttttggttacatatcataatctccttcaccatcatgatcaccacaaggaaagaagggctaggaagaaaaaaccatctagcccttttgggcttccatatagttctgaaaacaccttaaggcaggcaaaaaaaaaaaaaatttttttttcaagagatataaagaacagaaatggagatgaaaatatttacaagtcttctgcctctttctctgattcttctatgctgcttctaaaaaaatgatagtctgccacccctaccaccaccaccaccaccaaccaccccatctgctgccaattctgcaaacagcatagacatccatcaatagagaacctctttttaaaattctagtacaatgggaaatgatgcagccactaaaatggaaacggatctgaatgggctaccatgggaagctattcaatctaaactgttaagagagaaaagcaagacgcagggctatgcctactgtgcacgctcatctgtgcttaaacgaggggtggagggatttatgatagatatgtacaattgtatactctatgtgtatgaacatttctagaagctgtcttaagaactgtggatggtagttacctctggggaataggactgggaatctgcagacacagatactttttgttttatattatctttttgagagagtaattcatcttattttcatattaaaaaaaaatccccagtgcctgaatttcaaagtgagactaatatgcaaatacctgcaaaatttcattagcacacttaagatacttccttgtctcctccagtgacctatgattttactaacagtagcaaaataaataatctataggatagtaggcatttttgtaactcatcctaactgaattttgtttatgtaattacttttagaaaagtaactccctactgaaaagagaaattttaaatcccatttcccaaggaaataaaaccatggcttaaaaggtagttctaaaacaaattttatgggactaagctggaattgccaagtcataaatataagttttcaagtaaaagtcccattaaaatattgaatactaatgttacatctttcttaaataacttcataaaatgctgtctttttaagggaccaatgccactgaaatatttctactgagaactgggttgcccaaggctcacagctttgaatctgtatttcatgggcaatgatgttttccataaagactcttcactgagaatactcatacaagcagaccatggcagtgtatgataggcgtatatatacagttgtcccttggaatccatgggggattggttctaggacctcctgcagataccaaaatctgcgagtgttcaagtccctgatataaaatggtgtagtatttgcatataatctacatacatcctcctgtatactttaaatcatctccagattacttataatacctaatacaatgtaaatgcttgtaaatagttgtattttttagggaataatgacaaaaaaaaaaacactcggtacctgttcagtacagatgcaatttttcttcctaaatatttttgacccctggttggttgaatccatgaatgtgaaatccgtggatgtggagggccaactgtatatccattcatggcaactgaagggtcacagagttcatctagagactgtttacatatagttcatgtgattcctgaggctagactgttttacctgtgattctcaggtttggtgtttttgtttgttttttgagacagtgtcttgctctatcaaccagactggagtgcagtggtgcaatcacagctcactgcagccttgatctcctgggctcaactgatccccctacttcagcctcctgagtatctgggactacaggtgcacaccatcatgctcggctaatttttgtatttttttgtagagacgaggtttcaccatgttgaccaggctggtctcgaactcctgggtttcaagcaatccgcctgccttggcctcctaaagctgggattacaggcatgagccagcgtgcccaaatggttctcaagtttattttatttattttttttgagatggagtctcgctctgtcaccaggctggagtgcagtggtgcgatctcggctcactgcaatctccgcctcccgagtccaagtgattctcctgcctcagcctcccgagtagctgagactacaggtgcccgccactacactcggctaattttttgtatttttggtagagacgaggtttcaccatgttggccaggctggtcacgatctcttgaccttgtgatccacccgcctcggcccccaaagtgctgggattacaggcgtgagccaccgcacctggcctcaagttttaaagtttggttttgtccttcaaaaattgtttctacagctacaactacaaaaaaggaataatgttatctccttaaggttaaagtcagtttctcagaagacaaagcaagacagaattacttgcacttttaaaattttttcagtggttctaggattcattttaaaatgaagcaatgctaaaagcagactgcaaggtatatttgcagtgtttgattttaactgattcttaaaacattaaaaactgtttggcatttgagcatgtgcatcccctagagacccagaaattccatttgtaggttagaggagcaagtgcccctgttaggagcacattgaaaatatacacagcagcatcacttgcaaaagaaaaacaataaaagcaataacaaaagacaacccacaaataatccaaagcctatgggcaataaaatggagagatatatatacacgcacattggagatatatatatatatacacacaataaaatggatacacacacacacacacacacacattgtgtttatttgtacagtggaatgaaataaaccagaactacaagaattaaaatgggccaggcacaatggctcccacctgtaatcccagcactttgggaggccgaggctggtggatcacataagcccagagttcgagatcaacatgggtaacatgatgaaatgctgtctctaccaataataataataataataattagccaggcatggtggcacacacgtctgtagttgcagctatttggaaagctgaggcaagaggatgagcctgggaggttgaagctgcagtgagccaagatcacgccactgcactccagcctgggtgacagagcgagaccccgtctcaaaaagaataaaatgattaaatcttaaaagaagcaaatcaaagaacacatactttatgaattctactttataaaggtcaaacgcaggcaaactcttttttaggtatgaacacacatgtgataaaaagagaaaaatcttgagaatagttaaaccttatggcagcgatgacctcttgggggtgggaaggcttgtgatgtagggatgctcaatcagggaaggtcacagggtcaagttcatctcctcaccctgggtataacgtacaggggtgtttcatgtattttttaatggaatatcttctttgtatgatattagtttacaaacattttaaaataaaaactatggagtaggccggacgcagtggctcatacctgtaatcctagcacttcaagaggccgagatgggcggatcacaaggtcaggagatcgagaccatcctggctgacacggtgaaaccccatctctactaaaaatacaaaaaaattagccgggcatggtggtgggtgcctgtggtcccagctactcgggaggctgaggcaggagaatggcgtgaacctgggaggcggagcttgtagtgagccgaggttgcaccactgcactccagcctgggcgacagagtgagactccatctccagaaaaaaaaaaaaaaaaaaactatggagtaaattacacagtaaaataaaatgtgtgtgtgtgtttgcttaagctgtagaatgaatgtcttctgtcaatcctattgctttatctctggctctatacttaactcgttgggtaataatgttaaaatctaaatttgagaccctacttaaattgtgacctggtctcaaaggtcctcgggtcaccactgcaatgatcttcttggatcattatcctcactggttacacacaggaatgtgaagcatgcagtcaggagaaagccctgtaattgcccccaggccacaagtaatccccctggaagcaaaaacaacctcctctccataaactgactagaaaggaacaggtgggaaggacagcagaggggtggccagcattgtcagggtttctccagaatggcctgtcaaccaggacaagccctgttcccacatctttttgaacagcctggcacagaaagcagctctgactgttttacaagcagcactcttgcagtttggggagccattttcccttttattccaattgaaactgtgtgcatcaagctctgtcaactgttgcactcacagtgttacgaggctattgcatgatatgctgtcggaacaactggcctctctgacttttttctttttttaaacaacagacagatttttttttttttttttggtttgagacagagtctcactctgtcacccaggctcgtgtgcagtggcgcgatctcagctcactgcaacctccaccttctgggttcaagtaattctacctcagcctcccgagtagctgggattacagacgctgctaccactcccagctaatttttgtattttaaacaacagaaatgtaacctccaagacccaaatgatcaaatgacaagcagcaaacttttccaactttccctcctctcccacccccaggtgttttggtttctgaagactggggatcactatcaacaatgggcaaacctttgctacagaactgattaggacaaaaccacctgaattaataaatgtgtgcaaatattttaatgttcagggaaggaaagaaagattgcattttgtgtcaatatagagaagtcttctatgacaaagagccacaagtgaacacagatttcctgtgagatcaaaggctcccccaggcagaaatcacatgaacctgagccttcaccaccctatggggaatgaatcccacactatggggtgtccaagcatggtccgaggaggcccagttcagacgcactctccatttcccccatggctgcttcctctcccacagctcgaggcagccaccacacccttcttccccaacgtgggctgggcagcatcacacaaagtcagttttacagagtttcaagtttccaggcaaaggcaggatgactcaaagatgcccacttgtcgaaagactagatattaaagtacaaagttagattccaactcagagcctggttagacccggggttactttcgaactcccagggaggtgggaggagacctggctcttctccagccagtagctggcacaatccaacccagatatttgtccatctgttaaatcactcacactggactgacatttttaaaaggacataacaataaggagactggtggttcattaggcgtttaggcagtttaagtatctagaaaccaactgagaaattagggagggatttgggcaagcacaaagataactattaagagcacaaagacaaattgcatttctttctggcatctcccaggatattaaagaccacaaagctccacaatacatatttacacactctggctgaaacggaagagttgtgaagagacttaccaagggccacacagcaaacccaggagcagagcaggatcggcagctagctcaccctcctgcccgaggcatttgaatctgcaaggcaggcaggctagatattccaaacagcacctaccatatgactcagcctggactttggagatactgctcacattatctcggggtattcctgtgtttgtctcagagaaactccacgccctgcactgtacccaatacaaatgtcagtaataatgcaccgtattcaacacattgctgtacaaatgggctctttgtgcagtcagcagaagagatccacattctatatctttgcagggaggtcgactagaagggcgcctgctatcaatcaccccgactctgggattgcaagaggacattcagtctggtactctctctttaccaataaggaaatgggctcggctcaacaaaccttgttaggcagagcaaatgccagcagtggactgggcacagtaaacaccaatgtgatgaaggcagagcaaaggggccagccagcaccaagggaagggaagtggcttaaagacagtgagcagtcaggagactctctgttgattcattcatgagacagacacttgctgggtgcctcctagtgtcaggcgcagcgaggcgtgctggggaggcaaaggggcatagccgcctcctggcgtagtggccgggggagagacacaatgacagccactgataagtgtcaggagagtacttggtgctaagcgagcacttggaaggagctgctaagggggagataagaggaaagggggaggggaaaaagtcaatggaaagcagaaaggcttgtcagaaggtgaatcagttagacagagaagtaaagatttggaggacttggtgcagttgaagactgggacagcagatgggtcacacccggagggtcccacttaactcatacagaggtgtttggggttcatcctgtaggtcccttggcagccgcatagaggattaggatgatcacatcctgttttaaacaagtccttctgagaaagcaagatggaaaatgcatttccatggagccaactggagcctggagcctgctgcagcaatctatggcaagagctggtgaaggctggatgtagggtggtcgtgagaggtctatgaaggaggtggaatgagaggacttgccaccacctggatgtgggggtgaagggacgagtcaaggaaaaccccacttctgtttcattccttctggtagctaagcttattcacaagataggcaagaggaattttcagcctcagacatgataaacttaaggttcctatgggaccttcaaacacagacgtcctgatgaacagagagagaaagggacagaggaaacagcactggagcccattggtgacagcgccttaggcaactctctgaggagacaagcatagacaaccagacctaatcaaatcccagcttctgcctcttagcagctatacgacctggggcaagtaaattaacctttttgggactctggtctcacctaaggaaattccttttgggatttaatgaaatcagaaaaggacatgatgtcatggcaaacagaagagatttaatattttcctcttgcccttttgtgatcatatactgctttgtattataattgagtacttaacctttgcagcagattataagttttcttgctgtcactcatctttaaatcccttttgaccatatttgtaggcacagattctcaaatatttgaattgccacaagtcatatgaaaaactaaggccagactgttctgggggaccaggggtttcctgcttttgacattaaataacaaatgcaaagatctcaaaattgctatgtggcttaagtggtgttgatttaactctgtgttgggggtgggatggagagaaaagggcagtggggtttggaaaagagggagaattttgtcagcctaataaaggctagtcaaagcctactctgtgaaaactctactgtaatatttaagaggaagagtgtctatcaaagttaatattgcatagcctctatcctctggctcagttcaagtaaaggtcttaagtcatgttaaataatgaattccagcaaatggatcttgccttaaaccaaatgttaagtcaatagtacactccgtatatgagacgtatatactttctttgctaggtcattttgctaattctaactcttaaaatgaatattttaaaactacaataagatttttaaaaccagactgaccagtaaggcatacataattcagttccacagagctaagcttgttcatttttcttcagcgtttgcctttaaatttgggatctaacttgtctttacctatttttacggctgccttcctagtctgaaaatatcttggtcactagatattttgtttcatctccagcttagctcctaaaatacattcaggatcacttcttccttcccccttcttccctggtagcttcatatattcccatccattcacccatagcccagttcagtatacctacctcacattctgtgtctcagtcacaaatatcttttttaaaaacctgcccaagtttctaatacagaatgatgtggcaactgcctcaaagctcactgtttggctcatttaatcatttggattaaacgtagacaatgatccaattcagagctaatggtctttaggactactcttattcctggctgtcttcaacctgggcacatgtgacatgcctcaagcatgaccagtttgagaggacactttggtccccaagggccgaggaagaacaagttcctcctcgctcacatatgtagtctgaacctgaggttcttgattctctaggatgtttctgaactctgggtggttcccattaaacacacaatacacatctccatccttcttagccaacctctaagattttgacaccccactgacatatagaaccaagataccttccagttcttctctgccttgaatagacttgaacttcccagctgtgaatagactcaactttttgtcgtgtctacaagatgctctcctaccccactgccaatagggggaaaaatgaaagcagacagatggccacattagatggaatctgccattgaggtggcaacttccccatggcacccagcccgtggtctacttgagttattcctcagacactgacgagaggtgcagagtctcagggagagactactgagacgtaatcctttccctttaaacatgactttgacatatgcattacacacacttacacacgtctgactccaccatgactcacactggaggtggtgtttaaaatgaacagcatctccgtgctattatgatgcttcactcaaaattgctttacggcttctactacaggagcaggtcacatccaggaaatggtttgcctgatctagagcaggattttctcactattaccttatgccccagggctgccttactttcttcaaaacccagatcaggacctgcaacctatgacccaaagcactctccttgtaaattcaggattccctactaagccagtccctagctttttctctctctgaactctttaaacaccttttacattctcctctttctcatagctcatgtcattcctccaggcagaggcccctgagtttcctgtggttagtagacatggatagctgcctgctgcatcagactcagctgagcccaggaatccttctgaaaataaaagatttatcctacaaattggtgcaacctttgggaggacaatgtgtttgcctctattctcatttaaaaggcacatgccctttgacctaacagttttgcttttggaaatttatctaaatatggttatagagaaaaatgtacacaagttttcaatacagtattacaaagcaaaagaaacatgaaaaaacatcatcctgggaggaacttaaatcgcatatcaataggcgactggttaaataaataatagatatgtatattttgtgtcaagactatttctgtaaagacacataagaaacataacattgcagccaggcgcagtagctcacgcctatagtcccaacacttcaggaggccgaggcaggtggataacctgaggtcgggagttcgagaccagcttgaccaacatggagaaaccctgtctctactaaaaatgcaaaattagctgggcgtggtggcgggtgcatgtaatcacagctactggggaggctgaggcagaagaatcgcttgaacccggaaggcggaggttgcggcgagccaagatagtgccattgcactccagcctgggcaacaaaagcgagactgtctcaagaaaaaaaaagaaacataacattattatcattgctatctctggggaaaaggacaagaagctggaaaaagacactttaattttgctttaagccctttagtactgtggaaattttttttttttaataattattattttttttttgagacagagtcttgctctgtcgcccaggctggagtgtaatggcgcgatctcggctcactgcaaccttcgcctcccaagtttaagcggttctcctgcctcagcctcccgagtagctgggatcacaggagcccaccaccatgcccagctaatttttgtatttttagtagagacagggtttcaccatgttggccaggctagtcttgaactcctgacctcaggtgatccatctgcctcggcctcccaaagtgctgggattacaggcatgagctactgtgcagggcctgtggaattttttttttttcaaatgaattcacacttaagctacttaatagaaaaaaatgtgaacctttatcatttagagctactaaacacttcattaaacaatatcacttaatctttgctaaacacgaactagaaaaactaggcacaaatagaaactgtatagaccagatatacattagaatgggtctgctttagcagttaatggtttaatcattaaccaggtcagggtatttttctctaaggcactttatgtgttgctgactcttctacaatctaagtggctcaatgtaaaccattccccttgtgctaaacatgcgtgtttatacttaaagtcgatttcactgaggaaattagggtagggtcagtttgtaaggttttgccctaaaccttaaaaagaacacaaaatccttcaggtcttaagcaagattgatgcccaggccctatgaaggacacattgaatcttctgtatattttttaacaagctccacaggtaatttggatgtggctggcattgcctcgtgcacacctaaagtaaccatgcttagaaaacgctgtgttatccaaaagaaacacagcacagagaattctatgaacaaactattgcagtactctaagattttaaaataagtaactttctcaaacactgatatggggtttagagttaacactgcgggtaagcaaacccaccaggctctctcagttgacacagctcttctggctccttcgaggaagtgaggaccagtatgtggaagagcctttggggctggtgtttctcaagctacagcttcaggcaatctcagggacagaacctggactgtgcatctgacagccgcctttctacctcccacctccaccccattcttatgtccaagtagtttgaaactattgagctagatcagtatatcccgaacaccaaattgttaagagtggatggagccccagtgatctttcccactccccagaccagtgaatcaggaaatctctactggaggttctgcagtaccccaggttctttatctaaacaggaaagttaggaaacaccaatttaggtcaaactcattttaagataaggaaatcaaggcccaagaagtttaagtgatttcaccaaggacttatagctgattaatgatagctgggagctgtgaaacctggtgagctaattcttccctcttagaccaatactgcttgttatattatgtgtaatcatgagagccccagtatctgtgcagtttctgattcaccaggaagaggccccaagtgattaataaagcctgaacccaggggcatgtcagaacgcaccactggtttaaaggatgactgacatggtaaagtgtccaacgtcaacctgccctcggaattctttcactttcagtatcagtaggagaaatatacaattgtacatttcatagaaaagtaaacccagccccacacagttaacaaccaggtgaagcgggaacacaggacaattcaaagttttcggatcacaccatttcttggtcaaatattagtaccttcagcaaaagacctctaattaccacacacttttggttatggcaacagcctgctccttacttttgggagagaggagtactccacacccatggcctgaaaccaggatctccaaacccatcaaagagaaacatggatgggaaaccaaaccccccaagcttggaaagcatccagcaagctttaattcagggagagttcaatcgagatataattgcctctaattggccctcccacacgatctcacaacatacagctataatcagttccacaaagaatatgttatatttcttttctcccttgaaaagccagaatcctctcttgttaggtacttaccatcactgttttgatttttgtaaatataccgagacattaaaaaaggaagaatgaatgggtaaaagcaaagaagtagatggatttcttttttaaaataagcactgatccctatgaccttaatgataacccagtgcgattcaaatctgtaatggagactgatgtcgactcaggaaacctttctagtccagggcacatgtgatccaaaaaacacattcatctggtcggacattttccatactctgatttttatctttcttggcatgctcaactctcctttaataaagtcacaaccctttgttgccatggaacccaatcagacacggagcctgttactatgacttccctgcagatataaaaaaagacccagtgaccaaaagaccagctctttcttaaaaaaaaaaaaaaaattacaaggcaaagaggctccaaaaaaacctcaacacttctgtatttactgaagtttaatcttttatgtaggctcacctgaactcttcagccaaagctagctcatgtttcagctggaactttccaaagaaaatgattttacaaataaatacctaggcaaagaaggtaaaaaatattcttgggatatcttacttttcttcttcttctaggcaagctttctgaaatttgagtagctgtttagcaaacatgtgtcaatcagcagctgccaaattgcaatattcatttccatcaatacttaatgttgccaagagctcattatttctctgaaaagaaaagatattctaaacaatacaatcaatcctgtgttctggacctggactaaatctgcaggaaaaaaaaaaaaaatctgagactaagcagagtggactgagcagagctacttaagggaagagaattaacatttgttgagtgcctaccatgagctgggcacttttacgtcatcacgtcaggaccctgtaactgaggcaatgccacctctgtttggcagatgagggaccaaggctcagaaagcttaagtacttaagcagcttgttcaagctaccaggctagaatgctgcctggctcccaaagccagagctattccttcattcaaccagcacttatttctgctctcacaggtgttgtacattttgttatgcttcttattcttcaggagcgaattcacagcctgtaaagcttggctgtaaagagagcacggtgtccatctttaccggcacaggggccagtctggctacacccacgtacaactaccaccacgtctatacaacaccagctaccccttgggggaatcccgaataaatgccctggctacttgcctaaggaaacacgtgtgggctaggcacccattacacccttccagaggttgggccacggcccagagccttccaaccctggacctcatggtggggaggaccaggaagctctgggtggccttttcatgtgcagtaccatcggcaaagtaaaagtcaagccatgcaaaccacaacagtttctccaacctggttttggacaaccagcttcaagaaatgactagtaagaaggaatgtggcaagccacaaaagttataatttatattattaattataccagcctctcagctaaagaaaatttacctatttcatgtacaaagattataacaactgctttcattaaaagaaatttttaaaatcacccaaaactgcaatacgataccacttcatacttactaggatggctgtaattaaaagacagataataataagcactggtgaggatgtggagaaatcagaaccctcatacactggtagtgggaatataaactggtgcaaccactttggaaaacactctggcagttcctccaaaggttaaacagaattaccatatgacccagcaacactccttctaggtatgtacccaagagaaataaaaacatatacccccacaaaaacttacacagaagtgttcatagcaacattattcttcatagccaaaaagtgaaaacaacccaaatgtccaccaaatgtcacatatccatacaatgaaatattattcagccatggccaggcatggtggctcatgcctgtaatcccagcactttgggaggctgaggcaggtggatcgtctgagctcaggagtttgagaccaccctgggaaacatggtgaaaacccgtctccactaaaaaacgaaaaaattagccaggcgtggtggcgtacgcctgtagtcccagctactcaggaggctgaggcacgagaatcacttgagtctgggaggcagaggttgcagtgagccgagatcacaccactgcactccagcttgggctacagtgagattctgtctcaaaattaaaaaaaaatatattgttcagccataaaaagaaataaagtactgattcatgctacaacatgcgtgaaccttttaagagagggggaaatgaagaataactgctaagggtatctttctgagctgatgaaaatgttcgaaaatgggccaggtgcggtggctcatgcctgtaatcccagcactttgggaggccgaggcgggtggatcacttgaggtcaggagttcgagaccagcctggtcaacatggtgaaaccttgtctctactaaaaatacaaaaaattagctgggtgtggtgacacacccctccctccttgcctactggggaggctgaggcaggagaatcgcttgaatccgggaggccaaggttgcagtgagccgagattgcaccattgcattccagcctgggcaacaagagcgaaactccatctcaaaaaaaaaaaaaaaaattttttttttacagaggtttgattacctctgtaaagactgtatttccaaataaggtaatgttgtgaggtagtggtggttaggacttcaacatatcttttggtgggggacacaggtcaaacgataacactgactttaatagtaaatgggctgggcgtagtggctcattcctgtaattccagcactttgggaggctgaggtaggcagatcacctgaacctgaggtcaggagttctagaccagtctggccaacacggtgaaaccctatctctactaaaaatacaaaaattagccaggcgtggtggtgcacgcttgtagtcccaaatactcaggaggctgaggcaggagaacggcttgaatctgggagatggaggttgcagtgagcagaaatcgtgccactgcactccagtctgggcaacagagcaagactccatctcaaaaaaaaaaaaaaaaaagtaaatgatatggcagttccagaagggcaaatagtctcaccgtgaacgaaggtgtcaccacacacaatttttctaacagaaaagttacgcaagggttgaggctttccatcatccaggaggcaacagaagcattccaaattccacagaaaacctgccctgcagcagtcactactgtactgacacatggggagcgatctagagcaccagtaacttcagttaacattcatttaaattattacctttgtattttgtacgcatttgtttgagattttcataataaaatgttgaggtaaaaatttcctcagaatgttgataaaatctgctgtattagtctgttctcacactgctataaagatactacccgagattgggtaatttataaaggaaagaggtttaattgactcacagttccgcatggctggggaggcctcaggaaacttacaaacatggcggaaggggaagcaggcacgtcttacatggaggcaggcaagagagaacgcatgtgtgaacgcagaaaaaactaccatttataaaaccatcagatcttgtgagaattcattcactatcacgagaacagcatgggggaaatcgcccccataatccaatcacttccctccctcgacatgtggggattacaatttgagatgagatttggttggggacacagacaaaccgtatcatctgctaacaaaatctttattcttaaagaacacctaagtaaaaacaccaattagcatcttcaaacaaacatttttcacaagccaaaagtagagagaagataaattttgaaacacagaaacaagagtacatgtcttccctgattagacttatttaaattaatgtagccaaggccttacaaatcctttgatgtattaaacactgaaccctggggaaaaaaagtcctgctttctgttgaaatagtgaactcaaatattataccaatatcaatgcatgaaattcttaatgcattatttctttcctttcatgcttccttccatttctctacccatttattctgcaatctctgcccacctctgggtagagagggacaagtgagtcacaagttacaaggatgccacggctcatgcagacttgggcacaggttgggtagaagagcacccaagccaggtatgaactgagaaagggactcagggacgaccttgtatttacgttatcttacataagccttccacatccttatagggaaacaattacacttaatttgtttttgttgttgttgttattgtttgtttgtttgtttgttttgacagggtcttcttgttctgtcgcctaagctggagtgcagtggtgtgatcttggctgactgcaacctccacctcctggattcaaacaattctcctggctcagcctcctgagtagctgggactaaaggtgtgcactaccacaccaggctaatttttgtatttttagtagagatgggggtttcaccatgttggccaggctggtctcgaactcctgacctcaagtgatctgcccacctcccaagatgctgggattacaggtgtgagccaccacacccagccacacttatggaaactgaagctcaaatgggttaagcaaactggctaagatgatttcatacagcttgtaagagccaggattttaaaaccaggcctgttgcccccaaagccctggcaccatgctgcttcctcacttcaccatgcacagctgtcagcacactaggggagggctttaccacagcctgcatttagaagacctgaccgcttctcatcacctccactatcaacattctagtccaagccactctcatcactcctacaggtctacctgggccagcccatgcccacctacaatttcttttcaatccaacagcccgggagatccttgcaaggcctctactggctcaggaactggcctccccaccacctctcagaccccatgtcccaggactcaactccctgctcacactgccccagccacacagcctccttgctgtgcctcaaacacaacaggcacactgctttatcaaggagtccatgcatgctgttttcctgccctggaatgttcctcccttagatggctgcacagcttacttcccaggtcttttctcaatgtttcccctgacaagagctttctttgagtgtcctgtttaaaacttcttccctctacctccaccttgggcctccccagccctcttgtctatttctcagcattgcacttatccacatttaacatactatatattttatgtataggtctggcttgtctgccttgccctaccagaatacatattccacaagggtagggatttttgttttgttccctgagatgcctagcacatagtaggtgctcaatacacatttactgaatgaatgtactgaattgggctgaaagcccaatcattttaagtacaatccacatctgtattgctcatgaatggactctggcctgacgtaccacatagcccgctcctgacttggtggaaggttgggcaatgaagagacaattatccaacccaaagagctaaaaggagcccgttcttaaattcagtgccatgaaaggtgcccgagtgactccttttccataccacatgttgtggagacataggtaccactaacctcaatgctactcaacctcaaggtgtggtcctgggtgaaggggactccttgggccaggacattaggggaggcaaagagcagcctacctttttgtcttctctgcccaaagtgctcatcaataaaaaacccgcctggaggcttgggggcatctctgttttccctggtgaagctccacctatccacaaaagggctcttttcttacactgaccttctcatactccccatctatgaaacctcaccagagctaccaatgacaggcacacgggttcaattctccaagaggtctcaggcagcaaagggtgaactctgaacctgcctacagaatgactggcaggagtgagctattctaagcatcgcagtgtctgctggatggtgaggaaacaagcgcaacaaggctgcacaaggtcaaacagcaaaaacagtgcaacagcgagatggaccctttccaaaggggagcctgtgctgcagaaggtacaatgtctgccagctctaaactcatcctcatgctaagtcccttgtgggttagactggtggtggagaaatggggatgacaaataatgggaaagccataagcgcgtgacttttgtaaaattctagggcacttaaagggtgccgttctgctctgaaattctacgaagggactaaaatcactgcaagattgcttccaaacagcaaataaaacctcactgagagatggcactataatttcttgagtttgcgtcattctgttttctgtagttagaaaaaaggtgatggatttgggttacaaaggcagtgttccactataaaaacctgctggttgccatgacaattaacattcctgttcctccctcttctgcagcatccttcttccatctgagtcaaatcaaagaacctagctatgacgctcatgatttagtatttcctcggcacaaggatataaatatatacacacatatacaaaatacttatcaaaggctaatcacaggtgaaccgaagccttgaaaattgataccatctgtcctctaccaacaatgtcctacaaacaacaagagacatccctgcaggagggtccaagcaggaagggagggtgggccaggaaggcttaacagccaacacccagtcctccagtctagagtctctcagggtggactctgggggagttcttccttgggaggatccatgagaagccaggaccccatggagaactgtccctgccactctgcatcattattatctgtctgtgggtctgtcctccccagcctgagctccttgagggcagtgcccacatctgactgatctcagggcctcgcacagtgctgggcacaccgtgaagcaccaagggtgatggagggcactctggggtaaagcagcctccccttacattttctactgagacctcacgatcgggcctaccctgcttctaattggccctgtcggagaagaaagccaggggagaattctagatcaaagctctgaggtatgagctcgggacacctacagcacagtgttgccatgagctcccatccctgggtcaaaagtcttgaccaccaacccttccccagacctggagcaaaattaagaataacttagaaaataatagcataaatgtgatttatcttcttttcaggacaaaggctgatcattcaaatttcgaataaggttcaaatggagaccctgctatttgactatcattatcactctgtttaaatttattttaaatagaagttatatatgcccatttaacatttaattgcaaaatatgcttgttttacaaaagatatgaagatacaggccaggcgtggtggctcatgcctgtaatcccaacactttgggaggctatggcaggcaaatcacttgaggtcaggagtccgagaccagcctggccaacatggcaaaaccccgtctgtacaaaaaatacaaaaattagccaggcatggtggcaggctcctgtagtcccagctacttgggaggctgagacatgaacccaggaggtggaggttgcagtgagccaagaacgtgtcgctgcactccagcctgggtgatagagagcaagactctgtcccaaaaaaaaaaaaaaagaagatacaaagatacagaaaaggcagaggaggaaaataaaacccccatcatcccatgacctgacctggaggtagctcgggcctacatttaggtttttatgaggccatccttgcagatgtctgggtggttctgtctactggtttaggggcacaggctctggaacgcagagctacctgggttcaggttctagccttttcacttagtgggatgatcctggacaagtcgcttaacccctgtttgagcctcagttcttctttcctaacaggaggatagttgtgtctctttcttggcactgcatgagagctgttttaacccaggtggagccttgtcatagtgctggcaatggcactcctacccatttatgctagcttcattaatattctacttgtatgtggcactttttaaacaaaaatggtactttctgcgtatatcttgtaaacgttttgtgtttttgttttgttttgttttgtttttgaggcaaagtctcgctctgtcgcccaggctggagtgcagtggcaccaaactggcccgctgcaatctccacctcccgggttcaagcgattctcgtgccttggcttcccaagttgctgggattacaggcacccgccatcacacccagctaatttttgtatttttagtagagacagggtttcaccatactggccaggctggtctcaaactcctgacctcaagtgatctgcccacctcccagagtgctgggatcccttccaaagtgctgggattacatgcgtgagccacggtgcccggcataaatgttttcaatcaacataaaagcataaccacttgacatgtcaaaaaatatatttttataacattgatggttttacttctgaaacaagagctcactttagaccagttcttcctcatctttttaaacggttttctgccacaactgagaatcattccaaagaaagctatggaacctctccctagaaatatgcacgtatgcacacacacacatcaaatccacaaagcctaggggatatgggctgatttgtgtactcttaaaaattcatactgaaatcctaacccccactacctcacaatgtaaccgtatttcaagatagggactttaaagaggtaattaggctcaaatgagatcattagggtgggccctaatgccatttgactgatgaccttataagaagagaaaatctggacacagacacgtagagggaaaatgatgtgaagacaggagaaagacggccacctacaagcccaggagggaggcctggaacagctctttccctcctggttctcagaagaaactagctctgccaacaccttgatctcagacttccagcctccagaactgcatgaaaataaatgtattgtttaagctacccagtctgggatactttgtcaaagcagccctagcaaattatcacattaggttaagacaacactggccctaatctcatgtaatatatatagcagtgtttaatgtataaccttttctattctgaagtaacaaaacaacatttaaaaagtaacaggattacaaactaacctactttctaactgtggaaactgacgctccaaacttttcataatgctgcagtagtaacatgaaaaaacaggtaagttcagaaaaacagatgaggtgtgggatttcagccttcttcatctctgttcatagatgcattactcttaaaagtatattgacactactcacgaataaaaaggaatgaactcctgttacatgcaacaacatgcaattgcaaaagcattatgctaaatgaaagaagccacactcaaaaaggctgcgtatcacatgattccatttatactgcattatgaaaaagcaaaactgtaaggacagaaatgagatcagtaactgtcaggtgctaagcagagagaaggctgactataaagaggcgaaagagaactttccggggtgatagaaatattctacatcttaattgaatgtgggttataagactgtatgtgttcttcagaattcataggactgtgcacttaaagcaggaaattttactgtatgtaaatttatctcaataaatattgacacatttgctttattaggcattaacaagaatagagatgtaaaattattgactaggtacaaaaactgcctaatagcaaattcagaataactttatatttgctttcaggtaaaattaaagtacacaaactacatacaaataccattcaacacctacatagacaatctatcagcatcataaaaattttctcttacagatattaaaatgtggccttaaaaaatcactactgtaagtacagcagtgattacagtacttgagaaagctctttaagaatggatgtcaaagttgaagaagttcttttttctttgccctagcaatgtcacttcctggtatctccccttaagaaactctcccacgagtacagagactgtcccagaatcaacctacctgtttgccattagaagaatggctgtaaatacactctggttttattcatgtagcaaaataacatacagcagtaaaatatgaaaatgaagtaggataaattataaaaataccacattagaaaactgtaattacaaggctgggcatggtgttccaacactttgggaagccgaggcaggcagatcacttgaggtcaggagttgaagaccagcctggccaacagggtgaaacgccatctctactaaaaatgcaaaattcgctgggcatggtggtgcgcacctgcagtcctcgttacttgggaggctgaggcaggagaatcacttgaacctgaaaggtggaagacgcagtgggccgagattgcaccattgcactgcagcctgggtgacagagtgagactgtctcaaaaaagaaaagaaagaaaagaaaagaaaagaaaaattgtatttacaagagatgccatgtatgcagaattgtaacccaagaatacatatatttaattaaatacatgtaatacaataaattgtttatggattcatccagtgtgtgaaaacacgcaaaggaatgatacacagcttcaggttatggaggcctctgaggaagcaggaagagagaaaggcatctagatagctgtttatgggaccatttatttcttaaaaacaagtgacagaaatttgatgtaaacatggcaaaatgtcaacattcattaaatctaggaggcagatatatgggtatcatagttttaaaatttttttccatgtttgaagcacttaataattcaatttgtctgcttactatttaatcacagagccacttggttaatgattacggttttctccaggcaccaaacatttgcccctctttgtgaaacagttgctgtttctgatgggccatttcattaccttataattttggaatctgatgtcactgcatttacttctacattaacttcaaccttaaattaacaaccacagcaatcataaacttaggaaaattaaaatccactgagaagttaataagcttgctgccctagaaaaatatctaggctcattttaggctgttgtgtaaataaactaagaagcaattattttaaagaattattcactaacagttcgctgaatgagttactaacaagtaactgtgatttctgaaatatccaaagtatcaggaaacattaacataatctttgtattcagatttggtattctttgtttttcaatagtacatatatattattctttttgttttttattttttttttttttgagacagagtctcgctctgttgcccaggctggagtacaatggtgtgacctcagctcactgcaacctccgcctcccgggttcaaacgattttccctaactcagcatctcaagtagctgagattacaggtgcccgccatcaccagctaatgttttgtatttttagtagagatgaggtttcaccgtgttggccaggctggtctcgaactcctgacctcaggcaatccgcccggctgggcctcccaaagtgctgggattacaggcatgaaccaccgtgcctggcccagtatatgtattattcttatttatctatctgttaccattctaattaccccaaacatgcaaaaaattatttaagaaatgagggttgggaaggatcaacatttaatttaaagaaagccacaagaatgcaagactatttcatccatttcctatttggccaaaaaaacaaaagtttaaaaaaaaaaagtctgttggaatggtaggctcactttgcaaaactgtccttaaacagcaacaagtctcaagacctctcattttaagtctttctttaaaaataagagcttcatttgagccctgagtacttcaaaaactttcttggtattagatcattttaaacagccagagtgcgagtcaaacttctcaatagttgaatttaatgtgctcccacctacccaaacaataaaagcatttctaggtggtagaaacagatgctgattttgcataagtaagtgtccctactgctccccaggtagggcataaatgagccacctgaatgaaagagactcactttaattttggtgcccacatgcctaacagacaccaattctgtgaatgcctctaaattgcccagcacatgaggtaagctttggctggctttatgcaacacatagtacttgataatttgcttaagtcaggaggcttctacaagcatggtgcctttcccaaatgaaagcacatgtaaatagcatattcattccactcttaatatgctcttgaatcaggttataaaatgttaagtgttagtttctgggcacagcccagttttaacctccttctgtgtcagatgcagagatacaaggcaggtggaccgttcaataattaacacaagcgcatctagtgatatttaggaaggcacaggagtaacatacaagtaagaattaagccaaataaggaaacagatcgttacctacaaatcagaaatcttgttatattcgccatcctaacataagtgacaaaccaacttaaatttcccagtacagatcccagcacaaggatattaaatatgtttattaaataggaggaatgtgcaggcttgaaagcagtctggggctaacaaagcagaagcagtagtcctgtgacctgcagaacacaaagttaggctgggttcctgctcttccatctcccgagctgcgagctgcgatggtgtgtcacaaattacttaaggtggcaacagtggtttgggaagcaacaatacacattctatgtaccataacagtgtttgcaaactgtagaagggcaggattttataacattaagtcgaatttgatgagaggtaacacttagttcaaaagagaattaaaagcaaaattttaaaacacacacgcacaaaactttgctatcttttcctctcagccttttggtctttccttactgtaaataatactggagttatgcctgtttttgtgtgtgtatgtgggtttttttttttttttttttttttgagacggagtctggctctgttgcccaggctggatggagtgcagtggcacgatcttggctcactgcaacctccgcctcccaggttcgagcaattctgtctcagccttccgagtagctgggattacaggtgcccgccaccatgcccagctaatttttttgtatttttagtagagacagggtttcaccatgttggtcaggctggtctggaactcctgacctcaagtgatccacctgcctcggcctcccaaagtgctgggattacatgcataagccactgagcctggcctcaaaatgttcatttcaaatccctgaggggagaggttgggaagggaagaggaagaggactatcaatccagaataagtgtggcagaattacaaccttctgtgttcgacagatttaaaactcatggaaaaagtagacatttataaaaacaaaacttgatacatatgaacagcggtatatttttaaagacaggtaacaatgcaaaaaattgccctgggataactgtatagacatctgaaaaggaattgaataattctaactcattcaaagattcaaatatacaaaaataaaaatcataaaatatattaggagaacatgggcatgtgggcttttaaaaaatctcaaagtacaaaggccattctaagaatgatacaaacctataaaccagaaaatgtgtagatttcttcatggcaaaatatggttagtatttattcagcgcttgctatccactagctctatgctcagcacacaccaaacatataattcagggcaacaggcagaattctaagatgattcccacgatggtaccctcccacaagcaagacttttgaacatgatggaatttcactcctatggctacattatgttatatggaaaaataaaggaattttgcagacataattaaggcccctaatcagttgattttaattaatcaaaagggagagtgcctaggtgggcctaaactaatcaggtgaactccttaaaagaggatctagaagtaaaagacaaaatgcaacaaagatgctgttcattggccctgaagaaacaaactgtcgtgctatggaacatgccctgtggcagaaaacagtgaacagcctctggcggctgagggcctcaggtctacagttgcaagaaacctaatcttgtaaatatccagtgagcttgggaaaggatcccaagcttaagaagagattgcagtcctggttgacaccttgatttcaggctgatgacacacttggcagatgatgcagttaagctgcagctggactccaggcctatggaaactctgagataattaaatgggtgttgttttttgaagttgctcagtttatggtactttgttacacaacagttaaaaaaaaaatagagtcaggaatgacaagctgggaaaaatgtacttgcaaagcaattaatttaattagtagaaaaccaatacaaatctatgtaaaagaccaacagccaatagataaatggcaagaacatacatataaacagctcataaacacagacaaatgtctttttagtctatgaaaatatgatctattgtactatagttacataaaatgcaatcattgggagaagctgggtgaggggtacatgggacatctctgtactattttgtgcaaatttctgtagagctgtaattatttcaaaataaaaattttaaaaatatgaccaacctcatccataccaggaaagatatacattgaaatgggctaggagttttcacctatcagattggcaaggatcaaaacagttgaaaacatgctgtgtccgaagcgatgtgggtaaaggcatgttcacacattaatgatagttacacaaagtttaccagtgttgttcagtgctgcatccttagctcccagtgttcaacacagagtaggtgcagtgttcagcgtggtaatatcataatttaaaatgcacatgccctttggctgagtaattagatgcttgtgaatttagcctgctaacatattcctcacatgtgcaaaaataagtaatgaccaaagactggaagcaatatacctgtcctttaataagaaaatggttaaataaatgatggtatagccatacatggggatcctgtgcagcaattaaaacaaggcaaattaatctgaattgatatggatcaagagtagaataagctttccagcttctcaagtcccacagtacaatttcacaacatacacacattcactcattcagtcaatatttacaaagctccaactatgtccaatgctccatgcctagaaaaaagaacacaactatctccatgagagaggatggggcaggtacccacaggcacagagggaggcatgggagtccacaaagaaaggagaccggagttcaaggaccaagagtgggtgaaaagcaaaggtcagatgagagactctgggtgtctaagaagctgggcttctgtcctattgaagaatttgaagcaaaacattgacaagacactacgcaaaatatacactcaatgtaaaaataaaagagtgatctagctggagaaggtcataatctggggaccatctctgatgtcactagaggtgtcttaaggtatctcaacttgagcacttaagctgagtcacgtgggacatgctctttcccccatgcctgaatatgtgctcatattaaaaacatgaggacagcatgaggtcctcttgcaccatgccatcttatggggtggattcaaaggagacatttgccacctcttcctcctctggagaaatatctataagcacccctctcaagcatcttcacatgcatccctcgaccatatcctttcacccattctgcattcaacatgtaggatggaatggaagcagcacactcttccttgtatttcttccatcttccttcctgtctcccgtgctttctagtggggctttcaggcactttgcctgatgccaatacatagagtctgaacagctcttactgaatgggcttcatattgtcagataaattaaatctatgccaaccagtgattcagctgcaaatagaggccacctgttccaattagtgagattaaaatagtaccctgctgactatctgaagccaagttcaggctttctggatgatcacaacatcttgacaaagacagagaaaagggacttttggccccaacacagaattgaacacactggagtaaatatatttaggtgctgaagcacagctttcactaaaggcattctttatttttggacaagtgcttatactgaaatttctgtggaaggctgcagctcaagacaccatttaatttccttccattacaacaagcctacatacacatcttaattaggttcaactttactttagaaaaacatgtaactcaaatttcttctccacccactatctgtccttgcctgaaattcccaaagaattcatattttctggatgttccactcttcggcctatcgtcatccattacctcagtttctcccaggtcatggtcgtcagaagactaaagaggaaataatacagagagaagcaagctcagctcatttccaagctccttcaagtatttccacctagatgagactgcctttgacttatcagattgggcttctgttcatcccagtaacaatcatttatattgaattaaatcaattgatgaggccgagtatggtggctcactcctataatcccagcactttgggagggtgaggcaggtggatcacttgaggccaggagtttgagaccatctcagccaaaatggcgaaaccccatctctaccaaaaatacaaaaaaattagctggcatggtggtgggcacctgtagttccagctactggggaggctgaggcagaattgcttgaacctgggaggcggaggctgcagtgagccaagactgcaccactacactccagcctgggcaacagaacgagactctatctcataaataaataagtaaataaataaattgatgagtacctcatttggtatacaaggatttaagatagattacaggaaacacatatatgtaaacacacacacacacacacacacacacacacacacacattgaaaccaggccagaaaaaaatataaattagaaaaggaagccaaaatcaagaggtaagaaaaaaaaaaaaaaaagaagaagaaaagaaaaagaagcaggctataaaaatctcactcggttctgctgaaatttggatctgggttcctgttggccaaaataaaaaaggaaaacactcactaactcaaattttcacaacccatgagtgggaaaaatgtttctaagcatcttctagaccatgggtctaaagataaatatttcatgaaggaacgaaaggagatgatacattaagaccagggttttcctagatgattctgaattattttaggtgacataagacaaaagcattaaataacatagaatcacagtgagcgagttatttccttttcaatcctcaatccaattcagttgattcagtccaggaaaagtctttggtgctaaaaactttctaacattgctccaacacttgctaactagttttgttgagacagggtctcgccatcacccaggttggagtgcactgatgcaatcaaggctcactgcagcctcacccctcccacctcacccctcccagggctcaggtgatcctcccacctcagcctcctgagtagctgagagcatatgtatgcatcaccaagtccagctaatttttgtatcttttgtagagatggggtttggccatgttgctcaggctggtctcaaactcctgggcttaagcaatccacccaccttggcctcccacagtgctgggaatacaggcgtgagccaccacacccagtgctaatctacttcttaatctgctgctgggaggcctcaaactcagaagatatatagctagaataatgacactgatactttgaaaataaatgtaagttttaaggagataactgatttagaaatatcaagcaaataacagtgcaggtggtatgaggctgtgtgtcgtagatgtgggaatgactgaactttgggaaactgcggtagaccacgaatgactcaaactcagaacaacaaatgttgtaatgggtttcccaacaccgcttctaatggctgctcacaaagccgctaagtgaaagagctgacgttcaagtttcactccagagtccatttcctgatgcttcactctgttgctcaaatccagaggtaagcttaagagagggatgttgggggcaacgaggaaaagacagatgatcgacatttaagaagtaaaccattggggccaggtgcagtggctcatgcctgtaatcccagcactttgggaggccaaggcaggcagatcacctgaggtcaggagtttgagaccagcctggtcaacatggtgaaaccctgtctctactaaaaatacaaaaattatctggacatgatggtatgtgcctgtaatcccagctactcaggaggctgaggcaggagaattgcttgaacctgggaggcagaggttgcagtcagccaagatggcaccactgcactccagcctgggtgacagacccagaccctgtctcaaaaaaaaaaagaaaagaaaagaaataaaccactggatgcctgggtagggtgggggattgagggagcagctcaggcatctggtttgctgactggctgtatgggaaaagtataatattaaccaggaatagaagggcggttcaaagaatgaatctgatatacagactttgaggtgcctgtggaacaagaggtaggtggaagtgtctcataggatacagtaaaagccacattttactccccggctgggctctcaaattggcgtgtaaggcagaagtcacacgggctttttctagggggacgcttcactgggtattgcaccagacatgctgtctctccatgggccatcggactcaagtcctgtctttcccctagtgttggagcagataattgtttctttggtcaaggactaggtgaagttttaggcttgggtttaagggttgtgttatattgtatgcaaattttatatattgaaaacactcggtgctagaagagacccttaaggcgagactcacagaacggagagctttggagaccagggcagacttgggttgaattctaagtcaaacgcacagatgatgagctccatggcttatgcatctggcatacttttttccccaatatcccaccccaacaagtggaaggtcaggacatggatgaactcttcattttgcaaaactttatactgaaaaaatgaagacactaagaggaaccacaaaaaatatatatatatttatatatatattagcaacaatacagtgcaaagtagtttgatacatgaattgtcacccctcttttccccagtgccccccaaaaacctgtaaataaattcagaagaagaatggcctaacatcgtgtcattcaaattcacttttttaacctagaaaagtcacaaaaacttaaatttgttcatacctactgaaaataattttaaattctcattccacccctataacttagcaattaatttggtatttaaaaattatgtaaagcaatcctttttaaagacagaagatggtataatggttagtcccaatcagtctgtattaattacataattttactggttacagtctggctggtgtcattttctgcttctgcaaatggaatggtctggagttaataatgtctaaattcccttccagttctaccatggtaaaaccttgagtctaactttccaaccctctgccttcgtacctttaattcagtcaagccagggttccacagggagttctggtgtggacaccgggctatgttttctagttgctttaaactgccctttgtaatgtttttagttggcacagtctcctcgaatgcctttaagacctgaggaagatacaggtttacaatcagccatttaaaatgtggcttcctcaggggaccggcactaaatgggatgcatttcaggaagcaatccttgaaaagatctggtctctggagagaactcaaagtgttggaaatcacacccacggtctctgctcaattgcagctcctgcaatggccagacagctacaccactgttacatactgttattattcttcctctcccatctgaacattaaccgagcatttagcaggtgctggcactcaacagtgctttacacgtactacaccgtttaattctcacaacagtcctccaagggaagtactgtgacaacccttgtaaaaacctaactttggtaccatgcggcagggtacactatagaaagtcaaccgggccgggcgcagtgcctcatgcctgtaatcccagcactttgggaggccgaggcaggcggatcacgaggtcaggagatcgagaccatcctggccaacatagtgaaaccccgtctctactaaaatacaaaaaaatcagctgggagtggtggcgtgcacctgtagtcccagctactcgggaggctgagacaggggaatcacttgaacctgagcagcggaggttgcagtgagccgagattgcaccactgcactccagcctggtgaaagagcaagactctgtctaaaaaaaaaagaaagtcaaccgaggcacataactccaagactggcactcttaaccactccagtgcactcccccaaagtgtgatgttctgcaggggacacaagaaggcatggtttaatattacaagagccttcacagaaagatcaccaggtaggtgactgatgacatggctcaaaagaaggtgtgaacccacaggccagtcatgaggatctactgaggagacacgtttgcaggcatgtcttgaactccatgttcacaaggaagcaccaccttcaccttgctattcaacagtccatcctcaggagaccaaacatcaggcaaaaacacggttctttaatgatcttaaatcatgagcttatttgacagcctttaagacttcaaactactagcaaaattctcatatcctaggcattaaagttcatgaactatcattctgtatcattcattcacatgtttactgggaatatatgactacgtgcaaaagactggcaatgtgcatgtcataagaattagagcacacaattagggtaagtgcccagcagatgctgtacacatccttccccaggcacccaactagtttagaaagactgggctgctctccagtgttcgccacggaggcagacagggaagtggtaaagaatcaagctctggagttgagacatacacaggttcaaaccctagctctaccatagtttcctaatagccacaagatcttagagaaactaataatctgtctgggcctcagcctccccatctgtaaaatggaaaagtgggatattgtggaagaccaaggagatcatgtatttgaagtgcttcatgttgcctggtgtacagtaagcactcagtacacattaactattattgtgactgcattcttcctttcacctatgttctttttacctccttacagaggaataatccacaaatatactatggttcctttcaggcagcacccctcccaagtcgacggaagcagttggcctatgcacaaatcatatatcctgatgttctctttcgaaggaatgaaaagtcctcattctgattcacagtacagtgattcatggttctcttcctcttctcttgtcaccctcctcccctccactgaaaacatgaaaacacaattaagaaaccacagggctgaaagctgcagactcttctaagtcaagctgcgggcattttccaagtaggactaggttgatttctgaccttagcagcagtcctggagatgccggcagagggtctgaagcaaaatacaccctgagatccaacttggtagcagctgtcttggtgatctctacagcggatgtgacaggcgggtgagctggtggtggccggcagttccttctcctctaaaggaaaagcctgcaacaaagtacagctcgaaaaacacacaccgcatcactttgctcatcctaaatgtaagaaaaacctggcttgagacactcaccattattcattctctttaagaggctctttagaacaaaacaaatcaccggtgaaaacgatatctgtgtactactcaacttaccacttcaccgggtcagtgtcctccaggacagaggtcagtttccactccccctatttcctgcccagggagtaagcatgtgatcatcaacttactacatcactgcccaaccagttccactgtgagaagggctacagcatcctcttcttcactgcctttggtcattactcatcatgtaattgtagatggatttccaaaccacagaacacttgaagatatactacaggtggcactcacgcttgacacaagttttacttcagatgttagagatttctgcatgtattatcatcatgttctcctgtacaagacaggggtattgtccggaaccacaagaataaatgagatacacccaccagatattaagtttccacagagaccagactgtttcatttaccattgtattcctgatgcctagatcagcagccagcacacagaaggtgctcagtaagtattttttgaataaacgaagcatcttgctctcaaagtgccaatgtctatagtttataaatacatgtaagcattaaacatataaacagtcaatgtcatgagaaacatgacgcaaggaggcacaaaatgctagcaatgctagaaaagtctatacttttcacaaaattagcagcctttccgtttctaagctcacaaatccctctttcatatagtacaggtcccctattcaaaatgcttggaactagaagtgtttcagatttcagattttggaatttgttttgtttagttttgtttcggagatggagtctccctctgttgcccaggctggagtgcaatggcacaatcctggctcactgcaacctctgcctcccaggttcaagcgattctcctgcctcagcctccctagtagctgggattacaggcacctgccaccatgccgagctaatttttttgtatttttagtagagaccggattttaccatgttggccaagctggtctcaaactcctgaactcaagtgatctacccacctggcttcccaaagtgttagaattacaggcatgagccaccatgcccggcctaggaatctttgtattatacttactggttgagcattccaaatagaaatatctgaaatcagaaatgctcctgtaagcatttcctttgagcgtcatgttgacgctcaaaaagttttggattttggcttttggattgagatgctcggcctatagtaaaagtggttaacatctattgatttcttattgtgcacccggcatggagttaaacattttatagacattactgaatttattcctcaaaacacccctattatgtagaagtaggaactaaggcttagagtgattacaggatccaagattacactggtagcaaacagcactggtacaagatctgtattctggggactatcctaatgcaaatggttctgtagggaaaataatatggtccttgcatgcaggatggaacagaagttggtgaaggtcataagtgactaaggtgggggatgattgggagatatggaagaaaccaattccagagaaatgtcagagaaaggtgcggtggtattgctaataggttagagagatgggggagggcaggcactcaagatgactagcagttctgattagtagtggcaccaacaaaatagaaaaaaattattaacctgacatatagacaaatacagctttttcacccagtgagagaacataaatttaaaaaaatttttttaaatagctaatatttgaaagcacacaccttttttttttttttttttttttttgagaggaagtctcactcttgtcccccaggctggagtgcaatggcacgatctcagctctctgcaatctccgcctcccgggttcaagagattctcctgcctcagccttccgagtagctgggattacaggcacctgccaccatgcctggttaatttttgtatttttagtagagacagggtttcaacatgttggccaggttggtcttgaactcctgacctcaggtgatccacctgcctcggcctcccaaagtcctgggattacaggcgtgagccaccgtgcctggcttttttttttttttttaaaaaacaaatactttcttatttaagacacacaatcactcccagaagagtggagtattacctcttttacagatgggaaactggaggctcagaaaggctatttaggaccttgccccagtggtcacccagttaagaagctcgaagagccagaatacaacccacgtaggtccagagccccagctgtccaccactatactcaagtggctggagagggcattttagaacacttaaaatgaaaaccaactaaaagaaaacctaattcacacatcattaataaaagccagttactgtatagaaagcagacggcctgtattcttaaaaagatgataggctttaactatctagggcatgaaaaaaaagtaggagtctaattatggatgctctttcttctaaagtagagagatatgtgcatcaagttaacaagcaccatttctgagttttacaaagatgaagttttaaaatgtgaatgatcctgacttgtcagcttagcaacaatcacagaattcattacttacattttcactaaggggggaggggttatctaggtcagtccacctagatgtaaaaatagatttctgcaatgttgaaagagtacactgcctcattattattccagtctcaaaggctgaaataagcccagcaagacagaccatgtagtttccctgttatctcaacaggtattgattttgaatttaaaaaatgaccattcagtaactaagaacttcatctcatggagtctttgcccacttctaggcagaaactccatatccctgaaagattagtcgactcttcccatgaccccctagttctcattggcatttttaggggagctaattcaccaaatgagttcataaaagggttctttttaaatcctatactagtttcctcccaaggagatggtgacatcaagaaattagcactcgatgtcttcctctcgcatcacatacgttctgggtgtcaggaaaacatatctttacagctgcatccaagtgagttccacaatacaggagctacgatcatttaaatggatgaatactttctgcacagtaaaattgttgctttcccttcattacaacagacttattgtagcctcaggacagacttgaaattacatcaaccctgcttgagaaaagttattattatgagtttacaaaaatttcactagttctacctattcctcgctgtctcaacaataaaaaacctaaaagcagatagctgagaagtttcaactgggacctcaagaagtccagcatcactgtagtagaatttgtgattacggtctgctgaagttctagcccttctctgatttcctctcttcactagatctgactggcccaatgtgctaatttacgataatccgcacatataatgtctaactcagttttaatacacagcttatttaaaaatcgggtatctccatgctaacaatacaaggcagcaggtacaataacattgtcagtagaattgttttatttatttatttatttatttatttatttatttaaagacagagtctcgctctgtgcccaggctgacgcgatctcggttcactgcaacctccgcctcccgggttcaagtgattctccgcctcaccctcccgagtagctgggattacaggcgcccaccaccacgcccggctaatttttgtatttttagtagagacagggtttcaccatctcggccaggctggtcttgaactcctgacctggtgatccacctatctcggcctctcaaagtggtgggattacaggcatgagccaccgcccccggcccgtcagcagaattttaaagaaaatcaagaaatcacataaggttttgaccttttaatagaaaagactggcgtagacaggcaacagtggcagatgcggcagaaacactctgcagttaccttacacaattgctttaccacattccacctaagcagttgaggcacaaactttatcaccaccattttacaggttatgaagagtgagttttgtaaagttgcatgagttttgccaaaccacttaaatgagttgacaatgagccatccatcccgctaagattactaatcttgtttacacaaagaagatcacagttgtgacaagaaaaaacaagctttcacatttcaagtctgcaatattaactttacagaatcctctcaattacaaatgcattcgaagatgatctccttttcttcatagttctgttaactagcattacagctatccaagaagaaatgtctacctgtgggtaagcacatttcttcaatgtttattccaaatggagtttctggttattttcacagcaaactgttacgaaacttatacacaaagtgcaaaaacaagagaattgtaagattgagatgagtgcatgaggtattattccaccaaatatattcaatctgtaaaaactcaaatcatccttccaaaatgattaacagatgctaaaggaaaaagggaaagcgggcaaataaaccagagactcattgcttcacttctggggcaatcgattactacttcaaattatgagtgaagaccaaaatcctgcacaaagggccgcgacacaaccccgtcactattgctactatttccatccagttggtctctcgatcttggaagtggcaggccagaatctgagcccggctctccctccgtgaactttacacagaggctgacacccaaatccccagttctcggacaagcgagtaagtagttggcggagcaaagaacaactccaggtgcctcctgccagaacagatgccagcgtggaggaggtgctttgttaaatggcacttcaatcagccctggggagaacgggttacagagcctcacatccagcctcgacgattcaacagcccgggagggcaaaggtattcaccggggagggcgaaggcttcctctcccaggacagacccgcgcttgggctgcggcctccgtctttattttgaagccctacagggctcgtctctgcagcaggctcagaatgagctattttcgcccacagccaaaatcagcaacagcaaattacactgcaaacaatggcgagggcgcctgctcggctcggctcgaaactccggagaggcagcgcaaagattctgacttttcacttgggcagagcccgtccgccgcctccccgcgctccggctgcgcaccgcgctcgggttccggccacacgccccgaggacagggagacagggcggccgccgggacgttcggcggggagggcaccgtcacacccagggcgagaccccggagacctggagacgcggggccgcgggtggccgggtggcgggattccctcgcggagcggcgggcgctccctggcggggaggacagcagagcgcgggccgtcggggaaccgggcgtcccgcatagcgcgcggggacctgggcgccgtgaggggcaggcggacctgggatcccagaaccgcagcctgggctccgacgcccccgacgcccacccttttagctcggaggatcggggaggcacggacctccggcggcagcggagggcggcggcgaaacgccgggggcgcgtgggttagcactgagccgccgccccagcccgcctcgcccccgggcccgcgcgcacccgccgccccccagcccgctgcgctcacccggctcttgcagcggtggtgccggccggggtacgagtaggtccggtccacggtgagcgccgtgtcgctgcccggcatctccgcgctccggccgcgaactttcccgtcttctggggctgccgcgccgcgagccaccggctgtgctcgggatcaccctgggagccgcgggcgagggggcggcgcggctgctgcagctgttgcctctggtgccaacacccgcgcggccgccctgcgccgccgccgccgcggggtgggggaggcggggcaggaggcgagagtctcctcccccttcccttctccccgcctctcccgcgccccgcagccgcctggaccccccacccacccccgacccgggaggcaatgtcttcgcctccctccctggctgaaagttgattccatcccctcccacacagccctctttctccccaaaagataagcgacatccacactacactatctgttgacttattttatatataaaaggtgactgttactgcaagaagttgacacttgccttaaatgcctctttttatgttattctccattcaacaggcacttactgggcagctgccatgtaccagacgctggactagagaccagagatttaaagtaaaaaaatgaaataaaataaaaactccccccgaccatgattgccctgagcatagagcatacttccacttaaactaagatcctactgtgttgtgtattttaattttgcatatctggctcacctttatgtttctttcttttttttttttttttgagactgagtctcgctctgtcacccaggctggagtgcagtggcgcaatctcggctcactgcaagctccgcctcccgggttcacgccattctcctgcctcagcctcccaagtagctgggactacaggcgcctgccaccacacccagctaaatttttttgtatttttagtagagacgggatttcaccatgttagccaggatggtctcgatctcccgacctcgtgatccacctgccctagcctcccaaagtgctgggattacaggcgtgagccactgtgcccagcttacctttatgttttaagctacttggaagtcaggatatcttttcattttagtattccccattcccagtcatcagtccctgcccacaaggaatttggagtttagaagaggaaggaccattggtgaacaatttaaatatcagtaaccccaaacaaaattcaaaacacctgttctggctctgtagggtgtacagtgggagactgggctgaaatatttaaagtgcagctgttccagagaggacctggagcccagtgtgaccagtccagggggagggaaggatttccctcatagggttcaaaggggacggtagagcaggctgaagaaaactttggagcccctaaaatcagaggtacatttgggaaaacctcaagtcatcagttttggggagtgtcctcaggaacaggaagacatgatggaaaagaaggcagagaccatgcagaatcttcgttcaagggtaagaagttcagccttattctgtgggaactgggtagctgttggaaattcttgaacagggaaatgatagcatgggaatggaagtttaaggagaaggtatatctgacatcagggtgaagcagcgattgaagatgggcaaaacacactggcttcttagaaggccactgtaaagacagaatagcctaattatccttcagaaggagactaagtaaataaatgatggtacatcatccaatagaatattaggtaactggaatagaaatgaggcagccctctatgaatagctttggaagcaaatctaacatacatggttcagtggaaaaaaagcaatgtgcaggataatatatatggcattccaccatttatgtaaaaacaatatatgttatgtgcttctacatgcacgacatatatctgggaggataaataagaaactagggaaacagacaagaaattgatgccaagagaggggaaccaggtagctagaaggcagagatggagagagatctaattttcactgtgtatacttttgaaacttgaatgtttatactgtgggcatatattaactattcagaaagtaaaattttttaaaaaatgttttttagagatagggtatctgttgcccaggctggggtgcagtggcacaatcatagctcactgcagcctcaaattcttggtctcaagggatcctcccacttcagtttcccaagtagctagaactacaggtgtgtgccaccatttctggctaattttaaaaatatatttttttgtagagaaagggttaaaactaacttaagaagaaattgaaagtcccatgtagtccttaagccattcaaaaaattaaatcaacacttttaaaaatacccatctaccactaccccaacacacaactatactagacccagagagtttttcaggtaagttctttgaaagaagagaaataccaaacgctggggtgtgtgtgtgtgtgtgtgtgtgtgtgtgtgtgtgttggagggagattttagctagggtggctagagaagtcctccatgataaggtgaccttgagcagagacttgggaaatgaggaagccagaagtatagacattgaaaatttccagcagacaaacagaaagtcaagggccctgaacatttcgggagtgttcaaggaagagcaaggaggccagtgttcactggaaagagatgaggtcagagacatttcagagggccagatcatatatggactttcattctattttaagaactttaattttaggcagggcgtggtggctcacgcctgtaatcccagcacttcaggaggctgaggtgggccgatcacctgaggtcagcagttcaagatcagcctgaccaacatggagaaaatctgtttctaccaaaaatacaaaattagccggacatggtggcgcatgcctgtaatcccagctactcaggagtctgagacaggagaatcgcttgaactcaggaggcagaggttgtagtgagccaagatcatgccattgcactccagcctgggcaacaaaagcaaaactctgactcaaagaaaaaaaaaaaagaaaagaaagaactttaattttggggaatatgggaagatttggaaatttttgagcaaaggagtggcatgatctaccttttcacttggatgaaaataaaattgatctctacctcacagcataaacaaaaaccaataccagataaaggaaaaataaagaaaaaaaattagctggacatggtggcttgcacctgtaatcccagctgttcaggaggctgaagcaagaggttcacttgaggccaggaattcagcctgggcaacagagcaagacctgtctctaaaaaaattaaaaattaaaaaaaaaaaacagattaaagacttaaagtggaaaaaacacaacttaaaattgtcagaagaaaatgaaagaatatcattattatcatctcaagtaaaaaaaaaaacaagacacaaaaagcataaaccacaaaggtttgacattaaaaaaattaaacttctgcttatgaaaataaacaataaagtaaaaaaataagccacagaccaaactccagctaaaaaaaaaaatcaatatggacaaatttcacaaacaatactgagaaacaaaaaaagcaagccacaaaaaattacttgcagtaagattcatgtaggctgtgtggtagctcatgtctataatcccagcactttaggaggctgaggtgggaggatcacttgagcccaggagttcgagaccagcctgggcaatatagtgagaccttgtctccacaaaaaaaaaaaaaaaaagattcatgtaaagtttttgtttggttggtttttttgtttgtttgtttttggttttgagacagagtctcactctgtcgcccaggctggagtgcagtggcacgatcacagctcactacaacctctggctcccaagttaaagtgattctcatgcctcggcctcctgagtatctggattgcaggtgtgcaccaccatgcccggctaatttttgtgtttttagtagacatggggtttcaccatgttggccaggctggtcttgaactccttgcctcaagttcaagtgatccacccgcctcaccctcccaaagtgctggattgcaggcgtgagccaccacgcccagccttcctgtaaagtttaagaaaagcaagaggataataaacacaaatttcaggacagtatctctggtggggagatgaagaaggcttcaatagaaaaggggtacacaattataaatatataatgctctttaacaaatgactgttggtacactggatgtacattcattcatacatacacacaatagtgaagaataatttaaaattttaaaggtaacagagtctcaaaggaacagatatggtgatatccttaattctggaattcaaatcaccagttaggggtaccttctcaaataaataaacataatagcactttacgtgtgaataaactcagagaggccctgacaaaccagggttgggctttgcttgggggtaccaacaggcatctactttccatttctattactgtcttgatgtttcttagaattccatcctggaatgctgaccctcaatgagaaggataaattaaaactttattaggctcatttaaatgtcaattaacaaaggatgttcttttttagatcatttaaatttatttcataagctagttgcccaaaagctgctctgctgggcactcatacaaaattattttttaaaaatatacaaattaaatagcagaagagcaagctccccagaacagaaagaaaacaagcagtgctgatcaccatctgggtctccttttgggaggcagaacccaaggggaaaatagaccacatcccctcctttggacgcaatgccaatgcctagggttttgtcagccctggagagagagagagagggagagcgcaggtgcaaattcctcctgtcaatgtaagaattctgtgcttttgatacctccaagagcctctctctgcagaaagtatggaaaatatcgcactgttaaaataacaaatgcagtcagaacaataagaaatacaaaggttcatacctaaggtgtgaaataagaatttacttgcaaactataaggaaggagcacaacaagacagcagatgctaaaagcaccaaagaagagaccaggtcatttgagctgtaatagtttaaagtttggagtgaaaggcctatggaaagaggtaggactacacttgacttttgtagtgcgtgtttgttgtttcagcctgcccaggatcccaccccttattctgaagacagtacctaggttttctattgggacctaccctactcctacttttaatccaaatggcttagataaggtggaccattcccatccttggatctagagagtggcatgtcatccagccttggccagtcagagtcactgtggcttgtgcagggatgggcacatgagctaatcagagcagatgagagtcatccccagacttttgtcagaactgctgggaaagcctatgcccttccagtgggcattgctaagctggtacaatgcaagcctgatgctgtagtggacatccttccaccatataaagacagcctccctgggaaagcagagccatgaaacggagaaagacttcttactaaatccttagagcactagatccagcattttccatctgctatcgctgcatgacaaaccaccttaaaatgctttggcttggccaggtgcagtggctcacgcctgtaatcccagcactttgtgaggcagaggtgagtggatcacctgaggtcaggagttcgagaccagcctgaccaacatggtgaaaccccatctctactaaaaatacaaaaattagctgggagtggtaatgggcacctgtaatcccagctactcaggaggctgaggcaggagaattgcttgaacccgggaggcggaggttgcagtgagccaagatcacgccactgtactctagcctggatgacagagcgagactccatctcaaaaaaaaaaaaaaaaaaggtgttggcttacaacaataactacctctcattagctcatgattctgcaatctgggcaggcctccaagggaggtgaggtggcttttctctgttccatgtggcactgggggggggggggtagggtgtccaagatggcttcattcatatgagtgacattattatatatatatatacattggttttcacccatggttcctggcttataattaccaatgcccctgtaatagtctcttgtcatgattttggggcactttagatcccagaagccagcctcagaagccttatcctacccttgttccagctgctcttttctctcctgaaggaaggaatcttcccccgcctttctgtcatgcagctggccatgaagaaattctctgacctaccttgtctgactgtaggacataaggttcattttagaaggggtcctgctccataccctggaggaaagaatgctgcacagagaagccaagaagaatctgaacagacaggccttgctgggtctcgccactcagtctcttagtactagatcatatacccttttgtccagtcacatttctacatggttgtcaatcatgcccacccagtgacgtctccataaaaggccgaagagtacagggttcagggggcttctggatagctggacatctatggagggtggtgtactcagggaagacacagaagccctgcgctccttcccctacctcgtcccatgcatctcttcatctgtatcctttctgatatcctttatactaaaccggtaaatgtaaaatataaggttccctgagttctgtgtgctgctctagcaaattaatcaaacccaaagagggggtcatgggaaccccaacatgaagccggttggcccgaagttctgaaggcctgggcttgtgactggcatttgaagggcagtcttggggactctgccttcaaactgtggggtctgacgctatctccaggtagaggtggaggacacccagctggtgtccagaactgattgcttgcttggtgtgtggggaaacccctctcccatatttggtcacagaagtcttctgtgtttattgtttttgtagtgtgagaacagaggaaaaacatagtttgagttgatttttctacaaacaacgtgtcagcacctataagacttagggtggctggaatggtgggggctggccgggcctctgtctttatttttatatgtttatagttttttaaaaaactttttatcttactctgtcacctgggctggagtgtgatggcatgaccatagctcacggcagcctcaaacacccagattcaagctatcctgccacctcattctcctgagtagctgggactacaggtgcatcagcacgcctgtctattttttgtagcgacagggtcttgctgtgtgcctaggctgatcttaactcctggcctctcccacctcagcctcccaaagctgggattataggcatgagccactgtagccggcctgtttatacttttttaaatacttttttttatagtctctcatctctccatcagggtagttggatttttttacatggtggctgccttctaacacagcaaaaacaaaagctgccaaatctcctaaggcctagcctagaactggcagattatcacttccatcacattctactggtcaaggcaagtcaaaagtccagctcagactccaggggaggagaaacggggtctacctgttgagggaaggagtgatgtgcacatagatgggagaaattgctgactgccattttggcagccaatccaccacaccagccttgcctagaccaccttttcagtgatatgaagcaatggattcctctttttgctcaagcccgttagagatggggtttctgactcctgcaacccaaagaatcctgtctgatgcaacattcaatgcagggtatgggcagaaagaagacaaggaaaagggcagcatttcaagagaaggcaagaactttgaacagcacaaataaagggagaatcaacagaggattctagtgggggcaccaaggactctagagttttctcaggccactagcttgagtcttctgtggtcagtccacaccagattacctgtgaactgctcaactatttacagtctggactaattatttcaatacaaaggttataatacattatattctttaaatatttcatgtgataatttctatgcttcccccctacacacactagagtataggttacctgaaggaaaggactgtactttccaggtacatgtaggtattctggacagttcttaacatagtattcaataaatgtttgctgagtgaatgagatcaacattattaaatgtctacttatttcctaggcattggggttttaaaaaatgactccgacataagcaaaaactagtgtctgttcctaaggggttggaatgggtaataggaaaggatgaaaattcactgaatgatggatgttaccaattttcagctactaagtagttaatgacatttgtgaattctcccgtcatttattgagcacctttggtgtgacagcctctgctcttggtgctgagaatatagaaatgagtaagacatccagaagggacagcccatctagacagtgaggcagacacctccaaaaacgttgctgtagatgccaggatagttatgtgcttggcatggtagtaggacaaaggaaggaggtggtctcctcatgcagctcacttccttagatgtttcagtcctatggtcatcacagcagggagaaggagagacaaggaaagccagatgttgaaaacaaaagtacaagcctcttgtaaaggaaaggaaaatgtatttcttttcatattccagtttgatttaatagtgcagggaagtgttccctttgggggaaagagtcataagacaaaaagtacaacaagcttccctctgcaaggatataagaacagagcaaaaggaagaataaatcaggtttttaaaatgtattcttctagcttgaggtgaacacatgctgatcagctctacatatctatattacagatagatagatagaaatgcttatgttgcggatcagcagctttctggcctgatgcaaacatggatctctaattctaactacctggtttatagccaactaaaaatgaccacactcttaacatctacatttaatttctaacataccatgttctatgtgactgcaaataaacaatcactgctacttatttagtattagcaattatctggcacagaagcccgaaacttccacttggcaagattttgattaaaaacaggaaagtagacagactcaattgaaactctgcaggctagggaacttgcctttgaatattcctttttttagcaaatgcaacaattccatgctattgatttctcaagagcaatgagaaaattctccaggctgccttcaagtgtcctgggagatggtcttcaacatgtgccttgcctgcagacttgaggctacataaagaagtacaaaaatgtattttacttcatcaaaagtaaacgcttttgcttctcaaaaaactctgataagaggataaaaagacaagatacagatgggaagaaaatatttacaaaaccaaacatataacaagtgatgagtacctagaatgtataaagaattctcaaaactctatagtaaaaaataaacaatccttggcccggcgcagtggctcatatgtgcaatcctagcactttgggaggccaaggtggcagatcacttgagatcaggagttcaaaatcagcctggcccatatggtgaagccccgtctctactaaaaatacaaaaaaaattagtggggcgtggtggcgggtgcctgtaatctcagctgcttgcgaggcctaggcaggagaatcacttgaacccgggaggcggagattgcagtgagccgagatggcggcactgtactccagcctgggagacagagcaagactccatctcaaataacaataaaaataaaaataaatccaatttaaaaatgagcaaaacataggaacagacatttcactgaagagaatatactaatggcaaataaacacatgaaaagatgttaaatgtcattagctattagggaaatgcaaattaaaaccacaatgagatgttactgctcacttatcagaatggctacaataaaaacgagttataacacatattgctggcaaggatgtggagaaactacataaatcatacattgctggtaggaatgtaaaatggttcagcctctctggaaagcagtttgacagttttttataaaactaaaacatgcaaatctcccatctgacccagcaactgcactctcaggcatttatcccagaaagaaaacatgttcaaacagaaacctatacacaaatattcatagcagctttattcgtaattgccaaaacctggtagcagcaccatgtccttcaacatgtgaatggttaaacaactgtggtacatccataccatggaatatgactcaacaataaaaaggaacaaactatttgatatgcatcctttttttttttgagatgaagtctcgctctttctcccaggctggggtgcagtggcacaatctcagctcactgcaacctccgcctcccaattctcctgcctcagcttcccaaatagctgggattgcaggtgcctgccatcacacccagctaattgttgtatttttagtagagacagggtttcaccatgttggccaggctagtctcaaactcctgacctcaagtgatctgcccacctcggcctcccaaagtgctgggattacaggcatgagccaccgcacccggccccacttacatagcattcttgaaatgataaaactatagaaaaggagaagagatgagtgggtaccaggctctaggaacgggagggggtagttgcaggagggaggtgggtgtgtttataaaaaggcagcaccaaggatcctgtggggatggaactgttctgtatcttgagagtggtggtggatagaattgcacaggactaaatacacacatgcacacacgcaaacaagtactggggaaatctgaatgagattgatggattgcaccaatgttaatgtgatatttgtactgaagtttgacaagatactaccatgggagacacagatactaccactgggggacaggtaaagtgtacagagttcctcagaagtattccttacaagtgcatgtgaatctacaacaatctcaaaattaaaagtttacttaaaaatgtgttttaaggccaggcatggtggcgcacgcctgtaatcccaccactttgggaagccaagatgggcagatcagttgaggccaggagttcgagaacagcctggccaacatggcaaaactttgtctctactaaaaagacaaaaactagccaggcgtggtggtgggtgcctgtaatcccagctactcaggagtctgaggaaggagacctgcttgaacccacgaggtggaggtagcagtgagctgagatcgtgccactgcacaccagtctaggtgacagagactctgcatcaaaaaaaaaaattaaattaaatttagatgcaactgtagtcattttcacagaaaaaactgggttttgggaggaggggaacaacacaagcaggagtgaactttttctctgaagaagttgttcacagaatattctaccaggttatggccctttgctgcaccagaggagttgaccagctgtggaaactgagggcaaacaaagactgtaggtggtgctcattaatatgaccacacatgtcagtacctggccacagtgcatgctgtgtctcaaccacacaagttcagggccaacggcaatgtccattatccttggcccatcagtgtggagcaaagcacctggcacaaagcagtgattctacaaggtttttatggaataaataatggataattaagtcctgatttggttggaagaacatattaacgttcatagatttggttcaggttcaaaacaattcattatatgagttgtttagtaaaaggttacatagcaagtttgagtagagaattttgcaaattcctttgagaggtggaggcgggcggatcacttgaggtcaggagtttgagatcagcccagccaacatggtgaaaccctgtctctacaaaaacacaaaaattagccaggcatggtggcacacacctgtagtcccagcactttggagggctgtggcatgtggattacatggggccaggagtttgagaccagcctggccaacatggcaaaaccctgtatctacaaaaaatataaaaattagctgagtgtagtgatgcacacctgtaatcccagctatttgggtagctcaggcatgagaattgcttgaaccctggaggcagaggttgcagtgggccgagatcatgccactgcactccagcctgggcgacagagcgagactctatctcaaaaaaaaaaaaaagaaaaggaaattttgcaaattcatgtgctttgctttgctccatgttttatgattcctatattggtttgagtctttactttatatcatgcacacacagattataatataagtggtttgctatttctaacctcttgactctaccacttggaaagagtttcactctctgattatcgtgtatgactactggctatttgctactgcagttttccagaagtctacaacagggttagaaaacaaacatagataaaaatgccttactttttactaggcacgaaatgttccattcagttaaacctgtaactggacttgtgatgcttgggttcctacttcacacaaccacagagaaagcagttctctggggatctctagctgactccattctatgcacggctagcccaggagaattgtctttcattaagcacatactgaatctgaaggatgagctagctacactccaggaacatatcgtccgtgaattcactttgcattttatcaactcactttgcaggataaggaaagtgggaaatgaaactgccagaaaaatctgatgtgatgttgtttttaaacagtccaagtcacagtcctttcaaaagaggatgctgcttgctgaagccttccttgtccactccagtccacactgttatctctctcccttctctgaattctgacagtatctgttgcttaaatcactcacataaacattcaattgtaaatgatcttgtgctgttacagggaggcggtatggtgtactggaggcagactgcttggattcacatcttggcgctgctccttacgagctctaaagccttggttctcacattcataagctaaggataacaatagtacccacctcatactgttgttgaggattaaatgatgtaatatatgtaaagcacttataaataagagctcgataaatgtctgcacaaacaaaacaaaacctaaagtctgtcttcacgtggtatctctttctccttaccagtaagacttcagtaaggatgtatgctgttatcctggaaagtgtcctagtaaggtggaggatgcattttgatgccgtatgtcatcatcacaaattttgtgaataggattaggatgaaagtaggagcctgtggacaagctctggaccccggccatccctccctctctgcctctgcttgtgctgttcctaccactgcagagtctgcaaacttgcacaagtgacaagggcacacttcctccttttacactaacctccagctcctttcattcccaaggccgtagctcccatgtagaatacacagagtctttttgctggtacactttgaccaaaatattctacttctaggaagctatgctaaagaaataataggctgggtgtggtggctcacgcctgtaatcccagcactttgggaggccgaggcaggtggatcacgaggtcaggagttcaagaccagcctggccaagatggtataaccccgtctctactaaaaatacagaaaattagccaggcctggtggcacgcacctataacccagctactctggaggctgaggcagagaattgcttaatacctggaggggcggaggttgcagtgagccgagattgtgccactgctgtccagcctggcaaacagggcaagactctgtctcaaaaaaaagaaaagaaataatacaggaaaatacagaaaaacttttacacacaaacatcacacattttgtcattctgaaaaaattaaaacaattcaaaggattatttattatgaaaaatcatggactgattatataaattatgatatattcataaaaaatgcagtgcagctattgacaattatacttaggaagaatatgtaatcatatgaagaaatgtttctgtaatgatattataaaaattataacaggccgggcatggtggctcacgcctgtaatcccagcactttgggagactgcggtgggcggatcacaagctcaggagatcgagaccatcccagctaacatggtgaaaccccatctctactaaaaatacaaaaaaattagtcgggcatggtggcaggcacctgtagtcccagctacttgggaggctgaggcaggagaatggcgtgaacctgggaggcggagcttgcagtgagaggagattgcaccactgcactctagcctgggtgacagagcgagactctgtctcaaaaaaaaaaaaaaaaattataataaaaaatcagtataactctacaagactgacaaaaatagaaaagtattatgatacttagtgctggtaatgatctggagtagcaggaaccctcatgcccagccactccattcctcagtatatatctatcccggaggccacacatcaaccaggacacacgtacaagaacattcacagtggtaacagtccctatctagaaacaacccaattgtcattccacaacagaatggataaagaaattgttgtacagttatttcacaattaaggtcagtcatttgttgccaaaaatcaaatgttccatgtgaaaatgctaacagggagcctgttatcttaactcattttgcaaagtagggtttttctgttatgtgtatcaaacctaatactgactgctacagagcctaacaaaatgccccatgcaaagtatcacaaatgtcgatatcttctgtcccaccccacccccggaaaatattcagggcaaaatggtcaacagaagtccaaaatattttgctactgaagagtaagagaaacatctttctccatttcttctgtgtcttcctatagcatctctataggactttgcacagagccagtaaattgcaatagttatttattttgcctacgtcttctgcaccagacactgtcaatacatcaactgagttactgccaaactcttgcccccccatctctatgatggaaggtgctatgattttcccaatatccggagtagcaaccaggacatctgaatagatcaagtgatttgaccaaaggtactcagctaataaatggcaaaattattgtccaaattccaggtctaagcttatttactaggtgcatatccttggatgagctctttaatctttataagcctcagtttcctcaattgtagaatggaatttgcaattgtagaattgcaattgtagaatggaattgcagatggaattctaaaaattatacccattaaacgataactatctcttgactaaaagtcaaggctggcactgctgagaatatgaacagggaagaatctcagtgcatctgcagagtacactgttgcaggttccctctcaaaacatttaacttaaatgagcctgacttgtcctcattccctgtccagcctttccctgcttctccataacagtttaacacacatccactattactaatattcccatgaagatgatttctacattctaagcctcttgtttcctgttcttcccatgaagaaagaaaacgaagcttttgaaattcaaaattatatcatcatgactttaccctttatctgaaggctccttgtaaatcttttccatcatttctaagcacttctagattttcagttttgcatgtcaagtttcacaaaattagaagtcaattctcctatcacgttggaagtgaaggttcaatttcctgcgagtatttagaagtcctcactgtcctagctgacagttttgaaaggtattctatagttctgttatttctcactgcttcttcctacatcagctgtggctgatgcactcccagttaatatttctgacattctattgattttcttccattagaaggaatatctttcacaaaaggagaagaatgctatacaaggcacaagatttaaagtatgtaatataataccatggagtgtaggatacccagcaggcaagtacacccactaacatgcatgtacacacacatacaaaggaattagtagaagttatcaggggccaggtacagtggctcacacctgtaatcctagctctctgggaggccaaggcaggcggatcacttcggccaacgcaggcggatcacttcagcccaggagttcaagaccagcctgggcaacatggcaaaaccccatctctccagaaaaatacaaaaagttagccggacatggtggctcgcgcctgtagtcccagctactcgggaggctggggtgggaggatggcttgggccctggaggtcaaagctgcagtgagctgagatggcgccactacactccagcctaggtgacagaacaagaccctgtctcaaaaaaaaaaaaaaaaaaaaaaaaagttatcaggaaatcaagaatataacatgtaggtttttcagaacattagcaggatttggtcatttggagtttacaacaacaacaagcttccttttcaattgctaaaaggaactgaggtaacggaaaaaacaaatacaagatccaagaagatgctgaccaatttatagagctctattttgaatttctgcttcaatgaaagagacagaaaatccataaatttcattgctgcttcttgacactcacgattgcaaaaccattctctggataaagctctactgagatggggcttttcccattgtccattgtttacctctaatccttttacaaagggaatcgtactttccacaatccaaaaatgtcagaatgttttacatataaccaattagaagacagatgattagaatatggattattcataaaaccccagcccaggacctatttaaactactatgctttaaatattttccctcatttagatatcaagatgaagtgtacaataaatgattgtctgaatctgcatactgaatacagtagatgctggtcacatgagcgcaccgaggactcgaaatgtacctattgtgactgaggaactgagttttaaatcttacttaattttaattaatttacaccttaaagacagtacaaacaaaagaaggtaaaatatctcataaatattctatactgactacatgtcaatatgaatcacagagcccatgtttaattatcaaaatgtcaaaacacagagactgacaagtattcttcacatctcattatataaaatgagccaaacatgagctaaacatacaaatactagtactatacatggctctgggagggatcccaagggatctctcaggtttaaattaatcctccttccctggtagcatcttatgtatagctttagcatcatacttaccacagtctaatttatgtgaagtaaattgtacgtacgtctaccacgcctccctttagtagactgtaatctttttaaaatagaggacttacttgctcattctaaaaatccatcagtccccagcatggttgttatattggaaatccttccataaatgtttgaggatttaaatacagtgtgtactaatattttttaaacattcgtttttctataaaagcaagcctaaaactaatattaaggtcatactcatggaggaaaagatgcagtatcaaacaaatgtcagttttccctaaaagtcaatcaataaatgaaacacaatccagtaaaaaaggatttttccaaaaacttgacaagcttattttaaaatttgatggaagaggccaggcacagtggctcacgcctataatcccagcactttgggaggccaaggcaggtggatcgcttgaggccaggagttggagaccagcctggccaacatggtgaaaccctgtctctaccaaaaatacaaaaaagttaactgggtgtggtggcacgcgcctgtagtcccagctacttttcagtgagccgagatcatgccactgcactctagcctgggcgacagagcaagaccctgcctcattaaaaaaaaaaaaaaaaaaaaaaaaatcagcgtaagaggggccaggcgtggtggctcatgcctgtaatctcagcccgttgggaggccaagattattggattgcttgagaccaagagttacagaccatcctcggcaacatggctaaatccatctctacgaaaaaaaaaaaaaaaagctgggcatgtgggcatggtggcactgcacgcctgtagtcccagctacttggggaggctgaggtgggaggatcgcttgagcccaggaggtggaggttgcagtgagccaagatcgggccactgcactccagcctgggtgacagaccgagaccttgtctcaaaaataataagcaaacaaaatgaaaaataaaattcaatggatgaaaaaatacaacttgggggaaaaatatggggagtaggggcagacagagtgagctctccctaccaggtagccagacattttattggcaatagttcaggtgattaggaattggcacagagacccaggaagagagagctcagaaacaggctcatgcacatatgaaagcacaatctaggatggaggtggcatcagaaatcaatgtggaaaggaaataattggtagttcatattgaaaagagtgaaactgcagtagatccctgaataccaaaccaaaatttaaaatgcaggtgcaattgtttcatctcagaacattcttggtttttttgctgttgctgtttttgcttgttttgctttttttgagacggagcctcactctgttgcccaggctggagggcagtagagcaatctctgctcattgcaacctccacctccggggttcaagcgattctcctgcctcagcctcctgagtagctgggattacaggtgcccaccaccatgcccggctaatttttgtattacaggtgcacactgccacccccagctaatttttgtattttttgtagagacgggggtttcaccatgttgcccaagctggtctaaaactcccgatctcaactgatctgcccgcctcagcctcccaaagtgctgggattacaggcgtgagtcactgtgcccagcccacattttctattattgataattcattgggaattctagatggactgtataatacataaattatacattgatatccattgttcctacttgatcaataaataggaataaattaagaacaataaaaggaacaaatgatttttaagaaactatcttgaagaggcctacaccacagggtacaaaaacacatttttttccttctttaaagtactgaatcaagcaaaagtcccttatggctttataaaggtcacacttttagaatggagctggaggccatcaaatatacagagggactccatgactgtgcaaagtacttctaaagacttctttgaagctaactctataaagctgaaaccaaaatccagccaaacaatgactgctctggtgctgttaacagcacctctccactcatctccatctgggctgttaaccgagcgcagcttggctttatcttaattcacccggatcgaagcgggttaattctcagcgtaaccccatgcatcagacattcctagcattcaacatcagcatgaacacagctctctgaatgccacatagtttccttacacttccgtatgcctgaacctgtggtccaaatttttccctgacttcaaaggaggtcaaaatcccaaaactgggctttgatggggaaaaaatgttccaaagacgtcatacacctagaacatgtttcacacacgtgctagatcatctctccagagagtttatttcctgcttgaaagtggtttcacctgtttttctaggtctccttcttggattctcctgtttgatgctgcggcgatctcataacagaaatgtgatattgctataactatttgtattactttgctcaggctgccatagcaaaataccacagactcgggggcttaaacaacagaagtttattttctcacagttccagaggctagaagtctaagaccaaggtgccagcagggttggtttctctgaggcctctccctttggtttgcagacagctgccttcttgctgtgtcctcacatggtcatccctggtgtctctcagtgtgtccaggtttccacttcttcggttttttttgttttgttttgttttgttttgttttttgagaaggagtctcactctgtgacccaggctggagtgcagtggcacaaccttggctcactgcaacctccgcctcccgggttcaagcgattctcgtgcctcagcctcctgagtagctcggattacaggctcatgccaccacgcccggctaatttttgtatttttagtagagatgggttttcaccatgttgcccaggctggtctggaactcttaacctcaggtgatccgcccaggtggattacagaggcgtgagccaccatgcctggctggtttcctcctcttacagggacatcagatagatcagaacccagcctaatggcgttgctctaacttcattacctctttaagggtcctatctccaaatgcagtcacattctgaagtactagggtctagggcttcaacataccaatgttacaggggcacagttcagtccctgacaccactcatgcgatgatgaacttggcaaatgtatggaagcagctgtgcctggagataagggggaatagcagctggggaatgagagagtagggatcttgaaacctacaaagaaactccacattcctgggaaaataaagccctgatttcctttgttgaaatctgctcattttgattaggtactttcttaaacccctactttaattttgcatagagatagagctacataaaaatttccatccaaagagataactaaagaggtaatgacccatagaatgtctttaacagctcttcctagtatgcagtcttcttttcttaagaacagctacaattctcaatatgccatttctctgcataaagtatatgtgcacagcctgtgatatatgaatagaaagggagagtgtggggagaggaacagaggagatgagggaacaaaggaaggcagtgaatggagatttttaaagaaagaagttcagtgtgaaaaatacacacaaactcctgagaggtaggaatgtactgcaaagatgcttctctgaatgagaagccagggcaggcccaaccaagtgaatttctggtatgaaaagaggtaccaggaaggaaaaagaagtataaagtttttaataagaccaagtgattcagttttgaaatgagatataatctaacttaaaggacttgggagacaagtgagaacgtggagttatcagtggagacagtaccatagcagctgggggcagaaagttctgcctttgtctgtgggttttgcaggtcaaataaacagtatccccaaagattcaaacctgaggcttgcaaaggactctccagttccagattctggtgttaaaagtctgtatcatgcctaaataaatatatttaaagagctgtggccaaagatgtggttttataattacatattgatttatattggatttcttggttggctgcagagtttggaatctttccagcattactttcttgccaatttctaggtagcttatagcaatttcaaagtacctccaattatacattttcaacagatgggattattaaatgcttagtgcaaacaatgatccatagatgtgttaccacccaccagtagacaaagccgagcttctctctgctccactctcattccaataaatatttacatccttccatttactcatttcaagactgtaggatatggaatttcattgctcttttaaggtgagtgcaagaaattgttaatggtttctggattttccaattaacttgctctcagaagaatttatctttagtataaataacagaatggttcatggtctgtagatattttcatctacacatccaagtatggtatcaatttttaagtaggaaactttttttttttaagcatttatacttttaaagcctagactgtagaacttttcagaacaaggtgtgtggttcagccttctttttcagatgaggaaacttgaggcacagatatgtaaaatggcttgctacttggtagcagagctgaaggaataggcagtagaagagggagaagagactctgcagttcgtgtgggcacctgctgggtggccaggttctcatctttgtggcttcacaaacacacaccttgcagccagcatccttgtcacaaactcaggctagcaaggctgagacggagacaggttaggacagtggcccgctgtcattcacagtaagtgatttaaacccaagtctgtctgataccccagaccaacccttttccatttccctacactgttccctaaacagaaccaagttatattattgagtttaaaactgatatttataatggcattagataaagttagattcaatagcttctccaaaccctaggtttattttctagtattcaatctctgaattgttattggtttctgttttggcagcataactgacatttacttaagaaaatatgaattaatacatatttaggtgtaaatcaagtgaaagcctagctgtttgaccttaattaatcattaatggaaaaaattccctcatcctttgagcctttctattttgaatgcaattatttaaatgaaaatgtagggcagtcctctttaccatgtcttacccgaataggaaattcacggagtgtatctcatacgtccatccccagtgttcacggtgagagacatgaaaaggtacaagaatcagtcagctagtaagtgattcaaactcaagaccacctgacacccgaaaccaagcctttttattatctaacgtttcccaggtaaaggaagaaatacatacaaggatgtatagaatgcacctttaagacattatcaagcatattcagatgtaaaagcttcttagaaccttgtgcactggtattcaatttctgtgaagctattcgttagaaatagttttacttagcagagagaaaaaaattatagttattttatatagttaggtaattaattactcacccacagctaaactcgctgccaaacacaggtggaccacagggctatgaggcctaatgcttcacacctattaacccaaaatgcagtggacacaaagggcatccttaacccccatatggtaattctgaactgcacgagcaattaagtaagagtgtgacctattaccactgacataaaaacagctcaaaggccatgtactatttactattcataggagtcccgtggcatacattggttttcaaaagacagcaggtgacattcatcagcagactttctgtgtccctctgctcacacttacagcacaattttagagtctcaggttaaggctgtttttccttaacaatactcaattttcttctgaatcactgagaaaatctaagtctaccgtggggtcatcctcagtagactggaaatggggaagagaatgtgagcttcttttgtttttatatcctcctgtccataattaggcaatatttttaaaagagaaaaacaaaaacgttccaagcacaataaccttgatgccgttctgtaatccagagtggcatactggcaaactgggttattatttttttttaatttcagataaccttctctcaattgtcaagggtatattcagcaaatcaaatcgacttccctcagcatcataaatcccatttgtatcctagtagaaacacacatttcctgagaaagggagctgggtcttaaaaaaggaagttgaagtttttaagctggagataaggcatttcaaaagggaagaaacttttggcaggactcgagtgcatcctgcactaatggaaattggaaacccatccttcatttcatgaacattactatacaaaatgtaaaacatattggtaccacagcaaccaactctgcataatgtacttgcagcttcaaatggcaaccctgggggagataaaagttgattttttttttttgctatcatgaaatgttggaatttcttaattccacagatattagcaagtgtatatttcatgccaggaaatgttcttggctccaaggatatagcagtgaacacaattaggttgctggcttcatggagttatatttggaggtgggaaattttaaaaattactgtataatatagcagattagaatatatagggatggtataatatatattatggtatattagtatatatatttatcattattacatgtgtcacatatagaaacatagtatataataccatattatgcaatataacaaaatatgtcaggtagatatagatcatatcagatgctagtaaattttagaaagcagagaaaaggggatagatgagtgttgcatttctgaataatatgttttgggaagttctcatggataggctgggacacctaactagagaactgaaggaagtgagggggtgatacatgtagaatatctagaaaaagaccattctaggcaaaaggaccagcaagtgcaaaagctccaaggaaggggagcacttgatccatttgaggaacaacagcaagaaaaccagcatgggtggagcagagtgagccgagcaggagagcggggagggtggagatgaggtcagagaagcagcctggggttagaagaacagcagcgcagatcctgtggcattttctggcagagtaaggactttttatgggggggccagggtggaagccgggaggctgatcaggaggctattgaaacagttcaacgtttctctgcatctgtcccagaccgttcccttcccatcttgctttctctcccagaccactgctggcttttttttttttttttttttttttagatggagtcccactctgttgcccaggttggagtgcagtggagcaatctcgcctcactgcaacttctgcctcccaggttcaagcgactgattctcctgcctcagcctcccaagtagctgggactacaggcgcatgccacgacacctaatttttgtttttttgttttttgttttttttgagatggagtttcgctcttgtagcccaggctggattgcaatggcacgatctcggctcactgcaacctccgcctcccgggttcaagcgattctcctgcctcagcctcccgagtaactgggattacaggcttgcgccaccatgcccagctaatttttgtatttttagtagggacggggtttcaccatgttggccaggctagcctcgaactcctgacctcaggcgatccacccgcctcagcctcccaaagtgtaatttttgtattttcaatagagacaaggtttcactatgttggccagactggtcttgaactcctgacctcggacgatccgcccacctcagcctcccaaagtgctgggattacaggcgtgagccacctgcccggccatggagcctcttgctcctatgtctcttctgacctccagccttactcacccatccatccagttcatctacacatggatggctcagtatgttcaagtgtgcccgccttcctccatgcccctctggctcctctaggatcccacctttcagcaaatggcaccaccacttagttgcttaagacttctcttgggagtgtccctcctttaacacctcacatccagggactcacatccagagtcctgttgccgcagacgcatttcatttcctttcatgataacacagaggagtagaaggggccaaaggcataggaggaaaacaagaaaatacagtgtcaccggaaccaggggaagtgtgttgataaaagcagtggttagcatgtacttctcactgtagcagacactatgctcaccacttcccacaaactatgtcatttagacctcgctacaatctgaggaggaaggtgctacgcccattttgcaaataatttagagaagtaaatttcccaaggtcacagtgtgtactaaatcccctaagagaaataaattgagtctgaaaaactcaagtccactgaactgagtcatgtggagaccaccggtgaccttaacaaaaacctggccagtgtccagccggaagaagagtgagaaacaagagggagatgagaaaataaggacaggaagttagccaactctctccagggttggcctgcaaagcagacaaggaggaagataaggctatagttgaagggagggcagaggggctgggcacggtggctcacgcctgtaatcccaacactttgggaggctgaggtgggtggataacttgaggccaggagttccagaccagcctggcccacatggcgaaagcttgtctcaaaaataaaaactaaaaaagagagtgctgggggagtgtctagggaaggttttattttaggtgacaacaaagtaatttaaatttctaaaactcaacccctttgcagagtgtgggttagcatgtctatgtgagcaatcagcacagagaaggtatttgttttctctgcttcctgctccaaggaaattcagattttgcttatgagtttggtttaaaaaatcattggctatgcataaaatttgcgtcccatatcctagaagatgggaaaagctatagaacagaaggtgtataactgggtcaacaaaataaacaaaaagaggatctactctggttttcttgggaagctgaaaaatcagtgctttagaaaaaaccagtcaagccagactattctgtcacaatgtggtggagaaaccccaacactgaacccaaaagcagatgacctagtgggctgctctttccggccagccactgtctagctttgtcatcttgtataagtcactcaattcagggtcagcatcctctgtggatcaaggagctaatatttattatgccacacttggttctgggcagaatcaaacaactgaatcagccagaagattgacagaggatgcatgatttcaaacaactgaaatcagccagtaaaaacgctttatacaaatgcaaggtattcccaatatctatcataattgaaggtaagcattaaaagatacttatgggctaggtacaatggctcacacctgtaatcccagcactttgggaggccgaggcagatcgcctgagcccaggagttcgataccagcctgggcaacatggtgaaaccccatctctacaaaatatacaaaaactagccaggcatggtggtgtgcacctgtagtcccagctgctcgggagactggggtggggggatcacctgagcctgggaggttgaggctgcagtgagccgtgatggcacccctacactccagcctgggcaacaggggagactctgtctcaaaaaaagaaagaagatattgtacacagtctggaagcaagctgtttggatacatgtacattcaccaactgattcaagatttttaaaaaattcagtgatagcttaacaatgccagatatataacaacaaacacctgcatatttacttttcattacagctggtgctgttgaagctgatttccagtgaatcaggttaagccaggcctaaacttgtggccatgactggtctgtgaaaatgctcaaagtgtgacatactttcagtttgctctggatctcacagcataccaattcagtacacaggtcctgccacagaggtgtttctggcctgtgatttaataagcaaagaaaaaccagtacagccagtctaattattagagcagccaagctttcagactctcttaaatacttccaacatcaggcctccctcaggcagggcaagattacacatgactccagcccggtaccaattccctaactgtccatttcctatggagacatggatatggccttctctaattagagggacaaagacagaagagaaccattattaggactttactttttatcccgttttagttctaaaacattcaagtcctgcccttcactgatcactattacaaatattaaaatgggggtaggagtggtggattaagtgccacagagaccgaatgcatcaattgtttcacttatggaacattctgggctctgagaacctcggagtaggagtgaatcaatcgtacatccaagcagataacagctcaaatcaccagctcagcacaattcttctgggcaccctcttctctatctgcaaaaagagactggctttccttcctcctcttgccctccctcctgcccccaccccacccccgccgcgccctaggcctggagtctagggctgcccaatgacaggaacacccaaatcagcactgtcttctgggctgcgttggcttctgtggttgtagctaggaatggccagcagggcgggggttgggtggggtgggatgggggccgtgggggtggctgcacaaggaatcatacacctttggtaatacacttaccgtttacaaaaagttgagagtccacataaccaggaatgtgtaattcatgcagcttcctaaaactgccagggaattattcttgcctccaagtcagccctggctaggatcgtaagtattataaatgcaaaaagaataaaaaaaagacagtgcaattcttatttagtgggtattcagctctcaaacctgagggatggactaggagattaacatgatgctcaccagcctctgagaccttccacaaacgccctctgaccagtctttcccacctaccctcctgcactcccgcaccctctgccctgcagtcattctgcctcactcaccgcgccctgcacgtgccttgcctctccctttgtgcttttgcaggttatggttccgctgctgcatagaataatccctcctctctcacagaaattcctcccatctgggcccagatcaaatgctcctcctcaaagaagacttctctgattgctaggagcagtatctccttcttcttgccacaaataatattttgtttacagcaataataagagctacttattgaacacatactatgggatgggaatcctatgaagcacttgatacattttatttcatttaatcctactactattcctagttataggtgagaaagccatgattgagaaaggttaagtactatctctaaaagggcagtggcgacactggacttggtcaggcagttggacaccagagctcccacactctactacacgttgccttatactgtaatgatttgtgcaagggtcccatctgctctgtgaatttctgaggtcatatatcttcagatatcccattatatgaactcatggcttggcctaagtggtcactggaattggagcaaaagtgcacttagagacaggttgctatggctgattcttccaggtatgctattttatctttaacccagctctgacctttaggatgggtcaagagcagcaactaaaatggcctcacaaagtcaaggatccaagacccaggaagcaggagaaatctgacccctggaatgctctggaagcactgaggggccccacaggatatgggcaccattgtgtcctaatttggataacaggtacctgagacatacaagcctgtctctgtgcatatcagctagatctcttagaatggtgagtcccggagccaggggcagggtagctttcttttccagtatataataaatgcacacttgttgcagtcaatgtttcttcagactcggttttcagtctcccagagaataataaattcttgttgagaggataagacagcatggctcaaaggttaaaagcaaatgggctcaatgttaaacagaatcagtctgaatgagtccaactttgccccagtatttgtgatctaggacacgatacttaatgtctgtacttcagtgtcctcgtctgataatagagataatatcaccacccattcattcataaggtgactaggaggacagagtgagataatgcatgtaaagtgctcactatactccactcaaaaacggttagctcttattatttaacaattgctcttttcactaatgctaattattgttgttggttagtcaatttatagctaatgagagtacattttccatctgaaaaattctttactaaaattcactggttagtgttactcttttctgctctacagagctagcagtgaatatagagatcaacaattctgaacataaagaatgagaagatatgccaggcatggtggctcacacctataatcccagcactttgggaggctgaggtgggcggattgcctgaggtcaggagttcaagaccagcctgaccaacatggtgaaaccctaagtctctactaaacccttagtctctactaaaaatacaaaaatcagctgcgcatggtggcaggcacctgtaatcccagctacttgggaggctgagacaggagaatcacttgaacccaggaggcagaggttgcagtgagccgagatgccgagattgtgccactgtactccagcctgggcaacaagagcgaaaatccatctcaaaaaaaaaaaaaagaaagaaagaatgagaagatatatagtgatatggtttggctgtgtccccacccaaatctcctcttaaattcctatgtgctgtgggagggacctgtgggagataactgaatcatgggggcaggtctttcccatgctgtgcttgtgatagtaaatctcacgagatttgatgattattacaagggggagttttcctgcacaagctctttcttcctgctgccctctctgtaagatgtgacttgctcctccctgtcttccgccatgattgtgaggcctccccagccatgtggaactataagtccaattaaacctctttgttttgtaaattgcccagtctcgggtatgtctttatcagcagcatgaaaacagactaatatatatagcctgggcaacatggtgagactctgtctctacaaaatataaatagccaggtgtggtggtgcatgtctgtggtcccagctacttgagaggctgaagtgggaggatcgcttgaaccctggatgtcaaggctgcagtgagccatgtctgcaccactgcactccaacctgggtgacagagtaagaccatgtctcaaaaaaaaaaaaaaaaagatataaacattagaggtaccacctaacaattaaagctgttcaaaatatggtggcctctgagaaaaatgagctgccccctttccctacccagcagaaactgcctcctatggccattacatttggttcaatttaagaccctgatatggtggggatttgtgtccctgcccaaatctcatgtcatccccagtgttggaagaggggcctggtgggaggtgataggatcatgggggcagtttcttgtgaatggtttagcaccatcttcctggtgctgttctcatgagagagagtgagttattactagagctggttgtttacaagtgtggagcactgccccctctctcaatcctgctcctaccatgtacgatgcctgctcctgctttgcctttcgccaggaatgaatgctccctgagacctccccaaaagcagatgtcgctatgcttcctgtacagcctgcagaactgtgagccaactaaacctcttgtcttgataaattacccagtttcaggtatttctttatagcagtgcaagaatgaattaatacagaacccaatggtcttacttcttctaatatcctattttgccccagccacttatggtgatgattctcaaactttggtggacgtaagagtcacttagtgtgtttaacaaatacagattcttgtgtctatttgggattatgatttaattttatttactttttagagacagggtcttactctgctgctcagactggtgtgccaaggcctgatcatagctgactgcaacttgaactcctgggctcaaacgaccctccagccttccctcttaagtagctgggaccaccggtgtaagcccaactgggattatgatttaataaagaacatcccaggtggtttctgataccagtggtcctgtgaaccaattctcaaaaacagggtcagtaactgacaacttagaaatatttttccgtgtaggctgggcgccgtggctcacacctgtaatcccaagcactttgggaggtcaaggcaggaagaacgcttgaggccaggagttcaagaccagcctggccaacatggtgaaatctcgtctctactaaaaatacaaaaattagctggctgtggtagcatgtgcctgcagtcctagctactcaggaggctaaggcttaagaatcgcttgaacccgggaggcagaggtcacagtgagccgaggtcgtgccactgcactccagcctgggtgacaaagtgagactccatctcacagaaaaaagaaagaaagaaagaaagagaaaaaagaaatatttatccgtgtaaatttatttcctgtaacagaaaaagatggaaaaacttttaattctccaaatctgggtctgcattttttgaaaataatgttccctgaagcctaatccttggattcgataataatgagtttgtctattagttatcacttattctggtgagtaatttctaaagtctcgttttacttccttttttttttttttttgaggcagagtcttgctttgtcgcccaggctggagtgcagtggtgtgatctcggctcactgcacactccaccttctgggttcacaccattctcctgcctcagccttgagtggctgggactacaggcgcccaccaccacgcccggctaaatttttgtatttttagtagagacggggtttcaccgtgttagccaggatggtctcgatctcctgacctcctgatctgcccaccttggcctcccaaagtgctgggattacaggcgtgagccactgcacccggctagtctcattttacttctcattgctgatgaagcaccagttactttattgtttcttcccaaggctgtgtactggtaataattttctttaagagaggccagaatcttgacatggtcctgattctggggccaggaagcctcagttttgctttattacaagctctgaggcttcttttcaaatggctacagtcaggctgacattggcaatgatgaatatgatgcagaaacagctgcagtctctgaagcagaaggtgctcacaaacctgctttctaaaattcactaatatctgatatgacacacatccatccctcaagggtctagaatacaggatgtcaggagagaatgaggttgtaaatatagaatctgctccagcactggccagtctgaacatttctttcccttggctccagcatagcattaaagaccaataaaaccacagactctaaaggcagagacttcctgagtttcaaatccccagctccaatacttactactgtgtgaacctgagcaagttacttaacttctgtgtgcctcaagttttaagtttttcatctataaagtgctgtagggggaaaaatatattttcttctatccatcttaggtgtcttggctagtgctcctgtaataaaagccaaattaataagagagaagcacacaaatttatttaatatgttttacatgacacagcagccttcataaagagaggaaaccatagagaagcaattaaacctgagtgtttttcatagtaggttgatgaagaggatggtggtggagaaatatgatagggcaaagggtgcaaggtgagtgcagtgacctggaggaacttagcaaggcctgtttggattcttctctgtgtcccatcgtcttcagagataaggatgctccttccctttgaatatagggaaagcaactctcacatgagtgtttcatgaccctcttcaagggaagctcagaaaatctgtcctagattttatgatgtgcttcagaagggaagggtagaggaaaggtcagagagaccttcctgtgtctgcattttctcatattccttcagattaaaatatgcagtatgccaaactgccatatattggggtagtgtgttctgaaccccatcaatgggatgttacaagaatagaattggcacatagtgctatgtgagcatttattagtataggatggtcatatggcccaagctatccatgacacttcattccggtacttttgctgaatgagatgcttctgctggagttgataaatcggtaaatatttaagctgagaactgccaggggccacctgtggagaaagccttcctgagagtgaagctactgcagaggaacgagggctgagaggtggagacagtgtaggatttaatgcgaatgcttaagacctgggtccagtcatgcctggatatctagtgtggacttttcagtgacacgggctgtgaactttcttttctcacttgagttggcttgggttggtttctattgtcagaggcatttgaaccagagcgactccatcttgaataggggctgggtaaaatgaggctgagacctgctgggctgcattcccaggaggttaggaattctaagtcacaggatgagataggaggtcggcacaatttacaggtcacacagacccggctgataagaggttgtggtaaagaagccggccaaaattcaccaaaaccaagaaggccatgaaagtgacctctggttgtcctcactgttcattatacactaattataatgcatcagcatgctaaagacactcctaccagtgccatgagtttacagatgccatggaatgttagcaagttactctatatggcctaaatggggaggaaccctcagttcctgaaactgctcacccctttcctggaaaattcatgaataatccaccccttgtttagcatataatcaaaaaataactatacatatactcagtggaacagcccatgccactgctctgcctatggagtagccattcttttattccttttctttctgataaacttggtttcactccatggacttaccccaaattctttcttgcacaaggtccaagaatcctctcttgggggtctggattgggacccctttccagtaacattatcaccttccaacaaaagaattctgacctagctttattgagatataattcgcataccatccagttcacctatttaaaatgtacaatgcagtggtttttaccacattcacagagctgtgcaaccatcaccacaattgttggattgttgatctaaagatcctcagagatggctcagtaggcctgggatgtggaatgtggacaggcatgtgtgattctgcttccaaagtcaccacgattttgttttgtttcgtttttgagacagggtctcattctgttttccaagctagagtgcagtggctcactgcagcctcgacctcctgggctcaggtgatcctcctacctcagcctcctgaaaaactgggactacaagcacacaccaccacgccatttttttttttttttttttttttttggtagagatgggattttgccatgttgcccaggttggtctcaaactcctgagctcaggggatcctcccatcttggccgcccaaactgctgcgattacaggcatgagccactgtgcctggtttcacaattttgaaactaccttttttttctttgaaactgagtatcgctctgtcgcccaggctggagtgcaatggcgcgatcttggctcactgcaacctctgcctcccaggttcaagtggttttcctgcctcagcctcccgagtagttgggattacaggcgcacaccaccatgcctggctaatttttgtatttttagtagaaacagggtttcaccatattggccaggctggccttgaactcctgacctcgtgatccacctgccttggccttccaaagtgctgggattacagccatgagccaccacaactaattttaaagttagaattatcaactttttgatttggaagtaatgaaagttcagcagagtataatggaaaaggaaataaaataagagttagcactcctgctttctttaaagagacattagaaaatccctacagtccctttatactctcaataactcgaccaggcacagtggctcacagcattaatcccagcactttgggaggccaaggcaggtggatcacaaggtagggcgttctagaccagcctgaccaacatggtgaaaccccgtgtctactaaaaatacaaattagccgggggtggtgtcgcatgcctgtaatcccagctactcgggaggctgaagcaggagaatcgcttgaacctgggaggcagaggttgcggtgagctgagatcgcgccattgcactccagcctgggcaacaagagcaaaactctgcctcaaacaaacaaacaaaacagaacaaaaaacctctatagttttcatcaacttatctaatatttcagatgacaaaactgagggccagtgagggtaactaaaccgccaataaaactgaaggccagtgaggttaagtaaattgccagagctcacagaggtactcacttttagacacattcaagaattcagttcagttttctatgttgttagtttcaagtagttcttactttttctgcaggatttcatactcaagactcaggtcagtctcttgaaatgcctggagattaagagggtctttgtagtactaatcaaacattcattcaattctgttttgactcattcaagaaatacactgtgattatgatattccctatatttatgttaaattcattgcatctgtctctttagataaaatagtgttctacttacaacctagagaaaaatcaatatacttgccctaaagcaggatgtaataggaaatttcaaaaatattctatggtatttactgggttaggtaaataataaattggcaagtttccacaaacatttacgaaatagtcttagtttgtaggaccaggaggtttaattaccatgtagtgctgctggggataaggaaggatgatggttaggagagtaactgcactctttgtctaataaaaataaagagatttgataaccaaactggaaatatagaataatttgacttctaatagcccttgaagcttcagataacttctcaaaaacatgaaaaacaaccctttagctattgctaattacaaatctgtgtatctgggcacataaggactctctataccggctttggaaatttttagaaacacatttcctggaagaacctgagaggttggatctggccaaaaaaatataatacagtctgtggcaggatgcattgtacttaaccatattcaaggacagaaaggcatttgctttatctgggatatcctgtgaaaacacattaagaacacccagggaaacatcgtcagcagggatattatttgtggtcatcgttgtttttaacgtgtgttttttccttagtaaatcctagacaaagtaatttgaaccttgtaaaagagtactgcaggccaacctgggcaacatagcaagattacgtctctaaatacaaaataaataaataaattacaagcaagaggcggtagaatttttaaactgagttcattggtgaggatcttggatggagttcaagggaaaacagtgaaaaggagatgaaacactgtccctaatcccaccgtcttgatagaactactctgagaactttggtgccttttttgtgttacttttcttctaagtattccttgtatatacttgtaactgggaagtgacaaagttctaagagatcctggcaagaactgccacccccaactcatcaccacaacactatccttcccttccccactcccttccaacacacatacattctcagccttcaaaaccaacaagatcaatcccatcatgatttgtttttaaaactttttttagagtcagagtcttggtatgttgcccaggctggtttcaaactcctgggctcaaacgatcctcctcctctagcctcccagttgctgggattacaggcattttaaattcacgaccagaaactaggactgccaattggcaatcctaccacattccctggtcgatttactctgccgcgctgctagatggttaattcatactcctctttcctcaaacttccgacacctctcctcctcctccatcttcactcttggctcatgatcttgttttctacttctctgaaaagtaattgaagcaatcaggagagaatttccacacattccctctaccacatctattcccacctgctcctgtgcccatatatactctgcctccctcctgctgccatggatgaactgtctgtgaccctgaggccaacccctttcctcatctttcgcagtccgagcccccttccctacttaggagccctgcaccagcaattctgccctctttcctgcattgtcatatttctctctccatgcatcacttccaatagcatacaaacacgctggtattcccctacccttaaatatccctctcttgaccccgttaacctctgtcaaaactaagtcaaatctggtcattcctgtttgaaaccccctaatggctctcgtctcacttagagaaaagtcaaaatcctacaagaccctatatagtcagagcccatctacttactactccaccacctgtgttccctgttcctagaacacacaccgggcctcctccttgctcaaggccttcgtatctgctgtttcctgaaaggctctctgagtatctgaatgttcattccctcacttcacatcttcactcaaatgccatcttttcagagaggctttctttggcctccctacacaaaataaccaccacactccctcatattacccatctctcttccctgctttatttttcttcttagcacttcacgctttctaacctaccataccaaccttacttgttaggtttattgactgttccccccatttgaatataagccccatgacagcaaaaaaaaatttttgtctgttgtgtttgctgccaaacatattctctagctagcactgcagtgcctggtacataggaggtgctcaataaaagacacagacataatgtaggtcatcttaaagtttgcacagtcatgctcatttatgattcttctgcagcctctgcttagagttctctgaatcaaacccatggacctcgtcttaccatggtctactgtgtacatgtctttttgtctttcaaataaaatctgactgtagaacgagaaaagcgaaggacctggagtgccttcagcaatgcactgagtctctttcctcgctttcattttggtttctactaagtttggtatggagagaggaagcatttgtgtctatcttggagagagagcagagaagatcttgcagggggtttcagcatgagtatttggcaacagaaaggatgattcagagcttgaacgtgaaactcatacagaggcttaggggaaaaaaaataggagctagaaagagaagggagaatcagtcctatcgcctgagaatatggttctctggatcagaaagacactgtggcccaaagcagattccaaagatgaaaggagaagcggcattccacaccaggaataaatgttttagccttggttaaaagtaaacataaaagcaaatcaccacaggattaagatttcaaaacaataaggaggcagtgagctctagagtcagaaagacctcgctctaagtccagcttccaccacctcggagcgctgggacgcagttctcagggttgcagaggatttcaatgcaagcctggagcactgtctggcaaacggtggggcctcaagggatgttagttccttcccccgctacagcctccactgcatccccacagccccgcaccacgtaagacacatagcagatgctcaagaaatactagtttgatgaacggatgggtaacacaagaggaatcagttcccaaatcaagctgcttctgccctcacaccagacttcatagaattcacttgcttttttatcactttcctgcatccccttgccctctgcctcacccactcccaaaaccatcttcacgtttgttgtttgtgttcccactccacaatggagccggcgtcagctacgtcaatcctcgagctgccaaacgttcatttccatttaaaaacatcgtgttttagcagagaaacgtggactagggaggcacggtgcagacaccagcctccatctattactccaggctgacagattttttttagcagagtcttgtttttctcctctgaaggaaagcttgtttccatagaaggatttcccctctttgtgttcttgcttcattcacagttttagtgtttacttttgctttttatctttgcataatccttgctgttttaagaatctgaggagactctggactatagtccctcaccctcccctgtaaatatctctggttcatgccaatagtggctgacacatttccccagttttccttcacatctttgtcgtgtgaaaaaatgctggtaaatcatgtggacaagcctcagatgacttggtatttgttcatgggacatttttcaaatccttctgccaagattttgtgcaataatcagtttgttttaatgcagttcatggagagagggttccagttctgcactggctgtgcaaccaccaacctttctgtaagtccaccaagggtctggaggcggagggcctcaatgcttggaaggccaggaggcccactgctcagggaacaggtgtgctcatggaagtaagtggctggcctccaggactagctcataagcaatggggaaactagggttgggaactgtttggtggagcagcaaaaaaagtgatgccatcggggcaaccccagcgtgagtgagggcaggggactcttcttgtcttgttcacaatgtccccagcacctacctgtgtgcacagctcaggactggtattctgtaaatatttgtggaatgaataaatgaacaaatgaggtagaaagacagggtaccacgagaatcctcttgaataaaatggagagttttgaaagggattaaattgctattgtcatgtttaattttactggaaaatatttgtaattctactgaaacaccaggttggtgtggtctagagaaaaaaaatactagacaccattttttttccatataagacaaaccaaagcaaggaacttcattttttaaaatttattatttttttttattttaaatgttttttttctgggtacatagtaggtgtatatatttatggggtacatgagatgctttgatacaggcatgcaatgtgaaataaacacatcatggagaatggagcatccatcccctcaagcatttatcctttaagttacaaacaatccaatcacattctttaagttattttaaaaatatacaattaaattattatcgactatagtcaccctattgtgctatcaaatagtaggtctcattccttctatttttttttgtatccattaacaatcccaacctccccgccaaccctcactacccttcccagcctctggtaaccatcctgttactctctatgtctatgagttcaattgatttgatttttcgatcccacaaaataggggactttaggcaaaaaaataattgatgcctagtatgtgccaaatatggtgtaaataggaggtgagaaaccaagataacttgtgtatataatgctatacacctggagttattatgcaaacatacagagttacaataattgagcacttgctgcatgccagacactatgtaattcttctactaccactaagatgttgtaccattattatttccatgttacagatttagaaactgaagctctgagacattaaaaaaaaaaacaaaaaacccagctcaatacaaggtaaccttgaaaataatatgacactcgaattttccagtgaaaaaattaccctcttccagagatttttggctaacctgaattaaaaagcttttagaaatgacagcacaaaatctcatacacattgttcaaaataagaaacctaccaaggtcactgacttaatttttcctttggtcaaaagaagaagagacagaaataagtttctgaatttatttctcagagaacagctgtgcccactgatcaaacttaatgtaatctttgggagttacagttaccaatttgaataatgttaccccatgacaattaattagcatgtaatgttatttccattggagacattattaaattttagaaagtctagatgtctccaagtgggcttcttagagataactctgaaaggatatttaatggtaacgaaacacagggtaggattttactgtgggaatgttttcaggcttccattttatccagcagctttcctctgaatggctttactgtttatcactcagtgtcatgcgctcgctctctctctctctgtgtgtgtgtatatataatatatattatatatattatatatatttatatatatatatatatatttttgatactgagtcttgctctgttgcccaggctggagtgcagtggtgcgatcttggctcactgcagcctcctcctcctgagctcaagtgatcctcctgcctcagtctcccaagtagctgggactacagacgcatgccaccacgcccagctaatttttgtatttttggtagagacagggtttcgccatgttgcccaggctagtcttgaactcctgagcttgggtcatccacccacctcggcctcccaaagtgctgagattacaggcgtgagccactgcagtccctatatttacatcaacagcctctcttagaggcctggagtttctctatgatatggtttggctgtgtccccacccaaatctcatttttaattatagttcccgtaattcccacatgttgttagagggacctggtgggagatcactgaatcataggggtggtttcccccatactgttctcatggtagtgagtaagtctcacgagatctgatggtttgataagaggaaacccctttggctttgttctcattctctctcatctgctgcgatgtaagatgtgcatttcacctcccaccgtgattgtggggcctccccagccacatggaactgtgagtccattaaacctctttttctttataaattacccagtctcgggtatgtctttatcagcagcatgaaaacggacgaatacaaccagcaatgctaaaaaggaaaaatacactttcaagaccacaggcaagattttatttgctgggtctgaatcagatacacagaccccagacaaatctaaggctaagtgaaagaatacgagaagaaacagattttcaggaaggaatgtgagacctatagcatttttcttccagggatgaaatcatgtgataatcggacatctactatccatcaatttcattcaataaacatatttcaaatgtctttatcatgattagagccagccacttttaagccaactaaccattttctgaagtctttgtcctgtctactttgtttcctccatagaaacacacatgaaagcaaacacagccccttcctccactacatttgttaagtagccgcatattatttcagaatttattaccaattctctaaattgaacattgggttatttccaaatgctcaatattacaaaggacattgaaatgaacatcctatgaagaaacttctacacacgatcttaatgatttccaaagaatagttatgtcaaaagtgtgcatgtgcctaaggttttcaatacacattgccaaactctccagaaagatcacgttatagttaaggcaaacttttcactacgtttcctggtattatcattgccacatttgccaagatttggctgtaacactcaataaatttttttcaaaaccatttttattatagtgtataagaagcaaagtaggtaaagtacacaagctaaagtatacagtctgatgaatttttacataggtatgcctctgtaacatcacttgtatcaaaatacagaatatttccaacacccagaatgtttcattatgactctttcaaatcaatacttcccagccccaccctggcataagggataatctttttttttttttttaacttccttccataaccactaacaagttttacctcttcctgaacttcgtaaaagtactcttttagtgtctggcttatttcacccaacatgatatctttgaaattcatccatgttcctgcatgtttcattagtttatattttaattagttcattatttatattgctatgaagtatttccctgtataggaagcaccacattttattgtatccattcccctcttgatatccacttggattattaattagtttggggctgttaggaataaggccgatatggacactattgtgcatgtcttttagaagacacatgtacatatttctcttggttgtatacctagtagtggaactgctattcttggggtgggtatacatttagctttagtggaaattgctggtttttcaaaacggctgaaccaacttaaattcccaccacaaataatgtgtgagagtttcaggtatttcacatagttaccaacatactgcttaaaccttaaggtacttggtagatatatgacatgacagtccttacgtgttcaatttttacatcagtaatttattctagagtttacctgtagtatacagattacaataatgagggaggaagtttagtcagttgatttaagtggatgatcctaggtagagagggtcccaattatcctggtcagcatgtctgagaccgtccaaaacaagggtgccccactccggggccatggactggcacccgtgcatggcctgttaggaactgggctgcatagcaggaggtgagtggcaggtgaccgaacaagcgagcgagcaagtggagcttcatctgtatttacagctgctccccatcactcacattaccacctgagctccgcctcccatcagaccagaggcagcattagattctcataggagcatgaaacctatatgaactgtgcatgcgagggatctaggttgggcgctccttacaagaatgtaatgcctgaggatctgtcactgtctcccgtgccccccgagatgggactgtctagttgcagggaaacaaactcagggctcccactgaatctacattatgttgagttgtataattatttcattatatattacaatgtaataataataatagaaataaaatgcacaataaatgtaatgcactttaatcatccccaaactatcccttcccctcaacccgcccactgtctgaaaaattatcttccataaaaccagtccctggtgccaaaaaggtgggggactgctgatctaaagtgcaaaaatgtcaaagaaaaatccatatgacctttcaagtcaagttattcacctccaagatgaacctctaagatgtgacagtctataatatgccacagagtcaacaatctaaagaaagatacaggcacctgtatctcaaatctaagagggcctatgttactctgcacattaagacttctcatctccatgagaagtctcaaaaattgttaaaaagtctattaaaaatcataataaggcctataaaacctttagactttacctagttgaggccttacatgtccctgagaaggatgtattaccgtgttcattttataaataagtgaactgaggttttttaagagatatagctactgagataatgaatcagtctcaaaggctatgtagaagaaccaatttcaattcgttgtcctccaactaatccattgccggactttttccaaatgcacacttacaaaaagtaatttgtaaccgtctacctggaagatctagccatctgttagacacctggagccaagaatgtctgaatctgcacgaatgccaagaagtgtgcaaaactgaacttgcgatctgccccaccatttcctgggcatgcccagggtggcagcggtgctggtaccttccacctgcccctcaagatccaccccatcttctctgggagtccagtgtacatggctgcatccatggacaaggcttcctgctgggctcgcccctgaggagcagcagcagggggaaggagggagaagagggaggctggggtgttcatttcccctgttgccttctctatggctcactgtgggctggctccatcctctaactgaagggcacagcttgggtcaggaagccccctccacagagcctcttcacccccaggtttgggtaagtactcccttccctcctcaggtctagggctggtgttagcccttctgtgactaacctgaaggagctctgcaatgatctgcattttctctctacctttgtaagaagttacttcattaatgctcttcaggttatctgatttgggtgtatcatctgtttcctgtttggactctaggtgatactgtagtcttgtcaaagcccagaactgaagccttcataataaatgaaaagaagggctccattggaaatatcataagtgatacatctagtcttaggaggcctggaggaggaaaaaggaatcaatgagcttttccttactgactcataaaccacccaagaagagttggtggtctcctcaacactgttgctacatagcaaggggagggtgggaagaggaagaaggagggaaagggccacatagtgagcacttattatgtgccaggtgcagtacaggattttcacacacatcatgtgatcacgtgctgtgtaatcttgtttcgaccgtaacctctctttgtcccagtttttcatctgtaaaatgagaataatagtaggatctattttgtggtgttgagacaattaaatgagataatacctgtaaagtggctaacacatcatacatgttcaataaatattatctattaataatgatgatgaggataatagtaatgattttaaaagcctcataatcatcttctaaagtagatattattttgcccattttaaaaaggaaattaaggctccaccagtgatgtcacaaagaagaggcagaagggaaattaatctggatcctgacataaaatcttagaaatttcaccatcatcacatcaccctgcccctcagttgcctcccatgtgccacaattcacaatctatataagggatggcatatatgtgacccatgtgctgtcatgctcttctcccagatgagtgatggacaagggtcctcttttgagctgactctcagaatgcctcctaacatactccctgtcttagtcctttttctgctgcaataacagaatatcacagactgggtaatttataaaggtcagaagtttatttggctcatggttctagaggctggaaagtccaagactatggcaacactaactggccagggtcgtcacctagaagaaggtatcatgtggcaaggaagcaggcacacaggaaacagaaaaaggaggccaaacgtatccttttaacaggaacacattcctacaatagcagcattaacccactcatgagggtagatgcctcacggcctaataagctcttaaaggcctcacctcttaatactgttacagtggcaattaagttcccaacagataaacttttgggggacacattcaaaccacagcactacctaagcacccactaataatcactcccagttgacctgtgaggtaaagctaatttatccttgaagaaaaacattaatgcagatgaacaggacaaagtcagattcaacaaagactgtgtgctccatagatcaaaattttgttttgttcacaccagtatccctagggcccagaacaatgcttgatatgtagaaagcactcagtaaatacttgctgaataagtgaatgaataaaaggtattatataaagacccatgccttcagagaatttacagagaatgaagacagacaaaaggaagaccataaacagacctaatgcaaactagcctaagataggcaccataaaagcatagtcagttgtgggtaaaataagaagagagggaagtctgaattagtctgggtaacagcatttaaaaaagaatatggtgttgctttcaagttatcttaatctaagctcaccctcttctcaggcagatactctaataggcctgctttaacaagcagatgaaaataatttataattagtaacactatttaccttaaactgtttacaacttaagttcataaatctctttggagagaacaaatgggactttcaacccaattctgggtgggtcagtgtgaataaatgagatcttgaattattcgaacaagagccctaaggtgctatcacttgtccttttctcactgaaacctaacaggggcccacacagagactttctcctcttcctttgctctaacatggaaatattttttttttttttaattttaagagccataggccaggcgctatgactcatatctataatcccaagactttgtgaggcagaggcaggaggataacttgagcccaggagttcaagaccagcttgggcaacacaggcaaacatcatatctattaaagaaaaaaattttaaaaattagccagatctggtggtgcatgcctgtaagtcccagctacttgggaggctaaggtgggaggatcacttgaaaccaggagtttgaggctgaagtgagctacaatcatgccactgcactccagcctggaaaaaagtaataattgttctaaaaagttccaaaaatacaaaaatttaaacagtagagagtgaaagcaagcaaacaacttctccccaacccaaatgacaacaggcgtcagcagactatggcctgtggccaaagccagtctgcacctatttttataccgcctgtgagcttaggattgtttttatacttttaaatgactgaagacaggaataatattttgtgacatgtgaaaattatatgaaattcaatgttcaatgtccatgaaattttggtggcacatggccacgtccatccctttatatataaaatctgtggctactttcaagccagagctgcagagttgagtagcacccccgatctaaaagaatagattctttggccttgctaaaaaacacttctctttccaactcaccatctcttttttttctttttgagacagagtctcgctctgttgcctagactggagtgcagtggcatgatctcagctcactgcaacctctgcctcccaggttcaagcaattctcctgcctcagcctcccaagtacctgggattacaggcctgcaccaccacactcggctaacttttttacatttttagtggagacggggtttcatcatgttgtccagtctggtctcgaacttctgacctcaggtgatccgcacgtcttggccttgcaaagtgctgggattacaggtgtgagccactgtgcccagccctaactcaccatctcttattcatccatctatacatcaaacaagttgtgtaatataacacctcccgtttgtcaaccggtttttttttcatttaactatttactgtggctatcatactccaatcaggctgctataaaaaaatgccatggattctacacgactgaaatttatttctcacagttctagaggctgggaagttcaagatcaaggcattggcagactcagtgtctggtaggacctgcttcctcatagatggagccttcttgttgcttcctcatgtggtggaaggggcaaacaagctccctcagcctaatcccactcatgaggactctaccctcttgacctaatcacctcccaaaggtcccacctcctaataccattgcactggggattaagtttcaacataatgactgggagtggaggcacacaaacattcagactagagcagtggccatcattcttcaggttttcacagaacaatcaactttctaatatgtatgtcaatatcacccatatccctatcaagtttcttacaggcatttcatgaccagccatgcattcaaaagcatctcttccctacctcacttatcttgctggggaaacagcacagagagtacagactgcaaagggctcataagaaatgggagctataaccctgtgacttccctttgcagtaaacacatgaccctggtaatcagtcactctccaacttggctggtccggtgtggtagaacacaccctgggtgactgtgcagtttggttgggaaaatatttgccaagcaaatgtcttgggtaagtggggagtcccaaccaaaaatgtgagatgttagtcttctgctcatttagctaatgtgaagaactagctttagactgtatagttttcatacctaattcctagcaactcacagattcatagataaactgattttacattggcttacttcctacaattattttgatggcactttgttgatattctactaacaaatgtgttttttcctagaaagtttcaatttagtcagtaaatatgtactactgtaggtggtctttggtatttggtttagtgaggatagagaaaaaaacatctttagcatgcgaaaattattcctggaataattttcaggaatggcttaattaagagttaagtttttgctagaagaaactttctatgatagcactaatattaaagaaagcaaaacattttttgatctcacatatgattctaacgtatattagttaaccaaattggctggtgttccagttactgctatataatatgccatcccaaaaattggtggcctaagacaatactagtcatttatttttctcatgaaatctgcaattagggcagtgctcagcgggaacagctcatctctgctctatggggcattaactggggtcattcaattgaggcaggggatccacttccaagatggctctctcatatggttggcaagttgctgctggctgtaggatggcagctaagctgggctgtcagccagtgtccacatttcctttccatgtgggcctctctatgggcttcttgcagcttggcaactggattctaagagtcagtgttcaaagaaaccaaggcagatgctacaaatcttcttacagtctacctcataagtcaagcaatgtcatctccaccgcattctaccagttaagcaaattgttaagaccagcccaaagtcaagcaggggataataagatcccacatctcagtgaaaggagttgcaaataattcatggccaccttgaatctaccacagcacataaaagaaacaatataaatgaatctctgaaactcatggtttggatatcgaagtggcaaagagaagccaagagtagaattagagtctctcatggttggaccaactctcttgacaagaaggaagacacagtggtcaagagcacaggccaaggccaggagctatggctcactcacacctgtaatcctggcactctgcgaggctgagacaggtggatcacctgaggtcaggagtttgagaccagactggccaacatgtgaagccccatctctactaaaaatacaaaaattggccaggcatggtggtgcacacctgtaatcccagccactcaggaggctgaggcagcagaatcactcggacctgggaggcggaggttgcagtgagctgagatcacgccattgcactccagcctgggtgacagagcgagactctctctccccgccaaaaaaaaaaaaagagcacaggccacccaagtgtgactcctatgttctgtcatgtaccagctgaatgaccatagacaaactgtcctttccatgtccccatatcttcatctacaaaatggggaaaataatgatgtccactgcagggtttatccagagaaatcaagattctgctttttaattaactttaaaatttttttaacctggtatataacatgctcacagaaaactgcaaaataagtgctctgtgaatttttactaactgaacagacttagctgaccaccacccagaccaagacgtggaacacaggaaggactgggaaacaacagggagcgggaacaatagggagtggggaaggggagtaggaaacaacagagggtgctggagacttcaggaaacaggagaccacagattcttggctcttgccagtaataaaggtgggatgtgtagattaagcaaaacatggcagaggccagacttagtccacatacccctgtttggaaccttgaaaataggaggtgttagcagcttgaagaagtggggagggtttggaatagtgttaagggatgggaagatggaggtgcgtgaagaacaagaagggaatgtcagcataagagaggctgacatcataggtatagctcagtatggcagggataatgggcgtggggttaactaggctcaaggttctagaaggaatcttggtgtgaagttgtcctaatacaggaagaagcctaccaggtgctgagaaacgctcagagacaaacctcttgccacaaagccaagtgatcacccttcctagctgtcacctatttaatcactaaaacatcacaaggagctccactcccatatgcaactgtgctcagtctttctccccctctccttttgctcattcccacacatagtaagacgtttgttttctctcccttgctcactttgtcttgcttttgtgtatactgcccctctgcgtagagttcctaaaatttctctctcttatgaaacatctcacagcgcacatactgttggaagatttgggcacttcaaatcctttttggaaagaggcagatacaaaatgaggaacacgaaaagtgaagtcctgttcacaactctggctctgaaatccaaggtatctggtagacctcttgaaataatcccgagccctcctcaccttggctacggcaggcagtttaagaagtatgtaactaacctgcacaatgtgcacatgtaccctaaaacttagagtataataaaaaaaaaaaaattaaaaaaaaaaaaaaaagaagtggctaatgagatactcaagagtggtgggaggaggggaaatccggaatcattagcaactaactgggtgactggcagatctggagatgacggcccatggcatgcagctggcaagggtaacatcaagaagaagactaatttatttagaaatatttaaatcaaactcccatctgaacattagaatatgcctgcaccttactagatgagacagcacacaataagcatttcagtttagtgcttggcaaagagcaggtgcctctaaacgttttccccttactcaccccttttcctttcttctcctactctatcaggctgtatatggttacatgaagccttatttacttagggaccctgctggctacagtcagctcttcttctcaagctgtgcccctggcctgatctgaactacatggccacactagttttcaattgactttggaagaaagatttttgaatcatttcattcatgtgttaaaggtgaagtctctagttcacagatcttgagtgtctttggaaatatgttctgccttttatcatccctgccttttatcatactaccttggaggcagtgtgatggtgcagctggttagttcatgtgtgtgaacacttttttatgttcagtgcatgttctattgaaagatacaggtactttacatatatttggaaagaggcaagatgtaaattaatgaaatcaaagtgaagaaaatcccatttgccactgaaatcccatttttcaccctgtatttgtaagtatagtgttgtttttttttttatgaagcactgttttgggtattttaactactgtagcataaaataaaactaaggaacaataactatttgctggcttctctataacacagctctagattcttcacactgtgaatgaaaattcttactcaataatttaggatgaactacaatttttatttaagaaattcaggattattttggagaggaagcatatgggtggtgatgggaacatgttttaggctctacaaaaatgatagtaatttatgagaggaccgtttacatcactcagaatttagcactgagagtccacattttggtttagaattaaaacatttttattttcatttacagtttaaaagcatttaaaatttagcatatgttcttttagaagtgtacatgcacacatacattttgtataaactggactatatgaatgcattttgaaatatgttttttcaaaaatttaatgcaagcctttctattatgattgctacatctacaacactgaagccaaccagtgtctgtcttgttggatgttatcctcagtgctttactattttaaacaatgcttagatggtcattctttacatatatctttatatgcctatcccattgtttccttaggataatctctagaagtggactgactgaaacgaaggataaatacattttaaagtctggaatatatatttcaagctgccctccccctatattatgttgatctataatcctgccagagtactcttcttcatactcttgccagcattggttcctgcatttctttgctatcttcacaagtttaattatacatcttttgttatttgcaaagtttaattttgttcacacatgtattgccacctgaatttctttttcggtgaagtgcctgttcatgacctatgcaggcgtgaggtcttgcctgtggtttgatcctacactgataaatttcacatatttcatatattgttaatgcacagcagacatcgcaggcctctgatgaatggctgtgtgtatttttgaggcagttctggctgtaaaatataaatagggtagaaaaaggaatgactcaaagctcttacttcttgtctgaagtaaacaaaacatgcgctccagtatatttgggtcaacacaaccagcatttctagctaaagaaaaagggctggctctggctgctgagtcacttaaatcatgtttcacttggcaacatgactctaagtccttctgcaaataaagaggggctgatagctactccaagctccaagcaatgcattaatgacaaaaagataaatttacccacacagaaacatagaaacaagagcaggagtccagctatttatacaagttcaatcactactttatttttaatccagttcctctttctttttaaattagaatttaaatgccaaatgctgtgaggctagaggtcattttaaaccaaacatctgaaatccaaaagccctttctggccatttttattactttaactgttaaacggtacatcgcattcatggatatatccctagtaccacgagttcattatttcctattgcaagccagactgcctcctatattctgtcatttctgtccactcgcatagctaacttccgaggtaatcaggccaaagactttcacaaaaatctttattcctccttctcccttgccctccttacctaatcaattgccaaatcctagagatttttaatattttcttaatataaagcttttactgtagaacagttttagatttatagcaaagttgcaaaattcacctattctcctaacctaggtccctgtaatgtgaacatcttacatggccacagtaaatttgtcacaaccaaggaaccgacactgatacatgactattaactgagctccacactttgttcagatgtcaccagtttttccctaatgtcctttttctctcccaaggtcccatgtccaggataccacacgatgtttaatcacgtctccttagtctcctttgatctgtgaccgtggttcagtcttgccttgtttttatggccttggcagttttgaggaatagtgatcaggtatattgtagactgtccctaggtctacctggtcattttctcatgcttcaactgctgtcaatggcttttctggaggatgaccgcagggctggggtgccattttcatcaaatcctatcaaggatgcatgctatcaacgtggctctcggctgcttcactcgcaacacttctaacaccaactgtgggggtttttcctcacactaattctccagttttctggacagcagccaggtatcctgtaattcaattcaattcagttctgacactaactacccagagttaacacagagccccacaagactgccccatttcagacaccaattgcaagtcctgagccctccacacttctgactggctataaatctggggtcaggggagtcctaaaactccctcctcagggctcacagaactaaggagaatactttcctactcttacttgtttgttataaaggatacacataaacagctcaaggaagaggcacacggggtgaggtccagaaggggcagagtacagaagcttccatccctgtggggttgggatgtgccccattcctggtacatggatgcattcatcaatctggaaccctcagaaccctgtcctttaggttttttaatggagcttccataacagaggtatgattgattacatcattgaccactggtgattaactcaatctcgaccccttcacccctccctgaaggaagggtgactgcattagtctgttctcgtgctgctaataaagacatacctgacactgggtaatctatacaagaaagagttgtaattgactcacagtttcatatggctggggaggcctcacaatcacagcagaagaacaagggacatcttacatgggagcaggcaagagagagcttgtgcaggggaattcccctttataaaaccatcagatctcatgagagtcattcactgtcatgagaacagcacgggaaagacctgcccccatgattcaattacctcccactgggtccctcctacaacacacgggaattgtgggagctgtaattcaagatgagatttggatggggacacagccaaaccatatcagtggccctgaaagttccactctttaattacatggctggttcctttggcaaccagctccatcctggagctatctaggggcccaccaaaagtcactgcattagcagaaactcaggtaaggctgaaggggcttgttatgaataatagaaaatgctcctatcatgcatgccactcaggaaattccaagggttatagaagttctgtgtcaggaaccagggacaaagaccaaatatttcttactctatcgtgacttagcactgatgatgttgaccatgaccacctgactcaggtagtgtctgccgggtttctccactgtaaagttcctgtttaccctcttttcatactcatttttcagatggggaaactgaggttagaagttaaatgattatgtcaaaactaaaaagtaataaaaccaaaattggaaggcaaggcttctcactccttgttctgagtttcttccactctaccaggagttggcaaacgacaatggtccaggggccaaatctatcccagcacctgtttttcataagggctgtagttttaagctgttgggaaaaaaaatcaaatggacaatatttcatgacatgtaaaacttacattaaattcaaatttcagtgtccataagtttattggaacacggctatgcttgcctgtttacatattgcctatagctgctttcatgatacattggccaacttgagtagttacggcagagacttatggtccacaaaggttaaaatatttcagcttaaaaatgtaaaatatctggccctttacagaaagtgtttgccaacactgcactataccatgatgctaagctgcctctttattttttatctatctatttatttatttatttatttatatacttttgtcagggatagagaaaaccagcagctcttaatctcttaagatgggttcattgtgcaatatacgaagtgtaaaacaaaatcctctaaaacatttctttaggggctcagacttgaggtttgctcagctttcccactcttagtgatgatatcacataagcgcagtggagagcttgagtgtgggagagaagaagagatgcagagacagggacacagagcagggagaggcagagacacatacattactctggacattagaattggagagaagaagagtgactcccccaattaacagatcatagataaaatttgtgcaatgagtctaaaacaccccaaaaaccaaaaaacaaaacgtaccggggaggctgtgacaggccaggatcttttaaatgcaaaaatctgagatcttcctccaacatgtacagcaaagacattcttagaaacgttgcctacatgtttccaagtctcagctgctccaacagcatgctcaagagactgcctctccactctctccctcactcaaacatgacccccatcattcctatctgcagacgacaaggctggctactcgcccaactccaaaactgttctctgtttatttctaactctaggaaacgacagagatgtctcaagagaactgtattctggggtgttacgttccgatttttattgtatgtataatacagaaagctacttttcgtttttgtctcagtatcttttgtgaatagtcacttttctaagttcatatcgaatacctatgaaatttcttaggaggcccctcctttagaaaaatattttgcaaggcagataaaaagctggcaccattcaagaatcaggaaagtgggataatccttggagaggaaaatgcaactgtcacaaaaagacaaagggcgaagtgaaggccgtgtgaggataacttcatgaaagcagataatagaaaaaagaactgatgttagaaagttcaaggttaaggacattgctgaagctgtgtcatcattctgacctcaggaactctgcatttaatactttatactttcaaaaatgtgtttcaccatcacagcaatccagtgaggttaggaattagcttcacttttcaagtcaagtccaggcattaaatggctcatttaagttacctccatgagatcagggctcagctggatcatcactgtatacccagagccaaccattatgccttggaacacagcaggtgctcaataaagacttgctgggaaaatgtcattaggccgattgacaaatccccaaatcttctatctcctagtatttacatcactaatggataaagacgaccccctgctacaataaatacccctctcctttctattctaccatcaaggtgcaatttgttgatcaatgacttcccagcttaggcatcctctaagtgcagctctgacactcagtgagtcaatcgcagacacagagagcaaggagagggcctcaaaatcccatttcttacaggagaggatgggttatattaatcttaaaacacaaatgtggacaccacagtatttctagaggatcagtatttatggaggagacgttaccttttaataattaagtcctaaggtggcttttcaaacttacggatgggactggcttacttaacagtttagcaataagaaaataaagcacaagatgagaattctgcacaactcgccttctggtagaagccatatctgtgaagcagaacgagtataaggattctaaaaaaagcagaagaaaatccagctgtctttctgtgatcatctcataagaacagcaactctcaatcacagtctacttagtacaatcgattcattaacacctatttacataataacaccagggtttgaggctacaattttctgtacagaggcatgattttaaagcaagtatcttcacaatgccacacaatgatcctcaaggcatgaagatatctagcagacaatgccatgggcttctggagtcccctttaaaattttatttttccttttcagtcccaggaatgaatagggacttcctggaaatgccatctaaccttgtattttagagacattgttggggataacaaggcatgaaattgctttccaaaagaaatcatttttctgtttcaataaatggtgctggatattgggggagtccattcaatagccgatttgaataagggagagcaaagaaactctttagatgctgttcaagttattcctggattgagatattggtactgagagatgatgagaaaagaatttatttaaaaagaaaatgtgaagagcagttggtcatgagagagagagtgactgtgttattctcaagaaaacagtagactgtccccagtttttgccaccaggccacccagctatgatgggataactagatatataaagcccagtgtctgccaagggcaaattggttcctcaggtaaagcacaaataagtcactagcttgacagtagaatcagcagcaggttgttttggttttttgttttttgtcttctattttttgttttgttttgttttttcagtaagacaacaaagagctcacagtccccaaaagaaaaagttactttcttgccaacattggtcaaaagtatgattcttttagaaaaattcaatgaaggtttcctctcccaaccccatcaaggcaggaaatggaattgtatttcttaaatgaatgaatgttttcataatatttatgtttttggatatatatgatcattaaaatgtgacttctatttgcatgtgaagtggagacaaattagaattgattgcatgtggagattttgtttgtttcgtatccttttgtatatgctatgaaatcttaaaatcattagaccaggaggagcctggaggggccattggatccaccttacgtctctctgcttccaagtgtgggccttggactagcagcatcaacatcttccgagaccctgttagaaatgcagtggaccccatctcagacctaataaattagaatctgctttactacaagattgccaggtgatttgtatgcacttccatctcccatcttcttcagctgtaactttcctggtctcagacaaactcatctagcctacagatgggttagtggtcaaggaggtagtgtccaagaatcagaatcactttggccgttggtaggatgggtgctgactggccatgcctagggtcgcatgctcagccctggatgaaggaaggtccctagaaccatggggacttagattgaggaagaaaatcaaggcgctactatcagaagaacagggaatggatgacaggcaagcaaaccaaaagaccttcccagaagtgatcaattacttgggatgagtatctgaccaaagtcagatcaacgaagaacaattgcatgactttggctgtatctacagagaaggggaggctcttagattgaggttataaagttcatagaacgtaaacctagagctgccacgtggagaaagcctgcctgtgaacaaggcaaaccccaaggaaacagggctgggaaatggagagagaccaggtccctgtaagcttagttgtgtccctgaatgtatggccactaactccagggggcagccttcacactgtttgctaatgcaatgtgactgtgcccctgaagctgtgccatgacatgccagccctccctagatccagctacacctgaagcacattttctctctggacttttgttatctgtgcccatcaacttctccatctttttttttttttttaattttgatttaagtcggtttgaggcagattttctgtgacttgcaactgaaacactgctgacacccatgcggtgagttttaaaaatattcatgctcatcccagaccaaaactttttctcctgcaaaagacagactctgatatggccaaggtggagatggggagaagggaaacgggttggaggatgcattcttatgcactgccaggaagaagtcaatgaagaaatcctctacaggagagcaatatgattatctctatatttaaatattttaaatatttaaaggtatatgccatttggcctagtggttctatttctgcaaactgataatatagattaactagcatatgcgccaaaatatttatgttcaagggtaacatttaatttgttgggacagcagaagattgtacaaccaaaatgcccagcaataaaaggctagtaaatgatggaccatctaaacaatgtttaaaaaacattcctgtagttattaaaaagcaaatatgggaggtctacatgtgctaacccggaacaatccctaagataagtaaaaacaagtaaggtggccgggtgccgtggttcatgcctataatccctgcactttgggaggccaaggagggtggattacctgaagccaggagttcgagaccagcctggccaacatgatgaaaccctgtctctactgaaaatacaaaaaattagccgggcatggtggtgggtgcctgtaatcccagctactcgggaggctgaggcaggagaattgcttgaacccaggaggcggaggttgcagtgagtcgagattgcgccactgcactccagcctgggcaacaagagtgaaactccatcccaaaaacaaaaacaaaacaaaaagaaacaagcaaggtatggaattatgtatatgttaccatttgtgtgaatgcaaaagataaataggtctatatgtatatatatacacacacatacattaaatgcatgtacatggatatatctctaggaatagacagaaagttaatagggattgtttctgggaaggggacaggattgggagagagacctactttatgtcttttaaatattgaaaatactatatgcatccactatatatttaatgccttggcagatttggaatgtttccctcctttttctttctttttttgagacggagtctcactctgttgctcaggctggagtgtcgcggcacgatctcggctcactgcaacctctgcctcccgggttcaagcgattctcctgccttagccttctgagtagctgggattacaggcgtgtgccaccacacccggctaatttttgtatttttagtagagacagggtttcaccatgttggtcaggctggtctcgaactcctgacctcgtgatccaccccccccccacccacccccacccccagcctcccaaaatattgggattacaggtgtgagccaccgcacctggccccctcctctttcttttattaatacaactactggtctaaagaaactgagaatgcatgtcccaagcaagaagtctggagactgagaaatcagcggccccctcttgtctaattaggccaagagctgagcatatcatactcacaaatgaaaaatcactgaaagaacttcattaattggctagggtagagctgcagtgggagtggaaattatttttcccaggagcagcagggcagaaagattcagctatggaaacatctgtcctactgttaggtgctgcagggcatgttgcagaaattcccaggacccatcaatcaaagcaaccctactggtaaatactttctctcctgtgatgtgaatcctcagtggcctctggcctgccctactggccatttagaattaccaagccctcctttggaacaacactgttttctgaagctcttcccttattcttttatcccttctaatacatgcgcagctggaaacatttaaagcttcaagcatagtttaaatgaaaagtgtaagtaaggccgtgtgttgattcttaagctccaactctcctgattacgagggttagacagtctctgccatgactctgtgtgatctgcagtggccacggtgtactcactgacactgaaacagcaaacactggaacacatcagggtgacctgagacactcagagccaagtccaccacacagtgacagctgctgtttgggaagctcatgattggcattcgagttggctatcattttacgggtttaaaatgtgcaacccaagcatgacgatgttattgtttccatcaagctgtaattaacctacgaattaaccactgctacattgattcaattcaaggctatcttagaaagagtttgatcccaacttttgggattagaaactcgttctccgcttttttcccaacaaagctcctcctcctctccaaattatatattttaccagttagaagagttattacttggtagccttctgaaatgatacatgcaggatgggtggggcagtgggaagtgtgtggagaaggtggcccatgtttcttaccagaggaccacaattgattttgatgctatccctaatgaacactcaaagtttgcaatatttatcttcctaggcctcagccttctcatctgccaactttcttggggaatgagatagatgatctcagaggttcctgtactgcaccatcagcacttgaaacgaaagcacccaaaaaggtgaggtggcatctaaaaaatcccaaagtttggttgttttgaatattactgtggatttgagtgtatgtgttttgatctttcacagtgcttttcttaggaaaatgcttagtaaatacttgtggagctgagcaacctttatctctagtccagctgcctataagactgtgtgtgttcagtttaaacattaaaggacagttcaagtatgaaaatttgcagaccatcccatttaaatatattcaacatggactagtgtctattattctttatagcaagctaagaggaatgtgtagttctttttcagttggggagattttaaaaattacacagaaagtcctagtttaaactagaactagtttaaccttgagcctctcaagtttgggcagattgtgaagccagccaaagagggctacgaatcatgccatggtgtctagggaaatagctttgcctttgcttcactgcaagctttccggttccctcctttattccacagaacatgatgcggtcacaacaggtgccagatgccccatctgtccagagattgctttaagcacatcagtctgggcagctgcgaacagaatctgacctcattcactttatatgtagtcagttagcatgtggtcgggttagactacatcatggacaagagccctaacaaaaaaacatcctgagcagtctgtgaccaggtctgagtcattgttttacttccagcaacaatgtcaatgcttaggatatagtaggtactcactcaatcaaggttagctgaatgaatgaagtatgacagctttcatcagtgttatgacaacatggctgggagaaaagatgatctacgactatgagtttgaattgagggttacagagcctagcttgtagcaccacatagtttttagttttagacgtcattcccaattgaaaggtttatactaagaacaggcatacacagcaagaagctagcaatatattgagattttcatagctttaagtagagcatatgtacataaatatgcacatatgcacattgggaaacctatactttcactcactaaagcaaacttcatgataaataactaaaagacataaaattgatttaacaaaaatagcccaggggatttcttttcatcacaactgaacactgcaagtaacagaataagattcattcctaaatgactctagactcactagactcactacaagtgaaatttcatcccccaaaataccaacacacagcaaaaatttgatcagttttaagtctagaaagaaattagtttggaccccatgctgcaatatcacactgtatctgttgaaagcccttcaacatgtttcacagcttgaaacatcaaccgattccagagatattgatggctaacaataattaaacatctttttttttaactggaagctactaataaaatatatcaataaggctgggcacggtggctcacgcctgtaatcccagcactttgggaggctgaggcgggcagattacttgaggtcaggatttcgagaccagcctggtcaatacggtgaaaccccgtttctaccaaaaatacaaaatttagcagggcatggtggcacgcactgtaatcccagctactcgggaggctgaggcaggagaatttcttgaagctgggaagtggaggttgcagtgagccaagatcatgccattgcactccagcctggatgacagagtgagactccgtctcaaaaaacaaaaacaaaaacaaaaacaaatcaatgagccaatagattccttagtaattccataatgagcacacattgtggagttggactgagtttaaatccagattatactgtgctctcttcggcagcacatacactaaacaaaacaaaaagcagattacatcactttttagctgtgtgattttgaataatcaatttaacttctctgtgcttcccatctataaaagggggagaataaaagcatgtacttcataaggtcatggtaagtatcaaatgagataattgacataaaaacttttaggaaggaagttagcacatggcaattaatcagtaaatggtttttatcattattacatctatccgcaaaacatgtccatttaacaaatgctcgccattctaatcataaccccatccttcctaaatgctcaacctcagtgtttccaccagcacaataccaacaggaaaaccaatttgtcttgcatccctgttcccaagtgcctgatactgtgcctggcccagagttgagtaagtcctcacttaataccagccataggttcttgaaactttgactttcagtgaaacagctgaattggtatgatgagaccaattttaagagttaaattcctacatatttctggtcagaaaaacatcaacaaacttctaagtaaagaaccaaaacacttctatattaaacactgaaatcaatgtgagctaaatatacacttaagaaagattaatgaaaacaagtaagataattagttacccagttattccagttcagggttttatgtggctggaacctgtcccggcagctcagctcagggtgcgaggcaagaacacaccctggacaggacacatcccatagcagggggcactcacacccacacccacactcacactcactcagactgggcctatgtagacatgccaattcacccaatgtgcacatctttgggatgtgggaggaaaccagattatccggagaaaacccacgcagacatggggagaacgtacagcctccacacagacagtggccctggccaggaatcgatttgtttcatcatcaatgcaataacaaaacaatgttgaacaaaatgacgttattcaaggacccactatagttgctccaaaaatattgggtaagatagtgaaatgatgatagcaatattttaaagcacttaaaaatacatcacaaaaagtatgatattcactgtgttccttaagggttaagggagaaagagaaggaattctaagcttagattgcttttcttttcccacggggatggaagggaaatgaacaacagcagatactgaaaggtgcgctggaattaaattgtgtcaattccccagcataataaaaacagaaagtccattctggagccaaggctgatcacctattcatccactctattttttttttttttaaaaaccactctctcacacaaattctctctcttaccaatatacatgactcactaagaattcacattacatgaaatcacaaaaaagcaataggaattcaataaggcattttctaactctcacaaaagtttggcccccagacagtcggcaacagagagtgctgaatttccaacggatttaccactgctgtctgacagcaagatcctgtgaaagaggttggggctgacgctttgatgctttgtatggggaggggatcctgcgctgggaaagggtcttaatcagaccagtgtgagctgcccacggcttgtaattaaggctcttcctggccaaagcccacagagatgccaggcttcaagtacaggtattcagcacaaaaagccaaaattatcccccggagtgcagaggttacacggttacaaaagccgaggattttttttttttgtcctctttagagaaataaaatcatgaactgctccgatataaaattaaatggcaaaatgtccatgatatagcaagctccctttcccaaaataaagttgtagacaatatgtattagtgagtccatttaattaagcaaagccaaaaaccaaaccctctccactatcccctttctctctgtaatgcatacattgaaagcttcctgaaaatagatatcaaagtgttaaaactgattaccactggaaagtgagggggagtctttaaattttatataatctttcatcacaggaaaagtaaacagattagtttaatgaaccctgatgtacccattactcggtttcagcaatgattaattcatgactagttctgtttcatctatacccttcactcacttcctttcttctgtattgttttggagcaaatcccaaatactattcacccttaaatatttcagtatgtattgttaaaaacaaggaaatttaaaaaaaaaaacataaaaataataccatcattatacctaaaatatatcaatgataacaatttaatacttcaaatatccagtgtttaaacttccaattgtcccaaaaatgttttttaagtaaaaagaaaaacttgatacaaattaatttaatgaagtttaattgagcaaagaacaattcatgaatccggtagcactctgaaccagaggaggttcagaaagctctgctccataactgggcagggagtatttatagaaagaaaacagacatgaggcacagaaacagctggataggtggcagctcagaatttgccttatttggacatggtctgatcagttaacagcctgtaactggctaacacctaacacccagctccttgttacaaaatacactcctaaattaggctttcaagtttatttacattctaagttaggttagcttgttaagtagggactcatggtatggaggcagtctcaggccaaatttagtttaacatttgttttgttttacagttgtttgaatcaagattcaaataaggaccatatataatgattggttaatatgtcctttaagtctttcaatctataggttctccttctatcttactgggttttttaaaaaataattacatttagaattttatgtatctattaatttgaaattgatcactaataggttttctgttttgttttgtttttgagatggagtctcgctccgtggcgtgatctcagctcgctgcaacctctgcctcccaggttcaagcgattctcctgcctcagcctcccaattagctgggactacaggcatgcaccaccacacccagctaatttttgtatttttagtagagatggggtttcaccatgttggccaggatggtctcaatctcttgaccttgtgattggcccgcctcagcctcccaaaatgctgggattacaggtgtgagccaccgtacctggctctgttttttgttttttgtttttttaatgaggaaggaaagaaaaattaaatagctgagagtacagcactgagttccttcattgatgaaaaaataaaaaagcaacccatggtaagagatacagcagtcattacaggatattcctctgtctcccaaaaggcaactggacaagagtccatcaatatataaaacttgcttaagaggtaactttatgaagctagtgaactatcagtagcacagtgagaccaatggcagtgtaaaatgtcatcagaaatgtcatcacaaatccatctgagggaacagacaaatcagcttaactgtcggtgtgtcttggttctgccctagttaagaatggaaatgggggttattaggaagacagaagggagaaatcatattggggaagcaacggataaatgttcactgtcatcactgtttatatttgttgtgctgtgatgctcttgttaaatatgggaggtggtttcagtgctgaaattaacttccaattggtagaagttggggagagaaggtttccaattgtcaaagtacaggatgatgccttacacttggtacgtactacacacatttgttgaaaggaacataaaatagcttaaatttttaaggcagatagccaatgatgcttcccaaactacaagaccaagaaaagtaaatttacggactctccatgtcaccccacctgcattgaaaaagagtccgtatttacatacatgcttgaatctcttagttggttatgcaaacaagcagcattcattgatcaaatatttgtcatcgtgtctttccttgtaatggaaatcaaagaatcatatcattaaaaaagtcaaattcatagaagtagaaagtagaatggtggttaccagaggctgggggtggggacggggagagggatggggaaaggaaagacgctgaacaaaaggtacaaagtttcagaccatgcacaatggctcacacctgaaatcccagcactttgggaggctaagatgggaggattacttgaggccaggcgtttgagaccagcctgggcaacatagcgagatccagtctctataaaaaaaacattttaaaaaattagccaggcatagtggcatgcacctgtagtcttagttactcaggaaggggaagtgggaagatggctggagcccaggagttcaaggctgcagtgagatatgattgtaccactgcattccagcctaggcaacagagtgagactttgtcccaacattttttttttttttttagttagactacagaaataagctttagtgatctattgcacagaattttgactataattaataataacataatacgtatttcaaacttgctaaaatagattttagggccgggtgcagtggctcacactcgtaatcccaggaccttgagcagccaaggtgggagggtaacttcaggcctggagttggaaaccagcctgggcaagatggtgagacctccatctctacaaaataatacaaaaataagctgggcatggtggtgtgcgcctgtagtcccagctacttaggaggcttagtgtgaggatctcttgagcccaggagttcaaggctgcagtgagctatgatcatgccactacattccagcctggatgacagagcaagacactgtctctcttttatttatttatttttaaagtagattttaaatgttcttaccacaaaaagaagataagtatgtcaggtgatggctatgttaattagcttgatctaattgttacacaacttaaacatatatcaaaacatttcatcataccctttacatatatacaattatcgtcaattaaaaagcttttaaaataattttaataattctagtttctttctcttttttggcatatccctttaaaaaataaaatccagctgggcgcggtagctcatgcctgtaatcccagcactttgggaggccaaggcgggcagatcaggaggtcaggagatctagaccatcctggctaacacggtgaaaccctgtctctactaaaaatacaaaaaatcagccgggcgtggtggcgggcgcctgtagtcccagctactcaggaggctgacgacggagaatgtcgtgaacctaggaggcagagcttgcagtgagccgagatggcgccactgcactccagcctgggcgacagagcaagactcgatctcaaaaataaataaataaaatcctacaacatattacacatttaaatcaaataagagttgagttgggcctgttagaataagactggaggacttgaaaccctcccactaatctagtcctacttaccacataatactagtaactcctacaatatcagcttgaatatctctagtgacagggagtttactacctcacaggacataatcttattctagtttcagttcctgatactaaagcaatttcctactattgaccaaaagtctgatttcctgtaatgtctactcagtggaccaaaaccctcttctacaagtgaatatttcaagtatcttaagacagctgtcatcccgctcagctctgcagtctgcagctcaccacccccagttcttcaactgttactcaccagacatggtcactgctccttatcatcctgctcccctttcactgggtatgttttgggagttttaaatatgcccttgacccaggggagtatgctaaccgctcagtgtctgtcgaatttatttctcaactggcttttatcaacgcacacattttctgtctttgtcagtcaaccctgtttctaattttcagccctaagcctgagagaatgcccatcaaaactcatctcttgacttcttgctgtacttcctgaacttggattatcttctcctcttcgtataccgtaggctccccagactcatcattcatagcaaatgccctgcgctccagcagacaatgtgatgcctttcttgatgctgctacttttcccagctcaatccaaaggcccagaaaaaagttctcctcttgtctgtattcttcctaaaacagaatacaacaccccagatgtgcctcggtcacctcagagttcagtgtgactgttctttcctctctccatagagtgcttctcttcaagtagatgggtcatattagtgaatgtgtctgggggggttttagcagctgcccctccctgttcgctcatctcaagctcacagctggccatcagtctccactggccacagctactcctagctgtctccaatgaggtggcccccctgcagatttagttgggccctgaaccaatgacaaccaggattgataatagagtaagacaatggctgtcaatgctagctgcacagttaaaatcatctggaaagctttaaaaactatgaatggctgagtccaaccacagagattcagggtcaattgttctgagtatcctttaaaaaaatcagaattttaaaaaatgctcccaaagtgattttaatacacaggattcagagtcacttctgcaaccggaaatgcctcctaacaggtaaatatgttctagaattcatctgtgtctgtaaaatagagcccaaagtgcctggtagaacttctattccacaattcaaggagctgtcctaaccatctaataaaccatatttaattttcccaacaattccccattgaatcaaggcaaaaacccagcctcagaaatgtccagtaaccagtgcaaggcacactggaaggaaggggtgaatacagagtactctggcaggctccaaaggtagtgtccttaaccctgatacacattccccaatgtagcccattccttggccttgctggagtgctcaccctttcttcccagagtcctgggactcgggctttcctcagtttccaggggggattagagttcaactttgaacctctacctagttcctaccagcccttctctgttgctcctgatatgttcatcattttgaaggaactctgtcgacatagcctggatgcttcaaaatccagtcactaggtcagtcagtcccttgggtgcaattccttctagccactgacccagcactctgtgaggccaaagtggatctctttattcctttcccttctcccccgatcatgccctccccactcaatctatccttttcttccagattctgcccatagtcagtcctggtttactcccagttgtttgcatgctatgtggcaaggcccagccaattacagcaccaattaaatccctctgatttcttctttccaaatgaagtgccataaagctgcttctatttcatcgtgtacatttatgatcactctttgaaacctaaatgtatgacttcacaatttttgcttttttatttagctttattagtttgtgcctattatgtcagcacttccatagaatctgaaattgtcatttatcataatgaggtatctttctgagatgtttatatcagctgcattttctgttttttcttttgagacagggtctcactctgtcgcccaggctggagtgcagtggcacaatcacggctcactgcagcaactcgtttgacttcctgggctcaggtgatcctcccactttagcctcctaggtagctaggactacaggcacatgccacaatgctaggttaatatttttgtatttttagtagagacagcatttcaccatgttgcccaggctggtctcgaattcctgggctcaagtgatccacccaccttagtctcccaaagtgctgggattacagatgtgagccatcacgcccagcccagctgcaaattttttgataaagtcttctttgtttttatccaagttactaataacatggctctttattacaggcattactttagtttggtctaaaaccaacagaatcaacattttctggcaaaaatcatccacttgactgtctccaaataagtatacaatcttattttcaatattttaatgaggagttttgtgactgctttgctgaaactgagattcactatctagatattgttccctgagcctggttaccataatgagtgttgttagcgaacccttatgggttcctggtgatctctttattcttctccaattgctgacaaatatttgaggatctattataaacttgtcagggtttacatgaaatgtcaaagaccatttgtgaaaaagtggaacaacaccctgcattttcctattttttaggatcgctcctattctctataacctttccaaatttactaatagggccaggcgtggtggctcatgcctgtaactccagcactctttaaggcagaggtgggaggctggcgtgaggccaggagtttgagacccgcctgagcaacatggcgaggcctcgtctttaaaataaaataaaattaaaaaaaaaaaaaaaaagagtactaacagttgctttgaggtcagttcctttacatgtgggatgtaatcagctgggttttcttcacatctttccacctatccagtgtttcagtgtccttttaattcatttgtctttttaattgaaaactttgctgagataattaaagatttgcatggagttgtaaaacataatacagtgatcccttgtacattgtactgtttccctcaactgtttttgcaaaactatagtataatattgcaaccataaaattgacatttgatataattccccccatcttactcagatttcctgtttcacctggatttttgtatgtgaacctctatacaattttatcactcatgtataattgcgaatccagttaagatattcaacggttctaactctgcaaagattccctgtgttgcctattcatgactcttttaaacactgcttgctttactctctttggtttttagatcaatttccatgaaggaaaaaggagatgcaaaataagagttgagaggctgtgccttcactgcgctacttgttaacattatcactttctattccttttcagcatggtttcttaatctgcataagaatttctttttaaatattattgttattttttcctagaattttaaaaatgctttcatgtccttaggttttctttatctgatgtccattttcataatttctttgaaatgtagcttggtaagtgggtagagtggtttgcctgtttttctactttgtagtagaatgaaataaataacagcacccatttgggacacaaattaattgacattgtttcctacatagtttccaattataaatatgtatgaaataccttttatttgggtattaaactataatgagcatttgtagctatttaatgcactaaaatatcgtttctgggccaggcatggtggctcacacctgtaatcccagcacttcgggagtccaaggcaggaggatcccctgaggccaggagttcaaggttacagtgaggctactattgcaccactgcactccggcctgggcaacagggtgaggccccgtctctactatatataaaatttccctcagtaatctctttgaggaataagatcatattttatacctcttttgtatctacagtggccgctgtgcttgccttttcaacatatatgccccaaatgattagttttaagccaaagattggcccttgctttataaagtggcagacagtacatattttaggcttcgtgggccaaacagtctctgtcacattactcaactctgccactgcaatgcaaaagacaatatgtaaatgagtgggcgtgggatatgccgataaaactttatttataaaaacaggcagctaactgtagtttgcctacccctgatctaagccaacagtggcaacttcctcagccagtgactggtttacaaatgcacatatgatccaatctggtgaaagggatgtgagaaaagtctgatgggggcttctgggagagacgatttcacatgtaagacacacaaggaagagacaacccttttttcccccttggatgttaccaaatctgaatgtgatagccaggattgctagagccatcttgttcctgatctaaagatgaggccatcaaacataagggggttaggccacgagaatcacagaggagagcagcagcttggcatactgggcctggagacagccccacttcttagggaagacaataaacttccttattgcttaagccaatgcgttggcccaaaagcatcctaattactgtagcaccccctctggcgttcagcaaagtacttcacagagaatagatgttcagcaaacaacagtttgctggtctggctaacaatctgaaccatgaatttatgcaaatcagaattccttccgctgtaaataaactagttcctcttataatcctctttttttcttaaaaaaaaaaaggattaaaaaatagaaaaacaccaatgagaggaataatatagtaaacctatattatttaagatgaatagaaaagtgataagttttcatgttttctgaaaataaatgtgttttaacttatttatccgttccctgcagttttcctcctcttactttaagcctctctctccgtggttggcccttggaaggcctgccatatgcaaatgtgtgtatactcatcagtcttattaggcgtagttccaactggccaccccacatgaacacaattaaaagttaaacatcaattaaaattcacagactccatttagctttctcaaaaagcactaaataacggtacacatttgggacacaaattaatctacattgtttccttcatcagtctttagttatcaaacatcctaagcctcattttagactctgttaattgctcattcagcccacactgagtaagcaatgaaaaacgagcccgagacaaaagaacaaaagaatgagatgccacagtggatcaagtttagtcagccaggtggttcgtcaatgatggtggcactggagaaatcctgtgtgaggacaaacactgtccaagtgaggggcatgtgggtgatctctcttacgagacctccactgatacatgcatctgcttattcatggacgtcgatatctaataggcatgtcaagtttcaacagggcccaaacggaatgcataattttccctctaaatttattccttttccctcttcctccatttcaataaatggcactcagttgcataggcccaaattcagcatcacccctgatttcccattttctgtatccccacgaccaagccatcagcaattcctatcggctctgtgtccaaaatctgttcatccctcttcattccgctgccaaccccttaatccaggcctctgtcatgtgtcccctgtggtgactgcctccgcttcctgactggcctccctctgcccctcctgcctctcaacaacctactctgctaaaaactaaataccatcccattgctcccctccaaatgtgtctccactgcattttagaattagacacctgtttactttcctattgctgtaacaaatgatctcaattcagcagcttagaccaacgtacatttattctcttgacagttccgcagctcagaagtcgaaaatcagagtgttggcagggctgttttccttctggaggcttcggaggataatccaaattctcacctgctacaggctgcctgcactccttggctcatggcctcttcctcactttctctgactctgatcctcctgccccgctcttataagaacctttgtcatcatattgggtccacccagatgatctccccacatcaagatcctccacttactcacagctgcagcgtcccttttactatgtaagctaatatagtcacacagcactggctctggaatgagacacagacatttagcggggcctcattcagcctaccacaaaactaaaacacaacacacaaaaaaaccagttccttcctgtgaccacccggacctatgtgcccagccttgcacatctctctcagcttgtcctctactgctctctcctcactgctacaccagccttcttctgtctgttcctttgatgtttcagctcgcccttaccttagggtctttacccttgttgttctctccatctgaagtgttctccctccagaagtccacatagtggttcattcacgagagcccaaatgtcctttcctcacttactgtccttcgagatcatctcgtctattctcccagaccataagcaaactctgagggaaaagtccccatctgtcttactcatgctccacccagcacagtgactgacacacttaccaacttaacagttgttgaaagaatgaactatctaatttcaaaatgttagtgatctctggctgggtgcagtggctcatgcctataatctcagcactttgggaggcggagaagggcagatcacctgaggtcaggagtttgagaccagcctggccaacatggtgaaactctgtctctacaaaaaatacaaaaattagccaggcatggtggccggcacctgtaatcccagctactcaggaggctgaggcaggagaattgctggaacctgggaggcagaggttgtagtgagccgagatggcgccactgcactccagcctgggcgacagagagagactccgtcttaaaaaataaataaataaataaataaaattataacccattttggttttataatccatatatttatgtaagtactttttaaatacatcgacattttgaccctagatcagctcacaggataagactaaacaagatgaaatgtaataaaactgactttgaagtattacttgagaccaggagtttgagaccagcctgggcaacatggtgagaccttatccctacaaaaaaataataataataacagccaagtgtgatggcttgtgtctgcagtcctagctatatgggaggctgaggtgggaggattgcttgagcccaggaattcgaggttgcagtgagctatgatcatgccactgcactccagccagggcaacagagtgagacgttttaaaaaaaaaaaaaagacgataaagcctacaaaatattggagaggtggaaatgcagtgaggcgatggtgctgagaaaaatatgaataacaattactatataaagaagacttagaaggattaattatagttaactcaaaactccgtgtgacttgtcagcatggtgtggctaccaaaaacatgaccttctgtgcactggagattcctaagcaaaaagaggaaaaccgattcttggacacactaagatgttttaaaattaaagctaagtttcaactaatccttaattgttacagtcctgtgtcatttttgtatgagggccatcatcactaagatctgtcattattgtaacaggagtagtgatgctgtaaaaaggaacaggacacaactggaggctgcggaaatggtagggagcatgccaacatctctcctgcgaagggcaagcggagatactcacatccccagattaacatggtattaagtgctcaattcaagccaagatagactctaaggtccaaaggcaaatgaggtatccaagaaaggaagcagaggtcccacggggtgaggggtgggaacaggaagcaccactatattgcaccgtgtcaggtccgccatagtggaggtgtggagggccccaccttgtgaacgatttatgttttatcctagaatgcaaagtaggttccctcttgactgacaaagtacaatgctcttcctctgctggtaccactgatagcattcataatatgcttttacgaataatgcaatctggagacatctgaaggatacagcttttggtcaataaatccaactctaaaagcccttttaaagctttgcccaaccacctcggccttctttaatagaattacttctgtttttccacagaatgatttctcctctgattaagaatcacttcaaactatagaagagatgcatatgacagatctgtgtatcttcaggactttcgtgatgctaaatggcaaacacatgtgggtcagagttgaatttcttaggacaatagtgaaaagctgagtgccatctcctcctccccatgtcatccctcttcaggatatgctgaaaaactattttaaaatatcatttcaaaggtgtcaagttatgagctagctgagctagatgttcatgtgtctcagttttgtgtgtgtgtgtgtgtgtgtgtgtgtgtgtgtgtgtgagggtctcaagaaaggatctctttctgcagaaaaatacacgtgtgtacacatccctacaaattaatggtgctcttggacttctagtgcatggccaggaattccaagttaagaaacttatgtcttattccattttgtgttgtgtattagtctgttctcacgctgctcgtaaaggcatacctgagatggggtaatttacaaaagaaaaaaaatggactcacagttccacatggctggggaggcctcacaatcacagcagaaagtaaaggaggagcaaagtcacatcttacacggcagcaggcaagagggtgtgtgcaggggcaatgccctttatttttattttttattatttattattattattattttttgagatgcagtctagctctgtcgcccaggctggagtgcagtggcacaatcttggctcactgcaacctccacctcccgggttcaagcaattctcctgcctcagcctcccaagtagctaggattacaggcactcaccaccacgcccagctaatttttgtatttttagtagagacgaggtttcattgtgttggccaggctggtttcgaactcctgacctcatgatctacccacctcggcctcccaaagtgctgggattacaagcttgagccactgcgcccggccagaaatgccctttataaaaccatcagatctcgtggagacttactcactagcatgagaacagcatgagaaaaacttccccccatgattcacttacctccaaccacgtccctcccatgacatgtggggattatgggagctaaaattcaagatgagatttgggtggggacacagccaaaccatatcatgctgccataaaggaatacgccaggctgggtaatttataaggaaaagaagtttatttgcctcatgattctgcaggctgtatgagaaacatggcaccagcacctgcttctggtgagggcttcatgctgcttctacccatggtggaaggtaaagggaggccagtgtgtggaaagatcacgcgatgaaagaggatgcaagagaaagcagggaagggccagactctttttaacaatcagctttcaggagaaccaataatgtaagcactcccacccatccccaggaagagcattaatctattcacaaaggatccacccccatgacccaaatgcctcccattaggtccctcctccaacactgggtatcaaatttcaacatgagattcgcaggagacaaacacgcacacttatagtatcttactacagtgggtaagtatacctagagagactattttaaagacactctaaaatggcttatgaacacccaagaggcttatttttccagcttctaggtttgtcattgttcagacctaccacaggcacatctgactacctgtggagcccaccctagatggagcatgcactggcctgcagatgattgggtttttttcagtataaaatttataaacagattttgtttttgtttttgttttgttttttgagacaaggtctcactctgtcactcaagctggaatgcagtggcacggttttggctcagtgcagccttgacctcccaagctcaagtcatcctcccacctcagtctcctaagtagctggaactacagatgcgcgccaccatgctggctaatttttgtgtttttttctatagatggggttttgccatgttgcccaggctgatctcaaactcctgggctcaagcaagcctccctcctcagcctcccaaagtgctgggattacaggcgtgagccaccaccacttccagctattaacaggtttttaaattataactagcttgtctttggagaaagaatgcaagtatttgagaacaaattaataaactggcattgtaatgttgtgtgcatgtgtatgtttgtacatgtgtgagtgcctgtgaccgctgtgtatgttgtatgtacgagtttacgtgcgtcttcccttaagagatgaatcatccatcctccctgggtctgccatttcctggtttaccagacagatgattcactcaggtaggagccaacctatgggtccccaagcagcctatcccctaggagctcagctaacctcctcccatccacaaccaccccatcttcagggacgctatcatattggagacacctgcccacactgaagcctttgcagcagctttgaaaagttccaatcccttcttatcgcaaaggactaatctgcttcttatcgctaagcttcctcaactacatcccactgtgcggcctaaaggggattaccagctgtcaagtcgcttttatctttccacctacccaacagcagacaggagagctcaaaatgggacagaaataataactaagagtaaaggaattcccaaaggggcgaatctgtgtctctgaggcaatgaaagcatcctacacaaaatgtaaaacatgagtcttgggttttcctaaattctcctgtctttttttggctgaaagcatgagaccgataaataagtgtctgccaactgctcgctctgaccagcaaagaaaatcaactggggaaagaaagtcaaatcaggaaagggagttgagcacgggcttgcatatggggaagcacgcacacacgcacatacacacacgcgcacatgtatggacgctcacacgtgcagggagaaaggaaaggaaaagccaccacccttcctgaattttctgagacagacctataactgttccagacaacacaggaactcttcgaagttcagctaaggaaagagaatgtttccacttcacaggatcatcagacactggctctgtttctaggtatatgtgtacacagaggttcacagataatactgctgtcctgtggcagcaaatgtcacgctgctgaccagcacttgagtttattttcccagttctgatatcttttccagtcatcctggagaccaagagcttgatggtccgagtcaaacaaaagatctttttattgcgcaaggtcaagtggcccaaatcaagccaaataacttttgacaatgtgcatttgtttaaaattttcaatggcttcccacttccctaaggataaattctcagttctctaactgtgagaagggtgggccacatactttgatggtccaaatcgggacatttttgagagtgaaagagagtgctattaataatagtgctggggctgggctcggtggctcacacctgtaatcccagaactttgggaggctgaggcgggcagattgcttgagcccaggactttgggaccagcctggccaacatggcaaaacccgtctctactaaaaatacaaaaattagccaagtgtggtggcacactcctgtaatcccagctactcaggaggctgacatgggaagatcacttgagcctgagaggctgacgctgcagtgagctgtgaggatgccactatactccagcctgagcaacagagtctcagaaaataataatagtgctagacaactgccacacgcaagagctgtcttcactgacagaccaaacaatgggcaccctaccctgaggtctctggctctggcttgtgatcaacccacttatctcaccgtcctctgctcactctcttctctagccacactggcttctctccgctttttgaaaggggctagctttctccagcctccgggaccttggcatgccctttcctttccctgctccatgggtttgcagcttcctcacctggctcactcctgctcatcccttcttcaggtctcagcctagatgtcacttgggcagggaggtgtcctctgccccccaggacaaggctagctccctcttatgggctcccacagcatccagaacaccccccatcacatctgtgatgacttaatgcttgctcctgcccccacagatgctcagtgttccaccacaatgaataagccaccgagccagctttcctcgctgccaaatccctggtccccagtgcagtgctgacccaaggaggtgctgggttcaagtcccaccacaggcatccccactccaatgcttgaacgccactgcccttccccacactgctgtgattgtgggcggccctgagtgttcccttggactgaggctgcctttgacctagtctgtcacactggactgacatcaacccacttagtgctgtgcgttcctccaaggcagagactgtaattcactcaccgaggcacgtgctgatgaagatactggtgaaggaaacacaacatcacgacccctcatccgaaacctagggcttagatgtgttttagaatttagaatttttcacttgaaaatgataataatatgtaatattgcccatggggctggggcagcaccctgtaatctgccacactgatatttctgcagcaaaatgggtgaatcttcacactaaacagcgaaataaagcctcaaaattatctcacatcctttcaggtcaggctctgcaagtcatttagttcagatcaggtgagaatttctgcccaagtatgaagaaactttggttttcaatagcttttaaattttagaattatgggcagggcatggtggctcacatctgtaatcccagcactttgggaggccaaggtggtcaggtcatttgaggtcgggagttcgagaccagcctggccaacatggtgaaaccctgcctttacaaaaaaatacaaaaatcagccaggtgtggtggcacatagctgtgtcccagctactcaggaggctgaagcggatcatttgagcctgggaggttgaggctgcaatgagccaagatcatgctactgcattccagcctgggcaacagagaccctgactcaaaaaaaaaaattttttttttttctagaattgtggaaaaggactgtggacttgtaacagctgacatttcattaacacttatatgctaggcactgcttgaggtttacatacatattatatctcatttaatcctcaaaacagtcctacaaagtaagtattatgcctttgtttatttttcagataaagaaaccaaggcatagatactataatgaacactcagagagtaagcagcagagcacaacactggacgcatgatccacagcaggtgctcaatgacttctgaataaatgacaggacgctgcgagtgtgcacgtgttaggcacagtgaggcaggctcgaagcagttacacaggtagactgctgagatggccttgccagttcctatggaactgtctgcctcaactgcgtcttccaggcatagcttcaagcccagcttgatgtttacaaacacgacatgaccatacagcctaccctcctggacgcagatgactgcagcaggggcaggctcctgacccatgtttgggcgatcatagcgataccctaagacttaggaactggaaccacaaagtcattttctttcttggtccctggactctaaaacataaacatgtttcagagaaaaacagggaacaaacacatagcatctatatgtttgtacctatatttaggttaaaacctaaacacccaaataaagcctgacatattctaacaagtagcttacgttgtctaatttttccacttaaataaaacattggctagcacacaggaactactaggccagttaggactgcttctgctgctgaaatggaactgatcattaagagtcatttggtaattaaattattcaacccatgtttactgtgtacctactatgagccaggaactctgcgaagcagatggtaaacaagacagatgtggttcacgtcctctcagatcatacagttgtagtggaaagtaacactacagtgtgagtgttattatccatgggaaataagaggaacagagagaattcagagcagtaggtttaaacaaattagtcattgaaactgaagtggaacaaaaattacactgtttatgagttgtttgatcccaacaaattcttataaaattgaatgattatgaagaattattgatataaaataaatgctaaatgtataaataaagtcttacataaataatactaaaactataaagtcttcatatgcatattgagtcattctaacaatcatatatcaagtatggaccatccagtctcaccatgattaaacagaatattagtaagatttgcatatgcattatgaatgtctgattaaaccacttgacagtgaaaaactaagtggttttcagaaaacactcaatccaaccaataccttttgccagtttaacgccagggctagcctaattaaaactacattctgcaggaagcactttgcaaaaatattagaatatatttgaagttcgcaagctaaaagggcaacactaaaaggatttcagcaatagtaaacaggacgagtagctatggtgatagaaacacatttgatgtaatatatgacaggtgctattaactgtgagtgcattaaccttccttccctcctttcttcctcattagcataaccccaattgtgttcaggttactaagatgccctgctaaatatactctttcctggcctctcttgaaatcacagatgccttgtatcatagttctggtgaataaaacctaaataaaaatctgttttgagtttctttttttttttttttttgtgacggagtctcactctgtcaccaggctggagtgcactggcgccatctcggctcactgcaacctctgcctcccgggctcaagcggttcttctgcctcagcctcccaaagatctggggctacaggcatgtgccatcacacacagctagtttttgtatttttagtagagatggggtttcaccatgttggccaggatggtctcgatctcttgacctcgtgatccgcccgccttggccacccaaagtgctgggattacaggcgtaaggcactgcacccagccaagtttcttaataaaaggaggcagagttggtgagagaaatcctttccctacccttcttctcttccatgcagacatgagctgcagccaccatgctgtcaccatgaggacaaaagccaacataccatgtagctctgatgaagccctgaaccccgcctacctctagattttgtgtcatatgagaaaaaaatggccctgtttgtctaaaccactattctttgatttttctgttatttacaaccaaacattcctaataaggtagtgcaagacagaaggctgtacttaaaatgtttgaaccttgggcaaccgtagctatagagactgagaattctgtgtgcaatgagagactcggcatagataccaggaagtagcccatccgtggtgaaacagtgtaaaatattgatcattgtgggacactgaatcagaactgtggtagaagctggtgcttgtttactcaacgtacactatccatattcttcctcatcaacagaatcctgtatttgttcccatggtgggcactcacatgtcctttcctagccccagggcaagtcccatttcaggcatttaggcaaagcctagtagaagacaggaagggcagtgctctgccaactgtgtagacgtgatgctccctccagctcccactttacgttcaggagattttgatatggaatacagatctaacgtgtgactaactctagggtatgtttaatgacattgtcggccccttcaggacttttttggtttggtgtagaagtaggtgtacaagtacctggtatatctgatacagggttattactattcttgaactcaagtacagttttttttttttaattttttgagttaagtgctctcattttgttttgcagcataatattccttttcttagctttcctatgactttacttagcaacctttgccaaaagaagtacaatatacgatagactactttgaagacacatacattggacacctaaaatcaacaagagcagagaggtatggcataatctttttcatttgttatgtgttgttcctcgagtcaaactaatcttcttaatggcagaagctaaagcaaaatcatcctcaagttaacttttaggaaattatattgtaatattacagatatctgataccttcatattttaagtacattttaaataataataattattattattaacaataatagtgcagtggtacaatctcagctcactgcaacctctgcctcccaggctcaaaagatcctccctcctcagcctcccgagtagctggaactataggtgcatgctacagtgcccggctaattttttatagtttttatagagatgaggtcttgctatgttgcccaggctggtcttgaaatcctgggctcagtcaatccacccgccttggcctcccaaagtgggattacaggcatgatctaccacacccagcctgtttaagtacttttgctaactggataatttttaaaaatcattatttaagactttggcaacctcaaattttcatgctgtggtacaaaactacactttttgctcactttcatctttgaataccttatgaaagtttgctgctaaacagagcaaagcactggtgattggtccatagaagagtatctcaccaggcagccagcatggatgaaaaattatggtaacttacactgaagtaataatgattacctgctgcattaggtacaaggtttacaggacaaagtaatattttaatttaatagcagtggttacttatatgatatcttgagtaaatttaataaataggaatccattatatccaaattaccatttcaacatgtaagtattagaaaaattactaatgagatagtttccatttctttgaaggctttcaaagccttcagaattcagtgtgtgttttatacttataaaacatcttatttcaagagctaaatttttactagacatacttgagatacattagatttcataaaacttatatttataagagtagtttcacatacctaaattgtttgaaacatatttaaaagtttccgcagctcaaccatcaataaatcatttttctcttacatttgcatctactttgacaattctttatcttagcaaaagcatatcaacttgaaaactatctctgtccaagtgtatttaaatagcattttaatttaaaattattaacatcaaattcaaatttgagttgaaaagcaactccctaaatttatcaatataaagaagtgtttctttttttttttttttgagatggagtctcactctgtcacccaggctggagtgcagtggcgctatctcggctcactgcaaccgccacctcccgggttcacgctattcccccgcctcagcctcccgaatagctgggatttcaggcgcccaccaacgtggcccactactttttgtatttttagtagagacggggtttcaccgtgttagacaggatggtctcaaactcttgacctcgtgatccacccacctcagcctcccaaagtgctgggattataggcatgagccaccgcgcccggccctttttttaacttttattttaggttcaggggtacatgtgcaggtttgttatataggtatatagtgtgtcacgggggtttggtgtatagattatttcatcacccaggtaataagcatagtacctgacaggtagttttccaaccctctctctcttcccacccgccaccctcaagtagacccggcatcttctgttcccttctttgtgtccacatgtactcagtgtttagctcctacttgtgagtgagaatatgcagtgtttggttttctgttcctgtgttagtttgcttagaataatggcctccagccccatccatgttgctgcaaaggacatgatctcattctttgttacggccgtgtagtattccatggtgtatatgcacattttctttatccagtctaccattgcttggcatttaggctgattccatgtctttgctacagcagctttttaaacagataccatagtgataagtatattgcccctgaatataatgatctcttattttccctttataatttgagaagtggtctatacatttttactcttatattaaggcttcatttgtaagtaataaagcctaattttttaaaaaagaaaagaaagcatgaaaaggaatcttaagagagcagagcacattcagaaactgctaatgggccacaaaggctgtagagaaagcaagagatgaagacgggcaggtgggcaatggagatttttgtatatcgcacatcaaagtgtgactttcatcccagtagcaatgaggagccactgaaggattttaaacaagggactgacataaccagattctttatataggaagattaaatgggctgcactatgggaaagcaaattgcaaggtggcacaggagtctagtacaagacagtaaggcctgaattaaggccacagcagtggatggatttcagaggtgtttaggaggtaatggggaaagggtctggtgacagactggatttctcaggtaaagaatgagaagcagtgaaagtgactcccagatgtgacagggggtggctggtgatgctgtccacagaggcagggaatgcaggaggctcaggtgaatgggagtgtcaggaaggggtgagagacacaaggcacattcagtttttggcacttgggacatctcatggagatgatcaccagataacagaatctatgggtcaggcactctgatctaagcagtaactataatttgaatgcaaatagcaattgaagtcatgggacttcatgagatcatctaaagaaaatgaaaaaacgggtagatgcataagtgaaactatagaaaatactaataccagggatgaattaaggcgcagcatccacagagaaaaaactggagccaggcatggtgacacatgcccatggttcccgctacttgggaggctgaggcaggaggatctcttcagtccaagagctcaaggctacagtgatcacacctgtgaataaccactgcactccagcctgggcagcacagccagaccctgcttctaaaaagaaaagaaaagaggggagagagaaaagaaaagaaaaggaaggaaggaaggaaggacagaaggaaggaagaaaagaaagaaagaaagaaaaaaagaaagaaagagagagaaagagagaaagaaaggagagagagaaagagagaaaagaaaggagagagagagagaaagaaagaaaagaaagagagagaaagaaagaaaaaaaagaaaagagaaaaacagagacagagagagagaaaatgaagaaatggccagagaggcaggaagaaaaccacaggggaggtggagtggggagcagggtgggaaggccagggaagagggctataagggctgagtagtctgcagtgctcaatgctacagaactcagctcacgctgacttaagggattctcttccccaaggcacatgggctttgccccccaccgtgtgtacatgtgatcctgcttccctagccacagttaattggtcaaggggtgatcaatgacccaagtagcatcgaaaccttccctgggctgagctcttgaaaggtaaaagtgggccagacctggaatttgtggaatgtcacctgcttctgccacgtggattggaagcagacagagaaaggggaaagatgagcagggacagccaggaacaatcttggtccagggaagacaccctgtattctgataaatgactcttttatgctgcagctggttcctgttggtttttcttacttggaactataaaagtcccaaaattcatccaacaagagagacagaaatataaagagctggattacctgacagaatgaaacatgtgctgaatggggacctaagagggggctgtgggagctcaggagcaggggagagtcattccagctgggcggagggaatgcctccagaagggaggcagcacttcagctggcactttaaggatgagggggtttttaatggggaaagaaaggaaagggtggattctagccaaaggaagagcaccagcaaaggcagagatgagagtaaatggagcattagggaaatggaggcagcggctgtgcctctgacagtttcctggtctggttaactccaatatgcctttcaggaccctaggaagccttcctgccctcccacagaatctggccaccccatcacagcctctcccacactgtatcaaaatgccccgttgactggtctgcatcccacaccagacctgaggcactgcatctattgatctttgtatgtcctgtgcctgacccaaggcagggctcaatacagacttgatcatctcaaacatctccattcaaccagtgcattcagaggagggaaagccataggagactgagggtttggcatcctattctaaggaccaggagtggcaggaaggatgctattcggggttagcttgtgaagacttgcaggtatgggaacattaagacgactaacatttttttttttttttttttttgagacggagtcccgctcttcagcccaggccggattgcagtggcgcaatctcggctcactgcaagctccgcctcccaggttcacgccattctcctgcctcagcctcccgagtagctgggactacaggtgcccgccaccgcgcccggctaattttttgtatttttagtagagacggggtttcaccgtgttagccaagatggtctcgatctcctgaccttgtgatccgcccgcctcggcctcccaaagtgctgggattacaggcgtgagccaccgcgcccagccgacgactaacattttttaaaaattatagtaaaatatacaccacaatttaaaccattttttaaaagggatgggtctccctatgttgccttgaactcccaggcataagcgattctcttgccctagcctccagagtagctgggactataggtgcacgccaccacatccagcttatgtgaacctttttctttttctttttctttttttttttttttgagacggagtctcactctattgcccaggctggcgtgcaacagtgcgatttcggctcactcaacctctgctgcccgggttcaagcgattctcctgccccgagtagctaggattacaggcgcctgccaccgcgcccagctcatttttgtatttttagtagagatggggtttcaccatcttagccaggctggtcttgaactcgtgacctcgtgatccacccacctcggcctctcaaagtgttgggattacaggcgtgagcctccgcgcccagcccatgtgcaccatttttaagtgtacagttcagtggtattacactgatacacagccatcatcccaaactgaaattctgtacccattaaacaacaacttgaaacaacaactctctagcccatctcctcaggccctgcaatcaccagtctactttttgtctctgtgaattttattcctctcaggtaccttatataagtgatatcacacagtatctgccctttcaaaaacaatttacatttaaatgtgttttcaactgtaaacatttaccaagtattgtcacttcctcccctgtgaggcaggcagggcagaaactattggtctgggtttggaggcccagggagctgaggttcaggaaggttcagagatctgtccaagcctgtggcacataagatacccggcctatctgacacccacacactcctcagaggctggtacagaatctgaatgaatctggataggcggagggccatgaccacaactctcagcccacaccaggtaaccttcctgtacccacaggcatggtttgaacacgtcactgcagattggcaatcagaacaggaaataatcaatgcagtagggtgaagctaaaggaaaaggattcaacctaaggacattcagccagaggccaggatgtatctatctacagttgggtgcagagatggctagaaagaagaccttagtttttaattactctttatctatggccatgactaaatgtttggctaatcagggagacgactcagggaggtcaaagtcattgccagcatgaattattaatctgcacacttgtttggagtccactggaataggcagcatagtcaagtcacagtggaaggtgctacatgattaatcttcttcctgcctgaggcccccagctcttgagtgggcattcttcatactgaacatcaggggaaagatcttgttttccacactcaggtcaaaaggtttgctcactttttttttcctgcataataatggttgatactaatgacctatttgcaaactgccaagagacagtagggtttcttcacgtttgtttgttttctggaatcagaaatggttcaaactgtgcattaccttctaaatcaatgtactgcagaaagctcttagtgaacctgaagaaaacgagtgatatgcattttgttctcatcaatacttactaaaataatttattaggtgtttaaattgttagatgagacagagttatcagactggaataaaacttagttttcctctgctatcctgcttaggagaaaagaggggctcaaatgaggattgggctagctatagaaataaagctatcctttctttgcactaagtgtaacgtgaatacattttctgccctgttacaggattaataattactgagtgcctactacatactgggtcctttcatacatatcctcatttcatcatcaaaataaccccatgtaggaaacactattattttcccatttttagattaggaaacttaggcatagacaggttaaggttgagcagcattcccaaggttccacaggtagcaagtgtctgaatccttacaggaacttacagactaaaagagcacagaacccataaaaaggagacacttacaatgcagtgtactaaatgcaaggacagaaatgagtgcacggagttggggacataaagagaggctaaatttcacctgggaaagctttctggagaagattatgtacatgacttattttttgaaaggtattattaatatacaacaaaatgcacagatgttaagtattcagtttcataagtttcaacaactgcatatgtttgtgtagccaccatcaaaaacaaggtttaaaacacttccatcacccccagaaagttccagcatatccctttcctatcaatccctcccccttctccgatttctgaattctttcattacagattagttttgtgtgttcttggacttcataaaaacagaatcttctgatgtacacttttgtcccggcttcttttgctcagttgagtcttaaacaacgaacaaccctttagctgagcaaagggccggtgtaaagcagatgcagggaggtgagaggtggcctggagccggggtattgggcgggaggtaatgggggtgggaaggaagacaaggggagggactgaggaccccgagttttaatctaagagggcttggattttattccatgggcaaaggggagctaatgaaggcttaaagcagctacagatgcaccattttgcacttataatatctcaaactcagtagtcttaggacaaggttattagtgatccccatttttttggagtcattttatttttattattattaaacaacaacattgtcatgttttcttgaatattgacaatttgaaatttaacttgttcatgaaaataaatctggaaaaacctcaaagaggctaatttccggccacaatttaaaaaaacaaacagagccccaattgaactttagctttaaattcattttaactttatccccaagactcccagttttgtcctcctagatgcaccgagactacacaacatccttcgttaatggtggaaaataaacagcttcacaggaaacaagacttcatcacacaaaaatttatagacttgttcatgatccccacttttaagtaaaatttcctagctggtaagtcaggattcaaacccagactgactccaaatatcctgctttttccacccagagaaagctttgaaaataaggagagaaaagccaacataagctatgaattgctgcctgagaaaggcaatgaggagactgcagaggatgaaaagttactcagtgcatatggcaatggagctgaacggggctgacccgcagggagggcagaaggcaggaatcctggcaaatccagggtgagcaggagccaggcagttcctggcactcctgcttctcttctttaaggcgctgctaatgactccactggacatgagcatgatggcgttggctcactcaggtggaacaaacttaaagagataacttattttcctggattctcttagcaagcaacttcaaacctgtttgtatgccgcccttatactgcattaagccaactctccactgaccaagtatactctacgaccttgcagatgtgttaaaaagaacctccaggattactaaaaactatatcaaattcatatttactaaagatttttaaaccgatttacctttttatccttcccactgcatttcttcacagcattccttctacaatgaaccaaacgaaggtaacagagtcagtttctagaaaacatcctcagaattacgccttctcttactccatactcaaaatctgctccaaaatgtgataaaaagtaatagtgaggaaaaggagggctaataatatgtttcaattaaaaacttaaacaattggatttgtctgtgtcacaggatttaatgacattctggagatgaattgaacatcatgaggcccaagagctcaagagaaaggcagtctggtaatataatatgcagaaaaaagagctgaagaaagtctgggacatgcaaaaacctgttacgctttcctaacctcatttaaccataatacctattttccaggaaaaaatattagcaccctacaccttcagatatgctttaggaaaggttgcaattgttttcttgtgcctggaaagcttccctgccttgtctttctgcactcctcttctgagttaccacctttttctttttcctatctttgcttggaatgacttctttatggagaccttcctagaaacatatccctcccaagaccccaccccaaaggccagattcataccccttctatgtacccaagcctgctgatcacagcaggaacccctctgtgttataactgcttgtttactcctcagccttctgagcctatgtgaactttttcaagtcaaggacaatgtcttgtccaccattatattcctagtaactaaaacagtgtctgacaataaatgttcaataaccaattgacaagtgactgactgattgagcagccaatgaactgtcaacctaaataacagacaaagagggagactctttcaaagaaaataatacttatttgggagttgcactgcaatgggaatgtgcatggatatattcagggaggtcaaaggaagacaagggcttttaaaggaaaaatgaagaagattccataatttttttgagacaattatctttggctacaaggatcattaacaaaggtgacatcagtccagggttagacaggggtttgctgggcagatgttctcacagaagtattttttgtatatgtcaagttgcaagggcctttgtgcaaggttgtgtttttgcagagtcttttgtgacagttctcatgcatgagaacccttcattcatggccttctctggctccatcttttagaattttgacataaatgactccattttgattctgacagctttcacagccaatataccttaaatgtcaatagtttgaatgggagaagacatttatcatctgtcagggaacgccaagcacaacacagaaggaagaggaggaagtttggacatggctggttaggaggacttaaaaggccatgctcaatttggaatgggtcccaaagtaaagaaatcgtatttgaaaaaaaaaaaaagtatagcaggaatccctttactgggaactgagacacctggggcctggccaagctctgcctctcactggatatgggacttgggacaagttccttgtcacttgattctcaattatgtgtgaaatatagaggtaagcaaaataaaaattttaaatgtctttttgtatgtcttgaggtaacatttaataaaaccatctttcattgttttttaaaataaaagtgacatgtgctcatgctatgggttgaatgtgtccctcagaagttccttttgccatttattggcaacttaatccctctgccctggtgaatggattaatggcagctctgacttcaagaatgaattaatgttgctatcgagagagtgggtttgttactgtgagtgaatgtgttatcagtgtgggctctctctggctcccttgctcttgccctctgccatgtcatgacacagcaggaaggcccttaccagatgccagtgccatgctcttggacttcccagactgcaaagcggtgagctaaatatacttcattatttctttataaattacccagtctgtggtattctgttatagcaacgagaaacaaagacagctcactctatagaattttttttaaataaaggataaataatcctataatctcactcagaatcccatcacccagagcttcagggcttttaaggtggttgatagggagttagagagtcattttaactctgcattatataaaacattgaaaatataaaacaagaaaatgaataaccaggaataaaattttggaggatttccttctagttttatttatttctttattttttttattttttttgagacggagtctcgctctgtcccccaggctgcagtgcagtggcgcgatcttggctcactgcaagctccgcctcctgggttcatgccattctcctgcctcagcctcccgagtagctgggactacaggtgcctgccaccatgccccactaattttctttgtatttttattagagacggggtttcactgtgttagccaggatggtctcagtctcctgactttgtgatctgcccgcctcagcctcccaaagtgctgggattacaggcgtgagccaccgtgcccggccatttccttctagtttttaaaaatttacgtgattacccattttactttatacacttcaatgggatcacaaactacattcttcacttaacattggagggcagaccctgtgggtcagctgacccaacgctcatttccaaccctcatctcccttgcctgcctatactctacagttgtgaaaagctatatactcactttattaacatcctttgcaaccagctgtggccaggtgacatggttttagctgataagatacgaagatgtgtcagctagggagcactcgaaacagttttgcttttctgagtaaaggtagagaagccgtagttgccaacccccactccctccctactttggcagcaaactggacgcccatagctgcagcaggcctctggtgaccaccgggtgtcaagcattagaaagttaatgggaatagcagagatgttggtgctgatgttgctgaaccaactgagccaaccccagaagctgcctacgttggtcttcctgttatgtgagaaaaataaatccctatttgtatcagcccaatggaaataatttttactagctgtagccaaatgtattcctgacataaaatgtaacgtaaacagctttccaggccattaactttacaatatcattttaaatggctacagagtactctatcaaagcgatgtaccacaattcatttaaccagttttctattgttcaacttttagatcactttccatttaactattatgtacactggtcgaagatttttgtagacaaatctttgcaattttcatgattgttttcttagaataaactcctagagatggaatttcttgatgaaggggcacgtatattttttaaggccaataccagcttgtactcttctcgttctctccctcgtacaaggaatgccattttaaaaaaattaacaatcagatgagccaaaaccaatacctcattactacataatttctaagtttccttttataactaaacatctctgatgcaacttgtgaaacatagtagaagatttggatgtgggttttaacgggctttcggctgacttcagattcatttccaaagcaaagaaagcactgcttggcagtgtgttacaactctaatttgtacaaatcttcccattattgtgagcctgctctcatttcagccgtatagggcccctcaaccaaaagtcaatatagaacatctgcgggggctgggaggggagctacaaatgactggaaaatggaacccagagagatgggagatttctgggaagaaacaaattttaaaatgaataaggagagaagggagtaaagaaaaggaagaaagccaccagaatcagggtccacacactcaactttcaggcactcgcattctggttttccgccttgccaaggttgcttcctggctctgcggttctgtttggaaagttgtccccttaggcacagcagctacgtctttctcatcctttgtgagtcaccccaaatagtgcctcttcagaggagtttcctccaatcacctgacctaaagtggctctcacgtcttccctgaccttcgtatcatcctatgtgattttcttcatagcactgaaatggtcttgctcaatgacaagcatccatgttgattgtcaagttcccccagcagaatgtaccctcaacctgagcagaaacctcactctgtatcctcagcatctagaacagtgctcggtccgtactgaatgcacagactgacaatttcctaacctctaaccagacacacactcagagatgatcatggaaagcaaaggatgaactaactgctccggggccttgggaagtctgcagctcctgaaaccacacttcagagagcagtagagagtccagtgtccctaggcagctgccacttctccttccctgactcatcaactcccactccactgaagtggagggtccaggggagggagggcccagcatctagggctggccatctccaaagggatgagaggggttactgtcacatggggctcttcacacttatttctggtattttgctcttatcagtatttcaaatattttaattttttcttatgaagattttcaaacaaacaaggtaaagggaatggtacaatgaactaatgtatccatcacccttcttatttcatctcttctcttacactgtgtatgtgtactggagcattttaaagcaaaaatcagacacattaacaaaatgtttaactgttcctgtgtgctgagactgccttcagagccctggaattgcacagtacacatgctaagagcaccaaggggtcaaggtttcttgctgatgctcaatctaatggcagcttgctgctttcttctcgttgacatgcacaaaaaggtagatttccaactaactgcttaagaaaacattcggagcaaacaaagcctttgatccctgtggaaagcttagaagatgccaggcaattctgcaaaagcactagacgctaagcagtaataaaccaggtcaaacggacatgtctgcctgacacccagttgttttggttgtctcttctccagttacttaatttccctgcttactgccttctagatcccggaaggtgccatgttcaccaactggtactgccttttccttcttctcacgtgaacaaaatgaaagtattaattagaggtgtctctgagaacaagtgagggagcaagtgtttttatgtagccatggagggatgggtcttgggagagtcagagcggctgggctctctgaaagatgacccagtcagtaatggacacgcagacacaactgatccctgctggctcaagcatggtgcctggaacagggcaagcctgaaatgaactaaggaattaatgaatcaaatgagtgaatcggaattgaagaggctgggggatcagcagaactctggatcctgatctcccaggcaacgcactgtaaacaatgagcaactaaaacaaaacttacaaaataagacattaaaatacattttaaaatctatcaccttaacagaagagttactttccttcttccgtgtaagtctctgtcatttgaggattagtttttatgcagctgcaatcttgatacacgggcagttttataaacactcttcctcacttaacacagcaaacacgacctgtgttgttagtcttcctcagaattattttaaatggctgcatgtttgcaggtgtgccaacacagcctagcttaagttacttgtctgcactattcctttcctttccttttttttttttttttttaagacagtcttgctctgtcgcccaggctggagtgcagtggtacgatcttggctcaccacaacctctacctcccaggttcaagcgattctcctgcctcagcctccctagtagctgggattacaggtacctgccaccaagcctggctaatttttgtatttttagtagagacggagtttcaccatgttgaccaggctggtctcgaactcctgacctcatgtgatccatccacctcagcctcccaaagtgctgggattacaggcatgagccaccgcacccggccttcctttcctttttctttgcacattcatctccttttttttaggggttaaaagaaactttcccctggcctcatctcccactccctcttgctgcgaggcacccgaaccatgagcgctccctccctcgaggcatcagcacatgctgttccttctacatgcaacactctctcaaagtccattcgtttgcctaacctattcctacccacatttcagggatcggattgtcaccccaggaagcctgccctgaccttcgtagatgctttaacatcctgtacttcaagggtgatggtgctcatcgtggtctgtaattgcttgtcttaggatctgtttgtcccaccagattgtgagcaggacctatttttttggagccttattagctaggtgatcatggtgagcctcagtttcctcacctgtaaaagaggatagtcatgcactctttcccacccaccaaaaaggatgctaaggagatcacaccaggcagtactgtgaagattttctgtgcagcataaagaaaatgatttcaaattctatatctgccacctaatcctaaggaacgaaaggcagtcacatcatcttaaccctttgaggctcacagtcaaatgatagctaacatttatgaatatttatggacactgtactagacagtttatatgcacttctcattttatcctcattacaaatgaatgggacagaatctagtattatcctcactttccagaggctcagaagactaaatagatttcccaagtctacactgtttcagaatatgctgctgagcacccagtgcaagcctcttcccataaaaaaaatgcccatacatacatccacacaaaatagtgcatacaatttccaagttcatgaggcccctgaagccaaacttcttttgatccctattctaggccttgcatgcagtaaagtgaattctccagagaagctcaaagatttatacaccccacagggctgggaggttatgggaataaactgtgtcagcaaaaattctggagaaaaccttgtagcctaggaatgagttgtaaatcttgaggtctcactagacacagtttccttggcaacttaagtcactgggctgactgaagactcttggcccaagtaagagccacatggcatgaatcctgtattctgataagccaggtgctgggagaagctggtagtactgccaaactacagccaccaccaccgacagccagatacttactggtataggcagttgctgaagatactcactgcttgatgtacttcatataccggagaaacaacagctaaatggaacatacgaggcctaaaggagccaacgtgggagcaggaattggaattgatcaaaccatctggcctgagactgtgctaatctcagaatggctttggatgcagtgaggcatcactgtgggtgtgaaaggtgtgtctcacactgagcagagtgagagccaacacttgggtcagagggaatggcgcaacaccaccctctgcagaggattccgtgggattgtgccatgagccaaataagcaatgaaaacgtgaaaagcaaaccggtgagccaggctgcatttttcattgtggcactgtgtgggcaaagccttggagaccacctgggaatgggataagatgagccaaaatggtttccatggcgaatgctcccaaaatcaagaaacaaaggcttggggagagtgtggtgtccagaaaagctgcctgctgagcagtgcaagctgtgacggtcctcacacggaagatgatggaagccagcaactctccagatcccttagaagaggagaaacgggatgcagctgaagagactggttggggtgagggtaagggagagcagagagaactccccacccctgagaactgtcaagcttggaactaagctaccaaggggacacacacaggaatggtgccacagcagcccctaaatgtcggggaggcaggcattttggtggaaacaaagtttattttgctttttaaacaaaagaggtgataagggtcctctctcaaacatatttttttgatggtccacaagttaaactaccgccagtgcaaaacaggagaaaattatgggtccacaatcctttatctgcaattctgaaatccaaaacgttctgaaaacagaaatttttttcctaagtgtgtgcaaatcatttggaagcaaaatctgacctgaaatgacatgaagttatcataatctttacttatccccatctaatatgaatatgtcttactgaagacacattaacatgtctcattgcaaagtgctaaccccaagtcccactggaggcgttagataaggtgtaataagcaaagaatttcctccaaaacttggggtaggcaaaattgtggacacacatctccttttctacaggtcagtaaaaacaaaagaaatgtttgaccacctggaacagaatgaatgtaataaaaaaaggaacctaccagatctctttagcctccaggtcggaggatggctttggggcaatcgatgatataggtgtcctcatggggtccatgaaccagactacccttctgtttctaattctaaattataatttacatattgtgtttagttctattagactctagctttgcacccatataaatccaaagcaactccagatttttcattcatgcagtgaaatctgggagactctctactgggatgaaaatgaaaatatttaataggtaatactgtcattggctctcctgctccccctccaggagaatatgaactggtaaacttgatctctttcatttctagagatctatgattttagagggggagaataaaacaaagttaaatgaagatgatgtgttttcttggagatctgaatagtgttttcttgatgaacaagagaaaggactccagatttcccatcaaatgatccacttttcctgttccataatagaaggcccatttggcaggttaaaggataagaaaggaagatttaaaagggagtacacaatggaatactactcagccataaaaaagaatgaattaatggcatttccagcaacctggatgggactggaaactatgattctaagtgaaataattcaggaatggaaaaccaaatattggatgttctcactcataagtgggagctaagctatgaggatgcaaaggcataataaagacaaaatggactttgtggactcaggaggaaagggtgggaagggggtgagggataaaagactacaaatggggtgcagtatatactgcttgggtgatgggtgcaccagcatctcattaatcaccactaaaaaaccacctgttccccaataacctatggaaatacaaaattttaaaaataaaataaaagggagtacagatggcttttagccaaaaagacctggattcaaagccagacactaccacttaatagctgtgtaaccttggaaagtttacttcactgtggctgaatatcatctgcaacctagagaaaaacaatattttcttcatagggtttttacgaggattaaatggcatgtaaaacatacctaatacatggtaggcactcaatatatggtagctattattatggctgttgctagattcgggagttgaacagtgcctggcttcacttcttatttcaccagattgcctggctcagcaaatgcaggggatattgacttcatgagcacagaaacagtggataataaacacacatagcaacaaatcacatcggtaaaccaatctacctcagctaataactgctttccaggctcctgcatttgctttgttagaggaactaaatagttcctaatggctatggaacgaaatcatttagaagagggtgaatttcatcagctttagagtttctgttgagggcagtgtaggagactgtgcaaagccacctctttttaaagaaagctaagcaaaaataatccataaatcatgtgagtacctattacaggtgcttatgtaacttaccatgttttctaaggagaggcttatttcccattcattgaggtgacatttactgagcatgtccaatgtaccagctaccatattaagtgctagaacacaaaaataaaaagacataggccgagcacagtggctcacacctgtaatcccactttgggaggccaaggtggaaggatggcttgcgcccaggaatttgagaccagcctgggcaacagagcaagatcccatctctacaaaaaaattatttttaatttagcttaatttttaaatgcatagtggtgcatacctgtagtcctggctgcacaggaggctgagacaggaggatcactggagccccaaagttggaggctgcagtgaaccgtgactgcaccattgcactccagcctgggttacagtgagaccctgtctcttaagaaataaaataaaaatagaaaatcaaaaagacatgagcccttctctccaggaacccaggcctgtgggcgagtatgtatgtgttttttatggtccatgctggaagtggtaatgagagaggggtgcacaggatgatacagggtgactatccaaaatagacacttccctaatgtaagatagttccacgacgctggaattatatacagtgaacacgtgttacttttaaaactaggaacaaaaaaatgtaaaaggagaaacaaagaactcaaagtccagtggtggaaacagattatataacaaatattcaaatagtgggatgagtaccaaaattcaaggacatcagagtgttttggggggagtattcttcctttagaagaaaggaagggcattccatactgcctgggggtaaagatgacaaggcaggtttccttaagaaggtgacactcaagctgagaccttgagactgaatgatttgccggtaggagtgtgtaagtacagtttctctagagggcaatccagcaatatttattagtatttaaaatgtgcatactccttgaaccagatgttcctcttctggtatttcagctgacaggaatgccagaaaacatatcaaaagatctctgtaaaaaagatgtttatcacgtcaatgtaataataaaacactggaaataacttaaatgtgcatcaataggacattgtttaaataagctatggtgtagccatatgctagaacaatagagtcatgaaaaaaataaaatttatatatagcatattaagttttaaaaggtaagttacagaataatgtatccttgtttttgtagaaataattttacatattttttacacataaaaacgtttgcatataaacagaaaaagcctgagaagataaacaacaaaccattaacacttaaggcatatcagacctggtggggtaggggtggggagaagcaatttcattttcttatttactctgtattcacattttttacaatgaggatatcttccttttatatttaaaaaataatattttttggctgggcgcggtggctcatgcctgtaatcccagcactttgggagaccgaggtgggtggatcacaaggtcaggagttcgagaccagcctggccaacatggtgaaaccccgtctctactaaaaatacaaaaaaattagccgggcgtggtggcgggcgcctgtaatcccaggtacttgggagactgaggcaggagaatcatttgaacgcaggaggcggaggttgcagtgagctgagatcacgccactgcactccagcctgggcgacagggcaagactccatctcaaataataataataataacctttttttaaaaaaaaaagtatactaattggaaagttatgggtacaaaacgactgaggttttagagaaggcatctgctcaaaacagcttagcaccgctggaatacaagagccacatgagttcaggagacaggactgaaggaagactttgaagaagaaacaaatgtggggtgtttcaactaggagagaaggtgtttcaacttgaagtgaagggagtaagagctgtggggcagtgtgagcaaacagtaaaagtacaagaactgaaggatggtgttcaaagatacgggacactgcagagaaaggggcttcaggaattctcaagggtgggaagcaggtgtctcattccacaggactcatctgaggagaagggcattcttttaaaggagagcatctgcgaaaaaccaagttttcactaaatatctgctctacatttcttagtttggccagagagaaagtcagagcaagagagaacttttttttttttcctgagcagaacaccagggaatacaatgaatattttattgaaaaataagctagattaaatcattaaagtatccatttactcagaaattgttccattacaaataccactggcacagtggaaaagggccctttctttttctttttcttttaaatttttttatttccatgggttttgggggaacaggtggtatttggttacatgagtaagttctttagtggtgatttgtgagattttggtgcacccatgatccgagcagtatacactgaacccaatttgtagtcttttatcactcacccccttcctaccctttcccctgagtccccaaagtccactgtgtcattcttatgcctctgtatcttcatagcttagtttccatttatgagtgagaacatacgctgtttggttttccattcctgagttacttcacttagaataatggtctccaatcccatccaggttgctgtgaatgccattcattcatcccttttatggctgagtagtatttcatatatatatatatgaattatatatatataaatatatatgaattatatatatatgaattatatatatacatatatatgaattatatatataaatatatatatgaattatatatataaatatatatatgaattatatatataaatatatatatgaattatatataaatatatatatgaattatatataaatatatatatgaattatatatataaatatatatatgaattatatatatataaatatatatatataatggaattcacaatggaattgcgaattgtgctgccacaaacgtgtgtgcacatatctttttcgtataatgactttggaaaaggtccctttcatccaaggcgagttttagaccaaactgtgttgtcctctacaccccagttcctcctttctgggttttctttcctcttggtggatctcacttcatcccctttctggagctcaatcctcctctcagaaagatctaatgtaaaacatgtacacttctgtgtgagtttataatcattcttccctttcttccttcctttcttttcattttttttttttttttttttttttgagacagagtcttgctctgtcgcccaggctggagtgcagtggcacgatcttggctcactgcagcctccacctcccgggttcaagcaattctcctgcctcagcctcccaagtagctgggactacaggcacgtgccgtcatgcccgactaatttttgtatttttagtagagacggggtttcaccatgttggccaggatggtcttgatctcctgacctcatgatctgcccaccttggcctcccaaagtggtgggattacaggcatgagccaccgcacccagctccttccctttcaatgtattttaattctaggccctatctctaaataaaaaaatccttcatttagagagcccatctttttaaaaggagttttgagcatcaggtgacaggtggaaaaagaaggagagagaagattcttggaggccacgcagcagaaggtcacctacatttggaagctggtcctcttttcacatgactaaaccagcagtcctcaacctttttggcaccagggacatagatgaggggaggggaatggtttcaggatgaaattgttctctatcattattagatatcatatcattattagattattaggcattaattagattctcataaggagtgtgtagcccagatccctcacatgcacagttcacaatagggtcctcgcttctatgagattccaatgccactgctgatgtgacaggaggcacaactcaggcggtaacacttgctcgcccaccgttcacctcctgctgtgtggcctggttcctaacaggccacagatcggtaccggttcatagcgtgggggttggagacccctggcctaaacaatgtaggaaagcccctctcagaactatcttgacccaggatccataggatgaattctaaaatgtggaaggagtgggaggaggagaaaatattattctcttgtaccacttccttaaaacacatgagcaaatgaactgaaaacatggcaattttctcattaatcgattctcgacaagaaactagataattctgctgaaaaaaatatccctctggtggttaaattatctcttcggctgtctacatccaccaaattaactcaagaactgtaacctctatttcatattgtgttgtgttaatattactgtggcaggtttgaatgcagaggacctgagcacctcaccattcatcccttctgaaaggagggtctaaaaccaatgcccttctggtcactgaggcgggagaccagaaatggcacagttcaaacactgccccactttaagctgcagcttcagttaggaaatgttatgatttcaactgctttaagttgactttacatttcccaatctaaaaataaataattttaaggcacttggcaatggatcgagagatgtatagaaggttaattttcctacactacaaatatttgaaataacaatacaaagataaatagactgcaaactttttttaaagtctaacctcacttgtgagagtaacatgagttatcgttttttttacctatcaaatgggcaaaaaagtttgaaattctttccagtgtgggagagtatctaagaaagcagatgctggtaggagtatagattgcaacattctttcaaagtaatttgaaatcttatttaaaacatttgtctaacatgcagaccctatgattcagcaattctgcttctaggaatgcgtcctaataaacatggacacaaagaaatatgtacaagacaatctttctagtgatgcctataataataaaagctactaaaaccacaaatgtccattcataatgagctgtgagtaaattatgttataaaatggaatagtatgcagtcattaaaactgataacacagttattttgatttagaaatatatttatgttattaaagaaaaaggtaggttatgaaactatatattatatagcatgtgatgtcacttttgttaatacatacacaatgaccataaattaaaatgtgttaagcaatttatacacacctacacacacatataaatcgaaaaagtgtctctaattctctttaaaatactccagcacaaacagtatggtatataggtgtatgagtcttaatttatactctaggggcagttgcttagcatttgaaagactttaacaaaaaattggtatttccaaaaaaattggctattataaggcttcggctgcctttatctttaataaacatcagacggtttgttaataagcatagtggatattagaaattattttggatgaaaataggtgttcaaaatacagttatgcactgcttaactacgtttcagtcaatggactgtgtagaaacaatggtggctccttaagattataatggagctgacaaattcccatcctcctctagtgactcacagccgtcataatgctgcagcgtaatacattactcatgtgtttgtggtgttgctggtggaaaccaacctactactcttccatttgtgtaaagtgtagcacatacagctatgtacagtacataatacctgataataaaacaactatgttaccagtgtatgtatttactatgctatactttttattgttattttagagtgtactccttctacttatgaaaaaaagaggttaactgtaaaacagcttcaggcaggtccttcaggagatattccagaagaaggcattgttatcataggaaatgacagcttcaaatgtgttattgcccctgaagacctcccagtgggacaagacgtggaggtggaagacagtgaaactgatgatcctgaccccgtgtaggccaaggctaatgtgtgtgttcgtgtcttagtttataacaaaaaattgaaacagtaaaaatataaataatagaaaaaagcttacagaataaggatataaagaaactattttttgtatagctatccaatatatttgtgtcctaagtgttattatgaacgtgtcaaaagtttcttaaaatttatttttaaagttacagtaagttaaggtttattattaaagaaaaaattttaaatgaatatagtgtagtcttagtatacagcgtttaaagtttacacttgtgtgagtggtcacattcacttaccactcactgattcacccagggcaacttccagtcctataaactcccttcatggtaaatgccctatacaggtgtgccatttttaatcttttataacccactgtgtttttactgtaccttttctgtttagatatgtgtaaatacacaaataccaccatgttacaactgcctattcagtatggtaacactttgtattggtttttagcctaggagcaacaggctacagcatatagtgtaggtgtgtagtaggctatgccatctaggtttgtataagtacactatgatgtttacacaatgacaaaattgactaacgatacatttctcagaccatatccctgttgttaagcaatgcacgacagtgcagtaagggctcacttcatgtcatcaacaggaaactgcaactttcagtgaaacaacatatagtgaaactgattttgccacaggctaattgagatcaacaagagctaagttcttatggcatatttctgatcacaaaaaaaatcacaaaacttctaaataaaaaccaaaacatttataatattaaacactgaaatacatgtgagctatacatacatttaagtaaggttaataaacacaaggaagataattatttgcccagttattcctgtttcagggtcaagggtagctggagcctgtcccggcagctgaggctgcaacattgggacccatcctggacaggatacatcccctagcagggtgcactcagacccacacccccaccacacacacccctgccacacacacacacacacacacgctctctctctctcactcaggctgggaccacatgccagttaaccaaacatgtacatctctgcgatgtaggaggaaattgggagacctggagaaaacccatgcagatgtgggaggatgtgcaaactccacacagacaggggccccagccaggaacagactttctcatcaaggtgatcatgaaatgacaccgattgaaatgacatcatttgaggacttgctgtatatggatcagctggaaatgctgtacaggccactccgccttcttatgaccagggtgtgagaattcagcaacgccagcagcctccatccctccagtcttacgttatggaggattctgtggcctgcgtgactctaagtaaagttagctcaatgctatggctacaacactgctgctgcacaggccacaggagagcctttcatgcaaggtgtttgtctaagcggctgaaagctgggagcttgggcctctccagcgcagtttacagcacaggctgtgtgcctgcttggtcatgcatgtttgtccccgtagcaggattggtttgagaactgctcttgctttctcctttcacccttacagaggttgtggagtagagatctgtcatcactggaggctcctggtatcaaccatacataacctattagctgtgaaccactaaactggcttaggtcagtttaccacaaaggctgtgtatgcctgaacttcagcagtgattatctacagatggtgggattatacaattccaacccccaccccccaactccctttgtgcttatctgttttctaattcttcctataatatgtatgtatttgtacaaggtgggtgggtcacttgaggtcaggagttcaaaaccagtctggccaacatggtggaaccctgtatctactaaaaatacaaaaaaaattagcggggtgtggtggcaggtccctgtaatcccagctacttgggagcctaaggcaggagaatctcttgaacccgggaggtggaggttgcagtgagatgagatcccaccactgtacaccagcctgggcaacagagcaagactctgttgagagagagagagacagagagagagagagagagagagagacggagagagagagagagagagagagagagagagagagagagagagaggtattatttaaataataaataaataacaagagacttaagtaaactgcacagacagcactgtcaccacctactggcaaaaacagagaaagaccattgtaggtgaacgctgactgcttaacagcagagaaggcggcttgcagttagacttttcagtttccagttgtttttaacttcgaagtataacatctggattttagggaggggagaagatcactcctcttgaagcatgttaccttgaaagagttctgattttcaaaagcaaaatatagttctgctgaccatggtttaagtctgagagaaaatcatagtccctgctatgtatcagttagatacagtaagtatctaactatgatgccaccgcaggcagcagcttcaaatgagaagccaaaggctgatcatgggttataacaagtataagtcattttaaaggtctcgttctttggatgcttctaattaggcagttgccaaaactgatgcaatcagtaaggccataatctctctggtcttatgatttctgctaaatttctaatggggacctaagagtccaaccgcagtttgggttctataagcaaagcaaactcggcacagacacaaacagcgagaaaggcagcagttacgacaatgttgcaacaggctaacttctttccaggctgatgcctggggcacaggagcctccctgtgtccagcagcacttgaagtgtggatccctccacagatgacctgcctgtctctcctctgccaacccctgttctcctccttgcccaacctctgacaccacctatctcagaaaatggggaggctgctgccccccaaatgctcatcctgccatctaggagccactgccctcagacccctcccatccctattctgtctccaatggaagaaactactacagaaacaccctccccctagtaccctctactcccccaaccatctcgttctcctatgacatcccttatacagtgctcaccatatctagaaattattttcacaatctttttttttataaatatgatacttgcaatccctatttgaaataaagggaaaacaacacacaaatgctttttactttagggtagtatgcatgacacatctgcatttgcactggggaccaacacacacacacacacacacacacacacacacacacgcacacacacaagagtgggaccaactgctctcatattattcacacaggaggcaaacaagattttactggcaacttttttttttttttttccagacggagtctcattctattgccaggctggagtgcagtggcacaatcttggctcactgcaatctccgcctcccaggttcaagagattctcgtgcctcaacctcccaagtagctgggattacaggcacacatcaccatgcctggctaatttttgtatttttagtagagacggggtttcaccatgttggccaggctgctcttgaactcccgacctccagtgatccacccacctcaacctcccaaagtgctgggcttacaggcatgagccaccatgcccagccagatttgggggcaatttttaaaaatcatcatctatttggggaaaagatactttaatctcaaaaaagaacatgctatcagaatgacaatgaaccaacttagctttgggagaaactcacttcattgcatttactttgtcatggtcctgcactagtttggggatggactcaggagtgcatcttggactctagtgaccttctaggtagttccaaaacttcaaacacttcaaaaaccaaaatttcagtaattcaagaaccactaatatatcataactgtactactatttccttaatatttctcttaaatatactcacatttttacttatatagttttgttttaaaaggagactttgtgtcacttccataaaagaaaaatcaatatcatgtgtcacaaataaaaggtaacctatgaataatgcaatagaaacaaaacatgttattgaagtccagttagacagtgttgctggctgaggcctgatctcactgtgtagaccagggaggctggcaagtggtcagcagtgattaaagaccatcatcaaaccatgcttttctctttaataacatcagagggattgaaagtaaattgaaaataaaagtactttcactcaaggtgatacaatattatccagtgctagactcaggtcacatctaaagtcatctccagtggttcatatcccactcttagagtaacaagaatcatgatactttggtgcatgaatattgctaattcatccagccatttgacacatttattgagcatctactacactccgagcactgtacacaacagaagaaggaatgaataaaacaggcatggtatttcttgcaaaccttccagtggtgaaacatacattaaacaaatggttacacaaattatatttgtgtatatttgtgttgttttacatacatgtaagcatactgtgtgcatatatctgatatacatattatatatatgtgtgtgtctatatgcatcaatttggtaagtggttttgtttgttttgagatggaatcttgctctgttgcccaggctggagtgcagtgacacaatcttggctcactgcaacctccgcttcccaggtccaagtgattctcctgcctcagcctcctgagtagctggtactatggttgtgtgccaccacgcccagctaattctttgtatttctagtagagatggggtttcaccatgttggccaggctggtctcgaacacctgacctcaagcaatctgcctgcatcagcctcccaaaatgctgggattataggtgtgagccaccatgcccagcccaatttggtaagtgttgtaaaggaaaaatacgagacgttatggcatggtttcacagtaagaccgtctttaggtaaggggccagtaaagacatatagataggaggatgtaacaattaaactgaagcctaaaggtaaacaaactttagcatgttgaaagggtgggtaacctccacacagaggtaatgatgtagaaaaggtttggttcctttggggaactggaagaaagatatgtgctgagagggcagcaagcaagaggagggtggaatcagtgggcagggggtgggacaggggtggcgggggggaagcagtctcctaacctttgcctaaagggaccagaaactttctagttctctgtggaaagatcttccatctttgtatatcaccctataaatgtttcctaaagaaaaatctgtctgttgttttcacacactaataaatcagttcaacacttttgcatcatgtgcagaggaagtttaattcctcctccatgtgacagcctccaagtatctggagatggccaagtgttattccagaactttcccttccaggatgaacaccgtcaaagttcccatgctccctgttgtctgtgtccctcttaaaaggaagggtggctgggagcagtggctcccacctgtaatcctagcactttgggaggccgaggcgggtggatcacctgaggtcaggagttcatgactagtctggccaacatggtgaaaccccatctctactaaaaatataaaattagctgggcgtggtggtgggcacctataatcccagccacttgggaggctggggcaggagaattgcttgaacccgggagagaggttgcagccagctgagattgtgctattgcactccagcccgggcaacaagagcgaaactcctctcaaacaaacaaacaaaaacaaaaaaaagaggaaggcagattttccaatgtccatttgtgttatgggacttgaatttccttctctgcatattctttgtttctaactgcctttctggaaaacacccaataagttatggtcaggcctgaattccttgagaactaggaaattctcaaatgcatgccatcaaaaatatttatttcttctttcatgtctctttcctgcaccttggaaggcaaattccattcgtagaggggagggagggggcgctaaggaactttttcaaataatggaatgatggcgaacattcatctatgctaaactcaaagacatgcccaaagtttgtgatagaaaatttaaatacaatatttactatttgaactgatgttccatttgtgggtacaggaatgctacattcagggaaggtgagaataatgcaaaatccccactcttgactgctgtggctacagacccagattcccctgaagtgagggcagggtactggggtggtgctgtgtaagcagggcactctgccaggctcggatcacacatctcctctttgaaactggtgtggaaaaagacacatgagagcttcatgaataatacagcagccctgacacgctgaatgcacatttcagccaaatatatgcacatttcaaccaaataagttggtctctccacatccccaccctttcctctctcctccctcccttcagtgctctttcaccactttcgccagatttctaggttttcttgctgcctcctgttgcaaagtgaattgtcccagggaaggagggctagcttccggattccccccgttgcacctaaagccttctcctcctctgccggccttccagctccctgactgcagcattgcccattaggcttcatcagaggaggctgtgtgtggcccaagggcagcaggtgaaattcaaagcagacaagttgcttctccgcatcagtgctgatatgttagaggcaggcagccaaagaaaatgaatataataaagaaagtctggtttaagagcatctgttgcttttcttggaaaattctaccctttacgcattagcctgcccataagagctctacctctgcacataatcggaagaaataatattcaaaaaaagttttcaaatacgggtgtaataacaatgcaaacagcattaaaactcagcagagtgtagtgccggacgcaaggttctctctcatggggagtgccccttatgtaaagcagcaggaaactgtgctggccataaaattaccaactcctgagggaagagaccacatctgcttatctttacgttccttcaatggttgatgcaacgtaccgattagttgttcaacaaaatatgttgcatgaatttgattcttaagaagaataacatatacaggcactgaaaatagttatcttctgggtggtagagcgaaggtgatttttatttctgtctttgccttttccacatgttcctgattttctccagtgaacatgaatatatttagtgagaaagttatcagtaagaaggagatttttagaattggaagggaccagagaaattagtccaattctcttattccttacatgtggaaactgaagctcagagaagctaaatgacatgtccaaagccatgtagcttgttaaggagaaggctgaaagaaaactgaggccattcatgtttctcggcctactgcctttcttcccctatacatatcctttgcctttcctgaaagacagtttaggtgagactctaatctaatgttttgaaaaggcttggacccaatttaaaagcaaactgtgctatccagtgagcttattccccacagaagacactatcttagaaaatgcaaagcataatttaaaagtcattaagtaaaacatcctctgctgctgtgacagcaaaacgttcggccactccttcatgacagatggccccatgcattgacacacacctcaaaatagcctctgcaaggaagcttaacatccgagaaaggcggaatagtgaatgtcacagaaaagggagagtttgcttgtgggtttgcatctccagaagtaagaagacttaagagatatttactgtgggctcatcttccaccaaacttttattgatgtgtgaacttgaaacttcttatcataaaaatttctaacatacaaaagagagaatgttaaaatggattccatgtaaccagagtacagctttattaatcattaacttagggtcatccccccagccactgcctccctccccatgggtaattttgaagtcaatcctgaacattataacattttattcatgagtagtttaacatgtacctctaaaagataaggacctttgtttaacataaacattcaaatgtcataatgcctaaaaaattgataataaatccttgatacagccaaataacccgtttgtgctccacttttcctgattacctcacaaaaatgtttaaggctggtttaatttgtcaggcactgtgtattatctcagttaatcctgacaataacactatatgggggctgtaggtagcctgggggagcaagacacatgatcaggttagagatgtaggtgggagcctcactcccccaggctctagacacacttgacttattttctttctccttcaaaagccaagcaggtgcctacttcagggcattttcatgtttatttttcttcctggtctttccatagctgtgaactcctcagagatcacccctgactgcccagtcactctctattaaaataccctggctatgttcctcaaaacatttggtactatctacaattctcttgtttgtttatctgcttgtgtttctttccaacagaagagacgctccatgacaatcggctcctcatctgtggagctgaggcttctgtacctacagccctcagcacagcctctggcaatggtaagtgctccatggttgtgtgatgcgtggattaacatatgcctgcaaacacaacaggtatttgttgaatgaaataatgcacacacgcacacatgagaaaaagaacagccttgtttctgctgagctccactcttgggctctcaggcacttggccgaggcctttagccaaactgcacttttattactttctattgtcaacggctttttataactacaaaggcagtatgtgttcactgtagaaaatttgggaatccacaacaaacacaaatttgaagattcaaagagcctagaaatagccactgttgacattgtttttatgcacatattatgcaaaattggagtcatgggattcttattgatttgtgatctactcttttcatttaacaatgtggcattaatatttcataggtcacttaactctcttctaaaatgcgttgtttcaaggctgcattgcattccattgtacggccagacaaggttgtcaataacaccacattacgggacatttcacttgtttccttttcttcttggctaccataaaaaataacaataaacattcttgcgtgcttatgcacatttccattattagtttctccagatagattcccataagtggacttgcttgacaaattgaaatacaaattagagcatttgtaagtattgctaaattgatctctagaacaactgcatcaattaatactcccagcatcagtgtttaaagatgttcatctccttttccctttaccaacaatggatgctaatattttttaaaaatctataacactataatctatctttttaattagatcacagatttcttgcgagccctttcttttacttctgtattactcccgatatatagcaggcactccttgtgtatggatagatgaactgcatgaattttgtcaaggattaccaggaaaaacattgagcaacatgaacaagttgtctttttcctgtttcaagagctctcctgcccagtttacatgcgcacctgagcacagtccttcttccctgctaaaccttgctgaacgtccttttgcctttggtttgggaatgttgggcgcacatcccaccagatccagctctccctcccatttagcttcagcagaagaggtggcagaattactaattttagctgacatgatgtttactgctgcaagtatcactaattaatgatgtaaccgcagaataacaagtcccagatttcccttagcaaagcaaaactgagagtaaaccccacactggaccactccacagcatccgagcctaccaactggaaagagacaatcaccaggggctcaatctgacccagaatttgtgctaggagaaatttaaccccataatgccatgttaaagagctgcctgctacccactcaccccatgtgcagatcccagcttgtcagccctcagggagccctcagggaataggaccaggtcttgtttgttggtacagccctgtgcccagcattgcttgacatatggtaaatacctattaaacatctggtgaatacacagacaccaaagagagggaacagacgatgaaaagattcatggaagcctgggcagggagagggcagggtgaggagtattctctgatgttcttcattgtcatccacatggagtagagcaaatggacactcagggaagaaacagctggggccacagctgggcagctatatagcttgtaaattctgggatctggatttggtcttaagtcagaaacaacttcattccctttgcctgttctatgctgccttccaactctagagaaaaatgtctaataccctccatctgagaatttgtgttcaataaatgtttattacaattttaaaattaaaatgtcttgaataatcaacttatattccagctattgtgaagacgttctcacagcaacattttccctgaaatggcccttatatgctaaagtgggccctatatggtaaaaaaaaaatatatatatatggaagtgagaactattgtctgcctacacaaattgacagtaaaatcatagattttctgggctggaaagacagagaacaaaatgaacaatagactctccaatgcatttttgttttttaatgcacatcttctttggctggagataagagttaaccattttagtaacactgaatgccaataacagcttatgtgcaaatacagcagaaggagctatataattcatttattcatttatttggtgttagacactacggaaacaaaaacagtatgttcctccccattctcatgaagcttactgtcaaccagggagatccacaagcactctatcacaacagctaacagaggcctgtgcccactgggttacagaagtgctttaccaggcttctcaaggaggtgagaaaagaaggaattcagaaaaactgagatgaaacaagacttatgctaattgaaaatatattaataatactaacagttatccatttattgagtggcctactatgaacgcagtactaataacaattcattgattacagcattttgggaggtcaaggcaggcagatcacctgaggtcaggagtttgagaccagcctggccaacatggggaaaccatatctctactaaaaacacaaaaattagacaggcacggtggtacgcgccagtagtcccagctactcaggaggctgaggcgggaggatcacttgaacccgggaggcagagcgtgcagtgagctgagattccgtcactgcactccagcctgggtgacagagcaagaccctgtctcaaaaacaacaacaacaacaactacaaaaaaaaaaaaaaaaaaaactcattgagggggaatctattatctccattttacagaggaagaaactgaggctttgagagtttagtttacccagctcataaggtcctaaacaagagaagaacaatctggattagagttaaaaactagcatataacagtcattgtcccaaatgtcacttgaaaaataggtgcacatcttctattgagtatctattgctacataacaaattatcccaaaaacttagtagtctaaaacaacaaatatcctttatctcaaagtttctgtgggtcaagaattcagagacagcttaggtgggttgttctggttcaggatcactcagatttgcagttcagatgccaatcagggctgtgttcatctgaaggcttgactggggctgcacaatctacttccaagataccccactcacatagctgttggcagaaagcctcagtttccttgccatgtgggcctctccatagggttgagtgtgaagccgtatggcaggtggcttccccaagagctagtaatctaagagagggcaaaatagaagccacaatgccttttacaatctagtctccaaagtctagcaatatcactcctttaactttctattaattagaaatgagtcttcaagtacagcccatgttaaggggaagagaattaggctccatctttcaaatggtggagaatttgtggtcatgtgctaaaaccatcactctagctcagactggaaactagaattgagtagggggatcctatctggagaaaaaggtttgtgtttcaaaaagtagtgggtagtaaataaactagctcttgagtgttgaaaaaataagatggtatccacaaaccaggcaaaggaggttgctcatctaccaagtgcataagtggaatttttttttttttttttagacagggtctcactctgttacccaggctggagtgcagtggtacgttcccagctcactgtggcttcgggctcctgagctccagtgatcttcctgcctcagccttctaagtagctaggactacaagtgtgtgccaccacaccagctaagttttttttttttataagatggggtctcactatgttgccctggctgttgtcaaacttctggcctcaagtgctcctcctgcctcagcctcccaaagttcaaagttctgcattacaggtgtgagctaccacacctagccatggtgtaatacttttaggaaaagaggttggcggcttggtaaaattcatagttttaggaagagaaacatgaagtttaaaaatactttttggttattaactctttttattgttttccctgcctttgagcaaaaattcctttgaaaatgtcaatttacttattagatatgccttaagaaaggggtttgggctacaaagacaggtgggaattagaatctctggtggaccagaggaagtggggatggttgcagggatcaaagggagggagcacagaggggagaaaaggaagagcagggtctcctaggtaagctgtttccaccagaaattctccttcagggctctccttggcatgtcccagacttctgaacattctgtgctctgttcaaaaaaggaaggctcttccttttcagagcctagataaattagataaaatgaacttcctagcatagaaagctgaatgtcaaaaaaatcaattcacatgaccttaccaatgcaaaatacaaaccatgaaatggtcttaacatatcgaaggcagcatttgcactgtggagaaaaagatagacagcaaagcccagagccagcccagcatcgccactgaacggaaagcgctgcggtggggcctgggctgaaacccaagcgccatctataaccagctgcgacaccttgggaaaattcatctttctcaggtgtggtttcctttttgtaaagataggggtactagtaatttcttacaaggttgtgagggtttaatgagaaacgtaagagctcaacgaatgtcaactatcattaatgcatgatagggactaagacatgaagttagccattaggagtaaaattaaagaacatgtgttcattttctgcatctcaatgtatggttttatcttgaacactgttcagaaagcaaatggtaaatcactgcaccttctctccctccttcaacttccctaacttcccatcccttcgctctccagggaaaggggagggacctcatcactcagatcagacatggagaaacacagagagctgctgtttcccgaatcccagcagcatttcagaggcggtaagtcccgggaaggagccatggcagcggcttcccatggctcctgaattccgtctttctgaaaccacgtgtgtgtgtgtgtgtgtgtgtgtgtgtgtgcatagcaatagccctattcaacagcagcttttccaaatcccagaaattaggcacaggggagccactgggggactccttggaattctagggaaagggaccccaggagaggtgtaaaggttggtaaggaccctctctggagcaaagggtgggaaaatcatccccacatggcttttatctcctaatcaagcctcacgtctcaaaccacagagcaacacaagctcatgaccagcaaggctgaggttgtttccagcagcacagttcttgggcctttaagaacaggaaaaccaatatgcattagaaggtacataagaaggtacctgaaacacactgatgaaagaataattgtcaattcccatattacatggccaaatgccagtagattagatgactgctgtggtccctcatacccattttccagcagggagctattgcccaagcttggtcagaaccctgcagtcagaaacaggttaaaattccctttccagatctggtcctgtagcatcccatcagggaaatactccctgatgctcctgaataccttgccagccaaacaggtacctttaggcccacacagccttacccatttaataactgaagcacttttctaaaagctgccaagcccagttttattaagggtccaaatataaaaccttcatcaactattcatgcctctcaggggcttaactgggacctttcagagaacagtgtgagagactcggtacttagtcacaaaccctgcctaggaaatcaatttattctggattcttggaggaagaatagagcatgttgctatttacttttaataacaaaaccccttggcgtctcaagcccatctcttagtcaaagagaattgttattcatcattacagggtaaggtctgaccttaaaagcctgcctccactggacacattcctagatatatacatgtcggggaacctcagatggaccctccgtggagtcaggagagacaccatcacgcacccatcaggcttctgtcactgattcaaggccatcaacttctggcccttgtcaagcagctggaattgtttttaagttctcgctgtgcaatactttcctcagcctcaataaccaacgccaccactcagtgagccttattctatgccaggcactgctctaagtccttttgggtatcatcgcttttgtttttcaccactaccctgaggggcaggttctataacacccccatgttttacaaatgcagaaactgagatacagggggatggataaggaagctgcccaaggtcccacagctaattaagtaggagagctgggatccaaacccacagtctggccccagaggctgtatacttgctgctgtgttattcaaacctgtttgctgtatgggtttcagggttttttcgtgccatttaaggatgaagcccctctctcctttggcatcttagcaaaacactggtttggcattagatggtagccatctaatacttgctcagtggccatgccttagctgtttctacactgtaaagaactgccacttcatgattcttttttttttttacttaatgttgactctttcagctttcttaccctaaatggtattctagtgatgatcaaagcttcatttcccttaagaagcagaataaaatagtagaacatggattttgaagacaaagagaagcccttctactacttcaagatgagttaccttgggcaagagaattaacatctctgagccttagcctccttgctcatgatatgcaggtggccatatttaccttttaatattattatgagaaagaaaagatataaagtatataaatgacctgttacatgcaataaagagtaactccctgaggttctttcctgttctaaaagtctgtaactacctttactgcttgggtgattacatatccccaaggaagaaaagatttgggtttactggcttgtttccatcaaaagcatgtctctcgggtgtagaaaatcaacagttactgacatctaccagttctgtagtctcatgctaaattcaggggacatacattccagggagcaatcagatgcacatgcggggggaagctaacaaataattccacaagcaaatgaccaagcaggaaaccagcactgagcaggaaactaacagaaggagaagatccttccgccggcccctgtgtgaggtcagataagagaaattttcaggaaagagcagattggggcaggcagagaagatgaggggggaaaaatccaggaatggcagagtagaaaggagggaagaaggaagagagagagaggatagaaaggaagagagcgaaagaaagagagagagcagcacacgcaagcactaagatctggaatgtaaagatggaagatcacaagatgtacccagtcaacagtaagacagctagctgggcaggaagtcaggattaaataatcaattgatggtgtacatattgttgcattttgctttaccacttaccaagtgctctacatgtgtaatcctacttaatccttacaaaggccacgctaagcctatactatccctatttttcagttgaggaaacactcagagagactcagattcacgatttccacaaccgattctcaaaataattctgagatgagtaggcaagcattatttccatttcaaaaaaaaggtcaattaaggctcagagaacccaatgatccatctcagtgcttctcaatgctaaaggtgcagcatccttttttttttttttttttttttgagatactgtcttgctgtgtcgcccaggctggagtgcaggggcatgatctcagctcactgcaaactccacctcctgggcaagcaattctcctgtctcagcctcctgagtagctgggattacaggcacccaccaccacacccagctaatttttgtatttttagtagagacagggtttcaccgtgttggccaggctagtcttaaactcctaacttcaagtgatccacactgggattataggcgtcagtcgccacgcccacccagcaccctcgttttataattaatatttataatgccatcattattatcttcaaataaaacaaaactcaaaaataatataataaccataattgtgacaaccaaaattgtcccccacaaatatccaagcacccaccaggggataagacgcttcaggctaaaaactattcaaagacaaaggtaggaccagtcctcaaccttaggtctcctttcaaagaagggctcttgaaaaggtggggtgtggccacagggtggaggacacagaccagcagagccatgacagagaaggctggacatcagcaaggtcaggccttcagcctctttccctctaacgctggccaccagtattgagaaaatgatggcatttacatcacaaccactcaccacctcagctctttaatctctgaaactcatcttgccgaaatggaaattaagcactgtcttctaaaccctttcacggtacatattccatatgccagttctgatgcaaaaaacacagggacttgagaagaatcacttacgctcttcacagctaactcaaattaactcatagtacaaaacaaaacatccggaaacaagacttttgttttaaaagtctgtgcaaggccttggattcgatttatcttcctcttggtctaaccacttgacaggactgatggctttgatcaacctgccaagaaaaaccaaaaagacatccagagctcacattccaggggcgcctgtgggagattcagggctgacaaattgtatgcacagattctcaggaagaaaagccaaacatcttcattcttgaggtttaatttatgtgatttaatgccatgttagcacgcttgtaaacctatgtcatgatcaatcaagcaggaggcaagacgtccttctctcagttggctgtgccacattgttttagcagacattagataataaaacaaagctactggctgggtgcggtggctcacgcctgtaatcctgtcactttgggaggccgaggctggtggatcgtgaggtcaggagttcgagaccagcctgaccaacatggtgaaaccctgtctctactaaaaatacaaaaattagctgggcatggtagcacacgcctgtaatcccagctactcaggaggctgaggcaggagaatcacttcaacctgggaggcagaggttgtggtgagccaagatcacaccactgcactcaagcctgagtgacacagcaagactccatctcaaagaaaaaaaaaaaaaactgccatgaagaaactgctggctcacatcctaaagttccacctaagtggaattatacattcaatgaatgactacaaagcacctacatagcgccaggcgctacgagaagtttaacgacgtccctggtcctccctcccaggaccccacaacctggtgaagaaaatgtgccaggtacgcaggcacaaggccctgagtgagcggcccaaaaggcagtgaaagcaaaaagtcaaaaataaatccaatcagcctgggcacagtggctcacgcctgtaatcccagcattttgggaagctgagacaggcaggtcacttgcagtcaggagttcgagaccagcctggccaacatggtgaaaccctgtctctattaaaaaatatatatatacgaaaattcaccgggcacagtggtgggtgcctgtaatcccagctacttggaagggtgaagcaggagaatctcttgaatctgggagatggaggttgcagtgagccgagattacaccactgcactccagcctgggcgacagggtgagactccatctcaaaaatatatatattttttaaaaatccaattaatgtttggctatgtggtaaccaaagccaggaatagggggcatacataaaatccacagaaaccacagatttaaattaatttaaggtaaacccttttcagaatattaacaggtagatctctctcaattagcctttaaccacaccttccaacaagactaagattgacttactaggcagaaggaaagggactgttggtttatccaaggtcagctgagcagcagagaccaaacaccaactgaggaagaagagccatgtgcaaaaaggagataactttagatggaaattctagacatacagtgacatggaagcatattaccttgcctacaaagcaaaagagagaaagattcctatgccaagggaaagacagacccaaaatagctttaaggtttgttaaagtcctctgatgcagagttcaattgcactaattctgtcctcatttttgaaagaagacatgccacatttttaggaaatgaataaatattgccaaaatttattttatttcttataaacttgggaaacgtttttccctaagttttttccctgtatttgcaatgacaaactccctaatttcttctccaaaaagactatggcatcctatttcatggagggtaaaaaaggctattttgatgatatgacatccacaaggtgagcaggtggaatgtgcaataatgccgctaaagtttttcctttttaaacagatttattaagatgtaattcacataccatcaagggcatccatttaagtatacaattcaatggtttatatacatttagtatattgcaaccattactataattttggaacattttcatcatcctctaacaaaactttatatttattagcagtcactcccattttctcctaccacctgtccccttctcctaccctaaggaaatactaatctactttctgtctttatagatttgcctctgctcaacattttatataaacagaaccatacaatatgtggtcctttgtgactggcttcttccacttagcatgtttttgagggtcatccatgttatagaacataccagcacttcattctatttgttgctgaataatatttcattatagggatataccatattttgcttaaccatttatcagctgaaaaaaattgggattgtttccactgttttggctaatatgaatagtgttgctataaagatttgtatacaagttttgtgtcgatatgttttcatttgttttgagtataatatgcccaggagtggaactgctgagtcatacagtaaatttatgtttagttgattttttttagagacaggatcttgctatgttgcccaggctggcattgaactcctgggctcaagagttcctcccgtctcagcttccaagtagctgggatgacaggtgcacaccacagtgtccagctatgtttagcattttgaggaagtgttaaactgttttccaaagtggctgcacgattttaccttcccactaacagtgtatgagggtttcaatttctccacatcctcaccaacacttgttattgtccatttttttattacagccatcctcatgggtatcaagtggtatcctggtgtcattttgatttgaatgtccataaggactaatgaatgacattgagcatcttttcatgagcttaccagcctttgtatatcttctttggagaaatgtctattcagatcctttgcccatttttaaattgagctgtctttattgttgaattgtaagagctctttatatattctagatacaagtcacttatcagatatatgatttgcaaatatttcctcccaatgtatgagttgtcttttcactttcttgatgatgtcttctgaaacacaagttttttattttgaaaatgtgaaaggttttgaaagtacttagtacatatcttacaggggaggtgaaattaagataggggcatatttgtacacccatgttcatagcagcattattcacaattgccaaaagaggaagcaacccaagtgttcatcaacagatgaatggatgaacaaatgtgatacgtatatataatagaatattattcagccttaaaaaaggagattctgacacatcctacaatgtggatgaaccttgaggacactatgctaagtgaaataagccaatgacaaaaagacaaatatcatacaattccacttatatgagatccctagggtagtcaaattcatatagacagaaagtagaatgatggttgtacaaaaattagaaggggtaaatggaaagttattgtttaatgggtacagactttctgtttgggaagaaaaaagagatgaaaagatgaaaggagattgacagcagtgatggttgcacaacgtgattgtaataaatgccactgaactgtacactggaacagttaaaataataagtaataaacagatgaggggccgggcgcggtggctcatgcctgtaatcccagcgctttgggaggctgaggcaggaggattacctaaggttaggggttcaagaccagcctggccaacatggtgaaaccccatctctactaaaaacacaaaaaattagccggctgtggtggcaggtgcctgtaatcccagttacttaggaggctaagacaggagaattgcttgaacccaagaggtggagggtgcagtgagccgagattgtgccactgcactccagcctgggtgacagagcaagactccatctcaaaaaaaaagtaaataaataaaaataaacagatgagggcagtagctagttcccagtcctcgggttttagcttatcatttgctcttccctgctaacttctatgccaataagtaaaataagccaaaagcacaaaaagtaaacggttcaactaatccaaaaacaagcagcatacaaagttcaatgaaacagcaaaatgtgaaaataaattccttctgctgactcccatatttgtagaaggtccatactatgtgaagaacaatgctgaaggtggagattcagaaacgcttgagataaggactctgtgccctaaaggaattttcagaccaggaatatattttcagtcccgtgaatggcactcagcctaattcgacctgcatgctttttgaatgggaatcttgtaaagactggattgaagaacactgcaatcagagttagactacatctagggaagctcttgtttcttcttcttccctcctctgacatagcagtatatctttcaactctatgaaaatttaaagctcttactcatctgttaaatataaaaggaggatgattatgcaatttggaatccagatagtcatttttctgaatgagttcatgcatatgcttatttacaactatttcattttttcctgaatgcacgtaaaagatcactgcagcttaacagtatgcaaatctattcctactgtgaaatcataacagcagcaccagcctgctgagaactaagaggaaatgccacatatgaccaaagactaaattacctaccaaatcaagcctttgaaaagcacagacacatttactatggaacaagaatatgcaacaataagaaaaagttctagcagagggattagttagaataatacatgccgaaaagtgctttaagaagcagaaacatcttttggacagacagaagttcattcaataacttaaacaatatttattaagcacctattatatgccaggtaccatgctaggatctaggaggttaaaaataaaaaagaagacttagtccttcccaaccctctcccagaacctcagtgtctaccatggggaaaaataagcaacaaattcaataagatgtgataaatgctgtgatagataatgtacaagatgctatgaaagcaatagcattataggatagcatggagggatcaaggaaagtttgctgaaggagaggagacctagggtgtgtggaagtagatgggcgggccaggcacagtgactcacacctataatcacagcactttgggaggccgagatgagagaagcacttgaggccaggagttcaagaccagcctgagcaacatagcgagatttcatctccaccaaaaaataataaaatcagtggggtgtggtgacacttgcctgtactcctagctacttggggcggtgaggcaggagtatcgtctgtgcccaggagttcgaggttacagtgtgctatgactgaaccactgcactccagcctggactacagggcaagaccttatctctaaaaaagtaaaatgaaataaaaaataaagtagctgggcaaaaaaggtagagagggtcagtgttctgtggagaaagactagtatatgcaagaagatggctcccctacaaaagtaagactttgggttccggagtcaggaagatccaggatagagtcccactctaccacgtgttaagtaaccttcacaagctaatttttttccagctcaatgttctaatctgtaaaatggagatggcaattttacctcctcattgtggattaaatgaaataaatacataagtagagttccatacacacagcaattatcatgaagataatattttttaaaatagggggagtatagcaagaaaataattgagagagttacaaaaagaattgcatttgatccttgcattttcctttgactttggtctcaagtttcagcctaaccgtgaaatattcatgtccaataaatgataatgtcttaaccacttcaactgttgatatagtctcttttatatgagcacatgtatatcagttaggattagattcagttgagtaacacagactcaaactaatgatttaaacaaaataaaaatgcatttttcttatatgtgaaagtccagaggtaggcagcacagtgacaggtatgcaagctctggtccctgaaatcttcacagaaccaaaagccttccagctcaccattccaacatctttagagtttggcccttcttgtcatgatccaatatggtggctatagctctagtcatcacaaccatgttccaggcagcagggtggaagaaggtataaataagagagggcaaaaggcacacaccacttttttaaaacaggattccaaaagctaccaaacaattcttctacttgtaatagtagaatgtattctattggccagaactagtcacctggcctcctctggttgcaaaggaagctgggaaatatagtcctttttttcaaagtgtatgattttctaagcacatgtggaaccatcacataactaaaataatgaacatatccatcacctccaaaagaggaaatataatctttattctgaatggccatgtgcccaactaaaacttgtgagttctaagaaaaagagaatagatgttgggataagagtcactgtcacaacaattgatgtgctagaaactcaaagtacagaaagtagggttttttgttttgttttgttttgagacggagtctcactctgttgcccaggctggaatgcagtggcgtcatctcggctcactgcaagatccgcctcccgggttcacaccattctcctgcctcagcctcctgagtagctgggactacaggcgcccgccaccacgcccggctaagtttttgtatttttagtagagatggggtttcaccatgttagacaggatggtcccaatctcctgacctcatgatccgcccgcctcggcctcccaaagtgctgggattacaggcgtgagccaccgtgcccggcccagaaagcaggtatttttaaaggaaggcattactaagtgcccactatgagaaatctgaagagctctagatacaaagattgacacgaatatcaggaaacctggtacacagaggtgagccacaaaggagataaaaagagctgttgataaaatgcatgaaggtaacaaagaaggggctataggaagaggatgtgaaagaaagttaattgctgcttttagaaagtaatacagtgaccaagtaggcacattctttgattccacaaacccaattcttgcattttcttcaacaggaaaacaaacttatgcacaaatatgtttgctgatgaccattcaatgagaagagaaaataaatatttaactggacaacaggatagacttactatacaaaacactgtagtatattatacagtcattaaaaatgaaaaccatgtacaagcaaaaactttgccctatggagtgaacagaaagtttttactgattattattagatatacattaaatgtatacaaatgaggacatgaagttaagtcatacgcactcatcagacctcaatgcacacatcactctctcagagcaaccttctaaggccttggaatagctcaggtgttgtaagtgctgatagcaccgttacctttcttggggccacgcaagaccgtgtgtaactgcagtttttatctgaacttctccctttggactttaagctcctcgagggcggggacctgcaatgggcacctgtgtttttttccctgaccagcatcctcctttttcagtaacataaccttgataccttggctccaatgatggaccataccccaagcctgaccaatcagcccattccatgctctggttgctccatgccacaagcctcctgagtgctaggtccttgttcatctttgtctttccagggcctagcacagaacaagttttacataaatgtctgatgtccatgaatagatgaatcgatggatgctcttctaccaacccaggtacggaacagaatttgactaaatagatgtgtgggttgatgcttttaaggaaaaatgtagtgtttaatggaaaaatgtattcaaaagcaacaatttattttgctcaagggtcatttagacccgggctccagacctagccccactctttgctagattgtgcctctgcgtaagtcacacaagttctctaggcctgtttattcattggcaatgaaaattacaatatctaccttacatgactgtgtgcaggttacctacacatggaaacaaatgtggtatgtacatacagtggaagggtttagcatagaacctaatacatgacacctgctcaatgtcagtggtgctgttattattatacctgggaatagctacaggcaaatatagagagacagtgggtggggatcttctctttgacatttgtgtgtttagtattccccttgaccaaatgaagttatatttaacttctcctttctcactttccttggaaatttcactgggctgtggctctctgtgtcttagaggacaattatttatcttccaaagtgatgcctggcttattttatttacctgtggtagattggacaatttaggatccatctagtgaccacccccggtccccgcaacaatcactactcaggaagcttgtcaccggtagggcggtgaccacactagggcggctgactatgctaggacagtgcagaggagggatttattttttccttttgcagatagatggatagcaattccaaagccaggctggttaccagaaaaaccaagggagcttaaagccaaaacaacaaataaaaaccacatccctgggcctcaccacctgagaatctaatccagtcagtgtaggatggggcttagtggtctgtatttttaaaaagctccctgggtgattctaaagctcccccaggcttgggtactagagaaataaaatcagttttttcccaatgtatgggttaatatatggtcactcccagaccaagcatagagctttcactttttaacactgacctgctacataggggctccaatcctcagcccagtgcaaaactagatgagctttatatgacgtcacaaggattttttaaaaatataaataattctctcttctgttgtcttggagaatatttattcaatcaatagatagcacaacgttagttaaaatgacatatcatgtatgactttaaccagaactataattggctacaaagctgactgttttgcatttacctgctttcccttctctgtatcacctgatgcaccagtaagcagtgcagagatgatgaagcaaaggagtaactttaacaggtaaagaaacaacaagggaaagaagtaagcaaactgaatgatcaaaattgaatcaccagctccagaataacaaagacttaaaactgcaatctttcagaaaagctttgtctcttttgagaaattggcatgctctctcttttccaaaagtatgagttatgtaccttatcatgttttcctttttgccacagctaccaggaagttccaggtaaaatcagtcaaaagctctaatttaacactcttggatagtagtttggcattttcttcttttccatggtccttttctctccttttttttttttttttttttttttttttgagaaggagtctcactctgttgcccaggctggagtgcagtggcatgatgtcagctcgctgcaacctctgtctcccaggttcaagcaattctcctgcctcagcctgagtagctgggattagaggcatgagccaccataacagctaatttttgtatttttagtagagatggggtttcaccatgttggccaggttgttctccaactcctgacctcaagtgattcacccacctcagcctcccaaagtgctgagattacaggtatgagccactgcatctggccctgattttcaatttctaggtccactttattaatattattattcattggttgagaagtcactccaaatttgttttaggaaggagcaggctaagtcaaatcaaccaactccctggaagcttttttatattccatcaacatagcataccgcctagctcctcccaagcaagctcatcagaactatctactgcttaaagctcttaggacatgtacttttttcctaggtttaatttggtattcaaaggccacagcaaaaattatattcattacagaacagacactgcttggtggccatgccagctgacacaacaccaccatctcctctggcagacattttaccttaaagcacaaacactgtgtttcatcctgatatagggcctgtggctagaaagtgattgttatcattttctattcatgtgttctcaacagaaaaaaaaaaggacattcccttataattctctatcacagacaacttcaaaccatcttatgtccctttaaatcactgaactagctgctttcataaagactattgattttcatcctgcataaattattttacaagatagataacaaagggaaaagtaccaggagattcaataattctctctggttttatttaagggaagatatattctcttccctctacaaaaacacattgcttttcctgtcctccccgtgcctttcatgctgtgaaaatcagataagatacaaacattccaaaccctgcaaaacactagatggttctcatgaaaaccaattattattttaacgcatagggaggatttctgacacatcttttggtggcacattcatttattaatttctttcagtaaatatttatcaagcacctactatgtgccaggaactatgcaaggcatagaccctgcccgcccctttcctatacaatgtcattttggggagcacaaagggttttgttcatagctgctttcctgctagcatgctgcagtatggctgtgccagttcctcaattgtttaaatattcttgtacctcaagtcccctcagcatcccctaccgactgatctcttttccagcatgccagaccttctgcttggatttatgtctgatccagctgggaccccagggcatgctccagcactgtggccttcagcccttccacgggatagtgctgctgggtaccagctgataggtatctttaacagatcctcctcatttcaggactggcctatggacctaacactgcactcccattcacctacctcgcccatttcctcccatgttctcacaccaactcctcccctggcctagacacaacaagctctgcaggagaccaaagactttctctctttatgtctcaagaggatcagggtctccgtttctccattttactatcattgaacaagaccagttggagcttttgccttcctcccacccaaggtgatgttcacagtgtccactttgtcagcggtagcaagcaagtgaagggtgtctttcctcttactattttggcaaatgtagaatcatcacagggactctgtttaaaacgaaaatgtgcaatgaagaaaaagcaactgtgggtgactaggcaatccacaccagggtttgaaaatgatttaaaccagtaactagaactttgcatgggcagaattccaaacaggagaactgcagggcgagagtgacaggtgccaaatctgagcaatagttcctgcaatgattatgcaaagcactggccattcatgctttgatggtaatgcactcatttctccaacttccagcacactaaatgcaagtgtggcttaatgacggcaactggattgaaaggtaattgggagctgaaaatagagactttgcctcattatcataattctctaccagaaatgtttgttatgtcaaaaagcacttttccctgggcaccagtttaaaggaatatccattaaagattttaagggtgtaagcattaacagtgtttttaagccatgaatgctaagcttatacaaaatagatatgagggaccttggataactgaatgtatttcaggcaaataagatgtgagagcagtaagttcaagccatgagtctattctgctcacctgacttccctctaatattttttccactcccctcatttcctttccatctccaatgccccttccctatctcaggtacccccaccataccttgtataacctcttgtaagaggcaagttgtgttgaagaagagaaagaaacaaaagccttcaacatttcttctcttctgccacttccgcacctctgaccagcccatggtgataccttggggatgacagtgatgatggtggtaatcatgacagcaactactataacgaatctactttgttccagacatgttaaaaatatactcccttgttgaacaatgagaacacatggacacagggagggaaacatcacacactggggcatgtcagggagtcagggacaagggaagggagagcattaggacaaatacctaatatatgcaaggcttaaaacctagatgacgggttgataggtgcagcaaaccaccatggcacatgtatacctatgtaacaaacctgcacattctgcacaagtattctggaacttaaagtaaaatttaaaaaaataaatgttatatatatgtatatatatacatgtgtatatatctcattgcatatatatacatgtgtacacacatatacacatgtacacacatatacatatgtacatgtgtatatatacatacgtacatgtgtatatacacatatgtacgtgtgtatatgtacacatgtacgcgtgtatatatacatatgtacgcgtgtatatatacatatgtacgcgtgtatatatacatacgtacacatgtatatacacatacgtacacatgtatatacacatatgtacgcgtgtacacacacatatgtacacatgtgtgtgcacgtgtgtacgtaaacgtgtgtacgtacacatgtgtgtatatatacacacacacattctcccttattttcacaagaagtcaataaggaataaatacttttaaaaccatttttgttgttgttgtaaataacataaaatatggctaacagcagcttccataaataggggtccatttccttgcataacaagaaatctgaatgtagacagtaccaggggtgctttggggagactcaatgatggtaggacacaaggttggcacctctgtgattctcttagtcttccccctcatagtcatgaaatggctgcagcagtaccaagcatcgcatcttagcacggctgcgtgcaaagcagagtgcaggaagcagcacaggcagaggttctcctcctctacttccctcggatgtaggaaacaaattttctcccagaagccccccaccgccaccaatttccccttacatctcttgaaccagaagacactcacctgtctgcccctagaaccaggggcaaggcccacctttcccgagtttgggtgacctctgcctggttttgctaacaaggaaagaaagagtcatggctttgtggcaaatgacagctgccgcagtagtattctctgtaatctacagtgaggtgacgcaacaagccaaagctttattccactgaggggcctccctgcctgctgcagccctcggctgagatccagttccctccatctagaaggcttcctcctttttttttttttgttagtgcttattttttcttaagctaaccatactaagtctgtcgcctgaactgaagaagtattcaaatttcacccaggaccgttcagttctgccccctcccactcatttataagaactaagtccaaatcagtcaggtcaagagcaccccgaggtgcagacagaaacattttgtgcagaaaacagccgttccctaaccaacttgcaacagggctggaaactgctctcaccagggtcaccaggggagctgccatcctgttaaccgagctccaggaactcactggcaactgagacatggggcaggtagagcctgacaaaaatgtcatcctcaaaaacaggaaggggcgaaacccttttgtagaactctgaaaatgtcaagcgcctgcttgcacctccgtcagggttagattgaatttcacatttcactgcggtagggccctggaggcactgcggcagcgggagcaggcggtgaaggttggaatcccaaggctgacactgccggtgtggaattcctattccctctgtgcttcatcatccttcactgtaaaacagacataacaatggaatctatctcaccgcatatcttttgagaattaaaagacataatatatgttaagggattagaaaaatctttgctcaatgaacatcagtgtgttagcaatactggtagcaacaataccagcaatagaaacaaaaccaaatggtctccctgtaatggccaggatttattttaatgacttaaaggtactagcaaatcagtctcactgtcacctcagtccagagcttgaaagtctagctaccttctccctaaactcactcaacaatgagcaatcaccccaaaacaacaaacaagcataaaaagtagaacatctgataccatgcagtatcttgttttagtttcattttattcttggtatatcttgtgtgaaatattccaagaaatcaagagaatgtacataacgtgtatccacattttaaataaaataacaaaatacctatgtacccatcccacagtttaagaaatagaatgatgacgctgtgcatccttccatgattccaggcgccccaaccttaatatgcaggtaaccaacaatctgaatcttcaattaatcattccttttcttttcttcttttttttttttttttgagtcagggtctggctctaccgcacaggctagagtgcagtggcaccatctcagctcactgcaacctccgcctcctgggttcaagcgattctcccgccccagcccaccaagtagctgggactacaggcatgcgccaccacacctggctaattttggtattttttatagagacagggtttcaccatgttgcctaggctggtctcgacctcaagtgatccacccacctcggcctctcaaagtgctaggattataggtatgagccactgtgcccggcctcctttgcttttctttatactctcctcgtcacatatatatgtatccctaagcaataaaccatctaattttgctatattaaattttatgtccataaaaatatagagcaggtattcttctgtaacttgctttttcattcagcatttgtttagttttatccatgtttacacacataattatacttcattcattttcattgttatgtaatagtattcgatttaggaatataccactatttatttacccattctcccattaatggatatttgccttgtttctagtctaagacttctcacccgaggatgggcttacacagatcctatttagggtaaccatataacttactgtcctaattgagacacttgtgggaaggaaagagaatgctgttaataatgacacaaggacaacaggcataaacaactacactgtatggtcaccttgtacacactgaacatgtctcagggcttcttaattactcccctaaagtgcggactgagacatttaagcccaactcttcataactgatggtgaattcacatcttaaatgctgctagcttctccattcagatgagaaccctgaaggaaagcccaaacaattaattactccttctatcccaggaagaaaaaaacaaattctttaagacataagacggaaaaaatgcatgacttccctgcctcagccatctctgactttcacagttgatcatcactgtgtgaagaaaattctagctccaatgataactgcagcaaagagaaagtgtaaaaggcctcaaaatctgagtccttctcctgagttaagacggggctaaaggcctcgcacccactgcctcctttcatctttaccacaaccctgtgtggcaggtgtgggaaatgaagctcagagctgcagcaatgtgttccaggtcacagtgcacataagtgacagagcctcagtcactttgtctaagtagggagccgtatactttgtgatgcaaaggagtaaaagggggtgatttaacaagtgccaggaaaacagttgtaaactagtcttccccaggcacacccggacatgggacaccctagttctaactttaccatatgcacttattttccaagagcagatataaatgatttgggggactgatgagatgtgggacccaaatctctagtgttgacactcgtcttgtgtggcgatacactgtcctcgcagaggtcacagggtgtgcaaagtccctcccctcttcctcctcagcagacttgcaatgcctggtgacttcccagtggcatccttccatccaccacagcaggctggagaggatcatgactcgcttccctgaaattcacaattaaactggagaggcactcttcctcccaaagcagctcctgctggtggctgccagcagcagtgttatgtcgctctcactggagcaatcttctttcacgaggctgcgcacacattctccaacgtgggggatttgtaaccctgtccttcagcagggcccctgaaatccccagcctcgcacctttctgcatgtgtgtgtggcctctcacacacacacaaacacacacaatagttttttaaaagaaatatttcagccagccacagtggctcatgtttgtaattccagcactttaggaggccaaaggagaaggactgcttgagcccaggaatttgagaccagcctgggcaacatagtgagaccctgcctttacaaaaaaaaatgtttgttttttttttaattagccaggcatgatggcatgcgcctgtaatcccagctacttgggggcctgaggtgggaggaaaagaaatatttcagatatggaaaaatagagaattatataacagcatcccctgggcctgagcacatacatatcttttgctatacaaaaatgttctggccaggtgcggtagctcacacctataatcccagcactttgggagactgaggtgggaggatcacttcaacccaggaggttgagactgcagtgagctgtgattgtgccactacgctccaacctgggtgacagagtaagacctagtctcaaaaaaaaagaaagaaagaaagaaaaaaagttctgttcccaaccacaacattcacagtggccccaaaggagaaacaacacaaatgtccatcaacaaacagcaaaatggtacattgtggtacaatcacacacataaagtatcatacaataggaatgctgtccagtaagaaaaatccacaaattgctgctacacacaataaggtaatctcacagtcaatatattaagggcaagaagcaaaaacaacaaagaatatgtgcgctataatttcatatatataagtttcaaaaacaggcaaaaatgacctataatgctagaaatgaagactattacttttgtgattgaggtaaaggatattgattaggagaagcctagagagtttgcttctaggatgttgataatattccaatttttaatctggatgttaggtacagaggtggcagctgtggtaattcctcaagtaatatgcttaaagatgtggacacctttctgtatgtatgttacacttaaagaaaaaaggtttaatttaaaataaatccagaatgaaagcctcttttagtcaactattatgttatttatacccaaataattatcttcactatcaagccatctgtgtgacctttggaaaatcacttaatgatctgtgtctatttcttttttggcgggggatggagtctccatctgtcacccaggctgaagtgccgtggcatgatctcagctcactgcaacctccgcctcctgggttcaagtgattctcttgcctcagcctcccaagtagctgggattacaggcacatgccaccacgctcggctaatttttgtatttttagtagagacgaggtttcgccatgttggccccaggctggtctcaaactcctgaattccagcaatccacccacatcggcctcccaaagtgttgggattacaggcgtgagccaccgcgcctggccttttctttatctgtaatggcgtatgatgtatagtggtgatgtgagaagtacttgatataaatatgaaacatgcttagcaagcacttggcacacaattaagcacccaaaaatgttagccatttgaattagtggtattctatccacacctcccctccttgtatttgggacttatctccacttatatccttctggactgggcaaaggcatattgaaacgaacaggtttgcctatgtgtgttttggggtaggaagtggaatgggtaaatcccttctggaagacaatctggccatatataccaagagcccagaaaatgtttgtacccagtaattccatttaggaatctaccctaaggagataagacaagtaaaagagatttatgtgctgcaatgctgttacttatgttatttatgtaccattgcatgttatttataaaagtgaaaaactagaaacatttattatatcaggaaatagtcaataaaataatggtgatgagcacttttaatgacatgaaaagttgaatatgaaagagatctaactataccaatttttaaaataataaatacatataaagaagattagaggaaactaaaccaaaatttcagctaattatctctgggtggtaggattataggaatttaagttttcttccttatactcttctgtatttttcaatattcttctctgagtatatattacccttaataatgacagatataaatgttaaagaatttctatcctcttcccctaaggcctttgtctctgtggtcaaggtgacagctggctgcaatccatcacatttaggaaggatgctatacaatgaaatgtgtctgaaggaaagtgactgacaggttggcaaagtgcttcaaagataaaccccatgaggaatggctgaaggaacagggatgtgtactttgaggaagacttgttaacaggacagctgtcttggaacacctgtcatgtggaagagggattacacttgctctaccagcctccagatgtcggaaccctgacaataaatcaaagttacaaggagaaaacaaggggagggtgaagagtatagctcaagaagcatccaagctgcatgatcacaatataaactccaggtttccttcctgtccaatagtaagcagctcccctggaggtgtccagtgaattttctcgttagcatttgggcaaccacatggctccatcctgaggctgtgctctaccagcctcccagatcacagccttctctgtggacaaacccatgagttaggatctctgtattcataagcaaacaccagcctggggatatgcaggttaatccctaacccttgtccttcagcaagctcttcaaaatttacataaattggtctacttttctccattttttccacttgaccatcttagtctaagtcgtaatcacctctcttccctgtacaactacaatgtcttcctaattggtttctctcttctattcttgctacctccactcccaatctattcactacctagaagctaaagtaatagttttcctagggtaaagaaaaaaatcattgacagactataagactcaaagtggagactacatctccagccttcactggatgccacaccccttgcttggtgtactccggtgaaggtccccaccttttagggcccacattcatgctcaacctttccacctcaggacacttgcacatgctgaaacactctccatcaccttcagaaccccaaacctcagatgtcattccctagttttaatcctataatgggatcccaaattgggaaggagactttgtgtggcttatcagactttgtgtgacctagccacagccgaccagtctgcacctactatctctagtctcttaactaggctcagtatgaatgagcctcagcctcactgaggaatgagggagatgttggtgcatttgaggaactcagaggcatgtaccaacatccccctcattcctcaatctttaggcatcctgcttcctacgcctggaaaaatcttgtggctaattcttgatcaccttcagggctcagcatgaaatgtcacttcctcaggaggtcttaccttacctccagatactgggtgggtgtctctggtgtgtgcttacagcaactctaattattccatcagagcatttttttttttttactattcaactgtaactgtatttcctgctatttggtaaactatatgaaggcaggaatcacatctatattgctcagaactgttgagcaaatgactttattctttaaatatgactttccccccatgaatgagcatattaaagtcaaaaagaacccaggaaaaccatagatctcaacaggaagcattccaataagtggtatttcttcctggaataatgaagcaaatctagacttccgactcaatttcccatgtcctaagggaaggttcatgtgttgtcatttttattttcactagctggcatagtaattattctttaccagcattcgaatgcccgggggcaatcttcagtaggcacacaaaaggatcgataagtactaaagagactaaaaagataaataatattgaattcataaaatggcaggataaaagaaaagtaaattaggaaaacactggaggatataagactaataagcaaaaaataaatcacccacagtctgcttcccccaaaagcataagcagctgttgttaatttgataaaactgcttcatgtgaaagaccttcagaatcctaaaaccagagccctggtctggaccttggtgtggattcagggtagaaatacaacaaacagaagccaggagacagtgccctgtgtccccttccctgctctaccttttgtcagctgggagactttggacaagttacaagtcttctctgaatttcagtttctttacctaagaaggctacataaattcatgtggtagaaaactgctagttctctacgcattctcattcccttctcctttctcggtaacggaacccgatttttagctgggcacactaatgtcccattaaaacataacatttctcagccaacctctacaactaggaagccaatgagatgtaagtagacctgttgggtgggtctactggaaagttctgaaagaagagactggccattcatcttcccacttcctggcacagaaatgtgactgatggctgagacctttcaaactgtaaaaacaagagcagcaccagaaaggccaagaagaagaaagctggaagaaactgggacccaaatgacctaatgaaaataccacaacacattctggactatctacttctaaattcctttatgttagagagaaatacactgctcatctagtttcatactggatggcttcgtagaaagatttccctttatatttggccccagttggcctatttgggtacattggtcctgcctctctcctcgggagcaagacgttccattctgtcctccttagcgtgccagccccatggatatttagaaacactgggaagtggtctgagaaaacctgagtttccatgggatctcgggcaagtcgcttaagtgctctaagccttgttgttcatccataaaatgaaggttacttcctttatttccccagaaatattgtttagaggaaagagcataggtttctgagttacatatgaattcaaattacttaatggctatatgatcttaagcaagctacttaacctttctgaatttcagttttctcatctttaaaatatcttacttcacagattattatctaaggattggatgagatatcaaacacgaaacacttagcctaaagacttttatttgcaagcccaataccttaccataaaatagtagttactgtcatctgttttcattttgcagtgttgtatgtaatggtaacaacagctaacaatcactgagcactcatcgtgtgtcaggcactgttcaagcactttccatgtattaagtcatttagttctcacaacaatgaggtaagtactcttattatccccattctatagatgaggaaacagagacgcaatatgttaactgccttgccaagtcacacagctaaagagggaagccagacagtctgaccccagagcccctgctcctatatttccagcgtacaccatattgcttgctgtctgggggtagtgtcatgtctccccaaacaacatgctagcgtcctcagggcagaatctgcatcatatatgcctcggtgtcctccctggtggctaacagggaatcttacccaccacaggcctccaagcaccagagagaactgaatggcaggtaagtaataactgagccacttcctaaaatacctgtatcacagatgaccttgaagaagaccatttgtccaatgaaccaaggtatgcctgaagtgaaacacagagaatccctttcacagggggtggaatatccctccacccgaagtgcacctcttgggtcctcagaatcagattccctaaaggcttaaaggactctgggaacaattctggccaatgttttacatgcttccagagtctgaactgagtttaaggcctctgtcattcattcaaattaaaaatgcctgccagacagaatgaaatgtgtcagagtttgccggcctatagagagtcaccatttcctcctaggtgctgacggacaacagctttcgaaaatagatctatttatgttgtcatgatcaagaacactgattgagtatgtcactatgcaaactgagtgtgtcactatgctcgggatgcagctgataggacacaaacctcattagcacagacttcattaatttggaatatgtgatcattcttagtaatgaattttattttttgttatccataaagaaaacaatatgcaaaataaatgaagaaacaagaccaattcatctcttctaccaatattcattgtaaatctagcaccagggtggtagtcatagatgttattttgtgtaattctcattaaaagagaaccctttagtgcagaaggtaatgtacccattttaaaacaagttagaagtctggaaaattaaattacggtacatccatacaatgaaatgctatgcaactataataaaaccaatggagtacatcagctggtgctaacatattaacaagaacaaatgctgaatgaaaaaaagcaagaggtggaaccctctttaaagtatctcatttgtattaaaaaacaatgagaatagattataatgatgtatacatacataaatggatatacagtgaaattctcaggaagggcagtcaagaaaaatggatggtctaggatggaaaagaaactcatttttcactgtacttgtgtaacatggagttctttaccattttcatgttactgtttatattaaacctaacaaaaagaggttagcattaattattatttattggcccatgcctagtgcaatgtctggcatataactggaattccagtgttaattgcatgaatgtaaagaaatgataccactaattaccatctaagcacatttatcttttctattcatacatcaggtcccaccctaacattaaatgcaaaaactctctggagtaaattcaagttcctgtatgtgcttaaagaaatacacttgcaacaattttgaaagatactctgtaattcatccttcccctttatgttccccactctctcctttctcaagctctgctctccacacaggcgaacacacacacacgcacacaggcatgcagagtcaggtaaacagttcactgacccaaaaaaaaggactggaattcagaaatgttttaccgctattgctagaggtttggtatgatcaataatttttttaaccacatgctgatttgagaaagtctataaccacacactaccacttcactggcactaccaattaattttccaagtatattttgaaaagagttggtgcagattcattggaaacaatctgcattattcctaatagtaaccacaaacatgttctaaatagtcagagcaacccttaagcatcttggaggtctatgaacacttacctgccagatatcaaattcgcaggtatacctgacacgtgcagctgctccctcccgctgctatctccctacgcgagtgacagcaagccagggaattggaaactgacagttttgttttctcagtgctgacaaaggggaacaaatttcatattttccctgagtgtgcagtgtgttgttttaaattttgtcagagtttttcccctagtagcagcaaccaggagaaaaagaaaaagacatctggtaacttctttagagtatgtcttaacagatctgttggtgtgactccactcatctgtttcataaataaaacgcaggcaatgccatcaattaaaaatctttctaaagacggttttaacaagagcaatatcctggaaactacggtcccaatatcctaataatcacaagagccaccatatatggaacacgcttgtgtactggcactgtggggagcactttataagcaagcggcagcttaattctcacaattctattgggtgccatcattatccccattttgcagatgaagaaactgaggctcattgagatgaattggccagcacaaagtcatacagctagtgagtgaaagcgctgggattcaaaccaggttttgaagaactccaagcattctggagctctgtgttccatctatgttcaatgagtttatctgacaaaaaaaaaacagtaagaattagaggaacaaggaaggagccattctctctctgctccagaattgatagtctatgactttcggcacacaggccagctgtggcagacaaaacagtaagtctggcatcaggaatcccagaattgccgtcctgactctaccatgaacaaacctgcttgtctcacttaacaagcaagccttgttctccacagctccgagatgaggcagctggattacaatctccctcagcttaaaaactgcatctacaaagccaggcacagtggctcatgcctatactcccagcactttgggaggccgagaagagtggatcatttgaggtcaggagttcaagaccagcctggccagcatggtgaaaccacatctctactaaaaatataaaaattagccagacgtggtggtgtgtgcctgtaatcccagctatttgggaggctgaggcaggagaatcacttgaatccgggaggcagaggttgcagtgagctgagatcgtcccattgcgctccagcctgggcgacagggtggaactccatcttaaaaaaaaaaaaaaaaaaaaaaaaaaggtcaggcgccatggctcatgcctgtaatcccagcactctgggaggccgaggtgggtagatcacaaagtcaggagattgagaccaccatggctaacacggtgaaacctggtctctactaaaaaaatacaaaaaactagccgggtgtggtggcaggcgcctgtagtcccagctactcaggaggctgaggcaggagaatggcgtgaacccgggaggcggagcttgcagtgagctgagatcacgacactgcactccagcctgggcgacagagcaagactccatctcaaaacaaaacaaaacaaaaaacaaaaaaaacccgcatctacaaggataggtgtatagaaacattttgctgggatagtaaagcaggacaaaatggaatataagccacatggtgtacaattgagcatataatgtccactttgcagagaaaaaccctgacagatggcattaatcagcagtcagcttccaatgaaattgcaccaatgacctccagtgcccactgctaaatccagtggtcaatttgtggtcatctcaatgggctgatcaacagaaatccacagaattaacattctctcctcttgaaatctctctaattgacttccaagacactaatctctactatattttcctcttccttcctggatgcgccttccaagtctccttcgcaactttgtcctcatcttcccaactcttggagtgctccagaattgagtcccagtcttccttgtctacagtaactctcttggtgctctcatccaatttcacagatttaaatgcaatccacacactgatggctcccaaatgtgtaatctctaccccagaaccagacttttacatccagttaccaacttaacacctctgctcagatggctaatgggcatatcatgcccccaaatgagctcctgtatctccccaactccaccctcagagtcgtttcaataaacgggccctcagcccttcacggtgctctttgcagtcccagcttgtctgcagccaccccagccagctccagcttatgcacttactattcccatgacttggtgacttcaccaggtatccatgaggctccctctctcacctttctctggtaattattcaaacatcaccttttcagtgaggcctttccctgatcattccattttaaattgtaacccatccctcaaagcaccttctttcccttccccttgctttatttttctccataaaaatttcatcgcctgatatattttatattagattcatgtacttctttattgtctataatccccaactagaatgcacgctctaggaagaggaaagagtttgtctgtcttgttcactgatacatctctaacacttagaacaatgcctggaacatagcaggaattctttggggggaaatgatgtaatctacaagcatccatgcatagcctgagtacaccagagcatgcacagtagccatttctctctgaataggaaaatgatgaaatatctgtctcagacactagtttcttttcctcttgtctaaaaactgaggtcatttttggatgtaagaagtatatattgtagtgccccatttagaaatcacagcccccaaagaactaagataaaatataataatatcataaaaataactttaaaaaataaattagaatcagtgtgttgttttcatgtgtacattaatttttaacatatataatatatgatatgtagagaaagagacataaatattttttccataaaattggggaactagccatgccaggatttctgtggtaatcttgaaactgtctttatgtatcaacagccaataatgttatttgtttatctatagctagttgtgtgtctcatttttctttttctttttttttcatatttgaaatcttgtatttcacctaccactaccctgtaatggcaaaggatggtcactgagttagtgggtcaaagctcagacattagcatcaaagagactgggcctaattcacagatcccatctatgagaactctgaaaacattcttgacccctgatttcctcacagattcaccatccagcaacatttctgtgaggatcagtgagataatccgcataaaacccttagcacagtgcttggcacacagaaagtattcagtatacattaactattattaatcttcagaccttatctgacatctttggctctcaaaattcaaaggtcttattgatctcaaatgcaactcctgccagctgcaattaaatacagtcatgtgttgcttaacagtggggcttaatggcagggctacatgccgagaaatttgtcattaggtgatttcatcaccgtgtgaacattctaaagtgtacttacacaaacctagatggtatagcctactacatacctaggctacatggtatagcctattgctcctaggctacaaacctggacagcatgtttctgttctgaacgctgtagccagctgtaacacaacggtaagtacgtgtgcatcgaaacatgtctaaacatagaaaaggtaatgtattgccctgcaacattacgatggctatgatgtcagtaggcgataggaattttcagttccattatcttatgggatgaccatccattattggccaaattgtcactatgtggtgaatgactgtattcccttcttcagtttatacctaatgaaaatgcacccattttcagtaaacacgaacaaatcaaatcaccttaaatgtcctaacaatacatgtgaatgtaggttttaaagacaaaactattgagggttaagaactggctgataagtaaatgaaccaagtgttcgcatctgaaatgacatagaaggaggtaaagaccatgaagaaaagaggaaagaaaaatgctatctagaaaaggggtgaaacgaaaaacgaatcagaagatataggttccgtgcttaccaacgcattcttttaaaacagtgacaaaaataataaataacgcctacgtaggtagcatagataagagtgcccagcattgttccaagggcattatgtgtattattagcccattttgtcttcacagtgtcctctcagtgggtacattattatccctgttatggggcacagagataacatgtccagcagctgctgagtggcacagtcaggattggaaccaggcagggcaggtccagagcccaagctcataaccaccacgggacatacatcctcatgtatattccctgatttcagagagagaggtgtgtgttgttattctttgggaaattgcccctttccctgaccctatgtggctctagaaggcttgactcttccccttaccctatgtaagccacaagttatgggggcaaaggtaacccaatatgaccagacagggtccattctctgaaatttttttctactgcagctggaaagaaactgtccttatcttcccttggactgagagctgtaaggctatgatcccaaagcagctaggacccttttgccccactgcatggaggtacaaggaagtgcttaaagcatgggcctttccatgaacagggaccaaaatgagagatggacagacagaaagagggaaggggtaagctgtttaagtctctggatccaggtatccctgaggtctgctgtacctcctcctttctaaattccatttacctgagtcaactactttctaccttgttatttaagatattagtttctgttgcttatagcagaagaatcccaaggaacacatttaactagacatttaatacctccaggatgagctggagaaaacaacctgcctgctagacaatgaagtaggtttatagctaaaggaacatatgttcctagactgaacatgcatcttctgagcacccatcctctgtccaggaccgtgctagacacaggggaatcatgagaaataagacactgtcctcgttcttgaggagctcacagtctaatgtaagaggacacacatgaaaacaaataatcacaagacagtgagctaggtggttaatagagttcccgcctcggggtctttgtattttctgtttccttgctggaaacactatactctcagacccataactgtccaaggctggtatatcagtttgctagggctgtcataacaaagcactacaaaccaagcaccttaagcatcagaaatttattgtttcacagttattaaggctagaaatccaagatcaaggtgttggcaaggttgacttcttctgagggctggaagagagaatatgtcccacctttctctcctagcttctcgtggatatcttggcctgtagatctctgccttcatcttcgcatgccattctccccatgtgttatctgtatccaaatttctcctttttctgaggacaccagtcatactggattagagacccactctattccagtatgacctcatcataactaattatatatgcaaggaccctaatcctaaatcaagtcatattctgaggtactgcggactagagctttaacatattaatttttatgggacacaattcaatccataacagctagctttgtcttgccattcaagtctcagtccaagtattacctccacagaaaggccttccctgaccacccaattgaaagaagctcttccccagccaccagtcactctacctcattgccctacttgactttctccatgcacttaccactaccagaaatcatctcacttgtttgcctttggtctgcctctctacacaagaacataaacctcatgaaagcaaggactttgtcttgcccacttgtctccagagctgagagcagtgcctgtgacacatggtggtgctcaatcaatgtcagctgaataaatacatacataagttaaatgaaaatcacttggccattcataaatgtaatgccagggagtgccacagctatgaataaaagtcaagcagggtaagagggtagagaaaggtgtgctgttctgagtatggcagccggggtaggcttctgaggagctgacacagaagcagcaagagcggtttcagtgagagtgaggctgatggtctgactggggtaggaccgaggcatgaacaggaggcaaggaagtggagacagcaaggagacatgccataaagggaagctgagagtgggggcatctgcatttactacccagcacctagaccttgacagctggcaaagactttgccatgcctggggaaatagttttcacttattcccgaagtttttacaacagccctgaagccctcccttctctgtcccctgaacattttgttcttgttttggcactgtacttctagaatttctgtggaactgcaagctttcccttttacatggctctttcctcctccaaggaactccttgagggcagggaccccaagaggttcccaatagatatggaaggaagggaacttctggctgttgcttctccctgtgggtgcccctttctactacaaaaaaacaaacaaacaagttttatccctttacaaacaagactttgagatctgtgtggtgaaaattataaaacattgatgaaagaaattgaagatgacacaaacagaaaagtattctgtgttcatggatcagaagaatcaatattgtcaaaatgtccatatgcccaaagtgatatgtagattcaatgcaatccctatcaaaattacagtggcatttttcacagaaacagaaaacacaatcccaaaatttgtttggagccataaaagacccccaaatagctaacacgatcttaagcaggaagaatgaagctggtggcatcacgctcactgattaaaaattatactacaaagctatagtaacaagacagtatagtagtggcataaaaacagacacataggccaatggagcagaatagagagcccagaaataaacccacacatgtacggtcaaataatgaccatgtggacaaaggtgccaagaacacacaatggggaaagaatagtctcttcaataagtggtgccgaaaaaactgtatatccatgtaccaaaaaagtgaaattgaaactttatcttatgccatacacaaaaatcaattcaaaatcgatgaaagacttaaacttaagacttaaaactgtaaaacttctagaagaaaacatagggggacagctccattacattcgtcttggcaatgattttctttttttctttgatacgataccaaaagcacaggaaacaaaagtaaaaacaaacaagggagactgtcccaaactgaaaagattctgcacagcaaaaacacagcaaaacgaaaaggcaaccaaaggaatgggataaaatatttgaaaaccatatatatatgaggtattaatatctaaaatatataacgaactcatatacctcaacagcaaaaaataatagtaataatatcccaacttaaaaatgggcaaaggggctaggcgcaggggctcatgcctgtaatcctagcactttgagaggctgagacagtaggatcccttgagatcaggagtttgtgaccagcctgggcaacacagtaagaccttgtctctagaaaaaacatttttaaaattagccgggaatgatgctgtgcacctatagtccgagctgctcgggtggcaagaagattgcttgagcctcagaagtcaagactgcagtgagttatgattgtgtcactgccctccagcctgggcgacagagcaagaccttgtctctaagaaaaaaaatgggcaaaagactgatatttttccaaagatgacatacaaatgaccaaaaagtatacaaaaaggtgctcaacatcgctaatcatcaggaaatgcaaatcaaaacaataagatatcatctcacacctgttaggatgactatgatcaaaaagtcaaaagttaacaagtgtatggcaaggaggaaattaacaatccttatgcattgataatgagaatataaattggtacaaccattatggaaaacagtatggagtttcctgaaaaaaaataaaaatagaattaccatatcatccagaaatcctccttctgggtatatctccaaagaaaataaaatcatgttctcaaaaaagtatctggatttcacgttcagtgcagcatcattgacaatagttaagatatggaaacaatctaagtgtctagcaacagatttatggatagagaaaatgtgctatatatacactgtggaatattattcagatttaaaaaaagaagatgaaatcctgccatatgtgacaacatggatgaacctggaggacactgtgctaagtgaaataagccagacacaaacagacaaatactgcatgatctcacatagatgtagaatctaagaaagctgaactcagaaacagaaaatagaatggtggttgccaggggctggtcactggtcaaggatataaactttcagttataagatgaataagtcctggggacctaataacaacatagtgatggtagtgtataacaatttacacttgaaatttgctaagacagtagatagatcttaagcattctcaccacacacatatgaaaaaatggaactgtgtgaggtgatgaatatgttaattagctagattatggtaactgttttacaatgtgtgtgtgtgtgcatatctcaaaacatcatgttgtatacctttaatatacatatttgtcaattacacttcagtaaagctagagacaaaataaacaaaaaataaaaatcaggctttcaggagtgatgtcatgcaaactaacagagcaaggagctccaggagctatctctctactgaaacaaccattgacctggaaggagtgactagaatcaactatttaggaacggtggaacctaactagacacttacaacaaccaggggagggcttgatgaagggagggactgctgatctttcctaagacagcaacataagtgaaccagctaccattcccatcacagctttgaagatagcagcccatgttctaggaatggctgactcataccagagtaggtagtggggactttctcttccaaaaattgatgttgtacatttttgttggtctagcagtgtctgaggggttgacgcagacacccactttggttttggccctcttggtggcagcaacttcccctggcagcatccatatgaaaattttaagtaacaactcctacccacttttccctttttggaaccagtaatttaaagaaatatttttcaggtcactgactgaccacagagataacagaacagaaacttcagtgaccacacaaaacaagaaacacgtatttgcaaaaagagtttggaaaagtcacaaattaacagcactagcccttaatggaaaaaagtcagcaagtcctgagaagtgggaaaatggcatttctagagttataatattatagtactcagaatttccaattttcaataaaaatttgcaaagcatacaaagaaatgggaaaatatagtcattaacaagaaaaaaagaaatttgtcagaaatattaacaagcaaacccagacaatagaattactatcaagagtgttacatcaattatattaaatatggtcaatgagctaaaggaaactatagacaaagaactaaaaggaagtcaggaaaacaatgtgtgaacaaaatgaggatctcagtaaagagatagaaataattttaaaaccctagaaattctataacttaaaagtacaaaaactaccatgaaacttactagaaaggttcaagagcagatgtgaaaaagcagaaaacaggatcagcaaacttgaatataagacaaccaaaattatccaatttaagaaacagaaagaaaaaaatatgaagaaaagtaaacagagtctaaggaacctgtgagacatcatcaagtagaccaacatatgcattgtggtgacccagaaggagaaggagagaaagaagcagaaagaactttgaggaaataaatgccaaaaacatctccaaatctgatgaaagaaattaatatacagatgcaaaaagctcgatgaactccaagcaggataaactcaaagagatccacatagaaaggcatataattaaagtgtgaaaacccaaagcaaatgagaaaaatttgaaagcagcaagagacaagtgactcttcgtgtacagaggaaacttaatgaagattaacagctgatttattatgagaaactatggaggccagaagacagtgggatgacattcaaagtcctcaaagaaaaaaaactttgaaccaagaattttatatctggcaattctatatccagtaattctatatccagcaagtctatatcccacaaaactatcattcaagaataaaggagaaattatgacatttctatataattagaaggtaaaggaaatcattaccagtagacctgccatacatgaaatgataaaggtagtcctctgggctagaatgaaagaacactagacaataactcaaagccataaaaaggaataaataaattggcacagttaactaaataggtaaatataaaagccaatattattgtacttttgctttgtaactatgctttttttccccaaagtgatttaaaaggaaaatgcataaaacaataaatctgtgttaatgagcacaaactatataaggatataatctgtggcaataacaatataaaggaggaaggatggagatctataggagcagagtgtatactattgaaactgaggcaacattaatcaaactaggttgctctaagttttctttcagtttgaaatgctaattttaaaataaagtgtacaagacatacagtatcatgatggaacaactagaaaaacaaggcaaaaaactggaatcaccttaagtcataccagctttatcttggttgagctgaaaatttttttagtgactagatctttttcagaagtgccggaataaagaggggagcatgtcagacagctggaacagtatgggaaaagaagaatggcagaaaagatttttctttcttttccctcaaagagataggctcttttttgtgtaagatttctccaagtactttgtatatcaaaggcattagagtataatagttaagaaacagactctgggctagcctaaccaggtttgaatttggttctatcacttactaggtatgtgatgttggtccatctctcaacacttacttattttatttgtaaaatggaaataataatagtacctacttcatgggttattaaaatgttaatgcctgtaaaacactgaaaatcgctccaggtatataggtaaagcctaataaatactggcttttactataatcatacaatcatctagataccctaagtggcaccaatgaggacctaccaaagtctatggctgtagcaataaaaaaatttaaaaactacttactcaatttcagaatctaatcaattaacccatttcttaccagatgtagacaatttccacttaacatctatctaggccaagtataacatctgaaatattttggtgctttaaaaaggaagtcttccatcagagtaataatgcagttagttctgaaagcttttttctaaaccagaattggaacatctgtgtctttctgtccttgctgttgacacaggatctaccacaggaccaactcccatgatgttatctggaaagccaaaatgtctagccatatgagatttattcatttatgtattcatttgtccaacaaatattgagtgtcttttatgtgccaagcactgggatatgggaatatacaaaacagataaaaatccaggggacagtagtgcagacttcacagggctgtggtgaaatttaactgagttaaggagatgaaaagtacttagaataacatctggcacatatgaaacattcaataaacatttttcaaaaacaaaacctcccaacattgcttttggccaattatttcatctagagagtatcgctaaactgtgaaatcacacaatccgttagacaaatgaatatttaatcattacagcacaccaaatagcaacttggatttcgggggcatggcactttcagattacagtaagggccgaggttggctgctagagttggcttctctaagaaagagctcagaaccctgcctactgacttaaaatgagtcttggtgcagaatttcccagagacattggctcctatcccctccctcccccctgctttcctttaaagttgattcaagcaaggaagcatgggctttatggccagggcctaatatgagtaaacacaggcctccagggccctggcccctgctcaccatgatcaataacctagtcctggccaggtgaggtgactcacgcctattattacagcactttgagaggctgaggcaagcagatcacttgaggtcaagagtttgagaccaacctggccaacatggtgaaaccctgtctctattaaaaatacaaaaattatccaggtgaggtggtgcacacctgtaatcccagctactcgggaggcagagacatgagaatcacttgaacccaggaggtgaaagttgcagtgagccgagatcacgtcactgcactccagcttgggcaacagagcgagactctgtctcaaaaagaaaacaaacaaacaaacaaacaagaataacccagtcctcagtgtcaaatgagttccatcacagccaagcacactgccagcctttctctttccctcacgagagaactctcctgcgctcagctttcctctcttcatttgcattacaaaaagcacacctgaccctgttgaaaagggcatttaaggagatcatcaaaggggcctgtggtgctcctttcacagcacatgatctctctccctgataagccctctccccagccttaagaaacccacattcgggagcaacattacgctaccagctgcagctgagggctctgggtgaaatcgagccagggctggggaacaactcaaaagtcatctgagaggtgtgacacctccctggcgtccagacccacggcaggcagcctacagactttttctctttgactttttaaagtaagatttatgaaaccacttttcctatcacggcataagaaatgataactgcttgaaggattatacctctttgccatttgatgacatctctgtaagtacagggaactatgggctctgtcatctttgcatccctaaaatcaaattcagaaactggcccccaaaaaggctgttgaataaatacataagtaaattccatttttatactatctactgatgtctaaaaattccaaattagaagttaaaaatcctatgatagatatctaaaggagaacaaagtaatccaaaattaattatatattacatgctacctaggattttatgaaactgagctcaatctcaaaattaaagaactgtactataggctgggagcagtggctcacgcctataaccccagcactttgggaggccaaggcaggcaaatcacttgaggccaggagttcaagaccagcctggccaacatagtgaaaacccatctctgctaaaaatacaaagattagccgggtgtggtggctggggcctggaaccccacctacttaggaggctgaggcacaagaattgcttgaacctgggaggcgggccatgagcctagatcgcaccactgcactccagcttggatcacagagcgagactgtctcaaaaaaaaaaaaaaaaaaaaaaaaaaaagaaagaacttactgtaaaatctgctttgctttgttactcactcttatgaatacagagccaatcactggttctagcctcactattatgctatattaagggaggagaccacccctcatattgtcttacacccaatttctgcctccaaataaagaagtaaaaactaaaaggcagaaatgaaatccacaggcagacagcccagcgctgagccctgggcctggtagttaaagatcgacccctaacctaagcggttatgtcatctatagattccagacattatatggaaaagcattgtgaaaatccctgtcctgttccgttctgattaccagtgcatgcagcccccagtcacgtactcccagcttgctcaatcgatcacgatcctctcacgcggacccccttagagttgtaagcccttaaaagggacaggaattgctcacttggggagctcagttgttggagacgtgagtcttgccgacgctcccagccgaataaagcccttccttaactcggtgtctgaggggttttgtctgcagctcgtcctgctacaatattactgtatatatgtaaaatatgctatattactatattttctcatttataaagtgggagtaaaaataacagctacctcattgcatttttgtgaggattaaattagttaacacatgtataatagttatgggacatagtgaccacttaagaaatgttagctagtattattgttgttgttaccaggcactgttctggctaacattctattagaccaagttaaatattagttcatttagttaatctgcccagaaaagtattaatagaagcaagttgcccatataacctgtccccttgacaacaaaatttgccttctgaaagccattaatggattctcaaggtacaagaattgcctatgaattgtttactttttagaatatgatttccccttgaggcagaatatatatttaacaggtcctaaatgtataccagaaagaactgaatcgccagcttcactaacaggtttctctaaaaagaaaatcagacagcaattttaccttctgttcaggccagatgatgttcctaatcctgcaaggtctggggtactttcatctgataagagcccatgagcttctgagagcttcaaatgactactacttaggttaaaaataagcaccgagaaacaaaaactgagaaacaaaagcagaagtatttctaaaattgctctcttcgcactgtctcgctgcgggtactttcctgtctctcagatcactgaccttcagtccagcaatttccagtgtcctgcaggctgctgatcccaagatgctcagccacacaaaggtgttgcggccaagtaaggttggggaacccatactatactcccttttgccacaatacctttttaaccagactccttttgtgatagtaggtagctagttagacctgagcagggcagaagagggctcccctgccccactccaggagtgtcaggcaaccactgaggtcaggcagttgttaactgtctctctaaaataataattgggccgggcacggtggctcacacctgtaatcccagcactttgggaggctgaggcaggcggatctcttgaggtctggagtttgagaccagcttggccaacacagtgaaaccccatctctaataaaaatacaaaaattggcagggcatggttgcgggcacctgtaatcccagcttccccgggagcctgaggcaggagaatcgcttgaacctgggaggcggaggttgcagtgagccgagatcgcaccactgcactccagcctaggctacagagcgagaatctaaataaaagaataaaataaaataaaataataattggtcacagccagcaccagagaaaggcagtctcccaatagatagaaacacctgaagctgggaatcagcagtttcctgataagatctcaggagttgggccagtgggctcaagcaaaaaagaggcaaaatggcaaagtttaactggtatatgaccttctaggaacattcaactggtaagagaagaatgcctcgagtgagcatgcgtacaactccagtaaacataccgtgcatgcatcactcctaagtgctggcagccactgcggatgcggagagcccacccaagggaagaatcaggagacaagggacacaagctcctggaaatatgacaacatataaaatcccaagtcaatggggaatccatgcacttgatctctccagtcacccccttggccctcttccaagttcacttcctttcattcctgctgtaaagcttttgaataaactttcattcctctaaaacttgccttggtctctgtgtcaaatattttcttctgaagagggaagaattgaggttgctgcagacctgtatggactcaccactgctaacacctttttcaaggaatatctactagaatctaggtgttggaaatgctgaaatagtctaaactaaccaattatttccaccttaaaatgactgtaggctcattcacctggcctggcaaagtcagcacttacttaaaagcagatgggagagaatgttgaccctatacatacccacagtccctgatcaacatacattttcatgaagaggtatatcttggatcaagtcaaaaagaaactatccccggatccatctgaggtgtgtcccatactcagggaacacaccaaaaaattcaggaatggctcacagggaagcatgatttcagaagatcgggagcataagaaaaaggaagatgatgacactataagagaaatcctatcaacaaaaggaatataattctcctcctgttttttttaagtcaaggagaagaatgctggtgcattacaatctaattggaacatgtccaaagtgatgggagaaatccactgacaccagattaaaggagtcctgagcagagaggaagctggatggtggcagggtcctcgaaaaactatctccaaagactccaatctctagagcattatcttagttctatgactggaaattttttccagaatcctcaatatctatctgtaatgtaaggctcctttttgctagcaccagaagcttacataaaattaggcacttggggaagcatcttgaccccctcatcaggccacccaaccataactgccccaatggccaacaggtggggattatgggaactataattcaagataagatttgggtggggacacagtcgaaccatatcaatggaggaatacatggatatacatgcagaaatctgggtggctttaattccttccatgaggtcttacaatcctaccatcactataaactagccaaaattaaaatatatctgggcagacaggagacccagatgggtaggaactaaatatacaaacatttctctcagtagagagaaaaaccaagaaaagggaagaaataagattcaaaatgatcccaagaggcacatcctggggaaaacccaacaagataaatatagtaagtcctcaaaagatgctagttactagtattatcattaatgttaaatagtaatattaactgtaaatccctgcatttatattgaagatagcaattacataagaaaagatattagagaactggcttagccaaaatccacaggagaaaataaaatttgcgttttggctaatcacaagcccaacacgtgtcagcactgcaatgtagctgataagtaactaacaccactgggcagccctcacccagagcaaaggagctaacaggctcacaaaactctcccagccaggccatatctgatgtgtaggtttgatttaggcacaaaagatatagacaatcggaattgcatctagcaagaagtgactatcacagctgtaagtctggaatccaaattaaacacaaaatagttgatagaacaggtggcaaccatggaagtgatggtttaaggtactcttcgatatttgaagagctgccaataaagaatggcactagttgttttgtgtcaccaacgggtgaaatttacaggggaggctaagttaggctccatacataaaatgattttccaatacttaaaattatccaagaattgatcccacgggcttgaaaagttttaagctttctttttgaaagtgcctgggagccagaagattatcaaccaacaagagcaatctaaggattcctctggtgggtgaagggatgcactctgaagtttcaaggcccctttcagcatcaagaatctgcaattctatggttctgactatagctgagcttcatcagattagtagacagagcccagtgctaccctctcctcccactcatttttgcatggtgaatggtaaatattcttggggcgaggcgcagtggctcacgcctgtaatcccagcactttgggaggccgaggcaggcgaatcacaaggtcaggagatcgaaaccatcctggccaacatggtgaaaccttgtctctaaaaaaaaatacaaaaattagctgggtgtggtggcatgtgcctgtaatcccagctacttgggaggctgaggcaggagaattgcttgaaccagggagtcggaggttgcagtgagctgagatcgcaccactgcactccagcctggcgacagagcaagactccatctcaaaataaataaataaataaattcttggtagactctggaaaaaatgatcaaataatacttgtgtctccaatattaactaatttgtgttaaatacccttttattctacttaaactcttgtatttcttatctgcaaaaggacctaaatgagaagataaaggtaaattaactctgaaaacctttaaagcaatgtaagggatatttttataattattgatgtttatcaataagtagagaagcactcaactaattttttaaaaaagaaaaatttgcatataaagcagtcatttttcttatctgacttcaattgtaaattgctgaggaaggtctaatttcaccttctatctcaagatttggtagccaaagttaccaaaggcctgcatagttaccaaaggcctgaacacacaattccaggaaggtgcccaacacagtgtattagcaagagaacttggaggctgggctttgccttctgtcctcaaacaggaataaatgtagatccagggagaatgaaagagtaaaaattgggacatctaaactaagaataaaccaaagagacaggaatatttgggtgctaagaggcaaaggccaaacacaaactataaaagaaaaaattgattaactggacttcagaattaaaagctctcttcaaaagtcaccattaagaaaattaattaattactctacatatttaccagtgaaagaaaaggaaaatgaaatgcaagccacagatgggtgaaaatatttataaatgatatctgataaggcacttatatccagaatatataaagaactctcacaactcaataataagacaaggaactcaatttaaaaataggccaggccgggtgtggtggctcacgcctgtaatccctgaactttgagaggccaaggcaggcagatcacctgaggtcaggagttcaagaccagcctgatcaacatagtgaaactccgtttctactaaaaatacacaaattagccaagcatggtagagcatgcctgtaatcccagctacttgggagtctggggcaggagaatcgcttgaacctaggaggcagaggttgcagtgagccaagactgtgccactgcactcccacctaggtgacagagcaagacttcaccttaaaaataaataaataaataaataaaaataaaaataggccaaaaattgaatggacatttcaccaaagaaaatatataaacagctgagtgggttccaagatggccgaataggaacagctccagtctacagctctcagcgtaagtgacccagaagacagatgatttctgcacttccatctgaggtaccgggttcatttcactggggcttgtcagacagtgggtgcagcccagggagtgttaggtgaagcagggcggggcatcgcttcacccgggaaacacaaagggtcggggaattccctttcctagccaagggaagccgtgacagatagcacctggaaaatcgggacactcccaccctaatactgcgcttttccaatggtcttagcaaacagcacaccaggagattttatcccacgcctggctcggagggtcccaagcccacggagccttgctcactgccagcacagcagtctaagatcgaactgcaaggtagcagcaaggctaggggaggggcatctgccattgcttaagcctgagtaggtaaacaaagcggcccagaaactcgaactgggtggagcccactgcagctcaaggaggcctgcctgccactgtagacaccacctctgggggcagggcatagctgaacaaaaagcagcagaaacttctgcagacttacacgtccctgtctgacagcattgaagagagtagtggttctcccagcacggagtttgagatgtgagaacggacagactgcctcctcaagtgggtccctgacctccaagtagcctaactgggagacaccttccagtagggggccgactgacacctcatacagccaggtgcccctctgagacaaagcttccagaggaaggaatatttgctgttctgtaatatttgctgttctgcagcctccgctggtgatacccaggcaaacagggttggagtggacctccagcaaactccaacagacctgcagctgagggtcctcactgttagaaagaaaactaacaaacagaaaggacatccacaccaaaaccccatctgtacgtcaccatcatcaaagaccaaaggtagataaaaccacaaagatggggagaaaccagagcagaaaagctgaaaattctaaaaatcagagcgcctcttctccaccaaaggaacgcagctcctcgccagcaatggaacaaagctggacggagaatgactttgacaagctgacagaagtaggcttcagacgattggtaataacaaacttctctgagctaaaggaggatgttcaaacccatcacaaagaaactaaaaactttgaaaaaagattagacgaatggctaactagaataaatgcgtagataaaagcttaaatgacctgatggagctgaaaaccatggcacaagaactatgtgatgcatgcacaagcttcagtagccgattcaatcaactggaagaaagggtattagtgactgaagatcaaatgaatgaaatgaagtgagaagagaagtttagagaaaaaagagtaaaaagaaacaaacaaagcctccaagaaatatgggactatgtgaaaagaccaaatctatgtctgattggtgtacctgaaagtgacagggagaatggaacccaagttggaaaatactcctcaggacattatccaggagaacttccccaacctagcaaggcaggccaacattcaaattcaggaaatacagagaacaccacagagatactcctcgagaagagcagctccaagacacataattgtcagattcaccaaagttgaaaatgaaggaaaaaatgttaagggcagccagagagaaatgtcaggttacccacaaagggaagcccatcagactaacagcagatctctcagcagaaactctacaagccagaagagagtgggggtcaatattcaacattcttaaagaaaagaattttcaacccaaaatttcatatccagccaaactaagcttcataagtgaaggagaaataaaatactttacagacaagcaaatgctgagagattttgtcaccaccaggcctgccctacaagagctcctgaagaaagcactaaacatggaaaggaacagccagtaccagacactgcaaaaacatgccaaattttaaagactatcgaggctaggaagaaactgcatcaagtaacgagcaaaataaccagctaacatcataatgacaggatcaaattcacacataacaatattaaccttaaatgtaaatgggctaaatgctccaattaaaagacacagacaggcaaactggataaagagtcaagacccatcagtgtgctgtattcaggaaacccatctcatgtgcagagacacatataggctcaaaataagggatggaggaagatctaccaagcaaatggaaaacaaaaaaaagcaggggctgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtccctagagacctacaaagagacttagactcccacacaataataatgggagactttaacaccccactgtcaatgttagacagatccacgagacagaaagttaacaaggatatccaggacttgaactcagctctgcacaaagcggacctaatagacatctacagaactctccaccccaaatcaacagaatatacattcttcttagcaccacatcacacttattccaaaattgaccacatagttagaagtaaagcactcctcagcaaatgtaaaagcatagaaattataacaaactgtctctcagaccacagtgcaatcaaactacaactcaggattaagaaactcactcaaaaccactcaactacatggaaactggacaacctgctcctgaatgactactgggtacataacgaaatgaaggcagaaataaagatgttctttgaaaccaatgagaacaaagacacaacataccagaatctctgggacacatttaaagcagtgtgtagagggaaatttatagcactaaatgcccacaagagaaagcaggaaagatctaaaatgggtaccctaacatcacaattaaaagaactagagaagcaagagcaaacatattcaaaagctagcagaaggcaagaaataactaagatcagagcagaactgaaggagatagagacacaaaaaacccttcaaaaaaaaatcaatgactccaggagctggtttttggaaaagatcaacaaaattgataaaccgctagcaagactaataaagaagaaaggagagaagaatcaaatagatgcaataaaaaatgataaaggggatctcaccaccgatcccacagaaatacaaactaccatcagagaatactataaacacctctatgcaaataaactagaaaatctagaagaaatggataaattcctgcacccacacaccctctcaagactaaaccaggaagaagttgaatctctgaatagaccaataacaggctctgaaattgaagcaataattaatagcctaccaaccaaaaaatgtccaggaccagacggattcacagccgaattctaccacaggtacaaagaggagctggtaccattccttctgaaactattctaatcaatagaaaaagagggaatcctccctaactcattttatgaggccagcatcatcctgacaccaaagcctggcagagacacaacaaaaaaagagaattttagaccaatatccctgatgaacatcgatgcaaaaatcctcaataaaatactggcaaacggaatccagcagcacatcaaaaagcttatccaccatgatcaagtgggcttcatccctgggatgcaaggctggttcaacatacgcaaatcaacaaatgtaatccatcatataaacagaaccaaagacaaaaaccacatgattatctcaatagatgcagaaaaggcctttgacaaaattcaacagcccttcatgctaaaaactctcaataaactaggtattgatgggacgtatctcaaaataacaagagctatttatgacaaacccacaggcaatatcatatggaatgggcaaaaactggaagtattccctttgaaaactgccacaacacagggatgccctttctcaccactcctattcaacatagtgttggaagttctggccacggcaatcaggcaggagaaagaaataaaggttattcaattaggaaaagaggaagtcaaattgtccctgtttgcagatgacatgattgtatatttagaaaactccatcgtctcaatccaaaatcttcttaagttgataagcaacttcagcaaagtctcaggacacaaaatcaatgtgcaaaaataagcattcctatacaccaataacagacagagagccaaatcatgagtgaactcccattcacaattgcttcaaagagaataaaatacctaggaatccaacttacaagggatgtgaaggacctcttcaaggagaactacaaaccactgctcaacaaaataaaagaggacacaaacaaatggaagaacattccatgctcatggacaggaagaatcaatattgtgaaaatggccatactgcccaaggtaatttatagattcaatgccatccccatcaagctaccaatgactttcttcacagaattggaaaaaaactactttaaagttcatatggaaccaaaaaagagcccacattgccaagacaatcctaagccaaaagaacaaagctggaggcatcacactactatactacttcaaactatactacaaggctacagtaaccaaaggctacagtaaccaaaacagcatgatactggtaccaaaacagagagatagaccaatggaacagaacggagtcctcagaaataataccacacatctacaaccatctgatctttgacaaacctgacaaaaacaagaaatggggaaaggattcccgtttaataaatggtgctgggaaaactggctagccatatgtagaaagctgaaactggatcccttccttacaccttatacaaaaattaatgcaagatggattaaagacttaaatgttagacctaaaaccataaaaaccctagaagaaaacctaggcattaccattcaggacataggcataggcaaggacttcatgactaaaacaccaaaagcaatggcaacaaaagacaaaattgacaaacgggatctaattaaactaaagaacttctgcacagcaaaagaaactaccatcagagtgaacaggcaacctacagaatgggagaaaatttgtacaacctacccatctgacaaagggctaatatccagaatctacaaataacttaaacaaatttacaagaaaaaaatcaaacaaccccaacaaaaagtgggcaaaggacaagaacagacacttctcaaaagaagacatttatgcagccaacagacacgtgaaaaaatgctcatcatcactggtcatcagagaaatgcaaatcaaaaccacaatgagataccagctcacaccagttagaatggcgaagtcattctaactgttcatatggaccaaaaaagtcaggaaacaacaggtgctggagaggatgtggagaaataggaacacttttacactgttggtgggactgtaaactagttcaaccactgtggaagacagtgtggcgattcctcaaggatctagaactagaaataccatttgacccagccatcgcattactgggtatatacgcaaaggattataaatcatgctgctataaatatgcaaaggattataaatcatgctgctataaagacacatgcacacatatgtttactgtggcactattcacaatagcaaagacctggaaccaacccaaatgtccatcaatgatagactggattaagaaaatgtggcacatatacaccatggaatactatgcagccataaaaaaggatgagttcatgccctttgtagtgacatggatgaagcttgaaaccatcattctgagcaaacaatcgcaaggacagaaaaccaaacaccgcatgttctcactcacaggtgggaactgaacaatgagaacacttggacacagggtggggaacatcacacaccagggcctgtcatggggtggcgggaggagggagggatagcattaagagatagacctaatgtaaatgatgagttaatgggtgcagcacaccaacatggcacctgtatacatatgtaacaaacctgcacattgtccacatgtaccctagaacttaaagtataataaaatatatatataaacagctaataagcacacgcaaaaatgctcaatatcattagtcattacagaaatgcaaattaaaaccacaatgagatactactacacacccaccagaatggctatagtcaaaacgacagacaatatcaagtgtagaatgggatgtggagcaactggaaccccctcataccccagagatgggaaggttaaatggtacagtcaccgtggaaggcactgtaacagcttttcaaaaggttaaatatacatctaccatatgtcccaggaattgcaattctaggtgtctacccaagagaaataaaaacatttgtctacacaaaaacttgcatacaaatgattatagcagcattattcataatagccaaaatgtagaaacaactcaaacgaacatcaactggtgaatgagttaacaagatgttgtatatccatataatgagatactcagcaacaaaaaggaactaccaatgtacattacaacagtgaaaagggtcaaaaacatgctaagggagaaaaagcccgtcacaaaaccctatattaaatcattccacttatatgaaatttctagcaaaagcaaatgtatgaagatagaaagtggattagtggttgcccaggactgggggtgggagaagagactaactgcaagtgggcacaaggccaccttgtgctgtaatgggcatgttctataaacatggattacggagatgattgcacaactctacaaattcactaaaaatcaatgtatttacaatggatggactttagatatgtaaattatacctcagtaaagttatgggctcagttcagagggcagatcttccagtcatattcatgatgagtcacaggcaatccaaagatagaaacaaaatggagagaaagaatacatttccttcttcttcaattttatttatcaaaagcactttcttcaggtatctcaaaatttaaagctataagccaggcacgatggtgcacacctgtagtcccagctactctggaggccaaggcaggaaaaacgcttgagcccaggagtttgagatcagcctgggaaacatagcaagactctatctctctttattatttttttaattaaagctaaaatacccagatctctttttttaattattattaatttctgagacagagtgttgctctgtcatccaggctggaatgcagtggcacaatctcagctcactgcaacctccgactcctgggttcaagcaattctcctgcctcagcctccgaagtagttgggattacaggcgcctgccaccatgcccagctaatttttgcatttttagtagagacagggtttcatcatgttggccaggctggtctcaaactcctgacctgaaacgatccactcaccttggcccaaagtgctgcaattacaggcatgagccaccatgcccggccccacatctgttaaaatatgattttgcaggcagtttgcctggaggttaagggttggaactgtggactcaatctgtgtgtaaaacccagcactcctacttactagctgactttagcatgttacttagactgagtttcagtttcttgttctgatacaaaaaattaatacatactacagagttgttttaaactagcacactatctattaacagcacatggtaaatactcaacaaatgccgatgttatttttttattatcaacacatcatcattaccatcactatgactgtagtttccttgggagacttgaaaacttgactgatatgtgtatgttcctaatgtacatttagtgcttcatcactgctatattcaatttaattgactgcccaaacataaccatgttcccttataaccctcattccttatcttagggaccttatactttgaaataaaatccctggatcatttcactaacagaacaaaagctgtgctattccctggctaaagcaagatattttccaattcaaccataggaaaaaaacatttttaaaaggtgcagtttttgtttgtttctaggataggagaactggacaaagaaaaaatgtcagcatctcctcagagaagcctggcaaacaggggaaataacactaaacaaagaaagccatgtgcagaggacctggcacaggaacacaattgccaggccttgcacccgagaatcaccaacacctgcagagtaaagcaacgggccacgtacagtgctgactgcttcctgggtgacagctgaaacccagccaagttcaaaaacccctcattgtgggtgtgtgtttttgctttgtaacatctatatgaaaagggaagggaaactgcatggggtaaactttctattttgtaagacaagcgtcttcttgttctctttttctttttctggtcagtgagtggaaggacagaaccctggaaaaatacctgtgcaccaagcaagacaaccccatcactgatgtcaggaaaagcagagcagtcacctctggcttgcccagcccacctcactcgcccaccagcacacactgcgactaaagaaccccactttagctgactggagcattcttccagccacacacctcaaagatcatctgggaagagataccacaacacggcagggggccgggtgcctgtgccagggagggacacatgctcttcactccccacacttgctggtgagccacagaagccctgtgacctcagcacactcaagggaaatatgtcatggggcttacccttcatgaggaccgctctaacttagcatccaagaaaacctcacagcccctgtggggacttctcctgggcaccacctagctcctgccttagtaaagtgtggagaaaaccaacttcctcacagaaatgtcttttagagccaaatgtaagtgtccctgaaatcaagtagacaatgatattcctatcattctgggcctgtccttgaaagttgtctctgttgttttctttccactagaaagtcatagaccctgagacccaaaaaggcccacagggatctagagaggtgaaataacttactaaaggccacagaggatggaagtggccaggccaagactaacacccagctttatccacaaaatctggaaaatgctatcaggctatcttcgacccagaaaagaagcgctcacaagaagaatatcaagggaggctagtccagactctgcagctagtgtcaaagttcaaatccagttctgtcccttactagggcacgtaacctgggcaatttccttaacttctgttttctcttccattaataagaggataataacagcatcaacattacagagcactccaagcatgaatgtatcaataccgagagtttctatatgactgatcatcctcctcctcctcatcatcatcctaaaacagacaggggaatgagagtaaagaagggatgataggaaaaaaaggtagaaagtgagtgtatggtcactaaataagtagagcataatttaacttcaaaaaattcaaagacatgtctagggtcatatccacaggggttagtgagaacataaaagcaaaacgtattataaaccattaggtacagtatggctccaactatgttaaatattcatacccacatgtatatacatacttccagaagaaagtgaaataaaatgcatgaaacattaattctctgggcactgggattaaggttgatctttattgtcttctttattacttttatttcccaaattttccacaacagacatatattgctttagaaatcaaaataaatgtgggttttaaaggctgtttttatttttttatttttatttttatttttttgagacagggtttcactgttacccaggctggaatgcagttgtgcgatcacagctcaccgcaatctccacctcccaggctcagaagcaatcctcctgctccagagcccccaccacccatagctggaaccacaagtgcatgccaccacacccagctaatttttgtatttttgaagagatgaggtttcatcatgttgcccaggcgggccttaaacccctggacccagagccatctgcctgcctccgtctcccgaagtgctcacaggcagagccgcagcgcccagcccaaggctgttttttaaaagaagaaacttgataccaggccaggcctcaaatggcaaaagggctattaggtagaatcccaagaggcaggggctgtgtttactcagacagccaagggggaagtgcctgtgtctgggaagagaacaagacttagggggaagggggaagcttaaccacgaagcttatgcctgagagcatcaggccagggaaggactctgtaaaataggaataaattccaaaagaaaataaaacagaagtgacgacatcagcagtccctagttaaaagaagaagaagaagaaagagaatcctggagcaagcctctgcgcagataattttttttccctggctggaacagaagatcagtcaccaaaactaaaaagcaaaagatccaagtggctgaaaaaaggaattatgggctcccactggggacaagacttgcctggaagcccatctgagggcttgctgccctatccttcacatctgagattatcccctgatcccagccaagaccagggatttcctgctttttggcatccagatgcgagaaatagatctgctgactctgagatcactgactgacactagccagggcccagagagaacgccgccgtggggtctaagatcgagttcacctggcatctttctcggcacgtatcttcctggcttgtcctcagtctccactcctctcagtttgagttcccacctcacctcttttgcagagattccttgtagctcatatgaaggagtggacagaagacacagaacagatagcagagagaagtactgggggcctcccagctcttgttcagggccccactttcctctgacaagcatgttaaggtttatccagattatccctccagttcccctatttcacagatgagggaaatgagacagaaaaagggggactgtatgtctgtgcccatcaaagtcagatgaaatgatacactgtcttaagaccatctgattcgggaccttgcctgaggtcacaaatctttgtagtgacagagccaggacaagcacataactatcctaatggctgctccttccttcagcactgtggctgcctacgagctggactgcagtctctactgctcactagaaaagttccagtcccccagcaggcacaggggctccagcagccgcggcgtgtccttgtcctccttcggggggctacagcggcatcctgtctgggtccaacggattgcttgcgggcaacgagaagctcaccatgcataacctcaacaactgcctggcctcctacctggacaaggtgcacgccctggaggcagccaacagcaagctggaggtgaagctccgtgactagtaccagaagcaggggcacaggccctcccacaactacagccactactacaggaccatcgaggacctgcgggacaagattcttggtgccaccattgagaacgccaggattgtcctgcagatcaacaatgctcaactggctgcagatgacttctgaaccaagtttggtttgagtgtttgggtgctggatgaggtgaccctggccaggactgatctggaggcacagatcaaaggcctgaaggaagagctggcctacctgaagaagaagcatgaggaggaaatcaatgccctgaggggccaagtgggagaccaggtccatgtgagggtggattcagctcggacctgccaagatcctgagtgacaggcaaagccaatatgagatcatggccaagcagaactggaaggatgctgaagcctggttcaccagctggactgaggaactgaaccaggaggtcactggccacatagagcagctccagataagcaggtctgaggtcactgacctgcagtgcaccctccagggtcttgagattgagctgcactcgcagctcagcgtgaaagctcccttagaaggcacactggcagaaacagaggcatgctttggagcccagctggtgcagatccaggcactgatcagcagtattgaagcccagctgggcgatgtgcgagctgatggtgagtggcagaatcaggagtaccagcggctcctggagcaggagatcgccacctatcgcagcctgcttgagggccaggaagatcattacaacaacctgtccacctccaaggtcctctgaggctgcaggctctggggcctctgctctcctcaaagcacgtctcctgggtaggaggatgggaaggaagagacccttacccctggttcttcccctgacctgccagcaaaattttatggctcaagggaagaaaaaaaaaaaaaaacaagagcaaagaaaagttccagtctaatccccaggctcctcttgggcaaatgtcaacacataaaatgatccagaaggccaagtcaaattacggtgtaatggacaggggtgcctcttcacattgcctaagggacaactataacagaaaacatctcagtcaaaaaggtgaccctgggccaggcgcggtggctcacgcttgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcatgaacccaggaggcggagcttgcagtgagccgagatcccgccactgcactccagcctgggcgacagagcgagactccgtctcaaaaaaaaaaaaaaaaaaggtgaccctgcaatgtggattgccaggacccacaatgagccagaggggttggcaccttttcaacacgggcctgcattcctgcaggtccagatcccagagtgtactgtatccaacgtgcctgtggctagcgtgtgtctacagactctggaaccacactccttggcttccaaccctggctccagcacatactctgtgacttttggccagtacattaacctttctgtgtctccatttctccttctggaaggtaagcattaagtatctcctatctttaaaagttcctaagaagtctacatcctaggccaccctatatgtgcacacccagcagccctttctgtcccctttgagcccaatctgagggaggacaggtccctctctcagcctcagaaagtgaatgatgatgggattcaaccttttctttggttttctccttctctttggccagtgacaagtcaaaggcaagaataactcggttctcactaaacagggaggtcagcagggaaactttcctttcccaataaaaagacataggtttggccaggtgcggtggttcacacctgtaatcccagcactttgggaggctgaggcaggcggatcacctgaggtcaggagttcaagaccagactggccaacgtggtgaaaccccgtctctactaaaaatacaaaaattagccgggcatggtggcacatgcttgtaatcccagctactcgggaggctgaggcagaagaatcgcttgaacctgggaggcagaggtttcagtgagccgagatcatgctactgcactctagcctgggcgacaagagcaaaactccatctcaaaaaaaaaaaaaaaaaaaaagacataggtttatgcaaagcgtattaggccattcgtgcactgctataaaggaatacctgacactgggtaatttataaagagaagagttttaactggctcactgttctgcaggctgtacatgcatggcaccagcatcctgagcacagcttccagggaggcctcagggagcttttactcatggcagaaggcaaaatgggaacaggcatgtcacatggcatggcgaatgaaggagcaagagtgagttggggcagaggtgccacaaacttaaacaaccagatctcctgagaactcactcactatcactcactatatcaaggacagcaccaagacatgagggatctgccccatgacccaaacacctcccaccaggccccacctccaacactggggattagatttcaacatgagatttgggcggggacaaatatccaaaccatatcacacaaaagaagccttttgacccttccactgcctttagtgctgctatagcagccatctgccgccatggggaaagagccaggaaggccaagaggatctcagccctgagcactaacactgtcctggtctctgtgcccaggccagcctccacttattccaaggatgactgtgaggaatgtggacccctgcttgtttacagtactgttggataactcttcttttgcttgtggccaaatgccatcctaataggtcaactgtataagtttattctcattaaaaaaaaataaaatttaaaatcatgttctccaaaaagttactgagtaaaagtgatgtcgcaatatcagtatgactcatggcattgatttttgttcgtttgttttttgtatttttctgagacagagtctcactctgtctcccaggctggagtcagtggcgcaatctcggctcactgcaacctcctcctcccgggttcaagcgattctcctacctcaacctcctgaatagctgggactacaggtgtgcgccaccatgtctggctaatttttttgtatttttagtagaaatggggtttcaccatattgaccaggctggtctcgaactcctgacctcgtgatccgcccgcctcggcctcccaaagtgctgggattacaggcatgagccaccatgcctggccggcattgttttatacacacacacagatacagaaatatagggatgtgtgtgtatatacattatatatacacacacacacacacacacactatatatgggtgtacatgtcacatatatttcctagctttttccactcaggcggccttgaagctgtgatgtccctacagcaacaagcacacttagtatctggatcttggtttctaaataccatcctccagatgacctccaagagaccagtgttccttgaagaaatggctggctcaagaactgcagcaaggaaaatacaagatgaacctggacatcttagaatgccagaaagcaaaggaggtgctttttttaaaaaggaaagggtgagaaaaggaaaaaagaagaaagatggggcatgtcaaatggacgtataagccaaactgaaggagttcccaatagccaaagctggaacaaattagagggaaaaaaggggggatagtagtataagatcatagaataaaacaaatatctgtgagcctatactgaaataaataagtgactaagtaaatatagcaaaagggacagatcttccttacaaaagaattccaattaataattatagaaagaattaggaaaatagaaaatcacctgtatttcactggagcagaaatgtttgccctaaaaaaaattatggccttcagtcttcctgggaatgatcagctgttgcactttcggtgacagcaggattatggacattaatacagaactttacagtttataaatttttttttaagaaagaaaagaagaaatcatgattaaacaccatagtaataactgctttaacaagatccactgatgaagataaaattaatgtgtgaaactttatggagaaacattatctgcacaaccttaaaatatctcctagctgaatactaatacaaatattaattactgtggtggttttaaaatatgtccacagactctttgatactcctccatgaggtggaacttaatccccccatgccctgagtatgggctggacttggtgattcctctctacttaatcaatgatggaaagggaaagacagtaaccttacagtagtgaaacctagcagacatgagacatcaccagtaccaagccatcttgacatcatgtactccttcaaaggacgcagtgagaacagcgtatcacctgaatcgtatttgtccccaaagtccataacctcagtctaatcctgagaagacactagacaaacccaaatggaagaacattctataaaatgcctgaacacgactcttcaaaagtgtcaaggtcatacgtctcaagccttttagtgttgttataaagcaacatctgcatgcttggctcatggttctgcaggctattcaagaagcatggtgccagcatctgcttctggtgagggcctcaggctgctcccactcatggcagaaggtgaaagggaactggtgtgtgcagagatcacatggtgagaggagaagcaagagagaggagaggggccgggcacggtggctcatgtttgtaatcccaacaatttgggaggccaaaaggggagaatctcttgagcccaggtgttcgagaccagcctggacaacatagtgaaacgccatctctacaaaaaatagaaaaattaactgggcaaggtgatgcgtgccttaagtcacagctactcggggagttgaggtgcgatgatctcttgagcccaggaggttgaggctgcagtgagccgtgatcacaccagtccacttcaaccggggtgaaagaacaagaccttatcacaaaaaaagagagagaaagagagtacaggtgctaggctctttttagcaaccagctctcatgggaactaacagagtgaaaactcactcattaccacaaggacagcaccaagctattcactggggatccacccccatgacccaaacacctcccattaggcacccacttcctacactggaaatcagatttcaacatgagattagcaagggtcaaacatccaaactatagcagccatataagacaagggaagatgaaagtatcatacatcggaggagactaaggagacatgacaactaaataaaatgtggattggatcctggaacagaaaataacattcgaggaaaaactgggaaaatgtgaataaagtatgtagttaacaactaaagttaacagtgttgtaccaaggtaaatgttttcattttgatgaacataccatgttgtttaagatactcatattaggctaggcgtggtggctcatgcctgtaatcccagcactttgggaggccgaggtgggtggatctcctgaggtcaggagttcgagaccagcctggccaacatgataaaaccctgtctctactaaaaatataaaaataagctgggtgtggtggcacgcgcctgtaatcccaggtactcaggaggctgaggtaggagaatcgcttgaacccgggaggtggaggttgcagtgagctgagatcgcgccactgcactctagcgtgggcgataaggtgagactctgtctcaaaaaaaaaaaaaaaaaagtgtgaaaactaaaccaaacaaagcaatgctccaagaagatgcagcacgtgtatcctaaggcttcaggttcccataaaatccctgaggttgcccagacacccccagtttgggatgcatcagagcctctctcactaatgaataccatagccatgatgaccatgcatccaggaggaacagcatgtatcctctattttcactggaggctgtaccccaagggtctttcctaattaccactgctgcgaggacctggatgaaaagtgataagcccccaagcatggcaaggctctagcctgttgcttctggctatggtcccatcactcagcactttgaagacccgcatagaatgagttattaacacacccaaagaacaaattctgaaagtgcatcaatattaattcatttacagagaggttttgctttctcctctctctttcttgattaaatgcttagtgcttcctcaagagatatgctgtcacgaaactctcaacaagtcatgaatgagaagaaaagataaaatcttccccatcaccttaaaggaaagcatttatttaaaagttctcatcaaccagacgcagtggttcatgcttataatcccagtgctttgggaggccaggagttctagaccagcctgggcaacatagcaagagcccgtctttaaaaataaataaataaaaaattagctaggtatggtggcatatgcctgtgctcccagctattcaggaggctgaggcaggaggggagcctggggtgggagaatccacttgagcccaggagttttgggctgcaatgaactatatgattttgagacaaagtgacattccgtctcaaaaaataaagttctcatcacctaaacgtatgccttttagttcatattttatttgtttaatctttgggtaagactcttgttgctgttttctttctttttaagatgaagtgatagattgcttgcaaaaatggccccaaatcctccatcccactcccttgtatccacaccctttactcagtgtgattatgtggcttctttcatcaagggagacagtttgtttaccaaaccttgaagctgggatggccatgtggattactttagccaacacaatgtggcagacagagttggtaatgtgccagttcctgaacgcaggcccacgaggctctgctctcttatgctccctctcagaaccctgcttcacagccatgagaacaagtcaaggctagctgctggagaacgagaacacatgtggtataaagatgagccagcccagccaagaagacaactgcccacatgggcccagcctacattgcttgcctgcagaaccatgggctaaatagttatgtcaccacattttaggatagtttgttatccagcaaaatctaactgatacaattgaagtgtgtgattttagtgctgttaattattctgatcttaaaagtattactaattggagaaagtcagaaaatacagaaaaggagaaaaccgcccataatttatcactagaataaaaccaacattctggtggtgtttttccccagtcttcagtatattagtgtgactgaatgaaaatgaaatccacttagttttaattccgtatctttctcctcccactgaaaacattcaatagagcttttcttatgccattagtgtctgaaaacgtaatttttaatggtttaaatattctatttatcatggatgtacaataatttaaacgtgtgcatatgtttctgtagtttctataattaaataatgaaattatttattcattattgtaagtattattgttcatttgagtacagaaagctatgttcaactctgtgcttatttctttaaaataagcttctagaactgaaattcttgattcaacgagtatagactgctagtcaaagccagtccccctacacacacacacacacacacacacacacatacacttctttgctggcagagacacattttgttccattgtttaccctgcgttctaccatgtgctcagagtgaggagcctctccccaacaaggaagagaaaggagaatcctgatagtctaagctactagctaaatctagcccaccacctgttttagtataggccatttaatgcaattctggccagtgagacatgagagaggtcttttgggagcttttggaaaaagcttttctttacaaatacccatgcaagaaggaatggttccttttctcaactctagagatgagtgtataaagatgcaatgcccggaactgatgcagccatcctgaccatgaggacttaagtctatgggaacaaactgatatactcaggatggcggagaaggaaaaggaaacactcatgtcctttgtgatgtttttgagctgctgaatttcctggaaacactccacctctggacagtgagatgataaacctaaacttctttctgtgtaaaccatttttaccaggttttctgttccttacagcctaaaggacagggactctttcaaggctttctccacacattaccaaactgagcgcatagagagattgtagcaatgaacattttctgcagaactacatgggcttaacataaaatttacaaaataacttggagaaaaataatacatgtaaaatattcaatgttctaatatccacaaacctgatatctcctttgttcaaaattttaaaaaatatctcctagtaaattccattatttacttagtccagcaatgtgctgtgagtttttctaaaggttttacgcttttttgctgttattataactagaagcattttctctattatatctaacagattgttgctggtatataataaagctattattcttcatgtataaatccacaactttactgagttgtcaataagtttaggagtgttaccatacatttgtttcttttttattgttatgtaattatgttgtttattttttaaaaactttttacttcctgctatcagctatatttcatatgtttcatgctttattgtactgacaagaaattccagaataataaatatcatcttagtttttttattttaaagggaatctctaatgtttcaccattgagtatgacattaaatactggtttaagagatatgtatgtgtgggtgcacagacatacaaaatttattttttggtttataatatacataaatcatgtaaaaaatcttatttttataagaattatattttttaaattaacgacaggtactgaattgtcaaatgtaatttaggaatctattgtgatcatcatatagtttatcttaactgaaactgaccaaagagtctagttacagacttcctttaaaaaattcatattcctaggataaaatgttacatatacatcctgaattactcttttatgagcatttctttttgaactttttcatgtgctttatccggtgttttattcatatgatttggatagttcttctactagagtgtgatagcactcatagaacaggggaattatctcatatctggaactcgaataagctcattagtaaaattggaagagcaacccacgaccccatggtaaaaggacaaaattcccaatagatgaagttaaacgatttatggaggaagggaaggcagtcctttgaaatgctagtattaccatggacatttctttttctcttttttcttttttttgagacggagtctcactctgttactcgggctggtgcagtggcatgatttcagctcactgcaacctccacctcctgagttcaagtgattctcctgcctcagcctcccaagtagctgggattacaggtgcccaccaccacgcctgactaatttttgtaattttagacagggtttcatcatgttggccaggctggtctcgatctcctgacctcaagtgagctgtccaccttggcctcccaaagtgctgggattacatgcgtgagccaccgcacccagccacagctgacatttctgacggctttgctagatacagtccttgcctggaggttcactttccctttgtagcacttcaccaactatgctgtactttcctgatgctgagagttggccatggctggtttgttttattttgttttcctactgtaccagaaatactgctccatgttttcagacagtgttatataggaggagaggaggagagagtttctccatttctgaacacaggaccactgcctgtccatttcccaccatccccatgtgtatcagttatccagttcacaataatgctgtgcaaaagtaatcagaggacctcactagcatacagcagtaagggctcatagctcaagtgtctggagtggtcagttaggtggctctgctgatcctggctgagattactggccctggagtaattaccaccctgcaatcagctggttctttgctgatttaggaagtctttggctgggaagtttagggtaattcagctctgctctgagaacatctgcaagacaatggtgtatgtgcaagagagcaagcaggatcatgcagtctcttaagacctgggcttggagctggcataccctccatcactactactgcatcctgttggccaaagccaatgtcaagaggccagcccaagccaggcgcggtggctcatgcctgtaatcccaggactttgggaggccgagatgggcagatcacctgaggtcaggagtgcgagaccagcctggccaacgtggcgaaaccccgtctctactaaaaatacaaaaattagccaggcatggtggcatgtgcctgtaattccagctactcaggaggctgggatagaagaattgtttgaacccgggaggtggaggttgcatcagtgagcctagatcacgccactgcactccagcctgggcaacagagcaagactgtctaaaataaataaataaacaaacaaacaaacaaataaataaagaggccagcccaggcttgaggggtgtctctttagtgaaaagaactgcaaaggcgtggatccagggagaggtggggaactggccgcccttgcaatctaccacaccgtatcccttctccgtcttcagctacttctacacatcagtgatcctgcatcttttcctctcacatcttctctccaccatagtgtttggccacaagttacccctcccctgcagaaaagacagtggctttcgttagcccagcactttagctgtctcagagacccaaaggagtagctgggccttccggtcagggtaaggaacaagaactgctaagtgagctgttcaaggctctctcaggtgggaagggctgggggaaagaacacagtctccacggctgggtatgactcagggaagaatggccgttggggagccatgttccacatctccaccttacagtgaatcaggaatacagaaaatcaaggttgaggctatacacagtaacactcactagtggcacagctttgtccacatcagcaagtctaagtgcaggctctgctgttgctaactgcctgacctcgggcaagccttctatctcttaggatatttaaaaaaccaatgggttggacgagtctcagtgagccttccagcaccaaccttccacacctatagattttattttgttaacaaaccaaactctcttcacacatattcattcttcatgtcaacttgtagtacgactatctgctcacaattttaaaaatcagaagaaacaccaacaacagcataaccttcaacccaacttctccagatgagtatcacaccacctcaggtgaacaaaggcgggctaagattattattctatcaaagcagcttcatgtaaagaaagagaatggaatgtgtacatttttcagggcagtgcacattcatctgtgattgaagaatgattcagatctgtttcaagcaataatttaatttttcacagtgaaaattatcatttccccaattttcagtttttttaattcaacttattttttgaataggtgatacatgtacatggctttaaattcacaagctacaaaataatataaagtttaaaagtaagttttcctgtcactcctgcccctatgcaattcagttgctctcctcagtgacaaccacagttaccacatgctcggtacatacaataagtgcaagtgcatgtgtatgcaggtgagcaagcatgtgtgcacacacacactattcttttttttttttttttttatagagtctcattctgttgtccaggctggagtgcagtggcatgatctcggctgcatactccgcctcccaggttcaaacaattctcctgcctctgcctcctgagtatctgggactgtaggcacgcaccaccatgcctggctaatttttgtattttttagtagagatggggtttcaccatgttggccaggctggtcttgaacgcctgacctcaagtgatccacccatctcagcctttcaaagtgctgggattaaaggcgtgagccactgtgcctggcctgttctttttagactataaatggtattatcctaaaaacattattttccatcttgcttttttccctcctaatattatatcgcagacattacttcataaagagtagcctcagacttttcaaagactgtatcatattctgttgtatagctattctatttaaccagtgcctgaaaactaatgaatatttacgatgtttttggtattttgctcttttaaacaatgttaccatgagtacctttgtacacagggcattttgcacaggtgcaagaatatctgtaggataaattcctacatagtcactctctgcacaaccatgtattcataacttagatacagccaaaccacttccagagacactagactggggttgcaaactatatcccacaggtcaaatctagtccacgagctaaggatatttttatgtttttaaagagttgttttaaaaaaaagaaaagaagaaaaaggagagggagaaggaagaacatgtgacagagaccttatgaggccttcaaatatttactatctggccctttcagaaaaactttcctgagccctacaccaatttacagccccatcagcaatgtataacagtgaatgtttttccactatttccattctaatctttgttcaaattaagatttaaggtaatgcttcaagttttgtttcagttgaagaaaataaggcactcataaaacacttacatcatggcactatgatctttccaggcaaaaatatggcttgttctaggacacaaacataaagcgacacttgaacttctcgcctcacattcacaggtggtgagaaaaggttagaacctccaactgttagaaccggaaggaactttaaaggttatctgatgtaagagttacagattctgtgtaccattaaaatttcaaaacaaatttaaaggattaaaacaatgttgtcaattttttatgttgccaataaagtcattaaaaaataaaaacagactgggcacggtgtctcacgcctgtaatcccagcactttgggagaccaagacgggcagattgtctgagctcaggagttcacgaccagcctgggcaacacggtgaaaccccgtctctactaaaacacaaaaaattagccgggcatggcggcatgcatctgtagtcccagctacttgggaggctgaggcaggagaattgcttgaacctgggaggcggaggttgcagtgagccaagagcacaccactgcactctagcctgggtgacagagcgagactctgtctcaaaacaaaaacaaaaacaaaaacaaaaacaaaatccaaccaccatctacttctttcaccatcacttcataaaggaatttaacattaaaagtagggcattcccaatattagaataaaggagagtccattacattaaatatacttaccttcacgaaaagccaaacacatcaccattttccttctgcctttgcttcacattgaggaaaactccatgtcaaacccatgtggaaaccaacttcactgtttcctaaacaatcaaaagaccctatacccaaatgaatgctcaagattcaattctgggctgggcacagtggctcatacctgtaatcccagcactctgagaggccgaggcgtgtggatcgcacgaggccaggagttcaagaccagccttgccaacatgatgaaactttgtctgtactaaaaatacaaaaattagctgggcttggtggtgcatgcctgtaatcccagccactcaggaggctgaggcaggagattcacttgacctgggaggcagaggttgcagtgaaccaagatcacgccactgcactccagcctgggcgacagagtaagacccagcctcaaaaaaaaaaaaaaaaaaaaaaaagaaaaagattcaattctgatgacaatgaatttatggcagacctagaactagaacccaggacctatgtctgccaatccccctaaattttcccctacaccacattctccacatgtcccaaaatcacaaaacaaatgaccagcataactggtcccacagcaccccagccagtctcttccttcctacatcactgctcttccctctcaagtgtgatcgcttatctctcagccaaaatgtgttttcagtcctcttcgctgggaggcaggggagcaaaacaacaacaaaactggacattttctctcttcttagtagctggagaatcctaaattcatgcagactcaaatggcaatcacccattcattctaaatgtgtttttcccccatcaatccttataaatagcctccacctcactctcctttgctgtgtaaggtggagagggactggggtccctggaaacacatgcatgagcttctatgggcacttaagcatcaacccaagggtcttccagatggttgacaagaggcatctcctacagcttcttccacaagaagaaccaaaatagcgagtagatagtcacacttcaaatagatcatctaagacagaccactggaattcaacagagaaatgacaggaaacatctaaagcagggaaggagacagaagcaaggcagcctactctgccagggtgggccggcatccaggacaggcttcccaatggagagaaagggtaagtgccacattcccaccacggactcctgcaatcttagccacaagagagcccctccactctggggggcccagagactaacctaaggcactgcctggagactgtgcaaccagagacattgctccagacggggaactcatgctgggtcccacaaaccccaagtcttaagcacctacagcacagtgccactttgaaagcccagctcccaccagactgcaaccagtcccgggcccaacagcccctgcatctccacatccccggagtcccactgacatttctccccctcagccaccattgcaggggccaagaaggcagccactggaaacaactcgacccagttttcaccccctgcagagaggcagctgtgcattttcacatgccccaggacaattccactgaccacagctagtcatgcaggtagttatgggccaaagctagtgaagtacacatccctcagacccctgcctatggctgctcccactgaaagcaaccctgccctccccagtagcagggccacagcacacaggctgctgcctgcacctggccatttccccagtggcctatagggatcaccctacccctgcctggctgtggagccagtgcctacacacgccaccaggggtgggacagaggacagcttgactgggatttatcccagggatgcaagcatggttaacatatgcaactcctcacataaacagaataaaggacaaaaaccacatgatcatttcaacacacgtagaaaaagcatttgataaaattcaatattcctccatgattaaaaaaaaaaaattctcaacaaactcggcctagaaggaacatacttcaacataacaaaggccatatatgacaaacccacaggtaacatcatactgaatggggaaaagctgaacgcctttcttctaagaactggaataagacaaggatgcctacttttaccactcctattcaacaaagtactggaagtcctggccagagcaatcaggcaacagaaagaaataaaaggcatccacatcagaagagaaaacgtcaaagtgtctctctttgctgataatatgatcttataactagaaaaacctaaagactccaccaaaaaactcttagatctgataaataaattcagtaaagcttcaggtacaaaatcaacacacaaaaatcggtagcatttctatacaccaataatgaacttgctgagaaagaaatcaagaaggcaatcccatttacaatagctataaaaaatagaatatctaacaataaatttaaccaaggaggttgtcttagtccatttgtgtagctacatctgaggctgggtaatctataaagaaaagaggtttatttggctaatggttctacaggctgtacaagaagcacagcaccaatatctgctactggagagggcttcccggctgcttctactcatggcagaaggagaacgggagctgttgtatgcagagatcatatggtgagagagaggaagcaagagggaggggaagaaagcaccaggctttttttaacaagtacctcttgtgggaaataataaagtgagaactatccacccaggaaggacattaatctattcataagggatctgctccaatgacctaaacacctgccatgaggccccatctccaacatgggaaataaatttcaacacgaggtttcgcaagtcaaatatccaaactatagcagaggtaaaggatctctataaggaaaattacaaaacactgatgaaagaaattaaaaagaacacaaacaaatggaaagacatcccatgctcaaggatcagaagaattcatattgttaaaataaacatactgcccaaaataccaacatcatttttcacagaaatagacaatcgtaaaactcatatagaaccataaaagagcccaaatagcaatactgaacaaagctggaggcatcacactacctgacttcaaaatatattacaaggctatagtaaccaaaacggatggtattggtataaaaacagacacagagaccaatggaatagaatagagaacccacaaataaatccacatatttgtaaccaactgattttcgaccaagcctccaaaaacacacattgggaaaatgacaccccattcaataaatggtgttcagaaaattggattgccatatgcagaagaatgaaactggaccactatctttcaacatatataaaaatcaactcaagagagattaaaaacttaaacataagaaccaaaactataaaactgctagaagaaaacataggaaaaacacttcaggacattggtctaggcaagggctaaaacctcaaaagcacaggaataaaaaaaaaaatagaaaaatcgaactatattaaactaaaaagcttctgcacagcaaaggaaacaatcagcagagggaagagacaacctgttgaatggaagaaaatatttgccaactcttcatcaaacaaaggacaaatatccagaatatacaagaaactcaaacaactcaacagtgaacaaacaaataaataattccattgaaaagtgagcaaaggacatgaatagacattttttaaaagaggatgtacaaatggccaagaagtatatgaaaaaaaaaaatgctcaacatcactagtcatcagagaaatgcaaatcaaaaccacgagatctcttaccccagttagaatggctattactaaaaagacaaaaaaatgctggcaatgatgtggaaaaagggaactcttacacactattggtggtaatacaaattagtatatccattgtggaacaaagtttggagatttaaaaaaaaaaaaaaactaaaaatagaactatagtatgatccagccatcccactactaagtatttatccgaaggaaaataaatcagtatgtcaaagggtaggtacgcgtgcattgcagcactattcacaatagtttattgcagcactattcacaatagcaaagatatggaatcaacctaagtgtacatcaatggacgaacgagtaaagaaaatatggtatatatacataatggaatactatttggccataagaaatgaaatcctgtcatttgcatcaacatggatggaactagagatcactatgttaagtgaaataagccaggcacagaaaaacaaatactactcatatgtaggagctaaaaaatagttgatgtcatggaagtagaaagtagaatgatagacactagaggctgggaagggagagggcgatgaaaagaggttaatgggtacaaacctagacttagatagaaggcataagttccaatattcaagagcagagtacggccaggcacggtggttcatgcctgtaatcccagcactttgagaggccaaggtgggaggctcataaggtcaagagatcgagaccatcctggccaatgtggtgaaaccccatctctactaaaaatacaaaaattagctgggcatggtggcatgtgcctgtagtcccagtcactcgggaagctgaggcaggagaatcccttgaacctgataggcggaggttgcagtgagctgagatcgcgacactgcactccagcctggtgacagagcaagactccatctaaagaagaagaagaaaaaaaactagagtagggtgactgtaatagttacaaaccatgtattgcagtatttcaaaataactagaagcaaaaacctgaaatgcacccaacacagagaaatgataaatactaaaggtgatgggtaccctgacttgatcattacatattctatgcatgtaacaaaatatgacatgtaccccataagtatgtaaaatatcatgtatccattttttaaacccacaatcaaaaaaataaacaaaaaagaattagcttcccctgaaattaagagccaaggatacttcaacgggcttggatacagagctaccgaaacacagcatctttatcagatccaagacctggccttcctctgccctccctggtgctctttcatccaacatttggctttcttctgtgtgcatggcaccattcatttgctcctgtggctgctcatgtatctgtcctgacataggagtcagcctcattttgtgccatctaccacgagggtgcaaccctccttctagtacagctatgtcagcccctgccactcagacacccagcccctgctctgtgctgctaggcactatggtttccagctagccctgcagctaaagctaaatgatgctctggactgcaaagcttcccatagtccttccagcatcataagaaaaatccatttgagagcagtgagcattgacaatagctttaataaataacagtgttggctcaatctgctctattttcaattaagattttagctctcacacagcagggttttaataggactcctaagcctaggagtaggtcattgagaatttataacaccttttttaatgaaccaaatagcaagacttttgccgccatcccaggttgcttttgtatttgtttttaagtcttcttctgtctcccattgctccaaaacatagttgaggacattttcctctcatgaaactatgttactccttccccactagtaattactacctcagtttcttattcccttacaaagctttttaataggactagtaatccaagggagaaactaattagtagatggaatttttccttgtaatatgctgtggtcaaaaacatgcaaattctcaccaggatcccaagaaatgaaacacatatcccaagaagactcaatataggaaaggggagatgtgatctctctgccaatacttcatgtttccctcaagatgacttctgcaggttttggcagcaggctccagataacatcacatccctataaatcagctccgccgtgcagatgtgatttagttagttattcccaggaacaacaggaggttgatttggacttcatattggaggtaaatgaaggggccagccttagagactctgacctctttgttgtgggacagagggactatcttgcttactacaccaaggtattagcttcctggcttgaagtttgtattccaagatgtgtcccactgaagagatgggcaggagatgacaggactcaaatacgccttcagagtcatgaaatggtggacatagaagaggccacaggggttatcaaggaaaacagcgagttaaacggacacatgaatagaagaatggtgaatgaaataggacagatatgtatgcataaattttcccaatgtcaaggtttgtgatatgccacatgcttgggccttttttcaacctttccactcattcaacaaatagttattgtgtgcctaatgggtaccaggttcccaacagtactaagcactagggaaatggtggtgaactagactcttttttttttttttttttttgagacagggtctttctctgtcacccaggctagagtgcagcgatgcaatcatggctcatggcagtctcgacctcccaggctcaagcgatcctcccacctcaacctcccgagtagctggaactacaggtgtgtgtcaccatgtctggctaatttttaaatttttcttgtagagacagggtctctatatgttgccctggctggtctcaaactcctggactcaagcaattcttctgccttggcctcccaatgcgctgggattataggcgtgagccaccacgtttatccaacatttctctttttttttttgagacagggtctcggtctgttgcctgggttggagtgcagtggcatgatcatggctcacttgatggcatgccttgacttcctaggctctagcgttcttcccacctcagccccacaagtagctgggactacaggcacatgccaccacgcccggctaatttttgtattttttgtagagacagggttttgccatgttgcctaggctagtttcaaactcctggactcaagtgatcctcctgccttgacctcccagagtgcagggattacaagcatgagccacggcacccgaccgacatttcttcacatcgcttacagtctagagtttacagtttagttaataaacaaaattacaactgctgcccattaaaaaaaacaaaacaacaacaacaacaaaaaaacgcatgtcaaatggttggagaaggaagagtttaatacatttactgatattctgaacaactgagaattatcatagatagaataaaagggttctcaatttatcaataagtagacttaccttaactactttacatatatatatgtaaaccaaaataacaattctattcattcagaaaatgtttattgaggaccagctatatgctagtcacaaagtgactgacaaaagtcctgtcctgggcagggcacagtggctcacgcctgtaatcccaggacattgggaggccgaggcaggtggatcacttgaggtcaggagttcgagaccagcctggccaatatggtgaaaccccatctccattaaaaatacaaaaattacccaggcatggtggcacatgcctgtaatcccagctatttaggaggctggggcaggagaatggcatgaacccgggaggcagaggttgcagtgagctgagatcgcaccatggcactctagcccaggcaacagagtgagactctgtctcaagaaaaaaaaaaaaaaaaaaaaaaaaaatcctgtccttaatgagctcataatctaaataaaaagatgaaaaaaactaacaaagagcttcaatatgggtgacaaagtctttaacgaaggatggaaaaattctgagagaatggggtggggcaggttattaccttattagggctgggaggagggcagtacttgggacttgaagctgagccttgaagggtgagtgaggtgataccagaaggaaggagttgaggagtccctttcagatggagggaacagcatgtacattcctaactgaaaatagtgcctgctgggtgggcagggagtgcatctgggcagcagccaaagagaagcctagaaagggagacagaggccacaccctgaaggactctgtcggccctgacagtgtggctggacttgatcttgtgggcaatggaaggccaccgctgtgtcttgaccgacaacatgattagatctgcatgtcggaaacgtggttctggctgacctaacatgtacttcctccatcactgaagttgtggctgcagatggaaaaaccagaggaagggaaatggcccaggtgagcaacgttggtgaggtggcagaaggagaagcatcttcattttttctttcaactttgattccaatgaaagaaacatatctaaaaagagtttatccattatgactcagtctgatctcttcataaacactaaatcctacaatcatattacaagaggaataaaactgcttgacctagtaatttcttgttttgagacagggtcttgctctgttgcccaggctggagtgcagtgactcactgcagcctcaacctcgtgggttcaagccattctcctacctcagcctcctgtgtagctgggactacaggcacacaagccaccatacctagctaacttttaaatttttttgtaaagacaaggtctcactattttgccgaggctggttttgaactcctgtgctcaagtaatctgcccaccttggcctcccaaagtgcaggattacaagcatgagccccagcccctggctgatctagtgatttcattaaggaattcccaagaaaacaatctagatgagagaaaataatttttctcaaagatgtttttaactatgctacttaaaatagccaacaaatgaaaataatccaaacatctaaaaataaaggatggttaagccaaatgtcatctatcaacatgactaaatactacataaacattaaattaactacagccatgcatgggaatgtgtatgggagcaaaagcagactccaaaacatgatatgcacaacagctacaagcttaagtacctactatgtgccaggcccaatgctaggttctggggacacagaaatacaccagacaaggtccctgtcttctgaactcacagttcactaggaaagttggactcacacaattgtaacaagaacaaagcatggcacaaagagagcccagaggaggagttgcccaacttagagccaacacacaaacacaacacaaatgtgaatgttcaagtctgcagcagaatcactcatcaattataaattttgatgaccccaaacacatacttgttaattttgtgggtcaggtgtggtgactcacactgtaatcccagcacttttggagggtgaggcaggcagatcacctgaggtcaggagttcaaggccagcctggacaacatggtgaaaccacgtctctactaaaaatacaaaaaaaatcagccagtcatggtggcatatgcccagctacttaggaggctgaggcacaagaatcgcttgaacctgggaggtggaggttgcagtaatctgagattgcgccactgcactccagcccgggcaatagagcgagattccgtctcaaaaaaacaaaaattgttagattatcccggacatgtaaaacctaagatgaggaacactcaaatccccaagaatattgcatggagccttttaagagtccttggatgctagtttgagaaacaaagatctaatagcaggaaggtgcctgtattcgtccattttcacactgctataaagatactacctgagactgggtaatttataaacaaaagaggtttaattgactcagttctgcacggctgggaaggcctcaggaaacttagaatcatggtggaaggcaaagaggaaacaaggcacgtcttacatggcagcaggagagaggtggggaactgccaaacacttttaaaccatctgttcttgtgagaactcactatcacaagaacatcatggggaaaaccactggggattacaattcgagatgagatttgtgtgggaacacagcgccaaaccaaattagctccagtggacaggaagggagacaaaggcccaatagcatctggctcctgattagggtcaagagggaggaagagtcagagatgatgtcaaagtttgaagcctctgcatctggaaaaatggcaacagggctccctgatataagaaacctaaaagaaaagatcaggtttgagagtaagaataagttctatttttcatatattgagtttaagaaacattagagagtaggaaagtggtggtattcaggaatttgctgaaaattatctctggagacttggagacacagagtagagacccagtatccaaagacatcttccaggctgggcgtggtagctcacgcctgcaatcccagcactttgggaggacgaggtgggaggatcacttgagttcaggagttcaagcccagcctagccaacatagtgaaaccccgtctctactaaaaatacaaaaaaattagccaggtgtggtggtgtgtgcctgtagtcccagctatttgggaggctgaggctggagaactgcttgaacccgggaagcggaggctacagtgagtggagatcatgccactgcactccagtctgggtgacacagcgagactccatttcaaaaaaaaaaaaacaaagtcatcttccagagatagctgaagcttgaaatggatgctgcacaacaggtatgaacacatccaactgcattattacatgtacaagatactctcctgttagtccctcacatatttgttaggcatctacttactttcaaaggattagctccttaaaattaataaaaacagggatatagtataaaggatcagagtgaatacattgatctcgtattttttccatgggaaaaattctctacttttataacgaatacagtttgaaagatgatttgattttaaaaaggattaatattaaagcttattttttctacagtgatttatttcatgatcatcttccttctagcctgtgaacttccaagataaggactgtggaactatgccttatttaaattgctaacaaggtacctggaaaatagtaaatacttaatatttgtggtagaagttttgtaaacagaagaatactttgttgtggctctcaaacatcaggaagttgcagagtactatatgagagcatttgtgtgtatgtacatactactgaattctactgcggtaaacaatctgggcttccagtgtggaggtggatgctttcattcatttgaaatctacaattactcacatgtaaattagcagcaatgcagaaaatgtgagaaattcagaattagtttatctttttagaactaccgagattctttttgtgtttgtgatctatatgtgccaacactacaattgtgttatttccagaaataactcaaaaagacattttcaatgatgagttttgagtagcaaaactggaaaggatattgtcaatctgttgtacatttatgatgtgcacaatctagactttccttcacaaatatgcttcaatgcacagaagaaggtgaaaacaacaccataaatctcagggctgcagagggagagctgaaggggtaaaaaacgcaattggagttcattcaccaggttggacaatgaaacaccagctcttgctctgcttctacttgctgaaacagacgtccccaagaagataaagggaagatactttgtacccttcctgaccctctttcttcctatacctttattgttcatgaagacaaatggtatgaaattttagtgaaaaagtccaagcttgggttgagggaagtatttggtttacttaaatccattgctgaggtttatggaacatatcagagcttcccaaagtctaaaaaatttagacttctaggtcctatcatagaaatgctgattctgtaagtctggggtgagcctgggaatttgtatttcctgaaagccccactcacttccacaactgattctaataaccagcccagtttgtgaaccatgaacgagagactacactcagacttggcaaacataaactgtctcacttgattctgacaaatcaagtgcatgtcaatcatctctatttcacagatgtgaaaaataagtcacaagcctgtatgcgtcagtttagaggtcatagtgcaatgctgcctccattacaccattatttgagcaccaaatttctgagcataggtgaactctaacctgatcttgggtctcatctcacagactattcatgcaaccaaccaataactgtggtgtgcctgaacagttcttgcacctgtccatagttcagagagacctctgcatcccaaataaccactattcactacataagcactaaaaaaatccattcaaatagaacttcaataaatttgtattagagcacacagcttgtaatactcaactaatttcattttataaccagtaatgagaaattatctgaaaatgaataaagaaaacaaatagatctttccaaacccacttctgtaaaggaaacaatatccttgcccttactacttctgtaacattctgctgaatgctaattgctttattttaattttaatgcaaaattctacatttctgattaatgcaacttaccaggatcccaaagaatagaaatgagatcccatgtcatcaagaaagggtgccatgagcatcaagtagaggtgtgtgagggagagagagaggaggcagcaagtgatgaaggcggaagactgaaatgtcctggtttcagttgggtttctggttttctatccatgtcactctgcattacctcctgaataggtagacggactttggcagaaaaggatggctcacatactggaaaacaattgcacgcatacctggaatacattagaggaatctctaatgctttagggcaaagggtggcaaattacaatccaccggccaaatccagcccatgacctgttttcgtattatccacaagctaaggatggtttttacatgtttaaatgattgaaaaaaaatcagaataatagtattttatgacatgtgaaaatgatatgaaatccagatttcagcatccataagtaaagttttattggaacacaaccacattcattcatttcatgtgttgtctatggttgctttcacattttaaggcagagttaagtcattgcaataagagaccctatggcccacaaagcctatatttcctatctgcctcttcacagaaaaagtttgtgaactcccattttagggcaaaggaggggtgttaggttacttcctgaaaactgactctgacctagccttagtttgctgaatatgaaataaaatactgaacttagaatcatctgaaatacatttcctttgatattgacctgtaaggtataacacaatctagttatccctgcctgagtgtcccagtattgaattgagactattcctgtggcttcttagcccaaaaacaggggcggggaaggccttctgcacattcaactccattactggaatgatgaacgcataaagagaggagcccagcatactaacccagcagagccctctgcacaggctgcgtttgagccttccttttagcaaagggaataggtagctttaccctgtcagcaactatctcgagcactgctgtcattttcccagcattgatattcaaaaatcagaactgcgggccgggcgcagtggctcacacctgtaatcccagcactttgggaggctgaggcgggtagatcacgaggtcaggagttcaagaccagcctgaccaacgtggtgaaaccctgtctctactaaaaatataaaaattagctgcgcttggtggtgcgcacctataatcccagctactcaggaggctgaggcaggagaatcgcttgaacctgggaggcggagatcgcagtgagccgagatcatgccactgcactccggcctgggtgacagagcgagactctgtctcaaaaaaaaaaaaaaatcagaactgtggcatgtaaaacataattcagagttgaatagcaggagccgctgtcctcccttctgctgaaggcaggagggaagcttgtcagagtccagacagttctggtctattagcagcagcctaatttttgccatctctgaaggcaacacaaattacaaagcattcgctactgttgtaccagtcaactaattcaattgtcagaacatttcaaaccccataatttggatgggaaagagagggagagccttgctcttatgaattgactgttggactattccatgtcacagcttgcttgggggtgagaataagaaaatattctctatcaggaaattaacatttgtaagtaccctggaaagctaaataataagcataatggtttagaatgaaagtaaccaaagcggttcattattaacattgcaagtaaacattttaatttgtggctttgctacacacatggattgttgggtcaactgttagagtattttcactcatctttcaaactacacataattcagtcctctttgccagtgtttttacctaaaccctctgtgaatgacactttctagtttcatgatataactagtccttagattccaaggtaataaaggcgcccttctactcaaaaacttcatgggcttatttccctcttgcaaacttaagtatgctttaatgagccattacactcatttgaattccagctctgcgagggactagctggatgtgtacggatccaaaacctcatttccctgagccccactctccacctgagaaaatgagattaatgccactacttcaagtggtggtttttgactcagtaaatttactttaaaaaccattgaattatacatttaaaacaggttagtcttacaatatatgaatcattcctcaagaaagttattaaaattttaatttgaagaactgctcaagaccagcctgagtaacatagcaagaccccacctctaaagaaaaaaaaaattttaattgtacttaaaagaaggccgggcatggtggctcacacctgtaatctcagccctttaagaagctgacgcaggaagatcactagaggccaggagttccagaccagcctgggcaacaaaagaagactcccaactctacaaaaaataaaaattaataatgtgattaaaagtaaaaataaaaagaggcagccatgaacaataaactatcagtgaataaagcaagagaggactgtctgcagaataaagagtgcaattgtaagataaaggaaaacgtgctgtttgagcagaagagaccaggagaaggtcagagtagctagatcatgcttgaggagaaaagatgggacttacaaagaatgtgttcagatgccatgtcctgtttaaaattaaattcccctgacaccacaacacctctctcctgtctggaaaagttaattaccttttttctaggctgtattttagatatgtttttgctaatgcagtcatcacactgcatggtaactatttgtttaaaagtctgatcctcagtaaactaagttcttacggctcaggggccatgtgttttggcagccctagtccataactcagcccaagaatgtgagataaatgaatgaataattttgttgcttactgcaaaaaggaaaaagacggttttgaagagtcagtgaaatatacatatgtatatgcaaaacgtgtgtatgtattagcacaatgccttgcacatagcgatcattaagtgatttttttattattactagtaaaacatgccaagaactgcactacagttcaagtcaattttgaagcaagtttggtctaacaacaacaacaacaaaatgttcgaacgcatggaaaataagtagacctaaatttagatgatcccctgccctattactaaggtttaaaggcctagatatgggccagacttcaaaaagcctcacagaaccatctacaatttgagatcagaatcctccacattcactgttagcagcaattctactctcactaaaccttgtgcttgcaggcttgtcgccatttgagtagcagttgatgggctttctgaggattcgttcttcaagattttggtctgaataacagaggaaatggataaattcctggacatacaacctaccaagactgaaacaaaaagaaacggaaaacctgaacagaccaataatgattaatgaaactgaatcagtaataaaaaatctcccaaaaaaagagaaacccaggaccagatgactgtcttgtggaaacctacaagacttataaagaagaacaacacgaattcttctcaaagtattccaaaaaattaaagaggagaaaattcttcctaattcattctatgagaccagcattatcctgataccacaaccagacaaggacccagcaaaaaaaaaaaaaaaaaaatagaactacaggtcgggcatggtggctcatgcctataatcccagcactttgggaggccaagacaggtggatcacctgatgtcaggagttcaagaccagcctggccaacatggtaaaaccccatctctactaaaaatacaaaaaattagccgggcgtggtggcgggcacctgtaatcccagctactcatgaggctggggcaggagaattgcttgaacctgggaggcagaggttggagtgagcagagattaggccattgcactccagcctgggcaacaagagagaaactctgtctcaataaataaatagataaataaataaataaataaaaaaataaataaataaatactacaggccagtatctctgatgaatataaatacaaaaatttctcaacaaaatactagcaagctgaatccaacaacacgtcaaagggatttatctcagggatgcaaggatggttcaacacacacaaatcaataaatacatcaatagaataaaggacaaaaaccacgattatctcaacagatacagaaaaagcatttcatgaaattcaacctctctttatgacaaaaactctcaacaaattaggcacagaaggcacataccctcaacataataaaagccatagatgacaagccctcagctacaatcatactggaaggcttttatgaatccctcagactaggttaggaacacccactacagtcccccagtaattgatccttcctttgcaaccatatacgccacaattcatggtactgcttaactgtcttctcagagcctgcaaagtctgcaagatcagagccatgcagagcttgctcacccacagtggattcctagcacacagaaggaagtcaatgttaaaatatgtgtttgaggagtgtcaccacattacatttagtctacatgccaacacctatgaaacagcttcagttctttccttcagcttgaagatatgcacaattctaaactcagaaagttacatattatctgcagtattcatattttattctcctgatgctttggtgaatgctgtctctcccaccagagcagttgatcaaaagaagcaagaggtggcaagcctcaaaactaaccagcttgatttttgaatcttttttttaagccccatgtatttttccacagtgtctcacctcagttacaagggaggcacgatgcccaaaatcttgtcagaattaaaattattaaagtagaaagccttttggcaaaagaatttaaagttcctattttgtgtgtatgctgggattttcagccgaaatcacagctgggtgtactcagccactgccagggacagaggctgtgtgtaagtttaccagcagtttatctagagcagaagctctcaattttaaactcccaaccttccatcccatctttttttttttttttttttttttttttttttttttttttttgcataaatataagagcacagactctggcgccagaatgcctcatttaaaatccctgctacatcatttattggccatggtatgttgggaaaattacttagcattcagcatctagcttcctcacttgaaaatgggaataaaacagcacctattgcataggtttgttgcgaggattagatgagttaattacatgaaaggcgcttagagtaagggctgagtaaatattagctatccttattattaaacacagctggggcataggaatacatgtggaggagaagggatgtgaaacagaacagagaagacagcaaaagtaatctgctgtgtaatgatgagaatggagcactttccacaaattatcacagacctcaggaaaacctttcagtgcaggttaacccgtccaagccacatagccagtaaatagccgtgctggacttgaacccaaacagtttgtctccagagatcccatcctgaaccaccaagaaacactgtctcccatgatcacactttcccctttagggaaaggaattcctgggttgtgaagtgaagcaaaaggacgtgaggaatgaaaagaaagaatggataaacaagagaaggccagactcatctgttttttccatttataagaggtaaaatgacaggtttccctttatcatcccttcacagtcatgaaagagcccgctgtctctgcagacacttggctttgatttcagtaggccaagttgaaatcaaaaccactgttaaagaattcaagagattgacagatccttttcaacccagcaagatccaaatgtgaaatagaaatgatggacatgaagtacaaagggtaagcaggagaacagtggatggggtcattagggacaccggaatctcacctgtgtttagagtggcaagactagcagaggtgctctagagtcagaaagacaaaggattcaaatcctagtttggttctgtattaccagaaaaatgacttaacctctccaaggatcatttctttcatctgtaaaatggggataagaacatctgcctctccatggataaaccactttgatacagtttccaagaaactgggagacaggcactcacgctggtagatgtgtaaactggttcaatctctatggatgcagtctggtaatactgctcttttttcaaacttgacaaacttatatagcgcttaaaatgtgccaggcactacaccaggcactttacaaatagtatttgattcttgaggcacgttgtaaaaatggtggcaatgattcccttcaccgtatccctgcatccctgaccttggggagtctcctcttacacagattctgagcttgactcttgctttggtcaatggaacagcagcaaatgtgacacatgcagaggcttgacaagtgcttgagctccgccctcctgggctactctatggaaccctgagaccaccatgtgaagtagctaggctactggagcatgagagattgcatgctgtcccaaatgagtccccgatgaccaacacagctgtcaagcaccagatatgtgagtgaggtcatcctagactgcccagcctccagcagacccacaagctgaccacagaagcagaaccagaagagccactcaaccaacccacagatttgtgagccaagtaaaacggttatttttttaagccatgatgattgggggtgatttgttgtacaacataaactgagagaatcctcataacaatcctattaggtagctaccattattatccctattttgcaaataaagcaactgaggcaaagaggggttaagtgacttgcacgacatataaatggcagagccaagactcaactccaagcaatctgtctacaggtctgtgctcctaactcctacactatgttgctttacctactaaaaatacaagtattcacatcacttgacccagaaattccactgctatttatcatacaaatacgcttgcacatatgcaaaatcatgaatatataagattattcactgcatcattgttgataatagcaaaataccagaaaaaaaattctagtgcaggcatacctctttttagtgtacttccctttattgaacttcacagatattgtctcttttactaattgaaggcttgtggcaaccctgtgtccagcaagtctatctgcaccattttccaacagtatatgctcatttcatgtctttgggacaattttggtaattctcccaatatttcaaacttttttattattactatatctgttatggtgatttgtgaccactggtctttaatgatactattgtaattgtttcggggcaccatgaaccatactcacatgcaatggtaaacttaactatataaatgttgtgcatatcctgacagctctatccaccaacacttcttctctctctctttccttgggcctctctattcggagacacaacaatatggaaattaggccaattaataaccttacgatggcctctaagtattaaagtaaatggaagagttgtccacctctcactttaaatcaaaagctagcaatgattaaacttagtgaggaaggcatattgaaagctgagataggccaaaagccaggcctgttgcagtgaatggtcagccaggtagtaaacgcaaaggaaaagttcttgaaggaaattaaaagtgctactccagtgaacacatgaataatgagaagtcagtgcctggcttcatggcttcaaaagacaggctgactctcctgttagggactaatgtagctggtgacattaagttgaagccaatgctcctttaccattctgaaaatccaaggagattgatgttgtttttgtgcctgctaatacaacatccattcttcaggccacaggtcaagaagcaatttcaactttcaagtcttattacttaagaatacattttgtaatgttatagctgccatagtgagcccccgatggcaaaataaattgaaaaccttctggaatggattcaccatttttacatgccattaacaacattcttaatatgaacatttacaatatcaacattaacaggagtctggaagatgagtccaactcttatgaatgactttgagaggttcaagacttcagtggaggaaggaactgcactggaaacagcaagagaaccagaattagaagtggagcctgaaggtgcgactgaattgctgcgatctcataaaatttgaatggatgaggtttcttatgaatgagcaaagaagtggttcttgagatgaaactactcctggtgaagatgctgtgacattgttgaaataacaacaaagaatcagaattttacataactttagttgataacaggcaggatttgagaggattgactccaattttgaaagaagttctactatagggaaaatgctatcaaacaacatcacatgctacagagaaatctttcatgaaaggaagagtcaatcactgcagcaaacttcattgttgttttaagaaattgccacagccaccccaaccttcagcaaccaccccgctctagtcagtaagtagccttcaacactgaggcaagaccctccaccagcaaaaagattatgactcactgaaagctcagacaattgctggcattttttagcaataaagtatttttatttaaaatatatacagtgtgccgcaaggcgcggtggctcacgcctgtaatcccagcactttgggaggccgaggcgggcggatcgcctgaggttaggagttcgagaccagcctgaccgaggtggagaaaccccatctctactgaaaatacaaaattagccaggtgtggtggtgcatgcctgtaatcctagctactcaggagggtgaggcaggagaattgcttgaacccaggaggcggagattgcagtgagccgagatcgcgccattgcactccagcctgggcaataagagcgaaaatccacctcaaaataaaataaaataaaatatatacagtgtgcttttttaaacaatgcaattgcatactaatagactacagtgtagtatgaacataacttttatatgcactatgaaactaaaaaattgtttgattcactttatttagatattcactttattgggatggtctggaatcaaacctgcaacatcttcgagttatgcctgcatattcacatttacagctataaagagaacttggggctgggcgcagtggcaccacacctgtaatcctagcacttggagaggccgatatgggaggattccttgagctaaggagagttcaagaccaatctgggcaacagagtgagacccctatctctacgaataaaaaaaattagccgggtgtgatggcacgtgcctgtagtaccagctactccacaggcagaggtggaaggatcacttgagcacagaaagttggggctgcagtgaggtaggattgcgccactgcacttcagcctgggaaacagagcaagactctgtctcaaaaaaaaaaaaaaatatatatatatatatatatatatatataaagagaacttcataaatctataaataccaatcttgtatgagagaaaaatgcgtggtgaagaagagtatacttatatgctaccatttgtgcttttaaaaatgaaaagcatgaatatataactgcttatatatgcatagattatttctagagggacagaagagatgagttaacagcaattgcttctaggaaagggaactagctgtctgggcaacagaataggaaggcttattttcattgtaagcttttgatagcttttaaattttatactatgtaaatgtatcacctattaatttttaacttaaaaggttgttatgaaaatgaaggaagccagtagatgcgtggcacaaagaaaataatcaataaatagtagctaccagcctggacaacatagtgagatctcgtctctacaggaaattaaaaaatgaggcaggaggatcgcttaagcccaggaagtagaggctgcagtgagccgtgatggtgccaccgtcctgccacctgggtgacagagcaaaactctgcctcaaaaaaaaaaaaaaaaaaaaaaaaagtagctaccattataattattctcccacaactgctttctaactttttctaacacaaataattttttaaagcaaccaatcctctgtaactcctggcttgcatggaaagagttcattttggattcaaaaataatgaaggaaataggaaggagccatgtgaagacgtgaaagaagacccaaccatggggttctctggtgttcaaagccctggacagcatggtatgcacaacattagccgtttgtcagagtccatttgggctgctacaatcaaatcccatagactgggtgacttataaacaacaaaaatgcatttctcacagttcaggaggctggaaagtccaagatcacagccccagcagattcagcgtctggtgagggcccaagttctggttcagagatagtgtcttctcacatcatggaagggacaaggaagctctctgaggcctcctttataaggttctgcccttgtaacctgatcacctcccaaagacccacctcttaataccatcaccttgagggttaggatttcaacatatgaactgcggggacaacaaacattcagaccacagcttctctcttcagagcaacccaaatactgggcatcttctgtgctcctactctgtacattccctacacaccttctctttcattcaaggacaccaaaggaaagtaattacttttgattataatagtgtgtctgcacactctctctctgcagttactgatctgccacagttgaagggctgccacatgcatctgccaaactgccaaattatatgcttctccagaaccagacagggtctggggcagaaacaaaaagtttgtaggcaacagagtgtaatgtcaagagccagggctttggagtccagcaaacctgggcacaaatcctgctctattttcctcatagcactcatcactatctgaaactacattatttgtacctttgtttactactttattatctgatttctcagtttgaatgcggcctccaagagaacaaggcttttgtatgtcatgttcctcacagtattcctagagctcagaacagcgcctgcacatagtaggtgcttaatacacgtcttatggaggtgggggctgagtatttaaaatgcagattgccaagctccagtttcagagattctaactcattaggtttgaaacaaagcctaggaatctgcatttgcagcaagcatccacctctttcatcctaaggcaggtagtaggcagatcacatgttaagatactctggtcaatgccctccatctccaaatcgtgattctccctctaacacgcatttctacggatcccatccaggctcttttctttaattaccctgaggcactgagagtaaaaggaggttgctgacccctgaatttggagttcaaacaagtaacctcaccacggccagtttccatttctgctgcatgccaaactagctggccagcctggctggaatcctgttctccccagaaacacctgagcaggtctggactagctccaaaagtataagccaggtaaatttccgtgtcagctcattgagagactttccaggggcagctggggccaattcacatttgctctatactccctccaaagacacccccttcaacacacacacacagaacacttaattctggtaccaccagccaaaaggggcccgagttcccttgggagcagcccagccgctgagaggcggaaatctctgaaagggccactcagatgaccaaagcaataggcgcctacgtaccttacaacaagccaacctcaagttccaacctagagaaatgcatggactctggtgggagagtcttattccgtttttgttttcttctttttttttgttttgttttgttttggtttggttttcttccatttcttctcagccttgtctcttcagaaaatacccctccaccccttccttggcgcgtaaactgtcttcagggtggccttaggagttctgggacaatgtggagggtacccaataggatttccttaagtttcctctactgcttttccacacatattaatgctgagatcctgtatttgattaaagcaccttccatttccaaagttaaaatacaaacgggtctggtaacttacaaagtcgccagcatcttcgtgtcaattaacttccccagacaagtaagaacgagctgcactagggcctgcgctctctccggggctaacaacaagcagcaccagtcccccaagctgtccctggaggtggaagagccactgcagctgagcctgtttatttttcgtttttccacaggcagccttggctggagggtgggggtgagcgcgggctccctggcacctgccggtaaagcagcagccgcagcccccgagggcgccccaggccaggagctgcgcgccgtcggcgggccgtgcctggaggaggctcgcgccttccaaatgccggagtgcaggcatccttcctctccccaaccccagccccggcctcgacctgtcgcccacctggcccggacctggggctggctccgtctctggggtgtgcgccaagggagccccaccgacgcccagcagagctgcccgggctcccaaagaaggaccggggctttgggcagaattctggcagccaggcgggcgtcaggggagccggagaaggggctcgccagcaggcgtggggcggagtgccgggcgcagcccacctcgcaagcgcgggcccagggctccgacgtgccagcgcagccccgaagagtgcgggcccggggtccccgcggcgccccttcccctcctcagtcccccgggggcgaccgcgctccccgccgaggtccgtccccgccgcaccctcactattcccgctgggaggaccccggcgcacgcccccgcccccgcaccccggggcgacggcgcactcaccctccgcatggtgtctgggccgtccgggcggggctcggcgacttgggcgcgagaagggctgggccggcggcgacgctcggccggccgggagctccgcgctgccccctcctgcacacgcctgcgccgcggccgccaagccggcgggggcggggcggggtagcgctggccgcggggtccccggggctctcccgggctgcggcggaggcgcggagccggccaagggcgcactgagctcgcggagctccggggccccggggcctttctgccgccgtcgcagcgtccccgcctcctcgggccgcttcgcccctctcctcttcctcgagttctggccccaccaggagcggagcgagtctccgatgcctgccccgcggcccccagaactgagctggagaagctttggggtgaaagctgggcccaccctacagggaccccaagtttgcggagcaagagtggattggcggagagcgcagatggcaattctcacccgccttaaaagtaccaccttaaaattctccccatgggatgggaaggtggcccgctaatgtccgttcctactcttcgttttctttttaatttttcagacagggtctcgctctgtcccccaggctgagcgcaggggcgcgatttcggctcactgcagccttgcgattctcccaggctcaagcgatcctcccgcctcagccttcccagtagctgggaccacaggcgagtgctccactacgcccggctaatttttgtatttttattcttttgtagagactggtgtctcgccattttgcccaggctggtctcgaactcctggcctcaagcgaccctccagcctcggcctcccaaagtgctgggatgagaggtgtgagccagtgcgtcggccctttaccattctttagattctgcgattgttttttgaaagtcctgagcattcataaagctttccgaggaggggtgggaagagagttaagagcggtaaacagcagatccacccggggctggaggaaacaccgtggaacagagaccgtctggtctcattcaggtgaaggagctcggcaggggaagaggtcagcatccccattccagcgaaacccacgggttttcctagcagtcccctgtgtgcacagctttctcttcacaatcgacctccaccccaacttttccaaacaacacgggagcccatccccaaatgctaatgcttctgcgggaaaaaaatgagaagggggaaaaatgtattccccagatcatgaaaacgctgcacacccttgagctcagaatgcaggatctaaatccgcaagaacaggatggaatgatgtgggaaggtcttccaggaagaaatctgattttattctgcttcgactgctgaacaaagtaaatcaaatagcacggaactcaaggcagcctgaattttgtgtagaaaaaaatatctcttgtttgtcagaggatcctttgaaaagcatccaaggacgcttgtgtttccaaagcggctgtgacaggtatgcaggcagacagcagtgggaatgcaaaggcttgtgccgggtaaacacttctcatgagtgtttcagctttggcattgcctttatgccagttattctggcagatcaccactgccaaagaaatacctttataattttctaacattgattgtcagcagcactatagagaccgtaatattacacgaagtaccttaatgatctaatgaataaaaacattttgtctggatttctctttggtgcctatcagcacagatagggggaggagtgactgatgtgtgagggggaaatgtaagaaacgacaattaatgacacttgctatgtcccttttttactttatcttatgatctgtatgcagtgggttttttcctccctggatatataatctcttctgattgagcttttatgtttttgcctttctttgggaaaataacaatgttagtaagtgtacttctgagccatacctgtcttatcatttcaatccacacaactctatgaagtacgtactgggatattatggtttttttagagggagatactcgagctcagagagggcaggtcatttgcccgagatcatacagcttgttagtggcacagcctggatttcaactcaggcagtctgacacgaggaccctctcacttaatgcccatgcaatactgccctcctctgcttcatagaaaaggtgcaactgtgtaaaggtgttcctggaagtaaaaacgtgagcttttgtcatagattagtcacttgacatctcagagccttagcttcctcatcagtaaaatgacaacttggactaaatagatgcattaaaggcctagccagaagtaaagttcaagatttagagtattactatgtgagtattagagtatcagtattcttgctcagcattgtaagaaatcttaacctggagatacagtgttagccacttcattggtttgtgtgatctcaccacagcgccttgttttaacactacttgtgctgctttctacaacattacctcttcctgctccttctaattaatactctttgctttgcaaatgtgatatctaatcaatttaatgttctttttttttttttcttttctttgagacggagtcttgctctgtcgtgcccagtctggagtgcagtggcgcgatctcggctcactgctacttctgcctcctgggtttgagcaattctcccacttcagtctcccaagtagctgggactacaggcacccaccaccacacccagctaattttttatatttttagtagaggcaggattttaccatattggccaggctggtcttgaacttccaacgtcaggtgatccacctacctcggcctcccaaagtgttggaattacagacgtgagccaccgagcccgtcctaatgttcatttcttactaaacttgaataagactcctggtgtgggggaggggagtcagtttcagttaagtagttgttaggatgatcttgaagtattagttagcctgaatcatttttaaattcccttcagaaaccaagaatgttattcaactgtaccaaataaataacaacacgtcagttgctaatggaacacggtcacactggccatctatggaaatcctcatgtttccaatgctctcattaactaccctgaagaatcaatttaaaagtaaaactagattgaatcagatttcccccttttttattccagggggagggggaaaggtctttgtttctttcatatgtttaaagaatcttcaaaatattttaatgatagagttgtctatctgtttcatattatcatatctccattagccttctaaactcagccatattatttgattccttgaaaaccatctaatgtttaagaacactatattttccccttttttcttaattgtttaacttctccaccagtcacaaacactgttattcagccttaatttttttttttttttttttttttttgagacagtgtttcactcttgtcactcaggctggagtgcataggcaccatctcggctcactgcaacttccgcgtcccaggttcaagcgattctcctgcctcaacctcccgagtagctgggattaccggcacccaccaccactcccagctgatttttgaatttttagtagagacgatgtttcaccatgttgtctaggctggtctcaaactcctgacctcagatgatccacctgcctcggcctcccaaagtgctgggattacaagtgtgagccaccacacctggcctattcagccctcttgatctgcaggctggattcataggtcttcatcttagtacagtaggaagtatactggcatcaggaggtcaagcttacttctttcattacctattaaggtagataggcatttgttataaaattgaacaaaaaggaactagtttacaattttacataaatagtaaaagagaataatttcttcttttcgtagataagaaatgttatcaactggcataatttcttaccagtctgtcatcctccatttagaaaaccattagtaattaaatgttgttttcctttaccatgttcctaaatatgaatccttcataaggcatctattaaatacctactatggggcggtatacattattgattaaatcaatccatatttccctgagaaagaccaagaaaaatttcaaggaaacatgtatcacagctacatgcattgagtactttatatgttccaggcactgtgaaaagccatgtatcaatctgtttcatcctcacaaaactctgcaggattgttgttagtatcttctccatatgatagactatgaaactaagatttatcgagatgaaacaccttgccaaaggctgcatgtttaattagtgacacacttctggcccaaatctgactccagaacccaagagattgaccagtgataggtggatgttaatgtatcacacagacttctctctccggaatttcttcaaagtggtgaaaacgtgagccaagaattttatatccactaaaactgactttcaagtatttatactagaataaagtgacattagttaagaaagaattcttaaaggagatgagttcttagcttgaaaaaatataagatttgaatgggaagagtgaagaatattcttttttcagcctctcaagtagctgggactacaggtgcatgctcccacacccatctctacaattctttttgttcgttttgtagagatggggtcttgctatgttgcacaggttggtctcaaactcctagcctcaagtgatcccccaacctagccctcccaaagtgctgagattacggcatgagccaccatgcccagcaagaatattcttcaaagggtacagtggaatgagccacaaagtagaggtggtgagtcaataaaccattcttagggaaccctgggatgtgtgactttttaatttttattttttattccaatatcacagtcacttaaggatattctgggtcctttattttgctgtaggaggtctgcgtggttgctatgctatttcttttcttgcccttgacaaggcctgttcaacttctctgaaccacaatttaggggcttgacattctattgatcttttttttcttcttcttctttttgtggcctgaagatgcagggtagagtgggaaagaacttacctagagctgtgtgtcgcctttatcataggaatttagtttcttctttcttctaaagctctgtgccagagttcagcccttagtggatatttaaaaagacaaaattcacccggacttgcacccctagtgctacttatatatttaattccatgctcctttttagtcttcgtccaaatgcatgtccatctgcaatctatttacacagctatctctcctactagactctgaactcctttaaagaagggactgtcttaattcttacatctccatggcctaccccaaaataggtgtgcttggtacgtgtttaataaacgaattagtgatgtttaaaccatattatagtctgctgttttcccttggttaatgtttcctatattttacatagccttaataattacctttattggctgctcaatatgcacatctcagtgatatattatcatttaaccttacctcatgttgccatttgcattgtttctactcctttgattgagcccgagagttcaagaccggcctgggaaacatagtgaactccatctctataaaaaatacaaaaataagccaggtgtggtgacacgcacctgtagttccagctactcaggaggctgaaacaggagggtcacccgagctcggggaggttgagactgcagtgagccgagatcacgccactgcactcaagcctgagtgatagagcgagtccccatctcaaaaataaaataaaatactcctttgaaattcccttgagttagtaagtagggatatgacttcatattaagaaggatttggaggatgagaatgtgattaaatggtctagacgtaggaagataagttaggaggctaacctcagtcacacaaaatggaactggtgaaggaaccaaggtcaagattaggatggtgattgtggaaatggaaagagaaaatcaatttctacatccactgccaaagctgggaagatgtaacaagggatttaccctatatagggctaaaaatatgacaaacagtggggacattgtcctatgatggggagcgctattttagcaccatggacagctcccaggttatcaggtattcgttctgggtggtatggaaccattattgctgtccgtgatggtgccttttaataaaaaacattaagtaacatttttgaacatataactagtgaaagctttacatacatttattaattctcataacgaaacaggcacgtaaagattacataatgtcgcccccaaaatcatacagataacaagtggcagagctaagtcctgagtccaggtagtctgggtttaaaacccactacgccggccaggcacagtggcataataccagcaatttgggaggctgaggcgggtggatcacccgaggtcaggggtttgaggccagcctgaccaacttggttaaaatccatctctactaaaaatacaaaaattagctgggcgtggtggcgggtgcctgtaatcccagctgctcaggaggctgaggcatgaatatcgcttgaacccaggaggtggaggttgcattgagccaagatcatgccactgcactccagtctgggcaagagaatgagactctgtcaaaaaaaaaaaaaaaaaaaaaaaatttacaccatactggaaaagacactgatgacaaactatgattatatagttataaaggctatatctttccagctttggcagtagatatagacactgtctccctttccatttccaaaatcgccatcccagtcttgaccttggttctctcatcagttccattttggttacattggaactaagttttgaatgacaaatggaatttaactacagtccagatggccaataggctacctgaagccctgtgttgagaagggttctgagttctaatctaggcccaacaaaaagcctcctgtgagcagttagcaaatgtgatagagagtgataggagacctcaggctaggaaggtaggtaagccaaataataaagggtcttggatgtgaggaaggaagtttagacatttttcctaaaagttttaaaaacccactgaagagttttaagcaagatatggcattaggatgagatttgcattttttaaaaaataatcctaataatttcacggtaaagataacagagtaaaccatgatcacagattctccttttcctaatacctgatataacgaagaaaaactgtagctcagaaagaggacaacaaactcatctgagataaggtgagatgggggccaaggagacttcatccacactatataacagttacaaaaagatctggttggagctgcccatatgaaacaagattaagatgaaaagatgaccatgtacatgtggtacagtcaaaaaagggtggagtggggaggaaggaagataatgtatgcactgtgaagaaaccagtatggaagaaaacataaacccatgaaacacatcctccaggtagtgctttgaactataaatgcctcagaatatgaacctgggtaaataagacctcaaaattgagatgaaaaaatgaccgagagagcaaaaagttgtcagagctaaagaaatgaatcaaaaactgaaacaacaccattatagacctaatatacaaattagaaatgccaaataacaggaaagacatgattgaaaattgaattaatggatagtaaaaggtttacgataatcatggtaaatgcataatttgccacagagggagtaaagtaattagggagaggataataagagaactaagagaaaatcaaacataagattcttggtgtccctaattgatgtagataatccaataagtgtaacaaaatatgcatttagacacataatacaggaagagtttttccaaaatgaagaaagaactgaatctgcagaggaagatttatactgtatgccagacaaaaagtactttaaacagacatcaaaacatagtctggttaagttaacaattttcaagggaaaatagttatttaggtatctaggcagaaaaggcaaatcatctatgaacgtgggggtgggtggggatagaatcaaaacagatacgaacatgtccaaaaaacctcaagctagaagacaatgaaacaatgtcatcagcctggacaacacagctagactctggtctctacaaaaatatattttttaaaatcagctaggtgtggtggcacacgcctgtagttcttgctacttgggaggctgaggtggaaggattgcttgaacccaggaggttaaggctgcagtgggtcatgatcacgccagggcactccagcctgggtgacagagtgaggccctgtctctaaaaacaaaacaaaacaacacacacacacacacacacacacacacacacaccatctacctagcttgaagagagaaaaagtatgacctaaaatggttacacatagccatctgcaggtattctcaagcataaaagaactcacggagtaaaacacacgagccttcttggggaaaaaaaaatccagccaatcaggagcaggagatgaatgaaaaaaaaaaatcaggaacagaagacaccaaggtaaaaggtaaaagtgctgatggtcaacagttcagtatttaaatagagaactaagattaaacaactgatggaattctagcagtggaataaattgaaaatgttacaaattctgacaaagtaaaaataatagaaagatttttaaaattaggaggtgaaggagagtgaaaggaagtgtgagtgctaattacttcatcgtctatctgcagagaaccaattgagatcatccaaaattgaaacataaaagaaacactcaaacttcttaatgatttctgcagttttttcttaacctcaggcatatcttagtaacttctcccatgatggaggaaaaaaaagggttatctgaaactgaattacttcagtttaattattttttattgtgttaaagtaaaacaaacttaaattcagtaattaaaataaccttggtagtcataaaactctctctctctctctctctctctctctctgtctctcatcttctacctttatatataaatagagaggctttttgaattatgttaatactcatttctgggtggtgagattttgagacgtgctgcttttcttttttgtacttttccatattgcttaaaattttttttaaggaacagatatcatttttatttaaaaataattactttttaatgataaatgaatatggctcctaagtataattcaacatggaaagtcatccatgatatattgctgagtgaaaaggttggtttaaaatttcatctgtagtataatctcatttaggtaaaacctacatatcatacatgcttacgtgttcattaaaaagtctagaaagatgaacaccacaatgttaacagtatttatttctaaagttggtgtagagaattgggcttataatttctcagtatcattttctaaacctttttatttaaaaataaaacaggctgggtgtggtggctcacacctgtaatcctagcactttggaaggccgaagcggacggattgactgagctgaggagttagagaccagcctaggcaacatggcgaaaccctgtctctactaaaatacaaaatatatatatattagccggatgtggcagcacgtgcttgtagtcccagctacttgggaggctgaggcaggagaattgcttgaacctgggaggcagaggttgcagtgagcccagatcatgccactgcactccagcctgggcagcagagccgagatagtgccatggcactccagcctaggtgacagaatgagactctatctccaaaaaaaaaaaaaaaaaacagatggccaggaatggtggctcatgcatgtaatgtcaacactttggaggactgtggtgagaggatcacttgaggccaggagtttgagacaaggctgggcaacagagtgagatcctgtctctataaaaaaattgttttaattaaccaggtgtagtggtgtgtgcctgtggtcccagctacaagcaaatgctgagagattttgtcaccaccaggcctgccttacaagagctcctaaaggaagcactaaatatggaaaggaaaaactggtaccagccactgcaaaaccataccaaattgtaaagaccactgacactatgaagaaactgcatcaactaacaggcaaagtaaccagctagcatcataatgacaggatccaattcatacatgacaatattaaccttaaatgtaaacaggctaaatgccccaattaaaagacacagactggcaaattgaataaagagtcaagacccattggtgtgctgtattcaggagacccatctcatgttcaaggacacacatagactcaaaataaaggggtagaggaatatttaccaagaaaatggaacgcaaaaaaaagcaggagttgcaatcctaatctctgataaaacagactttaaaccaacaaagatcaaaaaagacaaagaagggcattacataacggtaaagggatcaatgcaacaagaagagctaactctcctaaatatatatgcatccaatacaggagcacccagattcataaagcaagctcttagagacctactaagagacttagactcccacacaataatagtgggagactttaacaccccaatgtcaatattagatcaatgagacagaaaattaacaaggatattcaggatttgaactcagttctggaccaagtggacctaatagacatctacagaactctccatcgcaaatcaatagaatatacattattctcagcaccacatcacacttattctcaaattgaccacataattggaagtaaaacactccgtagcaaatgcaaaagaatggaaatcattaacattctctcagaccacagtgcaatcaaattagaactcaggattaagaaactcactcaaaactgcacaactacatggaaactgaacaacctgctcctgaatgactactgggtaaataacgaaattaaggcagaaataaataagttctttgaaaccaatgagaacaaagacacaatgtaccagaatctctgggacacagctaaagcagtgtttcgtgggaaatttatagcactaaatgcccacagccccacaggagaaagcaggaaagatctaaaattgacaccctaacatcataattaaaagaactagagaagcaagagcaaacaaattcaaaagctagcagaagataagaaataactaagatcagagcagaactgagggagatagagatacaaaaaaactcttcaaaaaatcagtgagtacaggagctggttttttgaaaagattaacaaaatagaccgctagccagactaataaagaagaaaagagagaagaatcaaatagacacaataaaaaatgataaagggggcatcaccactgatcccacagaaatacaaactaccatcagaaaatactataaacacctctgtgcaaatccattcactttttaaggtttgcaaaataaagatttataattctgcatttctttttcattcattaattgaaatgcttttataaagaggtaatttccccccattggttaactagtattacagtttatacagaaaaggcaaaataaaaccttgattctatgcatttctctcccagttttcaagataatgaattggttccctatcatcttctgaaggtgaacaatcttttaaaatattcatatgaattcacgaatttaaacacttttgataattttaatcaattacaattattaacttccatgaaaactcaaattgtcctgtttttggccaataagagccccttcaatttggcttctcaggttttttttccccatgtacctagatatgtttgatatttttcttgctactgagtataacagaatgctctaggctcatctcatacattttctgtcccagatagaaatcaaccatttctctgaaaattatcagttttcccaggaagtcttcatttctcttagtggtaaatagtgtttcaagaccaggatcttggtactaggaatgctcctggctgctgacttggtcagaaattttaggcctcttcaggggacagagctaaactacaagactgtctatatagataaaatctataaactatatactctctctagctagtattatgtgatatatatcatgctaacagcagcaattccaagtcattcttgtttttatttagcctcttatgtattatatcttcttccagatgagactcctggtagttcgagaccagcctggccaacatggtgaaacctctcctctactaaaaatacaaaaaattagctgggcgtggtggcaggcacctgtaaccccagctactcggaaggctgaggcaggagaatcacttgaacctgggaggcagaagttgcagtgagccaagatcacacccgtgcactccagcctgggggacaagagcaagacttcatcacaaacaaaaaaacaagactcctggttcttaagaacacaagtgatgatagaagtagaatatcctataattacttatttatttatcacacaactctttcagaatggcaatactaatacactaaatattactactgagaacatttaagaacatttttgtatttactctccctattctgctgcctcattttttaactttaatttaatttttttttttagcaacagatctcactctgtcacccaagctggagcacagtggcatgatcatagctcactgcagtctcaagcgcttggcctcaagtgatcctcccacctcagctcccaaagtgctgggattactggcatgagccactgtacctggacttaatatttgcactatattacattatctgatcatttacccattacatgatatcctgttttaacactcacatagtcttaatttaaaaacaactgtatttctaattctcaccaccagtttctgttgtgtgaatcttattctcaagtagaatcctcgggaactgttaataggaacaatatttcttaagttcttactgttgataacagtttgtctattgataacagtcatcgagtgcttaaaagtttacagaatagaatgaaacaattaccttttatttaaaagccactaaaagatattaagagaatgacagaagagatgaaaaaaatttactgaatataaagttcttggctcacatgttcttttttcttaagtatcttaaacatgttaagatatatttattgagtatcttaaatacattaaatatgttatttaattttctcatgaggtaaatcattgctctcaaaaattctggtgttgatataattttttttccctcgctgtttctgcttagatgctcaaaggaaatttttcttctttaaagcagagtaattttattggaatatgtctaagtgctgtcagtttcagtatgatattctccagtgtgcagcatgttcattcatatatagcttcaaatctttttttttttacttcagggaaaaataatttttaatttataattttagaatgcattgttttcttcctttgctttttgtcttcagggattcctgttatctctatcttggatcatcttctatcttgaatatctgtcactttctcttgacagatattcctgtcagataacaaaattcctgtcttaatttctttttgacttaaaaaaatctgccttttcacattctgttcttcttttttcactctgttgcccaggctggagggcagtggcatgatctggtctcactgcaacctccgcctcccaggttcaagcaattctcctgcctcaaccacctgagtagctgtagctgggactacaggagtgcaccaccacacccagctaattttcgtatttttagtagagatggggtgtcaccatgttggccaagctggtctcgaactcctgagctcaagtgattcacccacctcagcctcccaaagtgctgggattacaagtgtgagccaacacacgtggcccacattctatttttctgttggatttatttgtccttagttttccctttagtcttcattcacaaagtttagtcttcatttcttttatttctaattctttcttgaagtttatcacctcatttaaaattattttttgtaatttgatttatgttatttttcatatcttctgttattctcttaatatcttttagtgacttttaaataaaaggtaattgttttgatctattctgtagacataccttgctgtgtggttttgtctgaatggatgttgttttgtttcacatatcttttattcatttttcagagacaaggtcttgctgtgtcacccaggctggactgcagtggtgcaattatagttcattgtcccacctcagcatccctaggactacaggcatgtgccaaccaattttttttaaattttttgtacagatggggtctcactatattgcccaggctggtcttgaacgtctggcctcaagtgattcttccgccttggcatcccaaagtgctgggattacaggcatgagccaccacacccagcctcttttattcttaaaataactttgtgtgggatttggtcttgagactttttattgcttatttttttatgtaaaactcattttcctgaaacccgagaaagaagtgtgaccgaaggtaatatttctaacttcatggaactcccttttctgatatttttataagaagctaaaaaatatactgcagcttgttttctgagatttcctggtccctttctttttaccacttatatctgttccctccccccgccaacccccccaccccccccaccccacttacctccaccccttctctactgcctacttccacagtttctcttcaaggtagaaactttcagtatcctgaaagggatccctggctggtcagttttaagagttctaggagccggactgctccagctccttcaatgtttttacagcaaactccttccactcacctgctattggagttggcaaacctcttcccagttacaaatgctgtcctcagcttggcctgccatgctttccagtgaacgactgttgactatttggggattctcttgttctcagatccatcagaagtcccacagagaaagcccctgtgctttctcctgcacagatgttagtaccatgcaggtctttgtggatctgggagtttgcagggatatcttctcaccaagttttgttgtaaatgtgttcatgggtttttgatttggctgtctagttgttctgtttttatttgggaattcaaagaaattccaaatactacgctgcagctattatcttcccagctcactttattttaaaaatatttttacagcaatcatgtttctctggggggaaaagcaataatatttccatttttggaaaaaaaagatgcacctggccacattctattggatggctttgagggatttaaacagatacaatcagctgatatgaagtagcacagctgtaccattgtcaaaatatttaaatactttcattccaactagaaagtagccagtgctccaacccccaatgcctgtttctcaactgtcctttccctaggtccccctgactgaagtagaagctaaagagtcaatgtctatcacaagggggggtcctgtgggctcctgctccagctcaatggctgattggtcaaagcccatgctgtaatgttggtttaatacttggaatatcacctctgagtagactccatgagatttggagacagtgtgggggaggtgaaagtgagggtttacaggccttctgaatgggcctcagcagaatatttcaaccaacatttattaagcacctcctgtatgccaggcactattccaggcaaagaaggtgcaaagacaataagacaacgttcttggccttggggcaaccacagtctagtgctctgtctttggggctacttatcctctggaaggatgccaatttcactgaattgcattacagagctcagcctctgagcagaaatgagaaaagaagaaaagtgcggacctaatggcaaagctcttactgaagccatgacctaaacaagctcaaatctctctacctttggaacagtgactgctgtaagaggcctggcagctaattaaaacatgtggtaaataagccaagcaaggaactctctgtccttgtacacaatgattcgagcggtctccttagacacaaaagcctgtatccttatctatggagcaaatcaactattaaacgattcatgttctgtgtcctcagtggactgcaatgctttttttgaatgaggaaaaagagacctggaaggaaatctggttggaaacacagtgtttggctaaataataactgcagtttttctcataaaagatttgtaccctgaggagtgcaatgcatttgaggagatgctctgatttttgtttgcccagttactggaagcacaaatcactctgtagagggtggagtggaggggctgggatcaaatgggactagctgtttactgtcagagcccaatgccataagggaaaagttacctcaacacccttatttccccaaagttaataaattccaattaaccacatttattaagcaaatatgtattaagcacttactgtgtgtcaactgtagtccctgctataaccaaattccaccttaaccatcaggaaaattaacatgcagaaaccggctgggtgtggtggctcgtgcctataattccagcactttgggaggccaaggcaggaggattgcttgagtccaggaatttgagactagcctgggcaacaaattgagaccccatttctgcaaaaaataaaaaattagccagctgtggtggcacgcacctgtagtcctagctactcggaaggtgagatgggaggatggcttgagcctgggaggttgcggctgcagtgagctgtgatcatgccactgcactcagcctcagcaacagctcagccttgcctctgtaaagaggtatagaaacccagtggttcccaaagctgaagtaatgcttaaacaggaatcagacgtacattatgagtaggacattattgtttataccttcagttgtgacttccgagagactgatcacagtcaagacaacttgattagtctgtaggagttcatggggcatttgggaacccctacctcagagcaagaaaaacaggccctataaattatcatctgacaaaatgagaatgttatattggcaactgctatcattaacttctagtaatgtagcaattttcaacgcaggaagggaatgtatcaaaaaccttggtgggaaggcaaaggaaaaataaaaggtgctttttcaaattacacgtcccctcttaatagatttgtgtatgttagtggttaagagcacaggtttcggagtcagactgcttaaatgcaaatcctggctctaatccttactagctgtgtgactctggttaaattagatagctactgcatgcctcagtttttgcatctgtaaaatgggaatgatgacattcatggtatcatacaactgttttgaagatgagatgagttaacacatgtaaagtagtacttagaaaagtgcctcccagctgggcttgataactcatacctgtaaacccagcactttgggaggccgaggtgggtggactgctggagtccaaaagttcaaggccagcctggacaacaaggctaaatcccatctctacaaaaagtatgaaaaattagctgggtgtggtgccatgctcccagctactcgggaggctgaggaggaaagacagattgaatccgggcagtggaggttgcggtgagccatgatcacaccactgcactccagcgtgggcaacagagcaaaactctgtctcaaaaaagaaaaaaaagtgcctccctcccaggtcttgtcccactgctgcctctttctgacctacatcaaccatcttagtgagtgtcccaaatctcagaccctgatagaatcaagaaggggaaggaatcttggaggccagctgctcttatccattcaggaatcctctctctgaaatcttggccacatcatcttgaacgtaccctaatgagaaagtttccttcccgctaaaacacccgttacatctctggacacttgaaaggtcttctttgcattaagctagagtctgtttccctgtttcctctgcctgttggaatcagagataacaaggtgattcacatccttttcaatgatggaggccacaaagggtatgcatgagggctgtagggacagcttgcatggattgaacctcagcttcaccatttatcggctgtgtgatcccaggcaatgtaatctctctatgcctcagattcctcatttgcaaaatgggcatcccaatactaccaatctcccagggttgttgtgaggatcgaatgaggtaacatatttagagcttggtacctaagactcagtccattttatcatgatgctcatgctgtggatagcccctcagcatttgcttcttcaggctacacatccctaattccttcacttgttcctcaaccagtaattcccaacacacctcacccctctcctttgagtagctccagttgccagtgttcttatttatttcttcatttatttatttattcattttctttttctttttttgatacaaggtcttgctctgctgcccaggctggagtgcaatggcacaatcacaactcactgtagcctcgaccttcctgggctcaagccatgctccaacctcagcctcccgagtagctgggagtgcaggtgcacaccaccatgcctggctaatttttgtattttttgtagagattgggtttcgccgtgttgcccaggctggtctcaaaatcctgggctcaagtaatctgagtaatctgcccgactccgcctcacaaagtgctgggattacagacaccccaccagtgttcctctttaattatagtcgtgtgctgtgtaatgacattttggtcaacaacagactgcttatacacagtggtctcataagattataatactgcatttttgctgtaccttttctatgtttagatacactaataccattgtgtacaattgcccacatattccgtacagtaacatgctgtacaagtttgtaacttagagcaataggctataccatatagcctaggtgggtagtaggtgataccatctaggtaggtttatgtaagtgccctctatgatgttggcacaatgatgaaatagcctaatgacacatttctcagaacatgtcccacttgttaagcaacacatgaccgtttatccccagaactgagcccaggacttcggtgggctgtggtccacaaagatcaagatgtgccatcctctccccagcttggttgtttattcattcatgtattcattcacaaatgatgttaagagtctatatgtttattaagcgaccctaagagagaattggcttttttttagtgcacttatcatactcttgactcaaagtgaacttgcagtgggctaaaagaagggtgagtaaactcttctgtaaaggggcagatagtaaatgttttaggctttgctgttcatatggtccctactgcaaccactcatctctgctgttgtcacacaaaggcagccacagacaaaatgtaaaacttcatttacaaaaataggcaactgcctgaatttggctatgagccatagtttgtcgacttctgaactaaaacataacataaatgtgttatttttccacctctcacctactgcctcgtgtttgcagttggcggttgttgttttaacagagtgcaagtcctttcatttatctctattcagctttatttcattggtttgcccattcctctaccctgctgagattttcctgagccccgattgtgccactgaccaaagtaacccgtctctcttaaccttgtgtcatcatctgccaatgataaatgtgcctttttatatatttatccaggtaattgattaaaattttgagctggaaagatctgagcacagagccttaatttttgcgacaagcaatgtccctccttgtaaattctgtatattgttcaggactcagtccagtgccacttcttccaggaagctattcttacagctgctctcccttcccaagccaccctgtccagtctgaggagggtgccctttgaatgtaagtccatcctaccttccacatacctctaccctagcactaccactgccctggaattatgcctcctctgttagactttgtactctgttccaaatcatggcacagagtaggtgctcaacaaatgttgctagaattaatgaataaaggaatgaatgaatgaatgaatgaatgaatgtgtggtttcatgtatgggtcctgcttagcatcttcccttcatcaaaagttacttttggggggctagatgcagtgattcatacctgttatcccaatacttttggaggctgaggagggagaatcacttgatgccaggagtttgagaccaacctaggcaacacagcaagaccccatctctacaaaaaagttttaaaaatagctaggcgtggtggcaagcacctgtagtcttagctccttgggaggctaagacaggaggatctcttcaccccaggagtttgaggttactgtgagctatgattgcactaccacacttctgcctggacaacagtgtgagaccctatgtcaaaaaaaaaattacttctttcttgttgccttcctttgatcagcagcttggttactggaatttaataaactaactggagaatggtgtaagtgcaagataacagctcaatgtaccatctctatctcttcccagattgcctgggaggttatgttttagaagagtgtccaatgtccttatctcaaaagtctaaataacatggcaattttaggtgctataggaaagagattttggaaagaaaggtgaatactttatcatccccatctaatcatacggcactgtgttctccttattaggcttttgcataagaaaaacctgaacacagcttctctgaagaatatgtataaatgtttgtggattacaaataatattaataaacaccatctgcaccccttagagtgttccaggcttgtccccagagagtctctaacaaaacaactcttagtctcatctttaaaaccaatatcatgctgttcaattaccaggaaatgcctgtctcaaaatccagcctcatcttgagaataaacaacaatatataaagatagaattggtgttatattgttgtcattgttaatgaattattgaaaattattgagggtctcattcacactggtattggggtagatgaatcctgtaccccgaagtacttggagtgacctaactcctctttggttagaaattcaatagggagtttcctttgtcactagtagttgaaaactgagggttaagacctgggatttatttcccaaacacagatcactcagctccttgacatatattctacttttttttttttttaaattagagacaaggcctcactatattgcccaagctggtctcaacctcctgggctcaagtgatcctcccaccttggcctcccaaagtgctgggattacaggcatgagccaccacacctggcccaaaatatattctactttaaatcagagtaaggggtgcaaactggtggctccagggccaagtcgaggtaggagctatgtacagtgttgtcttctttcctcccttgctccctctctcccttctgtcctttttttatgtataatatttgagctagattttcttttttctttttttgagatggagtttcgctcttgttgcccaggctggagtgcaatggcgcgatctcagctcactgtaacctctgcttcctgagttcaagtgagtctcccgcctcagcctcccgagtggctgggattacaggcacctgccaccatgcccagctaactttttgtatttttagtagagatggggttttgccatgctggccaggctggtctggaactcctgacctcaggtgatccacctgcctcagcctccgaaagtgctgggattataggcgtgagccaccccgcccagcctaggttttcttttagcagagcatgcaccctcttattcatcatagtttcttccattccctgttgcctgtcctacaccaggtagctttacacatttgaattattattttcctggcccctgaagacatttgagttctgttttcagaacactgagcaatttgcaaaagggagggatatttataacagttagtatttcagagcatttactaaggacaggccgtgcacgagaggtactttccacatattatttcacatatcctacatctttaggaggctaagaaagatgaactagtccagagccacaaagctggtagatagcggaggcaggactgataaacagagcctccccagagtaagccacattacaacacatgacagtgtgtgctgttctgaaacaatcacacctggtcgtcttcttaaaaatttaaagaaataattacagaggcttcaactcagcagcaaactacaactggatctgaaatttaaaacttagaaaagagaaaaagcagaaaagccccagagcaaaactgttaaaaaaaaattacccgcgatggcagaaatcctaaataaaatgagaacaagaggtttttctaggctgcttttgaactaactgttcttgtgtgcatgtgtatatatactatattttgtttaaaatatttttattttactagatcctgagtggaaaattttatttctctcaggacagtgcaaacagagcatcagagccaaaagctggcagctgtgtcctcagaagcagaaccagaatagggaaggggtggcaggaaactgggaaaattctggaaacctctggaaaattccaggctagtcaatcttcagtggtgacagaagccctcttaccctccctctggtttcctaacaggggccaagtgaaggcaatacagtaacagtcctgcaaactactaatcttctatcttcaggaagggctgcctttactgaattcacctttatcagggcctgctgctgtgctctgtgctgaaatactgaggcacagtccctgcccttctggagcttagaatctaaagataaagtctttccctttaaattccacttactcagaatttcaaatatttctggcaaccattttcaagcatgaaatgttttctggaaccctgagatttttgtcagacgtggactgtatcctccagtatgtagatcccaggatgctagggactgagttgtcttccttctccctaaattcatatgttgaagccctaatcccacatgtgactgtaccagaaataggggctttaaggaggactaaggttaaatgaggtcataagggcgaagccctaatccaacagaactggtgtccatgcaaaaagaagagatactggagctctctctctgcatgtgagtcccaaggaaaggtcatgcgagcacacagtgggaaggcagctgtctgcaagtcaggaagagaggcctcaccagaactcaaccatgctgcacccagatccagcccccagaactctgagaaagtaaatttatgttgctaaagccactaagtattttgtactttgtttagtaacccaagctgatgaatatacaggaaaacttccagaccatgtcatattgatgaataccaagcttgcttgtgcagtggggagctggagaaagaatcgtcctcagtgtgaggctgttggcgtctcatcttcactcttgtcttctgaacttgcctagtgcatctgaatttgaacagtaaggccattccttgggaagcaaaacctagaagaaaaagacaagctagtacactttttcaatatgcatcaaaacttggatcctaatcacagctaagaaggagaaaccctctacgaggaactctaaggtggttagtgatcaatgaattaaccaggtggtcttccctaattatagaatctatgaagaggaaaacagtaaggcgtatgtgtaaccattctgcatgtgaagttctatatggttgtcccttggtatcttagagggattggttccagaacctcttacatatgctaaaatgcctaagttctgatataaaatgatttagtatttgtatatgacctatgcatatcttcccatatactttaaatcatctctagattatttataattacctaatacaatataatatattgtattatatattatatgtattatatgtatagatgcattgtatataatacctgatataatgtaatacctaataccttcctgctaaagggaacacagtgttccttaaaaatctctctcaccatcatctctcatcatctttctattatcaatcagatcatcagccgggcgtggtggctcatacctgtaatcccaacagtttgggaggccaaggcaagtggatcaactgaggtcaggagttcaaaaccagcctgaccaacatggtaaaaccccatctctactaaaactacaaaattagctgggtgtggtggcacatgcctgtaatcccagatatttgggaggctgaggcaggagaatcacttgaacctgggaggcagaggctgcagtgagccaagatcagatcaagccattgaacttcagcctgggcaacaagagtgaaactctgtctcaaaaataaaaaataagatcatcaatgggctgcatagatacccatgcaccctgtgcatagtaagttctcaataaatatttattgataataatgacataataattttactctcacagttgcccttgaccaatgccagcaacagcatcattcagtttggaatttagaaaccaaatcttcatgggatcaaccctggatgtctccaacaacagatttcctggaagttttgggatcttgctgatatgacctctcgttggtgccaaattctatcaaccttgaacacatctccagaattttgtgactattctaaagaagacttttgtgctgaggattattaaaaagaaacttcctgtgacatctctagtccagttggaaacaaagcaatcttactcctgctaagcagatatgctgctccaggctctgagcatgtagctggaagggtttgctgctccctgcaggcaatccccatccatgactgcacttgcagctggcgcctgagacaactgctccatcctgggaagcagcctttctatacctttctgagagccctgcataacacacaataacatgttggattatttaacattacatgtaaaggtcaaggggaaaaaatggtaatgcaatgctaagtctaaatgacaattgggaatgagtaaatctggttgtcttggtagttggatacctgctttctgctcctaatagtattaggtggcttagccacctaagctgtcatcccctattccattagattctcctatagccttatgctctatccctaatctttttaagaatatgctactagcttctgaaggacaaatatcagaactatgaaggagacaaaggaactccagttataataagataaatgcagatgaaaaccacactaagacaccatttctcaatcatcagataagcagaaatataatattagataacatactctctctgttggccattccaagggctaataggcattcttatacattatcagcaggaatgcaaaatggtataacttctataaagggtaatttggcaatatcaggcaaaattatacatgcatttaccctttgatgcagcaaacccacatgaagactctatcccaaaataaaagaacatgaaaagactggaatagcaccactaaacaaaccctaatgaaatgaaggatctagacaatgatcaccagcagctgttaggaacacataaagagagacatcatgtgcttcctggtgaagttcacaataaaccctgtaatgtattattgcaaaaaaatcaaactgagtcagaccaagcctctagatttaactgtcaaattataggaactataagggacagaggaacatattaaacaacactttaggcgatgcaatgaacaaaatccagactgtaggaaacagtataggataaacagtctggctgagaatcttccagagttcgtgaaatatatgaatccttagatttagaaatcacagtgaatcctaagcaaaacatatagaaaaaaaactatatttgcacacattgtattgaaaatggtaaaaacaagatcttgaaagcagccagagggaaaaatattatccagaaagcatagctcatgaaaaataggagaaactaacagattgaaaccaaaatctattgtttttaaatgacatacaaaatctaaggtccccttcccagagacgggctacctattggcaacaaggagaaataacatagatacataaactctctgcttaaaatcactgtttgtttcaaaatcactcttggatgggtgcagtggctcatgcctgtaatcccagcactttgggaggccaaggcgggtggatcacttgaggtcaggagtttgagaccaacctggccaacatggtgaaaccccatttctactaaaaatacaaaaattagtcgggtgtgatggtgcgtgcctgtaatcccaggtattcaggaggctgaggcagaagaatcacttgaacccaggaggcagaagttgcagtgagacaagatcacgccattgcactccagcctgggcaaaaagagtgagactccatcccctgcaaaaataaaataaaatagaaatcacttttgcctatttttcttatttctattaaggcgtgggaagaaactgtgtccaggtaggagagttgaaattagatgtcactattagtccttgatttctgctcttaggaaacaaataaaagcagttagccagccttccttgcttggcacggtcactttgttgcgcttgcaaagatttggttgggttctgagcgacagctctggtgtctgccatcaacaccaagtgggagataccaccccaggggtgaggatggtttgcacaactaaagaagccactatttgggctgaagacaggagcagcgggagtggtgcatctgataagataggagatcaggcaagtgcaaaactcttctggctggtctctgcctcctgggatcctacaacttctattatgtgaaatcaaaaagaaccacagtacaaactgcctcagagaagagaagcagtcttcaatttggcagaccccagaaccacttctgtgatcattcaggcctcactgaacaatcaaccagagcaggacaatacctgctctggcttggaaaaccactgaaccatggcacttggtgggccagcctcagccaaggccatagggaccttaactggcacagacagagatctgagcaatacggcccctcagacaaaggcttctaccatccctgacaacaaatcaccccatctcagcttgggctgagactttcacttccttcccttgtgaagggaaggaagccttcccttcatggcacatgagccatggaaaaccagcacggtatgtacccaactcagtgcatgcaattatctcatttagttcctaccctgtgaagtcgtacctatccccattatatatgggaagaaactgaggctgggagatactaaataacccgttggtaagtggaagaacttgcaagactgggtgactgcaacacccacattcttcaccactgccataaaatgtttccacatattcaggccagcctggcggctcaagcctataatctcggcactttgggaggctgaggtgggtggatcacttgagcttaggagtttgggaccagcctgagcaacatggcaaaaccccatctcaacaaaaaaatagctgagtgtggtggcatgcacctatagtcccagctagtcaggaggctgagataggaggatcacttgggctgaaaaggtcaaggctgcagtgaggtgagatcacaccaccgcactccagactgggaagcagagtgagaccctgtctcaaaaacaagaaaacaaaacaaaacaaaaaaggtttctacatatttaagactcctgctcctaatgccttcgatgaaagaaattcaggcttgcacaccccggctgatttcataagcttcatctaataatctttatcccttttactcttagagagaaaactgtcctactggcacccttcaaaatatttactctctcaagagagaagaggttgtcctccaacactttctcaatcttaagagtgcctggcacgaccaggtgcagtggctcatgcctgtaatcccagcactttggaaggccgagacgggtggattgcctgaggtcaggagttcaagaccagcctggctaacatggtgaaaccctgtctctacagtccccgctactcaggaggctaaggcaagagaatcgcttcaaccagggaggcagaggttgcagtgagccaagattgtgccactgcactccagcctgtgtgacagagcaagactccatcttaaaaaaaaaaaaaaaaaaaaaaaaagagagtgactggcacatcgttcctccaaaaaatacaataatttttttctattattttagagatgggtatcaccatgttgcccaggctggcctcaatctcccgggctcaagcagtcctcccgctttagcctccccaagtgttagaattacaggcgtgagccaccacgctcagccatagaagcatgtctccagccctagagctggaccatttacttcagtgtctctggccaggcacactgaggatgataaaggctgctgatgccacggcactgactgcaccctcaggagagcaaagcattgccaaagaagcccaagctgttcggtggatgaacagatcccaggtacctggaaggctgagatggaggatcacctgagcccagggaggtcgagactgcaatgagccatgattgtgctactgcacaccagcctgggtgacagagtgagaccctatctcaaaaaaaaaaaaaaaaaaaaaaaaaaggcccggcacagtggctcacacctctgtaatctcagcactttgggaggctgaggtgggcagatcacttgaggtcaggagtttgagaccagccctgccaacatagtgaaaccctgactctactaaaaatacaaaaaaaattagccgggcgtggtggcgcccacctttaatcccagctacttgggggtgctgaggcaggagaatcacttgaactcgggagacggaggttgcagtgagccgagatcgcgccactgcactccagcctgggcgacagagagagacatcatctcaaaaaaaaaaaaaaaaaaaaaagtagcaggatatgccccggctgcctgctactctgtacaaatgataaccaaaggcacatttcatcaaggggctattgagaaacacctggtttacaaggttttgaaaagttttgaaataaccatcacttgagcttcattcagcagttggagaatcaacccaaagatagaaaggtgatatttgatgtcctgtgactactgcatttatttcagtaatatcaatattggcagcaggatgggcctaaattgggtggggagggtgtttgcttcttaattaaaggcccttcctcacctcatatctattctcattagtcagtaactggagacagccatctatgaaagattttgtttttcaacggtgttttattttattttcctaaaatgtcagttggatggccaaggaaatttttcccccaagagtccttggagattattttgagccgaaatagccaccatcacggttggctgagcactaaatgaaaaatagtgttagatgtcaaattaatattttaggaccgaaaatgtacaaaccctccctggcatgtcagccagcgtcatagcaagtgttagctacaaaactgcagggtgacgactggaaggctggagccacaagtggccatcagttcaagagctgaaatccaagagcaggagagagaattacagggagtaggtctctattcatcaaatttggcagactagaggggcaagaaaagacaagagtgatgacgtttttaaatggattcattttgtgagatgactgctgggtgaaaagcagtggattagggctttgtcaaaaccacagctgaagccttaagagaaaaatatgatactgtagaaaatgacaatggaaaatatagcaatgtgacaaaagcaggctacaaaccaaatgtacaacattgtccaatttttgaaaaataccatgagagggggagcacacacaagtgagtgcaagaagcctggttttgccacagaatgttctagaatgttttcttaaaaaatacagatcctttggccccacccctagaggttctaatttattagatctggtttgggtctcaggtacatgggtttcttttttttatactttaagttgtagggtacatgtgcacaatatgcaggtttgttacacatgtatacatgtgctatgttggtgtgctgtacccattaactcgtcatttagattaggtatatctcctaatgctatccctccccctcccccctccccccaccccatgacaggctccagtgtgtgatgttccccaccctgtgtccaaatgttctcattgttcaattcccacctatgagtgagaacgtgcggtgtttggttttctgtccgtgcaatattttgctcagaatgatggtttccagcttcatccatgtccctacaaaggacatgaactcatcctttttatggctacatagtattccatggtgtatatgtgccacatttctttatccagtctatcattgatggacatttgggttggttccaagtctttgctattgtgaatcgtgccacaataaacatacgtgtacatgtgtctttatagcagcatgatctataatcctttgggtaaggtatacgggtttttaaaagctttttaggtggttctctctgatatagagcaataaagagagggttggggggaggagaaaaaagatcagagatagctttatggggcattccattttttttttcttttctctttttttttttttttgagatggagtcttggtctgtcgctcagactggaagctcagtggcacaatcttggctcaccacaacctccacctcccgagcaagcagttctcctgcctcagcctcccaggtaggtgggatcacaagcatgtgccactatgcccagctaatttttaaaaaattttaattattattatttttttagtagcgacagggtttcaccaggttgaccaggctggtcttgaactcctgacctcaggtgatccacccaccttggactcccagagggttgggattagaggtatgggccaccgtacccagcctcatggggcatttatgatttaaatgttttgccagtggattttctatatttacatattgctccatgaatatgcattgtgtttactctcagaaaaggttattagtacaaattctaactcaacttcttaggagaaatagcctctggccacaataataataatgattaatgcttacaaagtgcttcctgaatgccagacacggttttattaatgctgccatttagtcttgaaaataactctgatgtaggcaccagtgttgcagccattttatagatgagaaaatcagaggccagagattctagctcagacaactagaaaaagacacagtatgagcatagatagggactgttactgggagcctgaggcttcactcccacattctatttcatcctagtgaacaggatgcttcggacaggaagaagtctgtggttcagacacccacctgaggcactgagggctcccctcagatcacatcatcccatgcactctggctcctgggcctcaaggtgcctgctttgagcttccctgggaagtcatgggaagtttctccctgccttcccatcagtgtcctgttccttccagagacttcccagagtttgctacttgcctgacaggaagaattctatcgccaggcaagctaaacagagggagaaagtatgaagaaattgaacaccccaggacactggctggctattaaggcatgccatcaccaatcctttgaaaaaattcttaattggttttttaattgaagtggagaatgaacttctgtgaagtaccccataccattgtacatgaggatacagatatgaaatctacaggggttttgactggagagaggacagagcattcattgagattatttccccattttgcagatggcggtgccaagtcattaagtaatgtcctaaaagagaaaagaatgagttgatgcccctcccagaaccaaaggtcttcactagtacaaaaatgttgggagccagccccccaaaacctggccataaactggccccaagacttgccataaacaaaatctctgcagcaccataacatgttcataatggctctaatgggcaagctggatggttgtgggtttaggggaatgaaggcaaggaacacctggcccgcccagggcggaaaactgcttaaaggcattcttaagccacagacaatagcatgagcatctgtgtcttaagggcgtgttcctgctgcagttaactagcccaacctattcctttaattcggcccatcccttcacttcccataagggatacttttagttaatttaatatctatagaaacaatgccagtgactggtttgctgttaataaatatgtgggtaaatctctgttcagggctgtcagctctgaagactgtgagacccctgatttcccacttcacacctctatatttctgtgtgtgtgtctttaattcctctagtgccactgggttagggtctccctgacaaggctggtcttggcacaaagtattctgtggattttaaagattttacaaaatcagtaggtattttaattcattctctttcatggtaaggttgccagataaaacacagcatgccctgttaaatttgaattttgaataacaaataattttttgtaaagtatgtcccaaatattacataaaacatatatatatatgttgttgttttgttttgtttattttattttgtttttttgagacggagtctcactctgtcgcccaggctggagtgcagtggcacgatctcggctcactgcaagctctgcctcccgggatcacaccattctcctgcctcagcctcccaagtagctgggactacaggtgcctgctaccatgcccagctaatattttgtatttttagtagagacggggtttcactgcgttagccaagatggtcttgatctcctgacctcgtgatccacctgcctcggcctcccaaagtgctgggattacaagcgtgagccactgcacccagccaaaacatatttatattttaaaattatttgttgtttatctgaaattcaaatttatctgggagtcctgtatttttatttgcttaatatggcagccctatttcatgggaaacatgatttattttctccttggagattgctttttttcctcagtgtcactagctcaatgatttgaagaagcataaaccagaaaattaatcccagcccatccttttgtgccagacacccacagggtcagttcttttggtagtcagtgagtattacatattgcaaaagcacacatgcatgcacactcacccacacaccttcaagcacacatgcacacactttcacatcaatgttcttacactcatacatacagatacaaatggattctgtttctcctaatatcctaaaataaaaatccctcactccattcagattttcatggctttccaaacacatcattctcctttttggtcagtgtctgtctgttcaaggagaaagtcatatccccagcttgctttgtgtgctcagctacactgactcagcttcccacagagtaggctggcactgagactttatctcttgtatttcagaaaatttgaattctcttttcttgccattgcataaaactgcctgttttagtataaagggatgaaagttgtcttaggatcagataatgaatgcaacttactaacaagaaaaagtacagaactgagaattgaaaactcaagccatataatgaaaacatttgaaaatgagagagaagaaaaaatttttgtgtattcacaggaagcagtatagcacagtggttaaatcatcactcccatagccaggctccttgagttactagatggccaaattatttaccctaatccgtaaagtggaaataataacacctgcctcctaaggttgttgtggtaattaagtaaatatatagaagatgtatgaaattgtatctgacacatagtgtttgcttttataatgatcttcgatttgccaggcacagcagtagcttcttcatgtgtatcctcccgtataattgtcgaaataagccttgagatgtgtggacatgaggaaactgaggctccaagaggttgacttgcccaaggctacacaggtggcatgcagcaaagccaagattcaagtatcaatctcaggacacagccacccatctctcaattacccagtattaaggcgacaaaaggtggaaggttgatggttctttagagaagtgacagcattccgtctacaattgttgcttttgtgggatggtggtgcatctggagatgtttgcagtggtgcttttgggggaggacaggaccctttgttttggttacagacctgacccaagtgtctgccaaccagatgaggaccttactttcttgtgacttctccaagcaaatccccaggaaacgggaagccctgatcccagactctgcctggctttccatcattaaggcagtataaggcagggtccgtcggcatgcggtggggggacagtggtgccagcaggagccccaggactctatcctcaactctgttctctatttgcacgcttaccatagatcatttcattcagtccctttgtaccatttataggctaatgattccctaattcatgtctctagcctagacctctcccctgaactcagactcacaactgcctactcagcatctccactaggatatataataaacatctcagagtttacaaatctaaaactagattttatttaaaaaagcaaaaacctgcttcacttccagtgtccctgggtcaatctatggcaattccattcttccaatagggcagtcctaaagacttgagatcactcctcacttctctctttttatggcttgactatccaatctgtcagctcatcccattggttccaccatcaaaatgcctcctgagccagactaccttccatcatctccacatctaccattttggaccattgcaatagactcctggtctccctgcttccaaccttgcctcctgccatggtctattcttcatactgcaaagtattcctgttaagacataactcaggttacatcactgttttgctcaaacttctccaaagcctcccatttcagaggaaagtcaagatcttccatgacttgaaaagccctccatggtcttagcctgccccagctctctccaacctcacttcccgtcactataaccagccccacctgcaccagctgctaggcctccatgccagtccttgcataaaccaagcacactcctgcattgggcctttgcacttgctcttcttcccatgggacatactccatccaccacaaagtcctcatgcctcacaacccaatgtccttcaacccctgctcaaatctcaccctaacagagaggattaccgcatctacctgcataaaacagccacatgccatcctcatctgagcattccctctcccctaaactgtcttatatatttttttcacagcattcatcctttatcagcacctgatgggatccattcatttattcacttattgcctccatcctctggaagggaccatctatgtggatagagattttgtctgttttattgactgctatatcctcagtgactggaaggatgtgtacacacagtaggtgctcaataagtactgagtgaatggaaagagccttctagatagtctcgtgccagctgaacagactgcttcagcttccctagcacacaatcaggctttcagaagactccgtcctgtactcctttccatctaaggagtcacagctctaggatgatactacatacagtttctttcttcctttctccctttctctctttctccctttctctctctctctctctctctctctctctctctctctctctctgtcttgctctgttgcccaagctggagtgcatgatcataggtcactataactttgaacttttggcttcaagtgatcctcccacctcagcctcccaaagcactgggattacagacatgatccatcatgcccagtcacacagatcttttctgatggcttgcttttgtgttttgtatctctgctctgtttgatttggcagaaaaggctcctgcgcaaagccacgtgcaagtctccctgtatgtcttggctgctcctgtgctcctgatggaaatgtgtcgggggacattattctaaaggatccaaatcaagccgcaaatgatgaaaacctcattgctcaagtagagaggaaaacaaatccatccatcctgactcccactgccatggaaaccccaaatgagttcaaaaggccagtacaggcaatgcttgcagcttttcttatgctctcttgtcatttcaggggattgtgtttgcaggcacatgctgagaagaggaggccttttgaatggaatgcaccaaggaggaagctttccaaaacccaggctaatcatctgtagcagcatcaacataattattattatgtgaggagtttgtagccaaacacttcggtacatctattagggaccctcaaaccacaccaagtgctcagcctctctgcagaaattcactcaccccttaatcaagcaacgctattagaggaaagctttgctgattcagctgggaggcatcaggcaatcctctggcttctgcagcatctcctaacaaagtgttgcttctggaaccctagaatgaacattgaacattcattgcaagtgtcaaatactaggacctgtgatatctctgtacccattcctaaaaagacccaggtatatccaatcaaaagatccaggtaggctgggtgccattggctcacgcctgtaatcccaacactttggaaggctgaagtgggcagatcacctgaggtcaggagtttgagaccagcctgaccaacatagtgaaaccctgtctgtaataaaaaaaaataataataatacaaaaattagccaggcgtggtggtgagcacctgtaatccctacttgggaggctgaggcaggagaatcgcttgaatcgcttgaacccaggaggcagaggttgcagtgagctgagattgcgccactgcactccagcctgggtgacaagagtgaaactccatctcaaaaaaagaaaaggaaagaaaaaaagatccaggcatagcaaaggataaatgaatattatcctccagaattattattagcaaaactgtcactaggccagagtgtctattaatgggtcccaggttcaagaatgcatgttccatccacataaagacagtgccccagtggaggtgcttaactctgtggtttttgatactcagatcagcaatggcacctgagtattcctgaacattcagccagcagaaatttctagctcatcttttaagtatatataatatgttggccaggcacggtggctcacgcctgtaatcccagcactttgggaggctgaggcggtggatcgcgaggtcaggagattgagaccatcctggctaacatggtaaaaccccgtctctactaaaaatataaaaaattagctgggcatggtggtgggcacctgtagtcccagctactcgggaggctgagacaggagaatggcgtgaatccggaagtcggaggttgcaatgagccgagattgcaccactgcactctagcctgggtgacagagcgagactccatctcaaaaaaaaaaaaaaaaaaaaaaaaaaagaaagtatatataatatgtctgtgtacatcatattttattttatctgtcatccatttttaagacagaccattattttgtgtaaaattaagaaagaaaatgattttgtcaattaaattagaatgagtcattgattgtaagatgcgtcctgatcagagacttaaattgtaaaaacataaagcaattgttaaaggtcaacattcagcaggacacaatgaaatcacgttcatgatatctgtgttttttattcgcttacccccatctttcatctcatgctggtagttgacagaactagagagaacatcaaatgttaccaaacagaacacatcaaactcagggagtttggcacatcaaactcggggagaagagcattaacagttttccaaatttatgcattgacaacgagcattttaaggctccaaaatgcagttgattgctaaagagtaactacaagaggcttagaccatttacaggatggaattagaatggcataattcagcagaggggatagacctcttagcaggagagacaagagaaagtataaacctacaaaaagacaccttctggggaagcactcacatgtttgagcatgctgtctggttagagtaggcccaaactcaaaacttttatttctaacctgtgaccccagacatctacacacccaatctgagtcaaacagaaggaattgttcttttctatttcaaaacttcatggagaccaggcatggtggcttacacctgtaattccagtactttgggaggccgaggcaggtggatcacttgaggtcaggggttcgagaccagcctgcccaacaaggtgaaaccccgtctctactaaaaaaaaaatacaaaaattagctgagtgtggtggtgcacacctgtaatcccagcttcttgggaggctgaggcaggagaatcacttgaacctgggaggcgaaggttgcggtgagccaaaatcatgccactgcaatccagcgtgggtgacagaaaacaacaaacaacaacaaaaacatcatgtctcaaaaaacaacaacaaaaaaaaacttcatggggggggaaaagctttaagcacctagcatccattctgtagcaaaagctaataatattcatgcactggaaacttgtattaatgagggttctccagagaaaagaaccagtaggatatatatacagatatattgaaagagacgtattttgagggatcggctccccagttctcagggctttcagatgcagactgggacttacaccatcggcctccccagttctcagggctttgggtttgaactagaactataccaccagcttttctcgttctccagattgtagatggcagattgtggggcttctcagcctccacagttgcatgagcttgtttgaatgagaaagcaattgcttgaagcaacagcagacaatacaaaattcacattttatattgaatcaggaagaggaagcaaaagtataaaatgatgaatctcccctgttccccagttctgctcgggctttgcccactctttcctgcctgcatgtggatatttagaaagtgcacagaggcactggcgttccaaacagtcacccaccgactcggcttcttgcactctgtttgtaactcattcagaaactgcaaaatagagtgaagaagaaaaagcaggtgattttccctgccttcttttaccaaagagggggcatgctgtggccttatttctgcatcatcttgagctgatagagtgttcctcagtcatccccaaaccacagctgggctgctcttccctcctgtacccctgctgaaagtttcggtctctccattttccttaagctactgcaaatcttgtcaccataagggccagacactttgccctggcatgtggaaagacacagggcttgatggcacttgcaaaggggactgtactagtctccatttgtcccccatgcctgccaccatcctttgccctcctctacctgcctgggggcccccaaacgactgatctctagggctgaatcacccaagcccctctgtcctcaggttagacctgggggaaggagggacaggaagtggttggaaagctggtggaagcacggaattagtagggcattacacagatcaaggttcttagttgcagacaatagaattcattcaccatggctagtttaagcagaaagaaatacatgaaaaacttcatttactccgatgtgattattatacattatatgcctgtatcaaaatatcctatgtaccccataagtacatacacctactatgtacccataaaaactaaaaatttaaaaaagagaaatacatagaaagaactaaagagcttatagaatctttcagaggaccagagaaccaggcttgaacactactcagccagaaacaatgcagccagaaaaaaacgtcctctgatggcatgcaactgtttccatgcacaccccagcagaaccaagtgcttccaccactaagcttagcagagaatctgttctctctctgggctcagccaccaccttgctgctgtgcctcacacgttggcagaaactgtcgtgaatatcaatctagctgcaagggagtctaagaatgtagttttttgctttcctgatcgaaagtgattcaaatacgtattgaatgagtcaacttacagtatctgccgcaataattttagggctcctttcctgtggctttattaatatgatttgtgccagaaagactgtgaggtatggcgaaaagaatatgggccatgaaatcagatagaggtggttctttcttttccttgaacacaccaaatttgttcctatcttagggtcactgcatttgttcaccttttgcctgaaacactctgcaccagtatcttctcatgggtcttcaagttccagcgcaaatgttacctcctcagagaggctgccttccctggccagcccatctacagcaacccacctcaccctcacctcccatcatctcaccttttaaattttctttttaggacttcactgccattttcttgctttttgtcgtttatgatccaagctcccctcatcccaaatagaatataaattccataagagcagggacttgctctgtcttgttcacagctgtgtcgctggagcccacaaaagtgtctgatacacgacagtaatagcattgattatataattaccatctgccacatattgtttaatcctcatgctactctttatgaaataattactgttatctttgcccttgcagaagagaaaatagaagctgagacagggtaataattatttgtctcaggccagacagcaagtaaatcatggattcaaacctaggtagtctggctccagagtctaaactcttaactgctatagcatgctgaatatagtagatgttcaataaatactttgtgaggctgggtgtggtggctcacacctgtaatcccagcactttgggaggctgaggtgggaagatagcttaaggctgggagtttaagagcagcctgggcaacatagtgagacctcgcctctaaaaaataaataaaaatgttgtggctaagtgaatggacaccttgtagtcatctcactgacactgtgttgcatttaacactgctggattatctatttctccatctctctcatgggcttctcttcctgaaacccctttcccccttccttaaacactagcgttccccaaacctccatcctgtgtcagctgctcttcttactacctgctctcttgggtgatattattcagcatcatgattgaaccatattatatactgataagtcccagctcaaccataaatctctagcatcgactctcccagagtgagagaattaaatgttcatggcttcctgataccaccctttttatttttttattttttaatttttttatttttttttttgagatagagcctcactctgtcgtccaggctggagagcagtggtgtgatctcagctcactgcagcctccacctcccaggtttaagcaactctcctgcctcagccaactgagtagctgggattacaggcttaatgccaccatgcccagctaatttttgtaattttaatagagatggggcttcgccatgttggccaggctggtctcaaactcctggcctcaaatgatccatccaccttggcctcccaaagtgctgggattacaggcgtgagccaccgtgcctagcctgatatcaccttttgaggatgctttgggcatcccaaactcaacaaacacaagttaacttaatttgctgtaggtacagtcaggttaatcccagccaggctgtgaaaagcattccatttcatcttcccccaaacaaaatctgctccttctcccctatcccccacctcagccaatatcaccaccatttatccagcttccaaggccaagagcctggcaggcattttggagttttcctccctcgcctcattgcccacctgtgactaagtcctgtggattctacgtcttaagtagttctccaatccatcccttcctctctattcctgctcccagcgggactattgaatgtattctgaagatcatatattacagttgtgttgcaggaaaggggtcccgatccagacctcaagagagagttcttggatctcacgcaagaaagaatttagggtgagtctgcactgcaaagcaaaagccagtttattaagaaagtaaaatggtgagaagacagctactccttagacagagtaggatgttgccgaaagtaagaggaggaacacattcaccctagggacaatgcttgtatatatagggggatgtgctctgctacaagggtttgtgataaagaattaattttcttcattactatgttttgcaagaattgatattattatctttaaagcaaaattaggaatgcctttgtgctccagatattgggatatctgcacactcccaagtctgggcctgtttagcaaacattattaatttgttgcccgaaccataaacctctagaggccaggaatgcctaacttctgagaatgcagcctagccagtctcagcctcattttcctagccctcactcaaaatggggttgctgtggttcgaatgcctcttacagtagcatcctaacttctctacctgtctctggtcttgctcccttctatgtgtttcccgaataccccagcatgacctaactgcagtagaaatctgcttgctcgactctagcctccccagtggctctgccattcattgccttcaggacaaacttccagcctgttaaaaatcaaccttgatgcagtccctgcccacgcctccaaatgtggcatcaagcctccctcccccgacctttaccatcaccctatgcttcagaaatagccaggtcaccgcatttccccagcaaaactcacatagagtcatgcttttctccttataaaacagtgatcagggaaagccagtcaacttgagaggagagggatggacatcattagagcttttcagtcccctattttagtttctccttgaggcccagctgcagtcctgccattttatttcaccagacactccaagagctttataattcagactcttcatttgcttctgcgagctctcattgaagtctgttatttgcaaccaaaagagttccaacaaatgcactgatgaactgaaagaaaaggcgtctatttacatgaaatgatttgcatgagaggaaagaaggagccacttcccaggaagagagagatgggactggggaggatggtcgcgccagccccagggattcgtatctgagcacggtggcaagagaagctgcaaacagaagacaaagcctgttttacaaaggctccctcttgaagcacacagtttgtgtgcccaagggacaaagtgccacacagagcagggccttcttgatgcagtgcagctttggcacatttagggttcccagtaacaagaaactgctctggcatctccagggctggctgtccagggatcactggaagttggcattcttgggacagtcttagggttatcccagggggcaccagcagtttgggtggtggaaatgcacattctcaaatggctagctgggcaaaggatatctgtgggtcagagcacaggaagaaggcatcacattacccagtaactgtagaggatacacttgtttgcaatataccctctgagaacttccagaaataactgagtgagacttgagtggggtacttgaggcacccaaacctgaagacgttagataaattcagcaaaatatgggttatcaccattaatgtgcccccctttcaacccacaggccaggggaacctgaggaaatcaggttcatggcattaggctcactttaaaaaatgaaaaagagaaagaataaaataacctactaaactataaatggaattacatgcggggcttttattcttccttcaaagtcttctctatagctctcaagatatttatgaaatgtcatctgctaaaagaagtagtttataatttagcttgttaagatttttcttttaattcagcaaagtagaatgggatgaacttatattccagggccacaggtctgaaagtcataaaattatgaaattataaagtcagccaggtgcagtggctcatgcctgtaatcccaacgcattgagacactgaggcaggagggtcgcttcaggctaggagttctaggccagcctaggcaacatagtgggatctcatctctacagaaaattttaaaaaaccggccagacttggtggcacgggcctgtgctcctaagtgccagccactcaggaggctgaggtaggaggatcacttgagcccaggagttcaaggttacagtgagcaatgatcacaccactgcactccagactagtcaacagagcaagaacctaactctaaaaaaataaaaaaagaaaaaagaaaaaaatcacggggtctctggttaatcaaagagctcttgcacattttcctttatctcattttggaaagaagcagacaggcatttttgtaagcttagttttagtcccacattttatattatattgcttgacccaatggtgaaatggcacattttgcacaggctggttgggattaacccaactgaacatacagtaaatcaattcacccatggaatggatgtcaacagagccttaaagagaaactttatctctacagaaaactttgaactaaattcaacttgacacttacatatccttcatgctcttcaagtgcttttttattcttattagtaatgagataatgagtttttcatttgagctgattcattataaaaatcttcttttaggccgggtgcagtggctcatacccgtaatcccagcactttgggaggccgaggcaggcagatcacgaggtcaggagatcaggaccacggtgaaaccccgtctctactaaaaatacaaaaattagccaggcgtggtggtgggcgcctgtagtcccagctactcgggaggctgaggcaggagaatggcgtgaacccgggaggcggagcttgcagtgagccgagatagcgccactgcactccagcctgggcgacagagcgagactccgtctcaaaaaaaaatatatatatattcttttaaaacatcttaactatgtttattctttgagacggagtttcactcttgttgcccaggctggagtgcaatggcgcaatctcggctaaccgcaacccccacctcttgggtacaagtgattctctgcctcagcctcccaagtagctgggattacagacatgcaccaccacgcccagcttattttgtatttttagtagagatggaatttctccatgttggtcaggctggtcttgaactcctgacctcaggtgatccgcccgcctcagcctcccaaattgctgggattacaggcgtgagccacagtgaccggccaactatgtttattcttgtaacagcctggagacatgaaatgcaggaccattagttcactggaagattaaaaacttggggaattatgtttttcaaacataaactttcaagtaaatgaaatccaggaattaaacttgctatgtgataggaattgtccacagcaattcacaaaaccttatgagaaagacactgttgttatccctaggtcatagacgaagaaacagaagcttggagagcttatgtaactgacttgccaaagaccccacagcttgtgagtgttagggcagggatttaaggcaacctgactacagagcccacatgtactgatcaggatactctgcaacctcccagcttctcctacctcctttcttgagctagcgtgtgtgtctttgggctgttttgttaccaactctgactccatctatacgtgatcttatcttacctagcccctaagaaagtctaactggcagccaagtgcggtggctcatgcctgaaatgccagcattttgggaggccaaggcaggaggattgcttgagcctaggcgttcaaaacgagcctgggtaacatagcaagaccccgtctctatttttttaaaaaagaaagtctaactggtttagcttggattatggtccacatttaaatggtgaggacatgggctggagagtcccttaaatgcacccactacatcttgttgaattctctgcactcaagactggaacaaccaccacaggcaataatatagcaagaggagagtggcaggaaaactaaccagtgttgattacctagtaggtaccaaacactatgcgaagtgttttaaatgcattacctcatttatctttataacaacacaagggctaaaggagaccaaagactaccaaaaggtcaatcaaaaccatttctaaggttaaagaataaagataatgcaagacattagaaagccccaacagcataagaggaatgaggataagaaaaatggcactaaggaagagccttgaaaaaggagacttaattttttttcttaatttatattttgaataaatattacagtaatggggctgggcgcggtggctcatgcctgtaagcccagcactttgggaggccgaggtgggtggatcacgaggtcaggagatcgagaccatcctggctaacacggtgaaaccctgtctctactaaaaatacaaaaaattagctgggcgtggtggcatgtgcctgtaattccagctgaggcaggagaatggcgtgaacccaggaggcggagcttgcagtgagccaagattgtgccagtgcactccagcctgggcgacagagcaagattctgtctcaaaaaaaaaaaataaaaataaaaataaaaaaataaaaaaataatatatatatatataacaacaatggtacaaaattcaaaagatatataagagagttttttgttatttccttgttttatatagtcaaaacagtttattgattgggaccataaacttttcttttcataaaagtttcataatggacatttgtcatttgtgtctgcctcaaatctttttttggtagttcttctatgttgtgaattctcttttccataggaagaaaaaaaacaaacatgccgggtgcggtggctcacgcctgtaatcctagcactttaagaggccgaggcaggtggatcacttgaggtcaggagttcgagaccagcctggtcaacatggcaaaaaccccgtctctactaaaaatacaaaaattagctcagcatggtgacatgcgcctgtagtcccagctactcaggagactgaggcaggagaatcgcttgaacctgggaggcggaggtggcagtgagccgagatcgtgccactgcacttcagcctgggagatagagtgagactctgtctccaaaaaaaaaaaaaaagaaagaaaagaaacaaacaaacacaacacatttctttcaagaccctttgctgctaggatatagacatttgactatcttccaacaaatccaaacctaagcaacacttgaaatataggtgacaggctgcagacacacaatattctagtaagtctggacacaatgctgcctggttttctgcacgaactgtaatgagggtcctggtggtcagttctggttttatagatgttaagcatcatctggcagcaacagcaggatttctgctagaagagtcttaggatatttgggacatgtgtgggatgcttggacattcctcctggctgcttcacttctggctgtgtaatatccaggctttgtttctcggctctcctagaaattctaagtaataccatgtaataaagttctgctgaaactagctagactggcttgttttcctgaaagagattccaaggtattgggaatctggaattgactaggtgacttggttggatttggaagtagtaaggataggatacaggaaaaacatgacatctggtggccaggaagtcactaaaaccattgttagagaagttagcatgacactattcctgcctccatttgttttttatttttatttttttaagagtgagtcttgctctgacacccaggctgaagtacagtggtgcgatctgggctcactgcaacccccccctcctgggttcaagcaattctcatgcctcagcctcctgagtagctgggattacaggagtgtgccaccatgcccggctaatttttgtctttttagtagagatgggtttcaccatgttggacagggtggtctcaaactcctgacctcaggtgatgtgcccgcctcagcctcccaaagtgctgggattacaggtaagagccactgtgaccagccgctgcctcagagtagattgaagcatcaacagattaaatctcaggatgccaaaattagattgagaccaaccaccacaccccctcccccgccacctacctcacccctgccatgcaggatttagaacaggagtgaaggagacccttttccacatctcctagggttctcgatgaaatcaaagatacaaaaggggtcagtgggaagatttagtagaagatggttgaggagattgttttgaagagggttttgctctgctgtgagccctctccccttaggatgagaggcagaggctctgtctcccaaccataagcctagtgagaaggtttttagttgtccactgggagagcttttaaacgtgtgccttgcagttggaagacacagaagactggggcggcctgactaaagagcaagaaacttagagtgcaccacgaactgaagtccaactccaccaagaaaattcagaatgttttcctccgttacaaagctggctacgtgctttggagatggaagaacaagcagggcttctatattgggatcagcgggcactcctggagtttcctgaggcaaaggatgaaggagacttcccaagaccatatgggggtaacacaagacaaggcttgagtcctgtctaccaggtcctctgagaaggacctcagcagaaagcagctgagcacgttcagctggatactcagaggctgaggaaggatttgaaagagacaagctggaatagagatacatccacttgagtcaagggaactgcaggagagcgggcctgcagggagcctctccagcattcctattcaagggccagaagagaaagaatcagcttgagctatcgtccaggccccctgggggttaccagctttaatcatctgcagccccagagagcacgaagctaccagatcaagtagtgactcacttacccctttttcctctcatctctaccctaccttcaaccctggaagagaaagaaaatgacagctagtgggtagaagtgagggtgagcagggaagaaaaaccagagaagccatcagaagtttcttccagggctagaggaaggcccctgaataaagtttaaagagttggtgagaaacaaatataaaatcgcattttgattaaatcatgagttgtgttcatagatgtccacgtcatccagtggcagaacaccaaaattatcacctgtagtgacacagaatgaagtgcctattgaaagcaaggccctgggggctgcagcgcggggattataaaggccacgaggtgagcagttacatctaactgcacgatgaagtttaaagaaaagaaatggcattttcagggatttaaattctcacttcgaagcatggtcagtgaatgagaaaatttctgtgacttccttcaagtactcttttatgtcatgcaggttcaaggctaatgaagctgaaaatcagaggcagaggcagagcctgaagattgatgaatctcaaaattgactgaattcacagtcccgctatgactttctgggcattgattgggaaaaggtggtttttcccctgagtattggagtggaaatattttggaggtgttagataacgccaagaatctgaaaccccaggactcacagagcctcgtaggccaataaaatgagagcagcccttcctccctttctgatgaggctggtcctgttttatgcagagaccctgtatcgagctcactgaatggtcaccttgcaacgggatgtggcccatgggccacgaggactctgctcatggtctccagatccacaactagagtcagattctagaatgtcctgaaatcaaaaccaaacctgggaagagaagacttacgtaccaaaagaatagcaagattatgaagaggtttacacttcctgcttggctgtctaaaagtgagactcaatggtggcctgtgcaggagaagtcagatgccacacaatccttgatgcgctgtggaaaaaggaacccaaagccttagagagatacaaatgttggtgtattagtccattttcacgctactataaagatactaccggaaaccgggtaatttataaacaaaagagatttaattgactcacagttccacatggctgaagaggtctcaggaaacgtataatcatggtggaaagcaaaggggaaacaggcactttcttcacaaggtagcaagagagagagagctcaggggaaactgccactttgcttttttttcttttttgggggggacagagtctcgctttgtcacaggctggagtgcaatggcacgatctcggctcactgcaacctctgcctcccgggttcaagtgattctcctgcctcagcctcacaagtagctgggattacaggcaccggccaccatgcccagctaattgtttgtattttagtagagatggggtttcaccatgttggccaggatagtctcgatctcttgacctcgtgatccacacgcctcagcctcccaaagtactgggattacaggtgagccaccgcgcccggcaaaactgccacttttaaaccatcagatctcctgagaactcactcactatgatgagaacagcatgagggaaactgcctgcatgatccaatcacctcccaccaggtcccttcttccatatgtggggattacaatttgagatgagatttgaatggggacacagagccaaaccttcagttagagtggatttataatcactgatctactcacccaccttcagaaaaaacacacattggtgagagaggagttggcattcttgaaaagcggatgccctctgtaggccagggatgatggtgagagatgctttgatggaaagaggtttccttggggggcaaacatcagctttaaccttcaggggcaagcacgtcctgattcctgaaaaaaagcagaagacttagatgagattatcaaaaggatttgactctaagggatatttgagggtgcttaatagatcctagggcctttggggctgaaatacatggacgctaaagtctgacctaatatgtataacaacaaaatataagtctggggaacagaggactgactagtcgtgatgatggcgagtccagtccttcacccaatgccaggcctgagtcactttccaaacccagagccctttgaatagcagggagacaagatgctcttgaggaacaacccagcaatgacagcacagtgtgtactgaagtcttcctcctatcctttcaggaaggcacttgggacaatttaccagggcaattggaccctgggaaaaggaactcatagacctttcaggatgactatcttttaactaatgctaatcctgcaggccccaaatgccatctgtgattctctggtaggtgtatggaattttatggtaatagctgatagcggggcttactcacagcggggactgttcccagtgaccccagtgggtccttgaactcatagttatttcctcagttcttgagtgcttagttgtaatcaaagtaccggcagaatagtcacactggctccctgacctgtgatgtgaatgttattacagttggaagtgttaagaggaaggctctggaatggtccctccctgctgaaataataaaccaaatgctttgtgtctattaactcattgaattttcacagcaaccctatgatgtaggaaatatgatcgtgcccatttacagatgaggaaactgaggcacagagaagttaagcaatttgcccacgtttacatggctggtaagagtgaattcaaatccagtcaaattttagagtccacataccaaccaaaaatcctcagtcaggctgggcacagtggctcatgcctgtaatcccagcactttgggaggctaaggcaggaggaccgtttgagcccaggagttcaagaccagtaggggcaacacagtgagaccctgtctgaaaaaaaaaaattagctgggcacggtggtgcacgcctgtagtctcagctactcaggaggctgaggcagaaggatcacctgaacccaggaggttgaggctacagtgagttataattgtgcaactgcactccagcctgggtgacagagggagacattgtctcagaaaaaaagtccgcagtcagctgagatgcttgctacaggcaaaagggacatcaaaggagtggtggaggaaagatgttataaacaccaattgcgcccttgtgaatattgtagaaacaaggaatgaagtagctattcatgttgagtatagttaagaggcccaggaatagaatttgaagtcagactgaatgggttcagatcccagatttactgctgaagatgttgaaaaattttcttaacttctatttggctcaatttccccataagttaaaaaaaaaagtggggagaagggaacactgatagttcttatttagtaggcttattataaggattaaattaattaacatttatgtaaagtgcctggaaggcagtgtttgctattattatcttccttactgtatcgagtacattttgatgcagttaactaattttctattttatttcttttttttttgagacagagtctcgctttgtcgcccgggttgcagtgcaatggcaccatctcggctccctgcaacctctgcctcccgggttcaagcaattcccctgcctcagcctcctgagtagctgggactacaggcacctgccatcatgccaggctaatttttgtatttttgtagagacggggtttcaccatgttggccagcctgatctctaactcccgaccttaggtgatccacccaccttggcctcccaaagtgctgggattacaggcgtgagccgctgcacccagcctattttcttatagcttttctcctactattttgtatagtctatgtcaacgatggccaagtttacaacttagttcaggggttatagaataacaagatgggctgcttcttcttcttcttcttccttcttcttcttcttcttcttcttcttcttcttcttcttcttcttcttcttcttcttcttcttcttcttcttctttcttcttcttcttctgttattattattaatattattattattattattattattattattattgagacagagtcttgctctgttgcccaggctggagtgcagtgggatcatagctcactgcagtctcaaactccggggctgaagcaatcctcctgcctcaccctcccgagtagctgggactaaggtgcacatcaccgtgaagagggcttattattaaacttgaggaggaacaaccatcactcagaagtcctggacttggagaaagattcaggagctgctatgacttcaggtctctcctttagggaagagagtgaacatgttctcatttttacaagggatagtaacatctcaaattatagaaagttatatggcttaaaggtagattttctttttctttctttttctttttcttttttttttttttgagatgaagtcttgctttgttacccaggctggagtgcagtggtgcaatcttggctcactgcaacctctgcctcccaggttcaagtgattctcctgcctcagcctcctgagttgctgggactacaggtctgcaccaccgcgcgcagctaattttttgtgtgtatttttagtagagacggggtttcgccatgttggccaggctggtctcgaactcctgacctcaaatattccacctgcctcggcctcctaaagtgctaggattactggcatgacccactacacccagccttaaaggtagatttgctgtggatgctttgcttttaaaaattatgactatggtgaatgttcattaatattcacctatagtttatccaattagttacgatgctggttactgatgctaatgctgataatagcatcagactgtagagctcatagaataattatgtaatgtcatctatttcattaaactgtaagctccatgaaggtcagggtcttttctctcttgttttccatcatatacccagagctactgcagtgtgctgcacacgggatctctcaatacatattagaataaatgacccatttattttgagtatgacgattgtattagttacctattgatggataacagatgactacaaatttagcagcttagaacagcacgcatttaatatcttaccattactgtgggtttgggtcaggagtccaggcatccgtttgttgggtcctctattccagagtctcttctgaaagctgcaatcgcatttctgaccaagactgcagtctcattcacacggttgttggcagaattcatttccttgtgggatgttggactgaggacctccgttttttgctggctggcattgaagattatcttcagttcctgccacataggccactccatagagcagctcagagcagggcacctagatccatcaaaaccaggaaggaagaatgtgttagcaagaaggatattacaaccttctgtaacatactaatgtacatgtaatcacatacatcgcattatctatctactaaaggcaagtgacaagtcccacccacgcccaaggggagagaattacacgagagcgtgagtaccaggtggcagcgatcactgggggctgtcctaggattctgcctcaaaattcaccaaatactctcatcagatcagctaacccggggttgttccctaaggaaggcaggatagttaacgtctgcgaaatggcagtgagtcctcattagctcagctctcattatcaaagtctttgcgttgccaggttgcacagggaagcgaaggtcatcttaagatgaaaatatcactaatattatcaaattagtccccactctagcagacatttctcctcttaatgctagttacatccttgtacatcccatttttccagagcagccgcatgctaattatatgagtctacaatgtaaattcaatcaaaccaattgctcaggttcttcaaaagaaaattatttgaatatcaggggctttggagaggcttttgaggaaactgatgaaatgctcaaataattttgcacgaatgatttttgtttgaatcatgttgggaaatttgagtgtgggagattatgtatcctgctatcatttcatgtttgggagaatactatgaaaaaattccagcaaaatatatatttttttcattctaagaaaattacctacatgcaaaacaacctaaataattgaaccttaaaagtaatttggcctggccaggcgcagtggttcacgcctgtaatcccagcactttgggaggtcaaggcgggcggatcacgagctcaggagattgagaccatcctggctaacagggtgaaaccccgtctctactaaaaatacaaaacaattagccaggcgtggtggcaggcatctgtagtcccagctacttgggaggctgaggtaggagaatggtgtgaacccgggaggcagagcttgcagtgagcagagatcacaccactgcactccagtctgggcaacagagcaagactccgtctcaacacaaaacaaaacaaaacaaaaaaagtaatttggccgggcaccgtgactcacgcctgtgatcccagcactttgggaggccaaggcaggcagatcacgaggtcaggagatcaagaccatcctggtctttagcagtgaaaccccgtctctactaaaaatacaaaaaaaaaaaaaaattagccaggtgtggtggtgggcacctgtagtcccagctacccaggaggctgaggcaggagaatggcatgaacctgggaggcggagctgcagtgagcagagattgtgccactgcactccatcctgggcgacagagtgagactccatctcaaaaaataaataaataaataaataaataaataaataaataaataaaataaaaagtaattttaaaaataacatagtttcatagttttactgtttattatagtttactgtaaattttggtctcttgtgagtggtgctttgattcaaatcctagctatgtcagttactagctgtgtgatcttggacaagttatttaactttcctgtgcctcatttaacacatatataacatggggataccaataataatagtatttatagcactaactacaccatttgactctagcaacaaccctgtgaggtcagtgttatggcaggtaccttggacagagtgacctgtggttgggataagatgaccagatgtcccatcttaatctctaaaatattaagccttagcatcataaaccaggacgcccaagtaattagggaagctcagagggtatctgcaagttttggataatttcctcatccaagtctaactggttttggaaaaagttctgcctaacttgaattcacctaaaagagaaaccaaatgatattctctccctctctttcctcttcttcaactaaacctttcatttcttagctctcccctgctcccaaacccacctcttaagttcctccagggtgctatcaaaggtctttgaacagtacccttaaattctcaggaaaagagaaacaatctaaatcaaaaaagcaaatatacaaatattgaaccacaaccaccttccaactgttttgtttgaacagagagagaaaaacccaaagcaagactcaggagtgttaaagttcattttcaaaacacagaacaaacagcgttcattcttaataagtcaacggagcgtaacagaattcagagggaccaaggaaagggttactgtacgacagatcagtgacacaaacataagcggtggagtccacagaggggcaaacacaggagattgagctgctgcttggggcaagaaaggctcgttggaacttggggttctgagcatgaaacctcgcattccccattcaagcaagtcacaacatctctgcttcttcagatgtagagaataacaaaatccttagaggccaagcttggggaaaagaaaagaaatggtggtatgcaagtagtactgaagtagtattgcctttggaaagtaataactaagggagaaaagaagcatgattccatagttggtgctggatacaatctgaagcatctaataaatttatgtcactgtagaaatttcgattccactttgatggaaatgaaaagaaactataggtaacataacacatggtatttaatcataaggcttgaaagaggataatctccttaacaaaagcacatggagaattcaaaaccatggggtggtatttctcgtctcagtaagatgagaaaaggggattggagaatatttacacttccaggaaccccagaaaaacaagaaccaataaatattttctagatgggtcatagatcttaagttcaaaaagttcttattatcactcataactctgatcactaccatttcaatatttaagggtaaaaaaactctccaatataacagtttattacatatgtgtttaaactctctaatatataacctttaatcttgagtctatgatatctacaaagcttgtaaaccatgtccccgttataagtattagagtgttatttgtaggaaattagatttcctcactgtcttggatcacattgcctagaagcagagcctgagacagggattggagtgtgcatgatttgaaggaatgcaatcgggagaaagggagtgagagaaggagaaggcgggagaaggggctcagcaaaactggggtctcaagcctggagaggagcttcagcctgatcctgcggccagctctgcagcatagattacaactcagaataggtcccacattgaggccaggcatggctgacgcctgcaatcccaacactttgggaggccaaggcaggaggatcgtttgagctcaggagtttgagaccagcctggacaacatagtgaaaccctgtctctactaaaattagctgggcatggtggtgcacgcctgtagtactaactacttgggaggctgaggtgggaagatcacttgagccctgaaggtcgaggcggcagtgagccatgattgcaccactgcattccaggctgggtgacagagaccctgtctcaaaaaaagaaaaaggaattgaagaattgacccacactgaagcaagggggccagcctcagaacctcggtcattggctactgcttgtgactggggaggtagtgtaatttctttatttggggtgaggcaattctcgaaagaaggggaaagctgtgagtgctcagcagccaaaactgcagcacctgagggtgggtgcaccagccaggtagaaggcacctgggggctgggcgtggtggctcacactgtaatcccagcagtttaggaggcctaggcaggtgaaccacttgaagtcaggatttcgagaccagcctggccaacatggtgaaaccccatctctactaaaaatacaaaaattagccaggcgtggtggtgtgcacctgtaatcccagctacttcagaggctgaagcacgagaatcacttgaacccaggaggcagagtttgcagtgagccgagattgtgccactgcactccagcctgggagacagagtgagactctgtctcaaaagtaaaaaaaaaaaggccaagcgcaatggctcacgcctgtaatcccagcactttgtggggctgaggtggggtggatcacctgaggtcaggagttcgagaccagcctggccaacatggtgaaaccctatctctactaaaaatacaaaaattagctgggcgtggtggcaggcgcctgtaatcccagctactcgggaggctgaggcaggagaatcgcttgaacccgggaggcagaggttgcagtgagcagatatcgcaccattgcactccagcctgggtgacaagagtgaaactctgtctcaaaaaaataaaataaaataaaataaaggcactgggtcagcacaccaacagcacccagtgcactcactacagctgcaacacgagctcagccacctgtgacaactaagccactatctacaacctcaccagcctgtgtcaaggaatctcactactataaatatggaagagaggttcttggttgtctgtcaccagtgttcgcttttcccattgaagcctgtttgaaataaatactttctctggcagattcaaatataaatacaatgggaattgttatttttccacagccacaggcaaaaccaattaaagatggataaaagtaaataatgtttaaaaaacaaacgttagaagactggaagaaagttgaattgaatatttatcatcattctcaaaggtagatgatttttcaaacctagaagtaaggaggaaaaaatcatgaaggttttatcgtataaaaatgtaaaacttctggccgggtgcagtggcccatgccagtaatcccagcaatctgggaggccgaggcaggcggattacttgaggtcaggaattcaagaccagcctggtcaacatagtgaaatcctgtctctactaaaaatacaaaaattagctgggcatggtggcagacgcctatagttccagctactcaggaggctgaggcaggagaatcttttgaaccagggaggaggaggttgcggtgagccgagattgcaccactgcactccagcctgggtgacagagagagactctgtctcaaaaaaagacaaaagtaaaacttctatccaccagggaaaaaaagaaaaaacaacagtgcattgacaaaattaaaaggtaaacaacagttagcaaagaatatttctgcaaatttagaaacaaaaattccttgtcaaatcaaagttgcttgtgtgttgcagatagtgttttcacagcatgctccttggccatattccggagtaaaacccccacccaacgaaagaaatgttcctttttgagcgctgtcagtgactagctgtgaccttgaggaagttacttaattgctctatacctcagtttctttataatgaggggacaataacagtacctgcctcttttttatcatgagggctgcaagagccacgggtcctactaggaattaattgtccttatttatttattttagaaacagggtcttgctctgtcacctagactggagtgcagtggcctgatcatggctcactgcagctttgaactcctaggctcaagtgctcctcccgcttcagcctcctgagtagctgggactataggcacacgccatcatgcttgcctaatttttttttctttttttgtagagatagggtctcactatattgcctaagttggtctagaactcctgggttcaggcaagcttcccagcttggcctcccaaagtgctgagattacaggcatgagccaccatgctcagcctaattgtctatacttacagaaagaggaaatcaagagttagaaagagaaaggggagctatggtgggtgacacaggacaactactagggaggaatacacagagatagggttgacagagttcaaggaagtatagccagccaggttctaccatgctctggcatgaagctatccttggcagaggtaaagacttagaacttgggtcagggagttgtcaggtgacccttaacactcccctttatctactatgacagaaacaaaattagtttcttcttcatcttcctgggcttcttgtagtggatgtggtcataagaccaagttctggtctatggaatatgagtggaagtggtgggtgccattgctgggctgacatgcattgtgttccttcctttccaacagctggaaattggatctaatgactcaacctggaccttgcagaaggcaagaggcccgaagacagggcagagccactagatggaaagagcttgggtcccagaattactctgcggagcagaactgccaaccaacctggaacacccacactggcagttttgtgagcaagaaataaacttcattattccttacagcactaaattaacaggtcttgttacaacaatttagtctgccctaatacagcaatgttgagctaagcccgttgataaatggcactaagatcctttcctacagaaacatccaaagcattccagaagttaccctaccaacaaacagcaggagacaacacattcctgctgaaagctacacatacaatttaaagtctactgctaggctgggcgcggtggctcacatctgtaattccagcactttgggaggccaacgcaggcagatcacaaggtcaggaattagagaccaggctgaccaacatggtgaaaccccgtatctactaaaaaatataaaaattagctgggcatggtggcgcgtgcctgtaatcccagctactcaggaggctgaggcagaagaatcacttgaacctgggaggcagaggttgcagtgagccgacatcatgacattgcactccagcctgggtgacagagcaagactccatctcaaaaaataataataataaataaaggctactgccaaaagcacttccctttcccctcttggcctaaagtaggggttggcaaactttttctagatattgtacttggctttgtaggccatttagttttacaactactcaactctgccagggcgccgtggcttacgcctgtaatcccagcactttgggaggctgaggcgggtgcatcacttgagtccaggagttcaagaccagcctggccaacatgggaaacccctgttctccaaaattaaaaaaattaaaaataaataaaaataaaactactcaactctgccactttgttagcacaaaagccaccgtaggtaatactgaaatgagtgggtgtggctctgttccaacaagtcatgatttacaagaacagagtgtaggctatttttggcctgcaggccatagtttgctgacccctggcctacaaggacccctggaatgtccactgttagacaatcatttgtttggcctatatgtaggagggtcttgttaaaatataaacattggcagcaaaccaaattgtaaaagtctgcatgttttgtgttctaatgacagccttatgttgcacctgattttcttgagaaagctacattataataggttgacactcctgaccaagggtctaaggttaaacttttataaaaattatagccatcatatttagtcaattaactttatacctgcccaatgtaatgctttctaaaatagataagcatactttaacagaaaaatattgtgaacactcatatcaattttttctgagacaaggtctcactctgtatcccaggctggagtgcagtggtatgatctcagctcactgcagcctccacctcctgggttcaagcgattctcctgcctcagcctcccaagtagctgggactacaggagcaggccaccacgcccagctaatttttgtctttttagtagagatggggtttcatcatgttggccaggctggtctcaaactcctgacctcaaatgatccacccaccttggcctcccaaagtgctgggactacaggcgtgagccaccacacccggcctcatatcaattttatttaagacatttctagagaaagttacgattgattgatctgctaccatggtccagatgctgagttaggagctttaaatacatcatcacaaaaactcctaaggtgcctcacagagggagaaattgaagcttagaggggtcaagtaatttgtccaagataacccaatcaactgataaataacccgccagacatgtttagtttcaaagcctctattctcataccacagcatcctgcccaggaaaaagaagggcatgggttgaaattttgatgggaaactagaggctggctagaagaggctacatgagttctgcttctcaaggcataggtttctatggtcaaaagtatcaggagaagaagcttggccactgcgcatttgtcaatggccattccatgaataactggcatgtattccaagtgggaattattgtaagtacatgtgagtagcctacaaagaggagatatgaaattaataaatttactgagtacctaccatgtgtcaggcagtgttctatatactttacacggattctatcatgtaatcttcacagtaaggtaagtgctattatcatctccattttatagttaaggagacagaagcacagggggattaaagtaatttgtccaaggtcaaacagaaaatggaaaagctggccaggccggcggctcgtgcctataatcccaacactttggaaggccaagttgggtggatcacctgaggtcaggagtttgagaccagcctggccaacatggtgaaaccctgtctctactaaaaatacaaaaacttagccaggtgaggtggcaggtgcctgtaatcccagctattcaggaggctgaagcaggagaatcgcttgaacccgggaggcggaggttgcagtgagccgagattgcaccattgcactccagcctgggcaacaacagcaaaactctgtctcaacaacaacaaaaaaagacagaaagaaagaaaagaaaaagaaaatggaaaagctaggcttgatcctatcagacctcaaagaccacatcttcatgtcctatgctatactgcttcctgaaacagcaaatggtaaaattctaccttgttataattattcttatcaccatccctgttcatttctctaaataacttatcacaacttgcaatgatgtgtattttgttttctttcttgtctctttaaatagtaagtaccatgagggcaaccgtgtctattttatccaccagtctcattcctcatacaatgcctggcaccttgcaagtatttgataaatatttattaaatgagttcatgggccaacaggggaactcatgataggataatgtctatgcaatggaaagtggttcttttcctagtaaaactcaaaacaaataaacaaacaaatcagagttggaacccttgtgtatggctactaggattatgtgatggtacagatggtatggaaaacagtttggtggtttctcaaagttaaatacagaattacaatataatccagctaatactagtatatatgtagtaagtaatagcatttagtacacgtacagtaaattactggtttaaatattagtaattattatgtattccactcctaggtatataccccataaattgaaagctgagacttaagcaaatacttgtacacagaaattcatagtggcattatttgcaatagccaaaagatagaaacaatgcaactgtctaccaatgaatgaataaacaaaatctgttatatcatatgatagaatattattatagaaaggaaattctgatacatgctaccacatggattaaccttgaaaacattgtgctaagtgaaataagccagacacaggacaaatattatatgattccacttacatgaagttcttagaataagcaaattcacagagacagagcatagagtagcggttaccagaggttaggagcagcggggatgaggagtaatgtcatgggcacagtgtttcagtttgggatgatgagaaatcctggaaatgaacagtggtgatggctgcacaacattataacactgtaagtatacttaaggctactgaattgtacacttaaaaatggttaaaatgggccaggcacggtggctcatgcctgtagtcctagcactttgggaggccgaggcgggtggatcacctgtggtcaagagctcgagaccagcctgacaaatatggtgaaaccctgtctctactaaaaatacaaaaatgaactgggtgtggtggcaggcacctataatcccagctacttgggaggctgaggcaggagaatcacttgaacccaggaggcagaggttgcagtgagccaagatcacgccactgcactccagcctgggtgacagagcgagactctgtcttaaaaaaaaaaaattggttaaaatgggccaggtgcaatggttcacacctgtaatctcagcactttgggaggcagagatcggtggatcacttgagcccaggagttcgagaccagcccaggcaacatggcgaaaccctgtctctgcaaaaaaaatacaaaaattagccagttgtgcacgcctgtagtcccagctactcagaaagctgaattgggaggatcacttgaggccaggaagcagaggttgcagtgagctgaggtcacaccactgcactccagcctgggtgacagagtgacactctgtctcaaaaaaaaagttaaaatgataaatattgttatgtatattctaccaacattttttttgaaataggaaatataaaactgtttccaccagcacatcactcaggtcagagagagccaccaagcagcaggcctgctaggggcacatggatctgagagaacagctgtcctcaggataagggtgctggtgtctgcagagcccaagggggctgaatgatggcagtgagtctctggcaatacagatgatactgattcttcatagagttaaactctgagccacggtaggcagagcccagctcatgctggtcattatgataaagtcctgggcgcaaggaagtgggcactccactgcagaaagagtggtgaacctcagacaccatggaaaacagaagattcacaagacagaatcctgctgcaaacatttccataggatggggacagaaacatgtctttcaactacctgtggtatccaccaatcctctgataagaaaggactgaaggctcatgccagggcctactgcacgcgacacaatgttgtccaaacaacaagtgcctgggactacttactgaacactgcccatagctccaagaaaagtgttacacatttttatcattaatactttggcatgaattagcttgctaagcagataagcaagttaatgactttccaaggcccgaagaaagaagatccaggtgaataagtttttgttttttgttttttgtttttgagacggagtctcactctgtcacccaggctggagtgcagtggcgtgatctctgctcactgcaacctccgcctcccgagttcaagcaattctccggccgcagcctcttgagtagctgcgattacaggcacccgccaccaggccgggctaatttttgtatttttagtagagataaggtttcaccgcgttggccaggctggtctcaaactcccagcctcaggtgattcgcccgcctcgtcctcccaaagtgctgggattacaggcgtgagcctccgtgcctggccccaggtgaataagttttgtaggagacagagatagtatttaggaagaagcaagggatagagcctaagtggatagccagagtgaagcccaagagggctggaggccgcaggaggggaggctctgaaatatccaaaggaagctcagagggcacaaaagagaaggtctggcttctttccaaacgttagtgtccatgaaatggagccatctaacctccagagagtagcgagagcctctcatcaaatgcccttccctagctaaagcaggggccctggagccacagttacactcaggcaagctcattctcatttttaggccttattgatgtgtataggtagcaatgatatgacaatgagaggaaagacattgggactttggagccagtcttcaggatgaatcctgcttcttccacttactggcttaggaattacttaaattccctgagaatcagcttattcattcatagaatgggttaatatcaacttaaggtaacaccatataccatggtaattcctattaggtaagtaggtgctatggattggatatttgtgacacccaccccaccccacccagaattcatatgttgaaatttaaaccccaatgtgatggtattaggaggtagggccctttgggaggtgattaagtcatgagagcagagccctcatgaatggggttggtgccttataaaagaggccccagaaagctctagcccccattctgccgtctaaggatacaagaagttggcagtctgcaactcataagagagcctgccatcaggccagggatggtggctcatgcctgtaatcccaaaacttcgggaggccaaggcaagtggatcagttgaggtcaggagttcgagaccggcctggccaacatgctgaaacccgtctctactaaagatacaaaattagctggtggcgcatgcctatagtcccagctacgtgggagtctgaggcaggagaatcgcttgaacctgggaggcagaggttgcagcgagccgagattgcggcactgtacgccagcctgtgcgacagagtgaaactccatctcaaaaaacacacacaaaaaaagaagaaagcctgcatcagaagccaaccatgctggcaccctgatcttggacttccagtctccagaactttgagaaataaatttctgctgtttataagccacccagcctgtgataccctgttagggcagcccactgcctacaacagcaggtaatacttaatgccgtgtccagcacacagttacatgttccatagatgttcatgtccttcttccatccctaattccagtcctgtgctctgcctaccctggagtgagcatgttgctgtttcatttattctgctccctgaatttgagatgtcagaggtcagtgccttctttttagccagcactgtaagaatttgtagcctttattttcacactgcccctcctctgaggctctctaagggcttagcagcctccaagggggaaatgtaaacaatttctattttaccaagagggaagctggaacacaatgcaagatcagctgtttttcccaaaaaaaaaaaaaaaagaaatttcaaattttcttccattcccatggttcattccactgtgtaaacggctgtcctggaaaccagccaagagcagccagcaatcggggaccattgcgggctcctggggactgctgagcaggggctggctggaggaagattttcagtcatcgcatcttctgcaaccctctcagactgcccctcccaaatgatgacacgttcagctcaagagtcatttcattctgaaacaattgccaagcaccaggcgtgcccagcctgtggataggaatgaatgacgtgcttcctctgatctatgtctgtccctttgagaaaacactcactgctaagtgatgttaacctcttgtatcacctcctatttttagcctcttgagtgagtgataaatcaggttataatctgacaggatgtttaaagacatattagaatcaaattaaatgacagggcctcagacatcatacacacttttaaagaacagagccagaacacattatccccgcccagtttcaatgcatacccattgaaacctagtttttgtaaaaggacttggcttatgtcataaggttgactctaagattaactatgtctcctccaattttaatcaagccccatgtacccagccagctcattccaaaagctggagaccgagatgatttctctggaatattatcattatgctgtgagctcagacactgctggtagaaaccatactctcatccatatctgtagggagcacctacttcatgacagccactgcctgaggcactgtggggacagtggtgaacacagaagacatcattcttacccttgtggagctagcttagtgaggagatagatgttaagcaaacaacccaataaataaatggctgggtcactgggttccactgctgaaattatgctatttggcgtctgttttagtctctctcttcatccatcccttatagctgtcttctatttggcttcattttccataagattctacatgactaaggtggccacttgcagctcctgactactgcggtgctaatgaatgatgaccccagagcaatgactgtccccagagtaccaccaaagtttcaaggaggaggctgactggcccgattcagatcacttgcccgttcctggacccattgtggagaactgcagaagaaataatccggccagcccaggtcgcatgcacactctcaaggtgggaagagggaggggtggtgttggtgcccccggcaccttatggcagagcaggattccgatggcacaggagagagtggtttcccaaatgaaaggatggtagctagtgaatgtttgtccacaagtgttagagagttgatgtttaaagttggtcaagtcaaagaagaaaagaggcagcactgtaaattgtgggtttttttggtgtttcttccacctcgtcttgagttgtgcaacatggtagaaagagagaggccttcagaaccaggcagatgtgggcccacatcctgcccccatcacttcttagtggctatgtggccttgtgcaagtcatctaaccctctctgagacagttccttgctggtatcatggcaatagaagctccgtatgggaagatgaagtgataggattttttttttttttttgagttttgctctgtcacccaggctggagtgaagaggtgcgatctcggctcactgcaacctccaccccccaggttcaagcaattctcctgcctcagcctcccaagtagctgggattatgggtgcctgccactaaggccagctaatttttgtatttttagtagagacgggatttcaccatgttggccaggctggtcaagtgacagaatttaaagaagtaggccaggcgtggtggctcatgcctgtaatcccagcactttgggaggccaaggcaggcagatcacgaggtcaagagatagagaccatcctggccaatatggtgaaaccttggctctactaaaaatacaaaaattagttgggtgtggtggcgcacgcctgtagtcccagctacttaggaggctgaggcaatagaatcgcttgaacctgggaggcaaaggttgcagtgagcagagattgtgccactgcactccagcctggtgacagagcgagactccatctcaaaaaaaaaagaataataataagaagaagaatttaaagaagtacctcattactgggagcactggaggtacctactggatggtgggtatttagaaatctccctggagtatcatgtcctgtaacaagctttgtaaatagtctccagaactgtgcagtgggacgagtgagtgatgcttacagacaagagaaagaaacaaaatataaacaaataaataaataagcacttccatattctgataagtgctctgatggaaataaacaatgtgacaagatgatacagagtaataagggtggaggtctccttagacaggtgagaccagaaaagcatccatgggaagatgacctgtgaactgaatcctgaaagatcagaaagggattgctatgcaaagaatacaggcagaggattctagacagaggtaacaggaagtgcaaagaccacaaggcaggaaaggggtgggcgtgttgaagaaacagaaggaaggccagtggtttgaatggtgagattaaagaggtgggtaggaaacagatcatagaaggccttcttcttttttttttttttttttttttttttgagacggagtctcgctctgtcgcccaggccggactgcggactgctgtggcgcaatctcggctcactgcaagctccgcttcccgggttcacgccattctcctgcctcagcctcccgagtagctgggactacaggcgcccgccgccgcgcccggctaattttttgtatttttagtagagacgggctttcaccttgttagccaggatggtctcgatctcctgacctcatgatccacccgcctcaggctcccaaagtgctgggattacaggcgtgagccaccgcgcccggccagaaggccttctaagacacagtaagaagtttggggccaggtaccagggctcatacctgtaattccagcactttgggaggctgaggcgggaggattgcttgagcccagaggtcaaggctgcagtgagccatgattgcaccactgtactccagcctgagtgacagagtgagaacctacctcaaaaaaaattaaaggaaaaaaaaaagaaataatttgggttttacattgaattatatatctggttaaaattctaataagataattaaggttgttgggtacaaaaataggtagataagggcatacgtggagaccagttaggagaccattgcaattgtctagagaatagacaactggggcccagcctaaggtgatggtactggagatggggagaaatgaatggattaaagatgtttttggtgcgccgggtgcggtggctcacgcgtgtaatcccagcactttgggaggctgaggcaagctgatcacttgaggtcaggagttcaaggccagcctggccaacatggtgaaatcccgtttctactaaaaatacaaaaattagcagggtgtggtggtgtgcacctgtaatcccagctactcgggaggctgaggcaggagaatcgcttgaacccaggagatggaggttgcagtgagccgagattgtggcgctgcactctagcttgggtgatagagtgagactcggtctcaaaaaaaaagatgtattttggttgtaggaccaggaagagtcagaggtggatttgtacatgggaaaggagtgaaagggaggaattaaagataaatcttgacactgaggtataaacaactacctgggagtatatggggccatttattgagatggggaagatttgggatgaaggagatttaagatgttgagtctgagatgcctatagggtcttaggtagtagtagggattaagacatcagttgggcaagtttgggtctcaagggagaggccagggctggggtacaaatttgaaggcatgggcatggatgagatctcaagagactagatgagaagggaagaggtgccagcctttaggctcacctatctgagcctcgagacccgtagaaaagccagcaaaagaaaagaagatctaggagggaaatcaggagagctggagtgatagagaccaagagaggaaaatatttcaaaaaaagcaagcattcaactctggtttaagatgttgaaagactagtgaaatgaggacaaggaaatgaactttaaatttagaagaagaaaaaaaatctaccctttacagtggtacccccaaactggacccttctaaaacaaatctgatcatgtttctcccttgattaaaagattcaagcctggcacagtggctcaagcctgaggcaggaggattgctggagcccaggagttcaagaccagcctgagcaacacagtgagaccctatctcttaagaatttttaaaaattcagtggctcatcacaacttcttattttattttattttaatttatttttgagaccgaatctcgcactgtcgtgcaggctggtgtgcagtggcgcgatctcggctcactgcaagctctgcctcccaggttcacgctattctcctgcctcagcctcccgagtagctgggactacaggcacccaccaccacgcccagctaattttttgtatttttaatagaaacggggtttcaccgtgttaaccaggatgggcatcacaacttcttaacagcttaattaacaatttggcctccatctgctgtcattccacaccctactctgccagctcttccaaagagcagtgaccagattcctcctgcctcgctcggcaccctctctgtgtctgtgcttacgctggatctctgtctgcttggcccttctcttgccctggtggatgtgtacccctgactcagctgagctgcaactccttaggtgaaaacttccctgattctacctccagacagtgttgtttgagccattctctagggactcacaaaccttctccatggatctctgacatagtatagtacttctcaggttccttttattttattttattttattttatttgagatggagtctagctctgttgcccaggctggagtacagtagtgcaatctcagctcattgcaacctctgcctcctggattcaagtgattctcctgcctcagcctcctgagtagctgggattacaggtgcccaccaccatgcccagctaatttttgtatttttaatagaggcagggtttcacggtgttggccaagctggtcttgaactcctgacctcgtgatccgcccgccttactctcccaaagtgctggaattacaagtgtgagccactgcccccggcctcaggttgcattttaatcattttcatattcatgtcacccatcagactatgagcaccttcacagtggggagtgtgttttattcatctttagtgcccagtacaatacctaacccaaagtagatactaaacaggtatttgttgaataaattcccaaaagaccactctttgaaacagacattctaaccattataaaggaaaagcaaagttaaaatgtatcttttgaacttgaatatacacacaagttcccatcacccaaaaaatcatcttagtggttagaaacatattaatacctgtattatgggttgaactgtatctctcccaccccaccccccaaaatattgaagtcctaaccccagtacctcaaaatgtgatcttatttggaaatagggtctttacagatgtaatcaagttaaaatgacatcagtagagtgggctctacttcaatgtggctggtgttcttacaaaaagggaaaatttagacatggagacagacatggtcagaggaaaatcatgtgaagacctggagttgtgaagacaaggattgaagcaacgcatctacaagctaaagagtgcctgaagctaccagaagcgaggacagaggcatggaatagttccttccctagcccctttagagggaacacggccctgtccgcaccttaattttggacctgtggcctccagaactgagacaatgaatttctgttagtttaagctgctcaggttttgttttggcagccctaggaagctaacagacctcacaacatgacagaagccaaaatatatttgctttgctttacccctttggaactctgaaaatttaattcttttcttttttggctgaaaaattgtttttatgctgaaaaaaatccaagaaaacccaaatagcactctgtgcaattttgcctaacagagaattaagaagaatcccaaaagatctcactttaattgggtttaaattaatctacattttacatttataatgacattaaattaaccaaatgcatttttataataataatgcattctgaagggtggaaattggattatgttaattagagtgctctatttttatttagtaaaagaaagttatgcatcttctgctcatttcataactctggatgagcctcattataaaataaaatagtctattaattaaaatgtactctatgaaaactgtagaattctggacggaaagcaacaggatggaggtaagtggtgaaaatttccagaatccacagggaggtgacggagaaggtgtcactaagtggttttggcagtgaaaaaagaaaagaagctgatatgttggggaggaattggtcagtctaaccagaaaacaaaagccactttaagtgtcttaacagagggaatttaatccagggaaaatagacataatggaaaagctacacatccaaagggatagtgaggcaaacctgaaattacagcagaaggaaccactgctggcttcaggctagagcactttctcaacctgggcactcttgacatttctgctgggataactgtttgttgtgggcagttgtcctgtgtttcatcacatgtttagccttcatctctgaccattatccactaaatgcccctccccaagttgtaacaaccaaaaatggctccagacattgctaaacatcccttgggtgtatttgtgtgcagcggctgggggtaagtagtagacagacatgctcccagctgagagccactgagctagaaggacaaaaggagaagtaatgaccagaacccagggccagggtcacccaagcaagaagagctggaaccacgaagcagagaggtctgtccagtagagaaggggaggcctcaggcagagaggggaagggacaaacaccctggcttctcccttgtccccacgttctccttcaggtggctgttggcttcctgccatacagagcagagcaagggaaaagagaggagtggctctgagaacacaggccaggggcagcactttgcttctgaataaggacaacaatttagatttcagatccaactcagactggtgctccttcaatttgccagatccccagacaatggctgcttcacacaggggtccccggatgacggccgcttcacacaggggcccccgactgacggctgcatcacccggggcagacctactgtgaaactaaaggcgcctaaacgccaagccccttacttgggcagactcaaggtccttggagggctctggtaatattttcctcatggcctcacatttagtcaacttggcatcacacttcccctcctgttgagtgggactgaagtgggtgtgggcatctgtttaaaggaaggttgagttggggatcacactgcccttggacctgggcagcagcggctcctgccctgaaccccacacttaggagggcctcaccctggttctcctcctgctatacccctccctttaggttgaaaagcccacagagtccaggagatatgccacccaaaatgtacacacccctcatccccagttcttgcccatactttcagtacctaagaccccaggattctctgctcaaaggccctgagtctgcctccaggatgtacagggtcctctcccctgagtccagccttccaagagtggaccatgctgtcagagtgcacacccttagacccaggaagtggccaaggcaccgctctttgctggaggttgtggataaagcttggacattgtagactagggtatccacatacatgtgtgagaggctgctcatagtatgaaacggagtagggagtaagaagagaattgggggttcagaaatgagcaataaaatcaatagaaattattctgggtcaagcactatggttcgcacctgcaatcctagcaatttgagaggccaaggtgggaagaccacttgagcccaggagttcaaggccagcctaggcaacatagggagataccatctctacaaaaaatgtaaaaattagccaaatgtggtgaagtgtacctgtagtccaagctactctggaggttgaggtggaggaacacctgagcccaggaggtcaaggctacagagagccatgattgtgccactgcactccagcctgggcaacagagcaagaccctgtctcagaaaaaggaaagaaggaaagaaagaaagagagagagagagagagagaaagaaagaaagagagagagagagggagggagggagggaggcagagagagggagacagagagagagaaaggaaggaaggaaggaaggatggaaggaaattattctgacaatgagaagcaaactgtaagccaaaatatattttttttcaaattatacccaaagtatagtaactaactcatttagaggaagaaaggactttcaaacaaagaataggcttttatattgtttgattatctatttattttttatctaacatgaaatactgataccataatccaccagttcaatggggttaccaatgacaaactggctaatgaaggtcatcaattcagaatacttaagatcagtccctctgtgagaaaacttgaaatgtacatgaagtcttacagttcatatatgaaagaaattttctgtggagtttcccaaatttggcaacaatttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccagctaattttttgtatttttagtagagacggggtttcaccgttttagccgggatggtctcgatctcctgacctcgtgatccgcccgcctcggcctcccaaagtgctgggattacaggcgtgagccaccgcgcccggccggcaacaattttaaaaatttacatgacttaccaatagccagttctgaggctgaaaatcttttctaatatataaatattttaaaggaagagtattcaaccatgctatagggaagactgaattctctatctctagaaaatgatattacgaaatcattgcatgtgaagaagcacatggaggtatgcaattacaaaaacagaaaagtgtaaagagagtgttgagtagtccaataataaagatattatttttctggatttttgtactatttgtcagcttttaaaactttgtaacatgctataatttcttttcccattttaagtaaaatattcaatttcatacttaattttatatttataactttgcattctttttcctagggaaggagctcacctccccacaaattgtataaaccttagtttccacaaaacctggatcttccctggcatcatcatttattatgtgagttgtttgggtgtggagaggtgaagtgagaggtgcttgagggctatgtctggggaaatttatagaaaattatctgaaagggcagcttctgctgacccataagatgtcaagatgtattattttgaggtaaacatgtcagcaactggtacttctcggatgccttttcagatgactgaattctctcctcatttctccttgtttttgttgtgtagtcatggtggcagctgataagaggtgagataatggggccagggacagataccttagctgtcacctcacagtctcccacaccatagagagcaaagaaagacaatggtaaaaaaaaaaaaaaaatcccacccaggagccccccggaacacgccactcatcctgacaaagagctggtttccaactgggacagatcccagaagcagaccaagctggggtgtgggccccagggcagtaggagccaaaccaacttgtttcctctgtgaggctacaggctgcagagccaggactattcttctcatggaacaaagcacagggattaatttgcaggatgaaatttattatgtcttttacagtaaagacattttgccctgaagcttattaggtttctgagtgctcacattttctgaaaaatagccactgcaatttgcagatttaattccaacctaagttggtgtggttcagggatgtgtccaagacaggctacccggggcaatgctgcgcatccatttcccagcaaagcttctttgatttctgaaagactttaccattaaatatagtgagttgaacacaggctttatctcttctctcttctgaaatctcaatcacatgactgtaaaataacaaaatcggtgtgaagtaggtataaatccacgcagaaaaaaagaatgagaggaagataacagcagactagagattcaacagaattctggaagctggaatcctgagaagtgggacttgcagggcagagaaaactggatcagaaatactcaccctgcccctgccacattaggccagaacagaacacctttcacaaagtaattttcaatgtatatgttatgagattattttctaagatggatcacttatgattataaaacaaagaactttcctttactaaataggaggagctaatcaggagcaagttcattgttattctatgtctgctctccaatccctggccaagaaattctctttctggagagggtgagcccgcaaatccctgactcaggaggacttgggtgagatgtcacagtgcaaacagaggtaaaggtggagttggctctatctgaaacacagactgaagaagagaagagtggtttccccagaggaaaagaagaaaagtggggtaaaaataataataatgtggacaggaagcaaggaaatactgggtagaagagggtggttccctggcaagggccccactctcaagcctggaaacccacgggaacaggcattcttgtttttgtgcccaaatgttgccttttggcctgccacgccccctatcttgtactcatataaaccccaaactccaggttccacaagcagatgagaaaacagaagagcagcagagtggtgcaacagagaaggagagaagagaaggagcatctgaacatcaagaggagttcagctggggacagttggttgggagatcagctacaggacagccaaactccaggggaagatgatcttcccactccatcccctttctggctcctcatccattctgctgagagccacctccagctctcaataaaacccccacattcaccagccttcaagtctgtgtgtgatctgattcttcctggatgctggaaaaggacctgggtaccagaaggacagggtgtaaaaggctgtcaccctgactctctactgagctggtgtagcaattagctgtccacagatgacagctactaaaagggcataaattgtaacaccttcttagatgccaccatggggccagagcccaaaagtgctcaccccagctcctgcatctgcccatctgtgtgctccccctcctgtaaggtgtttgagtgcatggtggtcgaacatttgagccatactcctgctgcatgtcctgccggggggtcagggaactctcccatttcaataagagtttatatataaacctgtaccaaatagtgtttaaaacactttctatacactaattcagttaattcttacacgactgtgtgctggaggtgcaaatatcacttaattttacatttcatgagactgagacacagagaaagtaaattccccaaggtcacactgctggtaagtagcagagccaggagatgaacccagacagtctggggaaaatggttcctgggtgacaaaaacacaaaagttctgccatagttaattttgcggatggtacaattttacccggtttcccataattagaaaatgggacgaggaaatgccataaggttaagctcgttcctctgagcagattcttttctgcagcagcaggtccccctataaatatgggtctgtgataatctgagtaatggcccccaaaagatgtctgtgtctcagtccctggaacctgttactttacatggtcaaagagactctgcggatgtgattaaatgaaggatcttgagatggggagatgagcctggatgggttctccagtcctcacaggagaccccacacccctttccacttccagaccacgaggggaggggctcacagactagaaagccctctgcaaatgctaccctgagcccatatcactattgcaatcactggtaagaatctggggacaaaggtgagtgggatctcagacagatatctctccaagttgggatataactgaaatcggcactgattacacctgacattggatacccatataaccaatggtttatgatcacagaacagcaaactctcccatcaaaatcagggtaaatataccaagatatttgtagaattcaaacaccaatctaacttgatttcattcaggaaacacaatgtctagagtgttaaagactttgctgtggtttcaaggaaagaatcatgaataaagtctggctcagccatgtctataaaaaggattaaactttatgagtcatggatgagagctggtgtgtgatcaacagcccacctgttctcttggtgtaaatcatgtcttttcatttttaagctacttttatattgtaaatctataattctaaaatgacctttatagctggaggattagagaggaaccctattgttctggaatgggccaccagagacttgagcagatgggagaagcaaataatataagccaggaagggcaccaagagagtcatttgtcttagggtatgtcaatcatttcaggtctgcaacaggactctgtgttccctagataaggagcagaagtttattgggtacacccatatgagtcatgaaccaggaaaacacacgttcagccaggagctgcaggcagacattgggaggccatatgactgtcagaggtactaggctcagaccttgacttagaacagagacatcaaaaacatgaggcacactccccattccatgtccatggcagacattactaagtgatcactgcatactttcttgctgagaccagagacagcctcagaatctctcttagcacagatccccattatctatctcctactacctattttgttgttgttgctgttgttgttgttgttgtgagacagggtctcactctgtctcccaggatagagtgcagtggcatgatcatggctcactgcagccttaacctcctgggctcaagcgatcctcccgcctcagcctcccaaatctactacctattgaacagagttgacccacaaaataaaacctatttgttattcctggtccagaacaaaaagaaaaggaggcaaacttcagttggaataaaatctgcattaatacctgtcttgagaatgcaccaaaggcacgtggcattgaacagagagctctggacaagaaaagaagggaggatttccgggcgctgaagccaaggaggcatccagggagttgtagaagatgacactagccacgctgaaatctagatgagctttaatacttcctcatgtctctttggccttaatggaatcaagtgcccatcctgaagcaatcactgtagtcagatgcaagggctttgttgatcggcttaagttaatcagagcccacccatggaaaagaaggaaggcatgtaaaggagtgatgagaagcagctgtgtgagctcaatgggcagaaaacccgtgcattacagagcaagaagaatttgtaagtaagtaaaaagggagccatcaaaagaaagcaagctggaaatccgctacagtgtctttacaagtggcatcaggtgggctgatgtggaactaaagtcattcccacctaaaccacatgactcacagtgggggtgaggtggcgcctcacagaaaactggggtactattaccatgaagaagaggagaggagatttaatgccaaggagtaaataacaggcggcattcacagtaaggtaagatttccaaggactggagtgagagagctctactcgaagtacaggtatctacaaagcaggtgcagagtggcctgaagcccaaagaaatcatttctggagaccaaatgggaagcactttcgttctctgaggagacctagggtatgaaaccggccataaaaatgaggaagcaaatttaggttgtaactcagaatgctcccaggactagcaaatgtgccggcatgaattttcctggagtaagtggttaaggccaaccttccaatgtcatatgagaaagacaccctagagccactcaggtttttcttactgcacctagattcataatagaccacaaagaccctaagagcaaatgatttctacaacctgtgcaaacaccccacgtttgtaattcttccctggatatttccttacagtggttagcaacaaattgctgaagtcagaaagctccaaagtgcttgccttctaggaaagaaagtaaggaaactggcggggggttgtgccccatttctttgtcattcctagaaacaggaaagttcccagggatgaagagggagatggcaacgttgaaaagaaaaggattcagggctgggcgtggtggtccatgcctgtaatcccagcactttgggagacagtagatcacttgaggtcaggagtttgagaccagcctggccaacatggtgaaaccccatctctactaaaaaatacaaaaattagccaggtgtggtggcaggtgcctgtaatcccagctacttgggagcctgaggcaggagaatcgcttgaacccgggaggcagatgctgtggtgagccaagatagcaccactgaactccagccttggacctatggaaaagaaggaaggtacatagaggaacgatgtatttctttacaactagcatcaattgggtcatgtatcttttagctttaagcattaaaaaaccttccccaaactggcttagacagaagaacttattggcttacgaaagagaaaaatggagaatgaattttaggcagggtttgatccagcaactcaagggcatccacgtcttcccatctctactctcttcatcctaatgttggctctcattattgcaagatgctgaccagtagcccctggggctgggagaaggggaaatgtgtcctcattaatatcaaagagaagagaaaggagtctgtgtctcagaattcttgtcaaaggacctcggattggactagcttaagtcttgtgcccgcctttgagccaatcgctgtgtccatggggaggaaaatcaggttctaaccaggagatggctatggagccagccacataaaacctgcagagctgagaatggtgggaatgagtgctggtttccccaagaaaataggatattgttatgatgaatgaagagaaatagaggctggacagccaacaacaggtctcctagcatcagatgtacaggggaaggtggaatgtgtgtactgcacattctaaatcaaaggtaaagttaacagctgaagtttctccctagaagtaacttttgcttgaaaaaaaaaaaatgcaacaggaagagaaggctcccatgatgtgattgtgaccatgctcagctgggtagcagctgctctgccagatgagacacagggatagccaatgcacatgaataatctctgaagatggatctgatacatgcactttacctaacagtcttggaaggactcataggatacaccccaaggagtgagttaatgttgtgtgctttatttattcacaaggatggtttcctcctgaaacccagcactgtgttaacattctgcatgtcactttggttcaagcaagtcccaggaagatggatcactatttattcactgaagaatttcccaagttaaagaagagatacaattaataacgttagagtagcccagctagaaactctaacaagttatataacatagaagacagagaataatgagaacagttattcctttgtgcttcaaagagagtagtaaaatagactcgatagcatgaaaatttttcaatagttttttttttccccactcttggcctaatgggccttgattcatgccaggggtctatggggctgaaagagccaacatatctatctgaaatagagttctccaaccattatgtcagatataacagtagttttcaaaatcttgtctgataatgaggcgattgtttaaatgagttatgatatacacctacagtgaaattgtactcattcatttaaaatgatgctgtaggctgggcatggtggctcatgcctgtaatcccagcactttgggaggccgaggtgggcatatcacttgaggtcaggagttcgagaccagcctggccaacatagtgaaacccccttctctactaaaaatacaaaaaaattagccagtgtggtggcaggtgcctgtaataccagttactcaggaggctgaggcaggagaatcacttgaacctgggagtcagaggttgccgtgagctgagatcatgtcactgcactccagcctgggcaacagagcaagactccatctcaaataataataataatgctatagataaaaatgcattaattttgcctaatgtttacaatttattacttttttctttttcttttttttgaaatggagtcttgctctgttgctcaggctggagttcaatgtcgcaatctcagctcactgcaacctccgcctcctgggttcaagcgattctcctgcctcaacctcctgagtagctgggattacaggcatgtaccaccacacccggctaattttgtatttttagtagaaacggggtttcaccatgttagtcaggctggtctcgaactcctgaccttgtcatccacccacctcggcctcccaaagtgctaggattacaggcatgagccaccgcacccggccacaatttatttattattgagcgagaaaagcagattaggaaacaacatggagaggttataatcatacttaactaaaatattaaaatatttacattttacacagaaaaacgagaagatatactctgaggtattaacagtggttttttttggatgctctaatcatgaatattcttgaatcttttcttgtttatattttctaaattttctatgatgtacatgtattgcttttgtaataagaaaaacacatcagagagattttattttaaaattatgcttgctgcatctgtaagtctttaattgtgcttatactttcctcttcaaaacttttgggtggcagctcatgcctgtaatcccagcactttgggaggctgaggtgggaagatcatttgaggccaggagctgaagaccagcctgggtaacatagtgagacctccatctctactgaaaactttaaaaattagctgggtatggtggtgtgcacctgtagtcccagctactcaggaggcttaggtgggaggatcacttgagcccaggacacagtgggccatgatcgtgcaactgcactccagcctgggtagcagaataagaccatctcttaaaaaaaaaatggcattctttctgtcagcagcgacagtcatctgtggattgatgtaggggagtaaaaggatatgcgcacggaaaaatgaatgaatgaataaacacagcaccaattagagcagtgaaggaaactcaggaatccagaggccaacccccagttcccttcattccatctagctaacatctaaatgagatcctgttccaggctatcctctttccagtcactagaagggacagtccgcaggaggcattttagtgcttccagatctggagatggcgttttcttgctctcaggaggggcatcttaagagtctagactctcagacccttctaaggggtcagccacctccagcctctaccccttgaggaatttatcttttcattgatctctagatccctccagcctccccaggtggggccacagcttgtctcggaaggaatgccatccctgctgaacctcaggggctccttgaccttcaccctgtctcagtcaccttctccagcgttgccacccccacacaaccctcattagtggccaccatcaccactgccgccgtgctgcagccctgttagagacgacttccctcctcttcagtcctgagcaaagagacaaggaaacaccttctcaacagcctcgtgagtctagaaacacagaggtcccattcacggggcttttcccaggtagggaggaaggcgtggactcatcaatcttccatctcggcagcaccccttcctcttcttgttaaccaccctgctagcttgagggacagaaagtgacaaaaaaaggaggcgaaacaaactgaaagcctgcaattagcttaaatgagctatccactagatgctgagctgtagtggattgttgcgaagggccccatgttgacaggtttggttttttgtttttttttttaaatttttcaagaataagcagaaatctagattcttatgtatagtctcccagattttaaacattggtgactcattttttttaagacaaaagtctctctctgatgccccggctggagtgctggagtgccgtggcaccatctctccagtagctgggattacaggtgcccaccaccacacccagctaatgtttgtatttttaggagagatggggtttcaccatgttagccaggctggtctcaaactcctgaattcaagtgatccacggcctcagcctcccaaagtgctgcaatttcaggcatgaaccactgcacctggcttcattctattttttaatcccaatataaatttgtacccattagaaaatctattcagctgcttttttttttttttttttttttttttttagacagagtcttgctctgttacccaggctggagtgcagtggcacgatctctgctcactgcattctccgcctccagggttcaagcaattcttctgcctcagcctcctgagtagctgggactacaggcgctcaccaccatgcccggctaatttttgaatttttagtaaagacggggtttcgccatgttggccaggctggtctcaaactcctgacctcaagttatctgcccaccttagcctcccaaagtgttgggattacaggcatgagccactgtgcctggcccagctgcttctatttcagagaaataatatggcttaagagagagacttctttctctcccacctgaaagaagtccagaggtgggcagtccagggctgcatgtggctcatgagagccctatgtctgaattacatggcttgggtttctttctagcagtttctagaatgcactggagcttcaattccagatcaaccagctaaatgtccctgggaacagccatttatctttctatgcctctgtttgctcatttgtaaaatgaacaataacagcacctccctcacaggttggctgttgagaattaaatgagataatacacaaaaagttgtcagcacagagcctggaacacagccccaaaagtgtaagattaagtgaccccatctccactctttgattacctgggtcattataaactgtaacaacaaagcaaaatcacttgaggtcaggagtttgagaccagcctggccaatatggtgaaacccccatctctactaaacatacaaaaattagctgggcctggtggcatgcgcctataatcccagttactcgggaggctgaggcaggagaattgcttgaacatgggaggcagagattgcagtgaatcaagatcgcgccactgcactccagcctgggggacaaagtgagactctgtctcaaaaaaagaaaaaaaaaaaagaaatgggaatcaggagccaaaagttaatctgtaagaacataagctctacccctccctgaagctttggatagattgttggattttcttcaactgtgaaggggagaggggctttctgagtcaattttatctagatctaaggagcaggaagaccccaagtgacatttgatttgtatagttaatgcctaccctccttctgtccccaaccacttctagagactcttggcaaaattggatgggaattttctgacactgcctctgcttgtacaatactgagaagtcaggaagagcttgagttggctgtaattctaaagggtgaatggatgctgatggtgtttcctagcaacagctgaaaagaaatcaatgtcaagtgatacaagttccatgagtagaagaagcaaaatatccactgaaacatggtgagaagtcacatgacctaggtactgactgtcaggcccaaactggccattgtaagctaatcttgctgttaggatgctgtaaagatgaggcaagagcaaaggggttgtaggaagcctcataaaaatgaccccaaatcaaaatgttcaatcaaagcccagctttggagcaatggccttagccagagaaaaccacttaatttgtagataaccaaaggtcatagaaggttgtcaaataaatccctttaatctaattatgaatgacatttacctcaataaagccacatggtattaaataagacattaataatcatatctcacaagaatggaaatgactctcatccattacccatctcataaacttagaaagcattgatttttagccaagaaccaactgaagaatactaataccctactgcattagtcagggttgtttttgctgccaatgagagaaattcagctggaattaagcaaattcaaggggacagagtaagtcatagaatcaaaggaagtctctctctctctctccttcctagggaggctgggcatggtggctcacacctgtcatctcagcacttggggaggttgaggcgggcggatcacctgaggtcaggagttcaagaccagtctgggcaacacgatgaaaccccatctctactaaaggctggtgaaaccagcctgggcaacatggtgaaactccatctttactaaaaatacaaaaattagctgggtgtggtggcacacgtctgtaatcccagctacttgggaggctgagacaggagaatcacttgaatccgggaggcggaggttgcagtgagctgagattgcgccaccgcacttcagcctgggtgacagagggagactccgtcaaataaaaaaaaaaaaaaaaaaagaaaagaaagagagacagagaaagagagaaaaaaagcaagccagccagcctagggaataatttgattagcttggtgtggaccgcacatatgtcttattccagggccacttattagggccaggaggatggtgtcagaaggcaggaggcagtgtgctgtagttagcagggctagaatgggaaggagaagttttccaaagaaggcggatgctgttttcaaaagggaagaaactgatgctgagcagacaaataccaaatgcccggcacatttattgaatctgtgataagagtgaattttataacctgccactatcattagcttgtctaagttgtcttggcaaaggtaaaacattacagaatccagggctgtctggaatgtactgtggatttgatctttctaaatcatttgtaattatctatcataggaggtggaacgtcagctgtacatctctgaaaataccaaatttcattttcctgtaaataaaagaagggcactataaagataaaagctaatattatagctatatatctaattttgtcttcaaatataaccattaagtgttttaagtaaataatttaaaattgagtttctagtaaaactcaaaggaatattacataaaataacttttaaaaagtctctaagtcattcttgtatagtgatctatattaactaataaaaggccaaaaattaatcatgctttcaggaactgtaaatcagtaaactaaattatcattatttaatattgttgttaagactgggtgcggtggctcacgcctgtaatcccagcactttgggaggccgaggcaggcagattgcttgagcttaggagttcaagatcagcctgggcaagatagtgaaatcccatctctactaaaaatacaaaaattagccaggcgtggtggcgcatgcctgtggtcccagctactcagaaggctgaggtggaaggatcacttaagccagggaagcggaggttgcagtgagccgagatcataccactggactccagccagggtgacagagtgagaccccatctcagaaaaataaataaataaaattgttaaaattttggatctttgcttatgattccaccaagatcgttaagatatgatgataataatactaatgtttaccatatgtcagatgctttacctaacaagtctaaggaagatttaatcatccccgtgttacagatgaggaaactgatttcctcttaggaggtgacagttgcccaacgctacgtgactaagctctgggatggtcctaggtcagtccaactctagagccggatctctttccaatctgtcatactgcttccctgactcaacggtgctggagagaagaacgcatctgttcaggatgtttgttaatcagatagaactctaacaactgagtgttccaaaataattattcagtccacaaccacaccaccctaaacatgcccaatctcattgaaaataattattgaatcataaattatataaatgtgccatacagttggacaaacaagttaacttattagatttttaaatgtactccaaaaatagagtagacacacttgcggtgtgtacgatgagataagtgccaattctaggatcctaaaagaaatctcaacatcaaactcaacgagcaaatacagacaaacaagaaatgagggcaaggcagccattcctccgtcaaacgtaggggagaaactttgctttaagtgaccacaagagaaaatgtgagagtgaaatcttagtttttcaccagtggaaaattagttaagggttttaatttagggttgtgggggctgggtgtgtggagaccgtaagggagctgggacaagcacagctgtgtgacaaatattaatggctatcgcaattctcaaactgagaaattcaggtcagcctgtagggcaagctgcctctaaatgcaacaacctttttatatggctgactacttcttccatgagtaatttttttattttttcacttagctcaagttggaattaatggttctagtgatttgtgttgccttagatgaaattcttaacattgcaattttattaatcctacctgcaaagagagagcactcgcgcctgtaatccctgcactttgggagggtgatttctcatttctcaaaactgagaaaatagtttttcatgtaagttaatatttaaattttcaaattaggggctgggcacagtggctcacgcctgtaatcccagcactttgggaggccgaggcgggtggatcacgaggtcaggagattgagaccatcctggctaacacggtgaaaccccatctctactaaaaatacaaaaaattagccgggcatggtggtgggcgcctgtagtcccagctactcgggaggctgaggcaggagaatggcttgaacctgggaggcggagcttgcagtgagccgagatcgcgccactgcactccagcctgggtgacagagcaagactccgtctcaaaaaaatacataaataaacaaataaatttcaaattaggatccaggttttcttgcatgtaatttttccatcccctttgtattactttgaaaagagtatcatacatcacctaaaattgtgaggctgatgcttacccttatttagtgacataaaaatgactgccaatttttttttttttagcaattttattgtggctcaaacttccaagtccaggctacatgcaggcaaatctgtaaatctgacttctctgcaactggaatcaggtagagccatcacttacagaaattttaaaggcccggatatatcctcaaatgtacatgcagaggttttatggaatacatgtatccatttcaacacaaactttaagtttttaaataaagctatttattagcttatagtaataaatcctggcaaacactactggttcataatatgccaagagttatgaatcagaagattaataatcagggctacatctagtaagaaaggtggctggctgggcatggtggctcacgcctgtaatcctagcactttgggaggccaaggcaggtggatcacctgaagtcaggagttcgagacctacctggccaacatggaaaaaccccatttctactgaaaatacaaaattagcagggcatggtggcgggtactggtaatcccagctactcaggaggctgaggcaggagaatcacttgaacccgggaggcagaggttgcaatgagccaggataacgccattgcactccagcctggataacagagtgagactctgtcaaaaaaaaaagaaagagagggaagggaaggggaggggaggagaggggagaggagaggagcaagcaaacttgggcaacataggaagaccttgtctctataaaaaattaaaaaactagctgggcatggtggtgtatgcctatagttcaagctacctgggaggctgaggtgggaggactacttgagcccaggaggtcgaggctgcagagagtcatgattgcaccactgcactccagcccgggcaacagagtaagaacctgtgtctgggaaaaaaaagaaaaaaaaaaaaaggaaaggaaaggagaggggaggggagggaagggaaggggaggggggaaaaaaaagaaagaaaggaaaggaaaggggaaaagggaaaggaaaggaaaatgaagaaagaaaggaagatagtacacagcagtaacaaattctattactagaggagaagtaataaagccataaggatgctgtatcagtgaggacattcagctgcaagtgaaagaagcataagtcaatacagatttgaagtcaagctataagaaaatagttggggaaatttactggttcatttactggttcatgtcattgaagagtgtaagtgaatgtacttcaggcacatgtagaaccaggttctcagacagcagacatcagcctggaaaacagcgtttctggccaggcacggtggcttacgcctgtaatcccagcactttgagaggctgaggcgggtgatctcttgaggtcaggagttggagaccagcccggccaacatggcgaaaccccgtctttactaaaaatacaaaaattagccagccatggtggcatgcatctgtaatcccagcaactcaggaggctgaggcaggataatcgcttgaacccaggagatggaggttgcagtgagccgagattgcgccactgcactccggcctgggcaacagagtgagactcggcctaaaaaacaaaaaatatacacagacattaacttcctggagccagagctgataaatatggctccattactatgctcttatgatgtgtgcatttcatactatgggcacttggcaccagtgtatgaattaacttgtatttgagaagaatgttaggaacaggacatctccattcatagaaggatgacttgaaagcggggatatagaccgacaggtctttgcaagctgatcacacaagtgattgcaaacccttgaaatgatcaccaattttttggaaacacagcatgacatcatggtaattagtgttctttttttcctgtaaaaattgcttaatgaaactttagaaatttcctatgtataactatttgcatgtttagatgttatttcccacaagaattcttactttctgaaacttcagaatttactgttctgggctgccgctgtttaatttcagtcactatctcacctccaacaaaaattattattattttttttgagacagagtgtctctctgtggcccaggccagagtgcggcagcgtgatctcagctcactgcagcctctgcctcccagattcaggcgattctcctaccttagcctcctgagtagctggcactacaggcatgtgccgccatgcatggctaatttttgtatttttagtagagacgggtttttgccatgttggccaggctagtctcaaacgcctgacctcagatgatctgcctgcctcagccttccaaagtgctgggattacaggcgtgagccactgcaccctgccctaaatctaatcaatacagttttgcttcattatgtctacatgtagagtgcttttgtaggtggacagtggctgtttagtaaatgctcaatacacagattctttactggaataattttgttcaggccttttcccaaaaagtaacaataagtactatgaataaaataaaacaaggaaattcatacaaataaacaataataggaagttcctgaggaagctactttagattagatggacacagaacattctgttgaggaggtgatacttgtaaagtaagatatgaatgataccaaaaaaaggagcaacacaaagatgttaatattctaggcagaaggaagagcaagtgcaaagacctaagacgagaatgaatccagtctttgaagattagacagaggcttgtgtggctgacctgtagtgggtgatgcagggagaaatgagagatgatatctgagaggtaggtcagtaaggcacatcataaacacaagcagggactcccacaggcagttccactgtctttttttttttgagacgggagtttcactcttgttgcccaggctggagtacaatggctcactgcaacctccgcctcccggattcaagtgattctcctgtctcagcctcccaagtagctgggattacaggcgcatgccaccacacctgactaatttttctatttttagtagaggcggggtttcatcatattggtcaggctggtctcgaattcctgacctcaggtgatccgcctgccttggccccccaaactgctgggattacaggtgtgagccactgcactaggcctcttttcttttctgtgaagtgagtttctccaccacggacactgtcctacatatgacaaggtagaaagcattctaatcccatgaatgctgatgttgaccaaggcatgataggcaaggaaaacagacccaaattcagaataagtgcctattcccacaaaaacaaatcatctctccctccaatatggaagaagtcccgtgaaatgaacttgccgcattgacgatactgggcttagatatgtgttttctgttgggatcttcaagaagtaggcactgagacaaagatttgttcccagaaggtgatctcagtaatcatctggctactttgttctaaatctttttggattacagctccaagcctcaaggttcatttgccaagctcctcccaaaacttttacactaatcttccatgttgcttttctccatctctgactatctagccagtgactggttacggttacagatcctcacctcagatcatgtttctctcaagtcaaagtacatgataaaagacagtgcttggaattctgcctacaaattgagatttgccctctactgtccttcaagaccaccccaaatatacacagtacatttctagctgatagtgcctattgttcatggtatctgtaagccaggtttggtttttttcattttcagttaactggataataatgctccacaagggtaaagggacagattggtaggggcgaggtgtgggaatagagtagttaaaggcacagggtcgggagaaatctgttcaaaggaaatgtgtcttcatggcctgtctggtcccacctgctaggtgatggagtgctgctggaaatggtcaactttatgagtagatggattaaatagcacctggtgtcccatagcctccaacatccccagaagcaaattagaaccgtttctcaaaaggagaatagtaatcttccagaagggggtatgaccttgctccaaagtcctgtgggcttccattgtgattctcctggagaaatttgtctctgacttcaataagtctcccaatcagccagatagactttgagagggctgagcagcagagctgcttggactgcagactgggccacctacagggactatttttgctctgccagcttttcaggtcaccaggtaaataaataagtgcaaaacacctgtatgttatatgctgtctcaaaagtccagggctcaaaaagccaaaacagcacactgaatagtctcttgaaggcactgaattcaacctgatccagctaagtaagggatactcaggacatagggctgtagtagactagtttcttatgaatgaggaagtttcaaaataactggtttttgcatgttggttctttagcacagttgttcaaaacattggctgtaaatggaaccacaaggtgggtgcagggagaggttttaaaaattactgatgcctggaacctgccttcagagatgctggtctgattgcctggcttctagattataaaaaagctaatatgcagccaagggcaaagaccattgttctagttccttctagatgtccctataccaataggcagggtcccactctatcccttcattttcatataggaaaccaaggaggtaagctaactcatataattaccctgcgtttcacttataacccgaaaggtatctgagacaggtctcaatcaattcagaaagtttattttgctgaggttaaggctgtgcctctgacacagcctcaggaggtcctgacaacatgtgcccaagtggtcagggtacagcttgcttttagacattttagggagacatgagacaccaatcagtatgtgtaacatgtacactggttccgtcaggtaagactggacaacctgagatgggggcttccaggtcataagtagataagagacaaaaggttgcattcttttgagttcttgagcagccttccactgaatacactttagtccggctcagtgaatccgtatttttaaataaacaataaggcagaggaagcaatcggtatgcatttatctccagtgagcctcagagatgactttgagttctgtctgtcctttgtccacaaggaatttcaaggaaggagatatgtagctttttatctttgtagctattaatatcttatttagggataaaatgggggtcaggtttgcctgacatagtttccagcttgacttttcccttggcttagtgattttggggtcccaagacttattttcctttcacacacttgatgccttgagttgagatttgagaatcaaggtttattctctcttaagtcattcaatgcccttggaaacaaccacctgactccataatcctagcatttctttccattgctattaaattgttccatggtggctgctaaccagtctccaggggccttatcctaagggggctcatggattctggtgactaaaggcaatagcctgctaagctccttgatcactggagctgtgagctttccatctggaatgcagagagatgtgggcctttcaccctacccagacacaacaaccagttccaaagatcccgcatcatttccttgaaggtcttttgcctacctctggtaccaatctggatattaaagacttttttatttgtaagcaacaaaaaaaatctgtgaccctagttagcttaaagaactaagaatatattggaatagagtctaggatagtttacagtttaaaatgaaccattaaagaaccagactcaggaaatacgatatctctgataacctccttagagagcgtcaataaaagccacccagttttgatgactttcagccttcgtgtctctccattcaagttccaaattcccatgagaaaatctggcttggcttaggtcttcccatataatgagctatggtagtaaggtacggtcccaaagcacaaacaggaccacagaggctgtttccagaaaagggaactgtaaaccaggcagctaccccaatacaagtctacttcaatcaccatgtttggaagcatctattttgcagttggaaaacaacaaagtgaagggcaaaaaggcacgaaagacattgtttagtcacacaattttaattgtgaattatagtgaatggtaaacagtaaaagagtaattacatgaaaagctccatattttgcatgtttcaactgttcttcattgtctttacttgtaaggtgttgaaggtgggatccactcctgaatcttctttctagtggtagaataaggtacatattgttctggggtgccagtcacgttgaatttatggttcgtccaaatgaatttacgagcagtaagtggttttgttgttggaggatcatcagtcatactgtgaagccaacgatgccttaaagaggggaaaaaacccaaacagttatgaagaggcagtacagcatagtggaaggacggttaaaaacgtagccctggaactattttgttgcttgggttcaagcctcaactccatcagttactagctgaattcttctatgccttagattttttccatctgaacatccctactcctcagggatggtataaacataaaaggagataatagacataaagcacatagaaaaattcttgtgtgtggcagatacgcaacaaatgttagctaccgttctcattactgtatttttttttcttcgttttctttctttctttcttttggagacagggtctcactctgtcacccaggctggaatgaagtagcactatcatggctcattgcagcctcgaactcctgggctcatgtgatactcctacctcagcctcctacatagctaacactacaagagcatgccaccaccatgcctggctgactttcagaagatttttgtagagataggatctcactatgctgcccaggctgatctcaaacttctgagctcaagggatcttcctgcttcagcctcccaaagtgctgggattataggcatgagccaccatgcccggcccattactgtatcttatcaaatctgacactatccattttcagacatgccatgattttatctacctctaagaaagaaaagatgctaccaaataaattatggccactactgattataatatgtatcctaattttagacgtggaaatgcattttagaactgataaaaatacagtattactattaggtgctagaggccgattctggattttcagtatgctcaggttactctggctcatgaaggtttagtttaaaacccatgaggctcctgctgagaagagcctgatgcattgtaaattcaagcatgtgagtgtaaacactagagaatatgcaacttgttatattaaaaaattaaatcagggccaggcacagtggctcatgtctataatcccagcactttgggaggacgaggtgggaggatcacttgaggccagaagctcaggaccagcctgggcaacatagtgagaccctgtcttgagaaaaaagttaaatcgacccccaattcacaaatatttcagtcataagtgcttaacaatttaagaggatatgttccagaaatcagacctaaaagctggatacctggagttgaaagggaagagaccaccgatgctgctgctaatgacagggaaaggaggaatcaaagtttgtgggacagagtgcaggaagctaagctgaggggtttacatgggaaagaagggaagacagaatttgtcccagcctctaagacctggagctcacaagacagagatgaccttattgggggaaaagaaaatgagaagacagccacagaactgcagcccgggggtggggggaaaagtgattatctagctgcagagaaaaggacaagaggaggatgtttcagtggaataactaaaactaaagctaatgagaaaaaatttttgttgctatgtaaacctaagaatatttgctagcagtaattgatagatatagctaggtaactgactaaaaaccagtctgaatagagataaaatatgattacagttgctatgtttatgtctaaagataattgtatcatgatcagcttatacaatgaagaatgcagaaggctgtacaagctaggtcagtgtctgtcttacatcctctaaaggaagctggggattagtgaaagtgacctggaccaataaactgtaaccattcatatgagcacacgagcgctgaagcccttatgagacgatagtggtgagccaggctccactaaccactcagaggagggattagctgttaaagtcaaggctgtcacttatcaaggggctttatgtgagcttacggcacagctgaaatatttaacttttacctcactgagtcagcttaactaaagaaaaattttattcaaaaaattgctgtcaagactccggaaggttaaaatgatatttaaggaaccatagtcccaagcttatgcctattcagttacttaagtgaggaagtgaagagctcatggagaaatggaaaatgctccaaaaaaggaaaagataatttttatcacaatacacaaaatctgaaaatatttatcctagcaagcctacatgcaagaatcagggaattaataaataataaactatacccattatggcagtttataaagaattataagaaataaggaaatgtttatagtctgctaggcaaatataacccttgttattttattattaaataaggggtaaaaaaaaatcatatctttcagattgccacaccagagagttttacttgcaaaacagactcttgggtctttttttttttttttttttttgagacagagtcttgctctgtggcgcaggctggagtgcagtggtgatatcttggctcactgcaacctctgcctcctgggctcaagtgattctcctgcctcagcctcccgagtagctgggattacaggcgcatgccatcatgccgggctaatttttttatttttagtagagacggggtttcaccatgttgtccaggctggtctcgaactcctggcctccagtgatttgcccgcctcggcctcccaaagtgctgagattaaggctaccgctctggtccacaaggagcagtaaaaaaaacctacaatgagatattatctcatcccagttaaaatggcttttatacaaaagacaggcaataataaatgctgggaggatacggagaaaagggaaccctcaaacacgttggtgggaatgtaagttagtacaaccattatagagaacagttaggaagttcctcaaaaaactaaaaattgagctaccatatgattcagcaatgatgctgctgggtataacctaaatgaaaggaaatcagtatatcgaagagacttttgcactccgatgtttgttgcagcattgttcacaacagccaaaatttggaagcaacctaagtgtctgtcaacagatgaatgagtaaagaaaatgtgatacttaaatacaatggggtactattcagccataaaaaagaacaacatcctgtcattagtaacaacatggatggaactggagatcattacgttaagtgaaataagccaggtacagaaagacaaacattgcatgttctcatttatttgtgatacttaaaactcaaaacaattgcactcatggagatagagagtagaagaatgattaccagaggctgggaagggtagtggggttggtttggggattagggggaggtggggatggttaatgggtataaaaaaaaatagtcagaaagaatgaataagacctagtatttgacagcacaacacagtgactatagtctataataacttaattgtacattttaaaacaactaaaagagtataattggattgtttgtaacacaaaggacaaatgcttgaagggatgggtaccccattttccatgatgtgatgatcacatattgcatgcctgtgtcaaaacatctcaccccataatatatacacctactatgtacccaaaaaattaaaattgtttttaaaattgaaaagtgtatgtcctaaaacactataaacaggattaaagactaaaagaaacaggggaaaatatttgtaatatacagaaaaaaggttcatctatcattacaaatcagaaaaagtcaaatatccaatagaaaactggacaaaaaacatcaagagatgtcaacaaagaaaaaattatagtggcaaacaatgaagtttaatcaaggcaatgcacattaaggtataattttttacttgctaaattagcaaagattttaaaaaataaaacccagaatcagtgaacttaaagagaaatcagtactcatatactattcaatatatttatcctgagaatataaattggtatagcccttctagagggcaatttggcagcaggtatcaaaaacttataaaacatgtatactcctggtggatccatttccatttaaggaaatgaggatatgaatactcatgtacaaggatatttatcagagctttatttataacagtgaaagaatggaaagaacaaaaccaaaaataaagggaatagctcatggcatatccatatgatggaagactaaggcattattaacatttatgctatagataatattttggccaggtatggtgcctcacacctgtaatcctagcacttctggaggccaaggtgggaggatcgcttgaggccatgagttcgagaccagcctgggcaacatgagaccccatgtctacaaaaaatgcaaaaattagccaggcatggtggcaggcacctgtagtcctagctacttgggaggctgaggcagggatcacatgagcccaggagttcaaggctgcagaaagccatgatcgtgcctggacagcgggggatcccatttctaaaaaaagagaagagagagagagacagagaatattttatgacttgagaaaatgttcaccatatatgttttaaaagcgggttatttgcctaatttatttaatacttatagatagcatttataagtcatgggcactaatctatacactttacaaatattaacctatttgatccttataacaactcgtgataaatattattatccaaatatagtaagtgagaaaaccaggctgccaaaagttaaaataacttgcaaacccaggctacttcttcaaaaagctcaattacattaataacaaaaacaaaagaatatatatgcatagaaatcgaggagataagaataaacagttgtccctagtgtctatgggggattgattccaggacaccctgtggatgccaaaatccacaaatgatcatttgtggatatgcaaatgtagcatttgcatataatttatgcacaacctcctgtatactttaaatcatctccaggttacttataatgcctaatatgatgtctgcatatgacttcattcatgtggattcaacataatactcggcacacagcaaatccaagttttgctttttggaactttgtgaacttttttctgatataatttccatctaatgttggtttaatccatggatgcagaacccacagatactgaaggtcaaatgtgtatcaaaatattaatagcagtggtttctacaagtggtgggataacaggctattcttatttcttttgttattttttgaattttctataatgaacatgctgagcagttcctcattcaccaagagtaatacatagtttatttccacattccacatatggaattttccaacaaggcatctttgtaaaatgttagaatcaatattaaatgaagcaatgaatactcagtgaaatgtgttaaataaaagctgagttttaaaaatcaaaacaatcttgtcttctgcttataatgaacacattttaacagagaaagggtataaagaaaagtaacattctgtaacataagagaaactacccaattaatgcagtttgtagtttcttagaacacagtctcctaatattctgatttttctggagcagaaaataaacattaggaaggacttactttgaagaaaatattatctgccattgacagctagcaatttatttagagaaataatattttagaagactgtaacaggctaggcacagtggctgtcacatataatcccagtgctttgggaggccaaggttggaggatcacttgaggccaggagtttgacaccttctctctcaaaaacaaaaacattagctgggtgtggtggcatgcacctatactcccagctactcaggaagctgaggcagaaggatagcttgagcccaggattttgaggttgcagtgagttatgatcacggcactacacttggcctaggtgacagagcaagaccttgtgtcaaaaaaaaaaaacacccctccgcccctgccccaaaaaccccacaaaactgtaacaaatgattcagtgggtcaaagtactaaaaaggacaggttgaaattgcaatgtaattcagaggtaaatctagtttcaaattcattagaaagctataaaggagtagcagaagatgccatttttggatcagctaaagtgaagaaaactgattatcatacccaaaaaataatgtttgtttcaagtaaaatgtatatgtacatccattcattcaacaaaaatctattgcagaaatactatgtggtaggcactgttccaacatggtatttggggaaacatacaataaattaaataatataaaaaaaatgttaagcagaggtagttaagtgccatcaaggaaaaaaccagagcaggggaagagtatggagtatgagagggaacagggctcttatagactagaccacctgaagagccaccagatgggcacttgaataaagtgaaggtgtgtgagccatgccaaatctggggaaacagctagtgcagagactgagttgggagtatgttcactgttcaaggaaaagcaagaaggccaatgtggccaagtcagagtcaacagggctgtgactaggacagtgcatgcagactgtgatcacataacgcctcgcagagcatggaaggagttggggtttttactctcactgtgatgggaagccactgggtcattctgagcagagacttgatgtgtctgatttacatttaaaaatatgcactctcatcacttagcatgttgggaacgctagtgcactgcaagaatgttatcaaaccagttgggaggtgactgtagatgtccaggcaagagataattgtgccttggactagggtaacagtcatagaggcagtgatgagatgtgggatatatggagaaacgaaagcaggatgaacttgctaacagactggacattagagaattagactgggggatgacactgaagttttgggcttgagtaaacaagagtcatttaagtgcttaggaacattttgcttgataggttaatctgcctatgcactggggatttgaagaattgaaaaaactcaaatatcaaatatgttcaatttataaatgtgactaaactgcttaaagagatgtattaactaaatttgcaaatgggtattactgtttaggacaatgtaatcctttccattagagtttaccgaacattcatcaaagaacaagagaaaatgattgttccttatttttatgcaaaaagtaattcaatttactaatctttttatcctatttataaattgaacctcaagaatgaaaaacaattaggtttttaaatttgcaactataataaatagtatattaattttaaatccaaattgcccaacaatcctttctaaatacaaaagccccacagaaactaaaacactcgaactgacacagtatttagtgagacaggaaaaatgtctgtgacatattaagtgaggggagggagaagcaagtcagaaaatgttgtatacattatatgagaaatgtgtaggtatatgttatttataataataagctttcttctaaagaaggtgtgaccaataaactacaatcagtttttcacactgtggtctttaaaaaacattcctctgtggagtcccagctacatgggaggctgaggcaggggggatgcttgagcccaggagttcaaggctgtagtgtgctatgattgcacctgtgaatagctcctgtactccatcctcggcaacagagcaagaccccacctctaaaacaaacacccccaaaacattctttctctacccaaaagcagaccctcaaatagttgttgaatcagtgaataaaatattaacagtattgcttctgggccaaagaattgtttctacctcatattaataattctccagatttccaaattttctatagcaattgtatattcttataatcagaaaaaatcttttaatggtgattataaggattgttttaataacatgaaaaattgcttataatattgatggaaaaaagcaagtaaaatggagtatggttatgaacacaactacacagaaaggattaaaaagggacggggtgaggtggcttacacctgtaatcccagcactttggaaggctgaggcaggcggatcacatgaggccaggagtttgagaccagcctggctaacatggagaaaccccacccctataaaaaaaaaaatacaaaaattagctgggtgtggtcatgggacctgtaatcccagctacccaggtggcagaggcacaagaattgcttgaacctgggaggtggaggatgcagtgagctgagatcatgccactgcactccagcctgggtgacaagagcaagaccctgtctcaaaaaaaaaaaaaaggattaatggaactatgtccaatattgacagtgcatgtctactaggggctatgtggatcactctcctttgctagaatgttcaaacttttctgatctctcctcatttctttcaagaacagattctatgtagattcaatgaatttcatattgccaaatcacacggacatttttctgtcatcatcttcctcaacctcttggcaacaatcaatacaacgaggcttccctggctgaaatactcctctttcttccctttcctcctaccttgctagctacttaccttgttctttgctggtttggcaggtttgaccattgtcctaagctcgatttgtatattcagctgtttacttgatatatatctaatcatgtagatttcacaacaggtatcacacacttactatgtccaaaaagaggcttctgattctaattctccacccctaccaacccgcccttctacaagtcttctcatctcagtgaatggtcccagcattatggtaccaaccactcaggccccaaacctatgaatcatccttgattcttctctatcgcctccatgtaatggccctcacctgccaccctgtttctctacaaaggcttctagaacacatcacgccaaatgaaaaacagctgaccaccacgatgttaagcatcttaaacaaattggcctttcaagggcaaaaccatttattaatttttccctgggcacagaaaaattttcagggacaaaattattttctgttaaaaaaaaaaagaaaccctttaccatacactattattttttaaatgatgtatttatgtattacttcagtaaattaattttaataagaaaaatcaatgtacgaggagagactggtgtaactatgctgagagagaaagacatgttactaagaaatgaacagaaagtgccaccaagtgggaaaacggtatacgtgcaatagagaaaaatctaaccaagccatgtcttgctttgtttttttttttaacttggttcaaaggacttcaaggttccaatacttcaaaccacaaaaagcacatctttatttcttctgatacaagtgaaaacaataattttatacagccgtgcatgaaatagcccaaactttctacttttctacactaattctatataaatgctaactaccataacaatgaaaatgaagacttctgtgtgttactgtgtagacggtggcaattagataacttcagaataaaactgaaggcaataaaattggcattgaacaaaataaagacaagaacaagagaaaaaaaaagaaagaaaaagtagtatagaatagtacttgagctgggcacggtagttcacacctgtaatgtcaacactttgggaggccaaggcaggtggatagcttgagcccaggagtttgagaccagcctgggcaacatggcaaaacactgtctctactaaatacatacatacatacatacatacaaacagtagccgggcatggtggcccgtgcctgtagccccagctactccgggtgctgaggcaggaggatggcttgagcccaggaggtcgaggctgcagtaagccaagatcgcaccactgaactccagcctgggtgatagagcgagacactgcctcaaaataaaataaaatgttatttgttatctacttaaatactttcagggtattctactcaatcaaattaaatataaattcctgaagaagaaattaatatcttgttgctgatcccataagagaataaaacatataggaaaatgaaggtactgtaaaaaaagacactaaattagaacacagtattagtactagtattcattaagtgcctataaactacaagagaacaaagaccatacatatttcactcaccactgtgaatatataaacccatcaaggcctgacatataggggggtgctcaatatatatttgttgaatgaatcaagtttgtaagcagactgtgttaggttctaggcaatccgtttcttattttcaaggcacgtgtagctcaactgcccatccaagaagtttgcaccaccatcttttgtttttgtactggtggacttagcagcctttactggtggctggtagattcaaagaagtgaaggcctttagaccagagagataaaatgagctcatttttccacaagatttctaatgtttcccataagattagagaacattaaatgaaacagagaagctgactaaaattctatccaaaacgctaatgtctctaagggaaatctttccctaggtgagattatgcagctactgaacagactcataagactatcataggccacacttggcatctgagaactcaggacagaggacaggaatcacagcttgccagctgggcagcatcagatgttcctctccctgggagtctgtgcagttgttcatgcaagtgacagctcacccagccgtccagaagctattttctttttcttttcttttttttttttttttttgagacagagtctctctgttgcccaggctggagtgcagtggtgtgatctcggctcactgcaagctccgcttcccaggttcatgccagtctcctgcctcagcctcccaagtagctgggactacaggcgaccgccactaggcccggctaatttttttttgtagtttaagtggagacggggtttcactgtgttagccaagatggtctcgatcacctgacctcatgatctgcctgctttggcctcccaaggtgctgtgtgtgagccaccacgcccggcccagaagctattttctttaactccctagatgacacagctcaggctcaagggagatgagagcatcatgagacaggtgcaggagctgccctaacttcaaagctttacgctccaccagagccaacgtctctagtaactccaaaggcatagcttcaggattccctttcccacagggtcatgccagttctaagagcagcagcactcaccaggcatttctaattcctctcaatccagaggcaatttcccaatcagaggtcgattttatattgcaatactgttaaaacaattttatctggtttccaggataacagagctaggcatttaactgaaggtcatattctcctaacccttaatttataaagttaagttgaatactacactagataaaatcaaaccaaaatcctatctccagcatcaatctctagcctaaccaacaggctagttttcaactgtctactcaccttctcacgtggtcgtctatcaagcttctcatacttaacgtagactacctcttctaaacctgctccccctactccactcttccctatctcagtaactgtacctctagtagttcaggccaaaaatattgaagtcatccttgactggtttttctctcaaaagccaatcaatcagcaactcctgctgaccccatcttacttggcaccctctaagagggcctccaacgatcactgcctcctggtattcacacccttgtataataccctcattttaagtgtggctggactgattgacttgcttctaataaatagacaactgaagtatgggatatcacttcctagatgaggtttaaaaagactgttccttccaccttggtctggggaagccagacgccatgtcaagaggtggcctgtgcagaggtctactgaatgagctgggaagcaaatcttctgaggtctgtctacagccacatgagtaagtgtggcagtgggtccttcccaagtcaaaccttgagagcacagcagcctcagagaagatctcagctgtaaccttgtgagaccctgagcctggggcacccagctaagctacactcaaattgctgtgagataacatttactgtcttaagctaagtttaggataacttgttccacagtatagacaactaatacgatcccaaatctcacaacctgcatcactagcaccctagtccaaccccatcaacagcctaggccatgacttacaacagcttcttaagtgagtagcctgcttccacacttgccttgcctccttcctttattcttcacagcaaccacagagatgctttaaaaatgtaaatcagagtgcaaaagtcattaagtgggcccgaggaatgtagcacttggtatgtgagggagggtgttgcggtagcccagcaagatgtgtcagagcctttgtggggagaagagcctgtccacacaaggagaagggagggtggcaagctggtttggggtgctggaggcaaaatagggtaaggaggaagtccagtgggggaggggggatgagagggcagcaatgggaacttagttacacacagtggaattgatcaaataactatattaagaagaaaccagctataaatgtggaaagggagaaaactggagtgtaaactgtagtgctggactgccgtcagtggtactggtggggacacacaatcattacccatgtttcctagcttgtccactgagaaggcctggaagcactgacattccaataatgatgagcacatctgacattcatatcttagtttctaataccactctccactaaaaaacaagcaaacggccgggtgtggtggctcatgcctgtaatcccagcactttgggaggccaaggtgggtgaatcacctgaggttgggagttcaagaccagctgacgcaggagaatcgcttgaacccagaggcggaggttgcggttgagctgagattgcgccattgcactccagcctgggcagtaagagtgaaactccgtctccaaagaaacaaaaaagcaacaaaaaaaagcaaacaaacacagggctcctcagagaaatggctgtctccaaggctggaacagagaaactctaagatgaacctggaacacctcatgtcagaaagtaagaaggtgctccaagaatgatgaagacttttcaaaatgaccccctctaatgctaatagccaaaaaaaaaaaacaacaaaaaacccatatatatataatatatatatatggaattaaaaaaactcaccatcctggccaacatggtgaaaccccatctctattaaaaatacaaaaattagctgggcgtggcagcgcacgcctgtaatcccagctactcgggcggctgaggcaggagaattgcttgaacctgggaagcagaggttgcagtgagtcaagatcgcaccactgcactccagcctggcaacagagcgagactctatctcaaaaattaaaattaacataacataacataaaataagataaaataaaataaaataaaagcaaagtggctgggcatgatggctcatgcctgtaatcccagcattttgataggccaaggtgggaggattatttgaggccaggagttacagacctgcctgggtaacatagggagactgtgtttttataaaaaaaatttttaaattagtcgggcatggtggcacatggctgcagttccagctacttaggaggctgaggtggaaggattgcttgagcccaggaggtcagggctgcagtaagccatggtcacaccactgtacttttgcctgggcaacatagcgagaccctatctttaaaaaaagtggttggtaggccgggcgcagtggctcacgcctgtaatcccagcacgttgggaggccgaggtgggtggatcacgaggtcaggagatcaacacaatcctggctaacatggtgaaacctcgtctctactaaaaaaatacaaaaaatttagctgggcatggtggtcagcgcctgtagtcccagctactcaggaggctgaggcaggagaatgacgtgaacctgggaggtggagcttgcagtgagctgagatcacgccactgcactccagcctgggagacagaacaagactccatctcaaaaaaaaaaaaaaaaaaaaagcggttggcagggacaaagtacccagacatttctcagaagacatacaaatggtcaacagctatatgaaaaaaatgctcattgtcactaatcatcagggaaaccagatcagactgtgcaacatagcaagagctcacttctactaaaaataaaaataggccaggcacagtggctcacacctgtaatcccagcactctgggaggccgaggtggacagatcacctgaggtcaggaatttgagaccagcctggccaatatggtgaaaccccgtctctactaaaaatacaaaagttagctgggcatggtggtgtgcacctgtaatcctagctactcaggaggctgaggcaggagaatcgcttgaacccgggaggcagaggttgcggtgagctgggatcacgtcactgcatcccagtctgggcgacaagagcataactctgtctctaaataaataaataaataaataaataaataagctagtctcagctactcaggaggctgagttgggaagatcgcttgagcacagcatattgaagctgtagtgggctattaatgtgccactgaactccagcctgggagacagaacaagaccctgtcttcaaaagaaaaaaaaagaaaaacaagcagagtagaatggtggttaccacgggcaggaggagtggagagtataagaaagaggagatgttgataaaagagtacaaaatttcagttaggaggactaagctttagtgctctactgcacagaatggtgactgtaataaataataattcactgtatatttggaaattgctaaaataattttaagtgtttttaccacaaaaaaatgataagtatgtgaggtaattgatttactaattggcttgatttaatcattccacaatgtaaacatgtatcaaaacatcatattgtaccccacaaatatatacaattattatttgtcaattaaaaataaaattttagcctgggcaacactgtgagacccctatctcctaaaaaaaaaccagcaggttgtggtgatgcacccctgtagtcccagctacttgggaggctgaggcaggaggatggcttaagcccaggaggttgaggctggagtgagctgtgaaagcaccagtgcactcagcctgggcgacagagtgagaccctatctcaaataaaatatttttaaaaactgagaacccctcccctctaaaaacctccaaagaactccaaatgcagcttgaatgggttccaactagtcaaattgagcccaatttgaacaataaaagaaccatttaaagcaatggattataacccattgattaaaataggagttgatacagatacaaataatgaattaaagctttgatgagtaaggggatacttacataacctcaaagtgtctccccacaaaatgctaattaatttcaaagggaaaattagtaactttagaatggagaaaaccggcagaccccttaatcacgtgatagaggttttcattaataataggacaaaaacaaatcagctgctacttaatagagtgcaacaagaaaaacatggcttcagtgacaggaatgtcacagaagcatagcctgaacctagtcatgaggaaacattcaacaaactcactgagggaccttcaacaatataactgtcaagtaattttcaaaagcgtcaaggtcatgaaaatcacagaaaagttgaggaaccaatcaagtgtgaaggagactaaagaacttgagatccatatgaaatgtgtgattggatctctctataaaggacactgttgggacaactgacgaaacctgagtggctgaagttcagaacacgctgctccaaaatatgcagctctggcatatggactatgctgagttaaaggcacttgaacaacagcaggcacggctgggtgtggtggctcatgcctgtaatctcagcactttgggaggccaaggtaggcagatcacttgaggccaggagttcaagaccagcctggccaacatgatgaaaccccgtctctacttaaaatacaaaaattcgccaggtgtagtggcacatgcctgtaatcccacctacttgggaggctgagataggaggatcatttgagcccaggaggtcgaggctgcagactgtaccactgcactccagcctgggtgacagggcaggacattgtctcaaaaaaaaaaaaaaaaaaaaaaaaaggtaaagaaaaacagcaggcacaagaataatatggcctttttctttctgaaagcaggagaaaaaattcccacatcaaagatatcctccctataccagaaggaaactatcattctacatcaaggacaggaaattgaggtcaagggaaatctgcacaaacgttgttaaattaacttttatcttcttagtcacttctccacccaattaacctactcaagcccaagtccctttgtcttctcattttcagtgttctactccttgtccaattcagtatctaagtgttcaacatgaactgcatctttgggtcttcatcccttatgagggctccacatcacggaactcttatattaaataaatttgtatgcttttctcctgttaacatgtctttaattctcaagcccaaccaaaaagccctaagaggataagggtaaaattttgcctccctttcatagtgtatctttgttactttcctgatatttatggtcatattgtggttatgtaggacaatgttcttgtttgcaagacgtacacactaaagtattcaggagtgatggggcatcaatttggcaacttacttttattaaaatattagtaatgattctgaaagttcgggattattccaaatgttaaaaaactgtaaatcagatcacaccctatcttaccttccagtgacttccaaataaattcagacaaaaagccgaagtatgtaccatggcttactgaaagattctccctgaggcctgaaagcttgaagagatgaataactcctcccttctcaggcccagtcccaagcttgggccagcagcgtgggtcagcaagacagcagaagcaggaagagagctggccgaaagacacatacccccttgaagattgaggggcaggccgtccaggtactatgtagcagttacatcagactgagacacttcctgtttacaggagactataaaacccctgccccatcctcatttggtgctaacgccattttaggcatcagcccacctgcacccaggcgctcattaaaacagtgtgttgctccacactgccatgttgtctgctgatgcactctcagggttcgagccgatacaagaacctttcatcttacaacatctacatgatttgggccctagctatttctcctacctcgtttcttaacatcttcccctcactcattccattccagccaaactggccatactgctgttctttgaacagaccaagcaatacatctcaaacatacaggctttgcacctgtggttccctctgcctggaacgctttctccccgcttctacgtctttcctcaaatgtcactttctcaaagaagctttctctaactgctgtataaaacagccacctgacccttccattgctcttgattcccatgaggcccagcttcatattatcttccttgcatttttcattaccacaattatataaaggatgtttttctgccttcccctatgaaaacaaggaccttgttttattcactgctttaccccaggttcttggcacctggtaggtactaaatagttatttgaatagggatgataaattgtatctgtacaattactctctacacgtgataatacctagctctctaattagagatatatcaacccaacatcaaatttattcatgaatcaaaggtaagaatccacagatttagaattccacagtgtgtcacggtcaacaaagaggggtttgagaaacaaacagctaagcttgttcaacaccatttctccctaaaaagattcatcacaagccgtgaagcttcccatacaaataagggtcatcaaaggtactcagaccttaggaggctcctctccacaaagaaatgcagctttgaatcctcacttgcccttaggcacctgctggagtgatcttctacagctcttagcttcattttcatgtggtctcagatcaaataaaaggacttgctccactgaatagaacttttagcttttcaggtttttactattttataattttaaacataattaatcgcacataattgaaatcacacccctacccctcatctcccaaaatgtggcccctgagcaccaatgttagatgaacattttgaagcaggtagatgtcaatctgaataagacagctcacatgccttctatagcctcccaggaccaattccacccaagaaacaatctctcagttaaacaaaaaccaggacacctcagctcctaaagcctgaattccatgttgacaccttggtctcaaatagtcctcctaacatatagaatgcccctttggagaaggttgatggttctaaacctaaaaccaaagctcaatgcatgctgggcttaatacctaggtgataggatgatctgtgcagcaaaccatcatggcacatgtttacctatgtcaacctgcacatcctgcacatgtaccctggagcttagaataaaagttgaaggaaaaaaataaagagacatagaatgtggaaaaaaaaaaaacaaaaaaaccccacagctcctcagaccttaacggaaccacaggttgttatttcccactaaaaagagtgcaacagcaatccccaaatgatgtagcatgagaaagctcctaatcagtgctgctttctcacggtaagaaccaaagagctttttttattcagagacagggtttcactctgtcacccacgctggagtacagtggtgcaatcatacctccttgcaacctcaaacccctgggctgaagggatcctcccacctcagcctcccaagtagctggaactacaggcatgtacaaccatgcctggctaattttctaaaactttttttatttatagagatgaggccttgttatgttgcccaggctggtctcaaacttctggcctcaagcgagcctcatgcctcagccttccaaagtgctgggactacaggtatgagccaccacaccaagccccagtgagcttttaaagatattatccattatcatattcttcaaattacatcactgacacagtcagtgctcacaattagtccaagtagtagaacaggggttgaaatctggttatagctcagcaaaaatgtacagtacaaatatgttttgcttagctcacagtatttgaaaaacaaacaaactattctgtccaatcgagtagcctacttatcttaaataaaaattttaaaatgtcctcagttgcattatccacattttaaagtgctctagaaaggccaggtgtggtggctcatgcctctaatcccagtattttgggaggcagaggttggcgaatcatttgagtccaggagtttgagaccagcctgggcaacatggcgaaacctcatctgtactaaaaatacaaaaaaattagctgggcatggtgccacatgcctgtagtcccagctactcagggggctgaggcaggaggatcacttgagcccaggaagtcgagactgattgtgccattgctctccagcctgggcaacagagtgtccccgtctcaaaataataataatattaataataataaaatgttctgggccacacgtggcaagtggttaccctattggacagggcagataaagaacacttccgtcattgtgaaaagttctgctagataatgctgtatttaaaatgtcaaatatttttaaaaattaattgaaaaaaaaaagaactgacccggtgcagtggctcatgcctgtaatccctacactttgcgaggccaaagtgggtggatcactcggggccaggagttcaagaccaacctggccaacatggtgaaacctgtctgtagtaaaagtacaaaaattagccaggtacggtggcaggcacctgtagtcccagctacttgagaggctgaggcgggagaattgcttgaacctgggaggcggaagttgcagtgagccaagatggtgccactgcactccagcctgggcgacagagtgagacgctatctcaaaaaaaaaaaaaaaagcaagaaaaaacaagaagtctcacaaataaatacagatgtccacctttgaaaaatcatccagaaacccttcgcagaattctcacctgatggaactgcaggttgctgaataagcctgctgccctctttgacaagtctgtacttttcagttcactgcagtctccactacgtcctattgtttcatagctgcacttcactcacttatgtcacatatctgggtttccaagtgactctttagaacagaggcaaatacactgagattatcccactttctactgaagacagcccaaaactagctctgatgatcaaattcaattaaaataaaatgtcacagcccaccagatatacttatttctagtttttgggtgaaattttctagaccactggaaaggagctccagagtttaattgtatatcaactgtatggtattatttcagcaatctatgaaacagatataagtactttgctttgaaatacgtcatgcaaaatttggtaattcaagtgagcatttagaatttcatttcaaaatatgcgtattataaagtcatacaaattttagagacctaaggaattttagggctctcattttatagacaatgagactaacccccagagaggttaaggaacttgcttaaagtcaaactgccagataagattacagccaaagttcttttcacctttcgcttcacccagacaggtgatactatggcatattgtttttccaagacagccacaccattacacatcccaatatatactgtgatgttgacatgcctccatcaagagataggttcatgttttctcatgtagaacttgggtggagctttctaattgcctcaatcaatggaatatgaaagtgacactggacaatttgcaagactaagttagataaggcaatatggttcctgcctagctcactctctcagagcacttgcctgtgtcagcccaggcaacaggaaggtgttccaacccacaggcccaactatacccccagctgacagccagcaataaatgccagatactaagtgaacaagttttcagatgattccagtgtccagacttggagtcttccagctgaggctccagacatcagacatctaggagcagagactagccaccctcgttttatcttgtctgaactcctgacccaaaaaaaaactatggagagagaaacagttgttgttttaagccactaaatttaagggtaacttattatgcactcaatgtaaataggacagatactttcagaagaacaccactgactgctttatagagagatattcaataaatatttttgtaatgaaataaatattgccaagttaaataaaataaaatgaaccaggcatggtggctcgtgcttataatctcagctacttggaagggtgaggtgagaggattgcttgagcccaggagttccagcctgggcaacatagcaagatcccatttcaactaaaaaaataaataaaagctgggcatggtggctcatgcctataatcccagcactttgagaggccgaggtgggtggatcacttgagcctaggagtttgaggccagcctgggcaacatggcgaaatcgcatttctataaaaaatacaaaaattaggccgagtgcagtggctcatgcctgtaatcccagcactttgagaggccgaggcgggtggatcacctgaggtcaggagttcaagaccagcctggccaaaacggtgaaaccccatctctactaacaatacaaaaattagccaggcgtggtagcatgagcctgtagtcccagctactcgggaggctgaggcaggagaactgcttgaacctggcagtcagaggttgcagtgagccaagatcatgccactgcactctagcttgggcaacagagtgagactctgtctcaaaaaaaaaaaaaaaaaaaaaaaaaaaaagccaggcacggtggctcatgcctgtaatcccagcactttgggaggccgaggtggatggatcacctgaggtcaggagttcgagaccagcctggccaacacagtgaaaacctgtctgtactaaaaatacaaaattagccaggcgtggtggctcacacctgtagtcccagctactcgggaggctaagacaggagaatcgcttgaacctaggaggtggaggttgcagtgagccaagtttgtaccactgcactccagcctgggcgacagaatgagactctgtctcaaaaaagaaacaaacaaacaaatttaaaaacaaaacaaaaattatccgggtgagatggcatgggcctgtagtcccagctactagggaggctgatgtgggaggatcacttgagcctgggaggtcaaagctgacatgagtcatgatcatgtcactgcactccagcctgggtgacagagtgagaccctgtctcaaaaaagaaaaaaaagaaagacaaataaaatgttgtcttagcttaccattcaggaggcaccatgcttccatccacatcccagaatgtgtttttgccattcatttcagtagtatatacaacccatcggtgacggcctgggtgggaagatgaacatttaaaaagaaaaacttttttttttaaagcatagatgcataatatcaaagaagacaacctttttattaagaaaagactttttgtgatcttatataagagagctattggaggaataacaccctgggtgaattcgtgaaggtaagctccaggaggtgtgtggcaaactttaagcagcaacccgcagcaaggactgagatgattcactgctgtgggtggggctcaggcctttcccacaggggagaatccttgcttccctgccagctccccacagagggagtagcagacaggataggaaagtgtgttcccagatgtacagggtattcagaaaagaaggtgttcctcttgagactggggaaaaaacacatttgtagcaatcatacttgaattctatgtctccacataagtatttttttaaaaccaccctagatccttttggaaatttgtgaattatatacaataagcaaacattagaaatgatggttaggtacataggacagctcatgtcatcaaaataatatggctgcactcctcatttaggaaatttctgtgcactagttgaggggcctaaccactacttatttacacaattgggtccttaaactgagcaaagacttgggctttgtcacttattatcagtggttattaggcaaattttatgagcctcagtttctttatctagtaaaagtggatgactatacctacatcttagagttgctgtgaaaattaaacatcacatacattcacctagttcagcatcagccatataagcacataataagtattaattccttctaccccttccttactgctcttacctgccaatagggaacactgaatccattcattcctatgatggactttaaaccaataagtaaaaggtaatctgcatttcatttacagggttttcccaggtaaacatataatcaacaaaaattgactaacggtacttaaacatgacctcatctctttttaaaaatacagatttcaatcaacatttactgcttcatttagagaaataaatcttaagaatagctaactaaaagtaaactataatccagtgaggcaggggaatgtgcaggcagatggaggagaccttgggaaaggtttcataagtcaagccctgacaatacagttaggctataatgatggaagtgggccctaacaatctctctctctctctgtctgtctctctctctgtatttcttgaaatgttaaatgcctattctcagactcagaaattcaactttatttatttatttatttatttattggagacggagtctcgctctgtcgcctaggctggagtgcaatggcgcggcctcggctcactgcctgcaacctccccttcctgggttcaagcgattctcctgcctcagcctcccgagtagctgggaccataggcatgtgccaccatgcctggctaatttttgtatttttagtagagatcaggccagaaatttatttaaacacatgaatgtagttacaagcaggtttacagtagcatcattcctaatagcaaaaagtcaaaagcaatctatgtgtctatcgatagtaacaggattgaagaaataatggttcttccatacactggaatgttgtgttgctatttttaaaaatgctgtgcattttttttttttaataaacacaactggctgggcacggtggctcacttcttaatcccaggactctggaaggctgaggcagggggatcacttgagctcaggagttcgagaccatcctgggcaacatagtgaaaccttgtccctacaaaaaatacaaaaattagctgggcatggtggcacatgcctgtagtcccagctactctcaaggctgaggtgagaggatcacttgagcacgggaggcagaggttgcagtgagccgagatcacaccactgcatttcaggtggggcaacagagagaccctgtctcgaaataaaagaaaagaattttaaatatacataaagactaaactattgaaagagttgcaaaattataaggggagggagctttcatacaccaaatatatataaatacatacatatataggtacacacacacacacacacacacacacacacacacgagatgggggtctctatgttgcccaggctggtcttgaactgctggcctcaactgatcctcccaccttagcctcccaaagcattgggattacaggcatgagccaccatgccaggccctaatttttttttaattagcaaaaataagaatatttccaatgcaagggagaacagaagaaaggaggctggctgcagtggctcacacctgtaatcccagcactttgggaggctgaggcgggtggatcacgaggtcaggagttcaagaccagcctgaccaacatagagaaaccccatctctactaaaaatacaaaaaattagctgggcatgatggcgcatgcctgtaatcccagctactcaggaggctgaggcaggagaatcacttgaacctgggaggtggaggttgcagcgagccaagatcgtgccatggcactccagcctgggcaacaagagcaaaactctgtctcaaaaaaaaaaaaaaaattaaagaaaggaaagaatgtaatattatagtttgtaacaatacagtgagaagtagaaagaataattaccccaggttctgccattaattacatgattaagtctctttggtaaagatacttccttgggcctcagtttcttcatctataaaacaatagtttttagacaatctcttaaaatctattctaggtctaaaattctgtgatttatgtattaaaaatatcataactaggtgtgacagtatgtgcctgtaattccagctcctcaggaggctaaggcgggaggattgcttgagctcaggagttcaagaccagcccaggtaaaatagtgagacctcatcacactcacacatacacacacacacgcacacacacgcacacacatagagtacataagatgtttacttcttatagaccaacatgcatccaaagcaaccacattcctgagaaatattcctaactattcaatgacttaccttcttcatctgtgaaatgggggcggaggagcacagaagtgcttatctcaaggagatgttgaagattaaggtagataacgtatgtttttgtttagcacagcacctagcacatggtaatcactcaataaatgccaggcaattattttttcacgttatacattgttcccctggatgaagactaattgctttttcctctttgatacttttcatctcaatcaagagagtatttttttattattataaaagtaacaaatgcacatgggagaaaattcaacaattcaagaaggtacaggttgggtatctccaattccaaaagctccaaaattggaaactttttttgtgtgctgttatgacactcaaaagaaatgctcattagagcatttcagatttcagattagagatgctaaactgggacgtataatgcaaatattccaaaatccaaaaaaacctaaaatctgaaatacttgtggtcccaagcattttgggtaagggatactcaaactgtaaaaataataacagcagtcacagtgctaatatttattgagcacttattatgtgccaagcattaggccaatggttcttaacagatggaaattttgcccccaaggggacatttggcaatgtctggagacatttttggtttgtcagtcagtgctgctgctgctggtcattctatgatgcacaggacagcccctcacaacaaagaattagctgtctcaaaaaaagaaaactacaaaccaatatccctgatgaacacagatgcaaaaatcctcaacaaaatattagctaaccaaatccaacagcatatcaaaaagataataatatatcatgatcaagtgggttgaatactagggatgcagggatggtttaacatacccaagtcaatgtgatatatcacataaatagaattaaaaataaaaatcatatgatcatctcaccagatgcagaaaaagcattcgataaaatccaacattcctgtatgataaaaaccctcaacaaaattggcacagaaggaacatacctcaaagtaaaaaaagccatatatgacaaacccacagcaaacatcataccgaatggggaaaggctgaaagcattctccctgagaactggaacgagacaaggatgcccacattcaccacttctattcaacacagtactggaagtcgtagccagagcaattggataaaggaaagaaataaagtgcatccaaatttaaaaagaggaagtcaaactgtcgctgtttgttgatgataggattatatatctagaaaaacttaaagaccatccaaaaagctcctagacctgataaataaatccagcaaagtttcaggatactaaatcaatgtatacaaatcagtagcacagctatacaccaacaatgaccatgctgagaatcaaatcaagaactccatcccttttacaccagctgcaaaaaataaaataaaatacttaggaatatacttaaccatggaagtgaaagatctctacaaggaaaactaaaaaacactgctgaaagaaatcatagatgacacaaacaaatggaaacatatcccatgctcatggatgcacataatcaatattgtgaaaacgactatatggcccaaagcaatctacagattcaatgtaatttccatcaaaataccatcatcattcttcacagaactagaaaaaacaattctaaaattcatatggaaccaaaaatgagcccacacagccaaagcaatactaagcaaaaagaacaaatctagagacttcacattacccaacttcaaattatactacgaggctacagttaccaaaacactatgctaccggtataaaagtagctaggtagaccaatggaacagaacagagagcccagaaataaagccaaatactcacagccaactgatcttcaacaaagcaaacaaaaacataaagtggggaaaggacaccctattcaacaaatggtgttggaaaaactagcaagccacatgtagaagaatggaagtggatcttcatctcttgccttatacaaaaatcaactcaagatggatcaaagagttaaatctaagacctgaaaacataaaaattctagaacatcacatcagaaaatctcttccagacattggcttaggcaagaagtcataactaagaacccaaatgtaacaaaaacaaaaataaataaatggtacctaattaaactaaaaagcttctgttcagcaaaagaaataatcagcagagtaaacagacaacccacaaagtgggagaaaatatttgcaaactatgcattagacaaaggactaatatccagaaactacaaggaactcacacaaatcagtaagaaaaaaacaatcccatcaaaacgtgggcaaaggacatgaacagacaattctcaaaagaagatatacaaacagtcaacaaacctatgaaaaaaatgctcaacatcactgattatcaggaaaatgcaaattaaaaccacaatgagatagcaccttactcctgcaagaatggccataattaaaaattcaaaaaataatagatggtagtgtggatgtggtgaaaacacaacacttttacactgctgttgggaatgtgaactagtacaacaactatggaaaacagtaaggagattccttaaagaactgaaggcagaactaccattcgatccagcaatcccactactgggtatgtacccaaagaaaaagaagtcattacatgaaaaagacacatgcatacacatgtttatagcagcacaatttgtaattgcaaaaataaggaaccaacctaaatgcccatcagtgaacgagtggataaagaaaatgtggtatatatacaccatggaatactactcagccgtaaaacagaaagcaataatggcctttgcagcaacttggatggagctggaggccattattctaagtgaagtaactcaggaatgataaaccaaatatcgtatgttctcacttacaagtgggaactaagctatgaggatgccaaggtataagaatgatataaaggactttggggactcaaggggataaaagactacatactggatacagtgtaacactgctcgggtgacagatataccaaaatctcagaactcaccactaaaaaacttatccatgtaaccaaaaaccacctgtactccaaaaactattgaaataaaaaaacaaaaaatgaatagaattatctgccccatagtgttaacactgctgaggctgagaaaccctaatcacagtaagttcctcccattcacttttcatcttttaatacagctttaggaggcacatattattattattctactttacagatgagaaaactgagggttagggaagttaattaagttaaccaggtcacaaagttataaagtggaggggcagaatgttgaatctctatcatctgattctatgagtttattgagtttccttccaaaatttaacatgcacacaaaaagcatgtattttctccttttaaggataccaaacattgttctgctactggaatttttttatattacacacatctttgacatctctctatattaaatttataggtttatatcattcttaacaacaacgtattccaaaacacgtatacatatgtaacaaacctgcacgttgtgcacatgtaccctagaacttaaaataaaaaaacaacaacaaactattctaaaaaatgtttaattcatcagtatccaacttacgcacactaatgttgcttttaaaatttactagcacggtggctcatgcccgtgatcccagcactttgggaggctgagacaagaggatggcttaagcccaggagttcaagaccagcctggggaacaaagtgagaccccatctctttaaaaaaattaaaaaattaaccaggtgtggtggtgcatgactgtggtcccagctacataggaggctgaggcaggaggaaggctagaacccaggaggtcacggctgcagggagtcaagatcacaccactgcctccagcctaggcgacagtgagaccctgtctcaaaataacaacaacaaaaacaaacaaaaatgctgtggccaggcacagtgactcacatctgtaattccagcactttgggaggctgaggtgggaggatcacctgagcccaggaattcaagaccagcctaagaaacatagcaagacctcgtctctccaaaaaaaaatttttttaaacaattagccaggcatggtgacacatgcctgtaatcccagctacttgggtggctgaggtaggaggacagcttgagcccagaaagttgaggctgtagtgagccatgatcgagtcactgcactctagactgggtgacagagcgagaccctgtctcaacattaaataaataaataaatttttaaaatataataaaacaatgctgtgatgtatgttggtttgcaagaatatttgtagaattaattcttttttgagataagagtctcgctctgttgccagactggagtagagtggcgggatctgggctcactgcaacttccgactccctggttcaagcgattctcctgcttcagcctctcaggtagctgggattacaggcacacgccaccacatccagctaatttttgtatttttagtagcgactgggtttcaccacgttgggcaggatgctctcgatctcctgacctcgtgatccgcccgcctccgcctcccaaagtgctgggattacaggcgtgagccaccgcgcccagccgaattaattgttaaaagtggaagtgctgagacaaaggatatgtgcaatgtaaatttttacaaatgttaccaaattatccctccaaaaagactgcattaacctacatatttatatggttttgcccacattgggatttatcagcttgaaaaatactcaaggctggacgcagtggctcacgcctgtaatcccagcactttggggggccaaggcgggtggatcacgaggtcaggagttcaagaccagcctggccaatatggtgaaaccccatctctactaaaaaatacaaaaattagccggccatggtggcgcccgcctgtggtcccaactactcaggcaggctgaggcaggagaatcgctggaacccaggaggtggaggttgcagtgagccgagatcgcgctactgcactccagcctggccgacagagactccatctcaaaaaaaaaaaaaaaaaaaaaaaaaaagaacaaaaacacttcaaaatttgataggtgaaaaatatataacactgtttttaaagttgcatttctgttgttacaagtgagaatgagcatttttccataccttcattggctgtttacttttcttttttctgtaaattatcttttttcattttctattgagtttttcatccttttccaggtgttttgtaaaagctcattgcataatatggaaaatagactcaaatcaaatcccaatcccaatccaattattcatactaaaaaatactgcactcaccaaaaaattgcttgttgtcttcatagtatttgtttccatatttgtcttcccccactaatgtaccaaccttcgcatcatttgtcctgtgaatacccaaaagaaaacagacattttagaatgattcttagttcaaaacataaacggaaataaagtgagagtaacaactttcagacacaagggctgctgcatcaactagcaaaatgaagaagtgctggggatgggaaaagatgaattgacaactgatgtgctcaaattacactaaaaatataaatgtagtctcttcagattacaggactacttgtatctactatccctcagccaggaggcactggaattagcaaaacctttaggaaatcaaaaagccaaagtatttcatcttcttacaatgatacgaaggtctccaggctctttcattccactctgggtctccatttaggtttctgcgaaactatgctgctcgtgggatcagtgaatgtcaggaagagaagggaccatcattattaccttcaacgccttacagacaaggaactgtacggcagtgcagggaaaaaaactttaccagggtcactgagttaatgtcttgtaatcctcattactctccagggcgtgggaaaagaggggagcccagatgcccttgcctccgagtcacagctctgactctacagatagcttcggtcttgtatcggggatatatgggacagagaccagcctgggggtggcaaggcagagattggggcggttgtccttgacaagagctgtggattctccaaggtgacccgagcctgggaccccttccaagaaatcagccagcgaaagtccagccccagaggccaagagcatggctctggccgcctacctgaaaaaaacccgtagatagcctcggagaccgccgtggccggtgatctgctgcagcccgcgtttcaggacctgcactaactccatcttgcctcgctggccccgcctcccgggtgcgccgagcaaaacccaccggatggaagctgccactcagccgcaggaagcccacgcccagaaggttctcacgcgaacgccagacgtggtggctctgcgcgtgcgcagagctaggtcttgcctacgcggtcatgttctggcttcccaagtaggcagaattggtttcccctggaagcaaaggtaccttaaaatttagttttcagaggttaaatctagaaggcgggcatatgctggaaagctcacctacacgaggctttctcacacggggattccccctttgggaatttcagtttcctcatctaaaaataattggctctggtgggcgcggtggctcactgttgtaatcccagcactttgggaggccgggtagggaggatcgtttgagcccaggagttcgagaccagcctcgccaacacagcgagaattctgtctctacaaaaaaaaaaaaaaaattaaaaattagctggatgtggtggcgcgtgcccgtagtcccagctactcggtaggctgaggcttagatgggagcatcgcttgagcctaaaaaatttcaatattacttcatttgttaaccacaattcttctacaaagagaaacctcccttcaactatttggctcctgagatacaattaatgtaggaaaggcagtatgggtgcttgattctcttactttttttttgttttttaattttagagacaggctctctgtcacccaggctgaaatacagtggtgtgatcatagctcactgcagcctcaaactcctgtgctcaagcagtcctcccatttaagtaagtgccaccacccctggctaatttttttttttttagagatgggcatcttgttatgttgcccaggttggttttgaactctggcctcaagtgatcctcctgcctcagcctctcaaaatgctgggattacaggtgtaagccaccacacccagccgattctttcccttatgtgtgttttcaaaataacaatttagttccctagctttttttttttttttttggtagtggtggttaaaaacacaaaatataaaatttaccattttaaccatttttaagtgtacagtagtgttaaccacatgcacattgttgcgcaacagatctctagaacttattcttcttgcaaaacagaaactttatatccatggaacaactttttcctctttctccatcccctgccaaccaccattctacttctgtttctaagagtttaactactttagatacttcatataagtagaatcatgaggtgtttgtcttttaggacctggcttatttcacttagcatgatatccacaaggctcatccatagtgtagtatatgacaggattttcttctttttataaatgttgaataatattccactgtatgtatatgccacccagttacctgtccataaacatttctgctgattccgcctcttggctattgtgaataatgctgcagtgaacacgggtgtgcagatatctctaagatcctgttttcagttcttttggatatatacccagaagtggattgctagatcatatggaaattttattttttatttttataggaatccccatactgttttccatggcagcatcaccattttacattactaacaacaatgcacaaaggttccaatttctccacctcctcaccaacactacatattttctgtgtttgtttgtatgtttgtttgtttgttctgagacggagtctaactctgttgcccaggctggcgtgcagcggtgcgatctcggctcactgcaacctccccttcccaagttcaagcgattctcctgcctcagcttcccgagtagctgggattacaggcgcccaccaccacccccggctaatttttgtatttttagtagagacgaggtttcaccatgttggccaagctggtcttgaactcctgacctcaggtgatccacccgccttggcctcccaaagtgctgggattacaggcgtgaaccaccacgcccaacctgtgttcatttgttttttacagtgggcatcctaatggatgatgaggtgatacctcattgtggttttgatttgcatttacctgattactgatgttaaccatgttttcatatgcttgttggccatttgtatatcttctttggagaaatgtttattcaagtcctttgcccatttttgaatcgggttttttgttgttgttgttgagttgtaggcattctttatgtatcgtggatattttctcccgttccctaggtcatcttttcattccgttgattgtgtcctttgctatgcagaagtttatgtttgatgtagccccaattgtctatttttactttgtctgtgcttttggtatcatatctgagaaatcactgctaaatccaatgtcatgaagcttcccccgttgtcttctaggagttttatagtttcaggtcttacatttaggtctttagtccattttgagttaattttggtatatggtgtagggtaaaggttgaacgtcattcttttgcttgcggatatccggttttcccaacactattctctccccactatgtagctttggtacccttgtcaaagatcacttgaccagatacttgagagtttaactctaggttctctattctgttccgttggtctatatgtctgttcttatgccaataccactctgttttgattactgcatctttgcacaatgttttgaagtcaggaagtgggttctctattctactccgttggtctatatgtctgttcttatgccagtaccactctgttttgattactgcatctttgtacaatgtttgaagtcaggaagtggaaggcctccggctttatttttctgaagattattttgtctattcagggtcttttgagattccgtatgaattttaggactttttaaaaatctgcaaagaaaaatggccctgggattttgataggtattgcaatgaatctgtagcttactttgggtagtatgggattttaacaatattaagtcttccaatccacaaacacgaatgtctttccatttatttgcatctaatttctttcagcactgttttgtagttttcagtatataagtcttttgcctacttgattaagttattcctaaatattttattctttttgatgctattttaaatgtgattgttttcttaatttcctttttgagttgttcattgttagtgtttagaaggcaactgatttttgtgtgttgattttgtaccttgcaactttgttgaatttatttattagttctaaccattttttggtggaatccttagggttttccacatataataccacatcatttgttaatgaagataattttacttcttttccttttttttttttaaggcaaggtttcacccttatcaccaaagctggggctcaagtgatccccctgccttagcctcatgcacagctgggactacaagcatgcaacatcatgcctggctaatttttaaaaagttttttgtagagatagggtcttgctgtgttgcccagactaatcttgaaattctggcctcaagcaagcaatcttcccgtctcagcctcccaaagtgttgggattacaggatgagccaccgtgcctggcccttcttttccaattttcagcttttatttatttattttttgcctaagtgctctggcaagggcttttagtaatatgttgaatagaagtagcaagaatgtacgtacttgccttgttcctgatcttagaagaaaagctttcagtttttcactattgaatatgatgttagctgtgggcttttcaaacatggcctttattaggttgagataatttcctttcattcgtagtttgttgagtgtttttgccaagtgctttttctatatcaattgagatgataatatggtttctgttcttcattctgttaatgtgcctctcaacttaaaatggcattacattctgacatgcccattgtaaataaaaaatatctaaataaaaaatgtaccgaggccaggtgtggggtggctcacacctgtaatcccagcactttgggaggctgagtcaggcagatcgctttgagcttagaagttcaagaccagcctgggcaacatagtgaaaccccatctctacaaaaaattaaaaaaaaaaaaatggctgggcatggtagcatgcacctgtgaagctgaggctggagaattgcttgaacctggggagcaaaggtttcagtgagccaaggtcatgccactgcattccagcctgggtgacagagtaagaccctgtctcaaaaacaaaacaaaacaaaacaccacaaaaaaaatgcattgtaaacaccaataaacccatcataaaacaaaaaaattgtaagtcaggtcatgatcagttgcaaaccatttgtagtccattacactgattgatatttgtatgttgaaccatccttgcattccaggaataagtcaagtcccacttggccatggtgtataatccatttttttttttttttttgagacagagtctcactctgttgcccaggctggagtgtagtggtgcgatctcagcttattgcaacctccgcctcctggattcaagcgattctcctgcctcagcctcccaggtagctgggattacaggcgcttgccactatgattggctaatttttgtatttttagtagagacagggttttgccatgttggccaggctggtcttgaactcctgacctcaggtgatccacccgtctcagcctcccaaagtgctgggattacaggagtgagctaccatacccggctgtataatccttttaatgtgctgttgaattcagtttgtgagtatttttgttcaggatttttacatgaatatccatcaaggatatctatagttttcttgtagtatctgttgtggttttggtatcagggtattgctggcctcataaaatgagtttaggctgggcgtggtggctcacacctctaattctaacactttaggaggctgaggcgggcagatcacttgagtccaggagtttaaaaccagcctggccaatgtgacgaaactgtgtctatactaaaaatacaaaaattagctgggcctggtggtgcatgcctataatcccagctactcaggaggctgagacatgagaactgcttgagcctgggaggcagaggttgcagtgagctgagattccaccatcacactgtggcctgggtgacagaggggaaactctgtctcaaaaaaaaaaaagagtttaaaagagttaccttggccaggtgcagtggctcatgcctgtaatcccacgcagcattttgggaggccaaggcgggtagatcacctgaagtctagagttcgagaccagcctggccaacatggtgaaaccctatctctactaaaaatacaaaaatttagccaggtgtggtggtgtgctcctgtaaccccagctactcaggaggctgaggcaggagaatcgcttgtacatgggaggtggaggttgcagtgagctgattgcactattacactccagcctgggcaacaagagtgaaactccatctcaaaaaaaaaaaaaagtgttaccttctctctttcttcttttttttttcttttctaatgagatggggtctcactatgttgtccaggctggtctcaaactcctgggcttaagtgatcttcccacctcagcctcccaaagtgctgggattacagatatgagccactgtgcccagccaagtgttaccttctctttaattttttggaataatttgagaaggattggtattaacttttcaattaattcaaatgtttgctagaattctcctgtgaagtatctgttccttggcttttctttgttgggagttttctgattactgatttaatctccttactagttatgaatctgttcagatgttttcttctttttctttatttaaaatttttgtttgtttgttttgagacagtctcactctgttgccaggctggagtgcagtggtgtgatctcggctcactgcaatctccgcctcctgggttcaagtgattctcctgcctcagcctcccgagtagctggggctacagtcatgtgccaccatgcccagctaatttttatatttttagtagagacgggttttcaccatgttggccaggattgtctcgatctcttgaccttgtgatccaccctcctcggcctcccgaagtgctgggattacaagtgtgagccaccgtgcctggtctctttttctttatttttatagatgggatctcactctgttgcccaggctggagtgcagtcattcagtcatagctcactgaagcctcaaactcctggcctcaagcaatcctcccaccttggcctcccaaagtgcttggattacaggtgtgaaccaccatgcctgccctgtgttttctatttgtcaaagtattttccttttaatttcttctttgaggcattggttactcaagactgttttgtttatcactgctgcttggttggttggtattaaaaaaaaatgtgttgtttcatttccacatttgtggattttccagttttcgttttgttttttacttctttttcttttcttttttttttttttttgagacggtgtctcgctctgttgcccaggctggagtgcagtggcatgatctcggctcactgcaacctccgcctccctggttcaagcgattctcctgcctcggcctcccaagtagctggaactacaagcacacaccaccacacctggctaatttttatatttttagtagggatggggttttactgtgttggccaggctggtctcgaactgctgaccttgtgatcagcccacctcggcctcccaaagtgctgggattacattacaggcatgagccgctgtgcccagccctttgcttttgatttctagctttattccactgtagtcagaaaagatacttggtatgatatcaatcttcttaaaatttgttaaaccttgttttgtgacctaatatgtaatctatcacagacaatgttgcatgtatgcttgacaagaatgtgtattgtcattgttaggtggaatgttctctgtatgtctgttaggtccaattgctctagagcattgttcaagtcctctgtttccttttcgatattctgtctgggtgttatatccattattgaaggtggggttttgaaaactacttttgttgtgttactatttctatttctcctcaattctgtcagtgtttgcttcctatatttgagtgttctgatgttaggtgcatattgaattgttatatcttcctagtggattaacccttttatcattttgtaatccctttgtctcttgtgacagtttttcacctaaaagtctattttgtttgatataagtacggccactcctctttttttgttaccatttgcattaaaaatcctttttctgtcttttcactttcaacctatgtgtgtccttacatttaccctatgtaaatctcttatagagagcatatagttaagattctggtgggttttttttttttttttttttttggtccatttagctaccctgtcttttgactggggagtttaattcttgtacatttaaagtaattactgatagggaaggatttactactggcattttgttaattgttttctgtattttttgctgttgtgtctctctctcctctcttgccaccttccctgtgtttcattggttttttggtagcaatttgccattcctttttcattttcttttgtgtatcttttataggtattttctttatggttatgttgtccctaggtttttttttttttttttttttttcaaactgaggcggggttttaatatgttgcccaggctggtcacatgctcctgggctcaagtgatcctcccatcctagcctcccaagtagctgggattataggcacatgccactgcacctggtgtctctagcatttttaaagtacaatatgtacttatagatttaaatgtttgatatgtttcaacccattgcagttattattctaatcaattaccaaattgttttatctttggttagtagagacctcttcaggttggttcctgagtttctgagacacaatctagtcatctttgatagttttattatcattattttatttttggtgtgacaagatgttcccagctcatcttacatatttcctacccggacctgcaatcagcctttcttctggggagctctactccagggcttatggttgcttaaatctcaactctatcactgtattagtaccctctcacactgctaataaaggcatacctgatactgggtaatttataaaagcaagaggtttaattgactcacagttcagcatggctggggaggcctcaggaaacttacaatcagggtagaaggggaagcaaaaacatccctcttctcatggtggcagaaacgagaagtgcagagggaaagggagaaaagccccttataaaaccatcagatctcatgataactcacccactatcatgagaacaacatgagggtaattgctcccataattaaagcatcctttccacaacatgtggggattataggattacaattcaagatgagatttgggtggggacacagccaaaccctatcaatcactaattagctatattgagcaagttgcttacaccttagtttactcatttgtaaaatggggttaataatattacccatctcatgagatcactgtaggcattaaataaggtacataaaaaacacagtgcctggtgtatcataagtactcaataaaggttagtttgataaattacttctaaataacaatagagacatatgtcttcttgagcagatttttcacagaacattctgacttcctgttctaattttgatcagttgtctttaggcctcattcatgaatggatgatcattctgggatttcttttcattgtgtttctgaataaatgagtcttattttatcttggatcctgcatatttttctttcttagaattctctcatttagggttgcttgttttttttgtttgttttggtagagcacatttttgagacttttttcaaaaatgcatgtaggagataacatttccctcgattgatcctttacttggtcataaaaccctaggttcaaaatagtttcctcacagaactctgaaagcattcctccattgccctctaatatctaacatttagctgggtgtggtggtgcatgcccatagtcccagccacttgggaggctgaggcaggaggattgctacagcccaggagttagaggctgcagtgagctatgatcgtggccactgcactccagcctgggtgtcagagtgagaccctgtctcaaacaaaaccccaaaacctctaacatagttgatgagaatcctgctgccaatctgatacaaattcatttgttaaaaacctgtttttcaatcttttgaagtttttcagatttttctatttgtctttaaagttctgaaatttcatgaagatttatctagggcttttgtagttgatgtttgttggaattcagcatcatctttgaatttggagatgtgacatttttagcagtagaaattgttttaaataatttttcccctacattttctgttacttctttccgaaatctgggtattaggtgaacattgacccttctggattgatcccctattatctttttaacgttacctgaatattttgttttttctgcatattttccattttcatctttgtgctttacattctgaaccatttctttgcatttatgtaccagttcactaatttgttccttgtctaggtccagtccatcagtcctgatagattttttcaacatgatttttagtttaaagaatgcttaaaaaagaaagaaagaaagaactctttctttaatctctcttccttttttttttttgagacagagtctcactctgttgcccaggctggagtgcagtggcgtgatctcggctcgctgcaactccacctcccaggttcaagcgattctcctgcctcagcctcccaagtagctaggactacaggcgtgcgccaccacactcagctagtttttgtatttttaatagagacagggtttcaccatgttggtcaggctggtcttgaactcctgacctcgtgatccgcctgcctcagcctcccaaagtgttaggattacaggtgtgagccattgtgcctggccagtctctcttctttttcatagtatcctgttctgattttttttgtcattaacttggtatcaacattattatagaacaactaaagttaaagagacacacagaattcagttggataataccgacatgttcatgtgaacaaacattgccagaagccttaattctttcttcaatgatcttagcttcaatttagctcatccattttgatcattttccctcttaaatttggtacattgaacatacgtacctcactgaagaaatcatatagttccattttctgaactgatttcccactcctagcaacaactacttccaacccttttagcttagttattccctaccatatttctaaattacatgcttatagtatttctagagtttttccaactttaggcattacttgttgacttctcaacataggtgaggacttttagggctttcacacactcccctcctcacacctagctccccctccaacttcctgctccatttttcatatacggtttactaaattttctgttacatatccatgtaaggacaatttagtgtttacaacttctcaagggcttactcccctcccttggatacagggaattgtggaggagatctggagatctaacagcacctcattttttccacataaggatttatttttctatcaaatattgggaaatatacaaaagtgcctatttgatcttaagaatctacagtcagcttaataagtagaatagtatcagagattcaagttttcaaaaaacatggctgaaaaaacagctttgattccctaaactcttccagaatcttcccactttcctgtcaaagggcatagtttatcttcccttgaatgtgggtgggtctttgcatcaataaataaaatgacatggaaagcaatgttgcttggtttctgagggtaggttagaaaaaaccatctggcttttccctggcacttcctctctcaacacttcctccagcagccacatggaaattacccttcatttcccacaaaatggagtccagtctgtagctgagtagttttcttagccatctcctgcccatacaagtttgaaggtccaagatgataccctcctgccattttttttttttttttcaaattttagagacagggtctcactctgtcacccaggctggactgcagtggcatcatcatagctcactgcatccaccagctcctgggctcaagccatctttccatctcagcctccagactagctagggcagccatgcaccaccatgcccagcttaagatgttacaatcctttaaacttcttatgatttcttatgtatcaatttgtaaacaattccataagatgaaaaccacccccaacctcccaggccccaatcttgtccaggtaagccttgtctacctgggtttccaagtgaggctgctgagatggaatattttttcccccaaatgagggaaacatttctagtatttctggttccatatgctcttccagaagcttgccacttcatcatcaggaggtggagtctatttcccctccttttccatcagcacagacctttgtgacttcttcgatgagtagaatgcagcagaagacactgaattagtgtttttttcatttttttttttttgagatggagtcttgctctgtcacccaagctggcgtgcagtggtgcaatcttggcttactgcaacctccgcttcccaggctcaagcgattctaccacctcagcctcccgagtagctgggactgcaggcacatgccagcaggcctggctttttttttttttttttttttttatgtagagatggggttttgccatgttgtccagtctgatcttgaactcttgaactcaggcaatctgcccgccttggccaaagtgctggaattacaggtgtgagcctgtatcccctgcctaacactggatgaattctaatgccaggcaagaaatggtaacagagctcccacgtggccttctcaacccttgttcttggaacctagcctctaggttgtgaggaagggaaacaggactaggtatgtgttctggcttcagctccacctgaagtcccagcaaacagtcactatcaacttccagacatatgagtgaatgattacatacattccaacctcactatttgagctcacctagctgtggctgaaaggagcagagacaagctgtctctcccaagctctgtccatgttgcatattcatgaacacagtacatgttgttttaaaccgttacgttttgggatggcttgtttaaaagcaaatagttagaactctgtcaatacttttcaagccccttgtattctgtttttatcctcttcccaccccttcagaagtaactagtattctaatttagtattatttcctttgctttcacaaaattagctttcccacataaatacctctcaacaatgtatctgcctgttttcagtaaaccagttaaattatggttttgtatacttttgggcttttttcatacaacattgtattttggggattcacccatgtttatagtttattccttttttagtgttgcatagtattccattgggtgattataccacaattaacttctccattctcctgtcaatggatatttgaacagttttccttttttgctcttacaatgctgacatgaatatttttgtatgccccctggtacatgtgtgagtttctctaggataacttcatgcatgttcaactttctatttaatgcaaaatctttcccgaatttattgtaccgacactccctccatcaacacacatatttttactccacatactctacgtttggtttcgccagactaaaattttatcattctggtgggtgtgtatttacttccaaaatagactttcagcaaatccttcatcttcccctccagagatgtcatagtacaagagcattttggaggatctgtggtacaaatcagattgcttcacagttttccacactgcaggataaaaagtccttctcaggtttgctaggatcatcactactaatctatttttagctttcaaaaagttgtggttatcatttatttctgtcccatttttttgtctttgtaagatgcattaaaaaacaaacgaaaaccataaagcaaaccaggtgtggcagttcacacctgtagcccagctaatcaggaggctgggagactaatcaggaggctgaggtgggaacatagcttgagcccaggagttccaccctggccaacacattgacacttggtgtctaaaaaaaataaaaacaacccacaaacctttagctgttttaatgcagttttagaaggaacttagggttaaatgtatgcattcaaggcatctttcaccaggcattaattttttaatttcagtaaattttttctaaatgttttttggcttttcaaatctacttggttatttttgctgctgtttcttgtttacttttagattcaatttttttctccttaaaacatatcatatagttgcattctgcatgtgacaattttaatatctaatactgtctttgagggtctttatgtattgcttatttccttgtgagtttgataattttgtgtactcatatttggttgagcctaatctgtgagaatatcaagattttaaattaagggttggtaaactatactccaagagccaaatccagtccactgcctgtttttgtatacgctttattggaccacaggtatgcccactcatttatgttgtgtatagttactttagcactttttgagtcgttttaacagacactgcatggcctatgaagccaaaaatatttcctttctcaacttctgttctcaattatgaatattttctccagagaagatttacacttgcttctgccaggacacagggggtactactgacctgaaacaaccttagccttctttaggaagtcatctcaatttggtgaactcagctaatagatcaaaggccttcagagtatctgttcctctatgctgctaaaaatagcagttgtcttctttgactatatgatgatttcaagatgccatatcttttaaaatttataatggtggatcatttccacccacagacatgtgtccttttgtggaacttttcttacattatttaataatttccttttctgaaatctttcctattttccctttcttaaactcttagtattgaaagtgttagaccttggccgggtgcggtggctcatgcctataatcccagcactttgggaggccgaggtgggcagatcatttgaggtcaggagtttgagaccagcctggccaatatggtgaagtcctgtctctactaaaaacaataagaaattagccgggtgtggtggcgtgtgcctgtaatcccagctactggggaggctgaggcagaattgcttgaacctgggaggtggaggctgcagtgagctgagatcgcaccactgcactccagcctaggcaacagagtgagactcaacccccctttcccctgccaaaaaaaaaagaccttgtttgattctctgattttatcatttctatcctattttctattcctttgtcttttgggtttactttcagggtgaattcttcaattttatctctcaatccttctaatgaattgccttgactatcatttttaatttctaggggcaattccttgctccacattttttttgggaaaattctgttctccttttatggatacatctggtttctctcaagatactaattatatttggggaatatttttctgatctttgcgttttgtatctgctccccacccctcatgtctggtctctcatgtatagagattttccttaaatatctggctatcctgggctgtaagttcacatttaataatagggcactaaagaactgaatggaaacccaatacatacacacatgacttggtaattggagggcttcattgaagagtgataaggtggcaaacaggctttatttatttatttttttatcattaagggataaccaaaatggagatcttttctctggggccatttagcttctccaaagaaaaaaaacctggcagagaaaactgtacttgattgccagtatcctgggaaaagggtagcaagcctacatatcaaccaaatgcagacttttttttttttttgaaacagagtctcgctctgttgttgcccaggctggagtgcagtggcacaatctcagctcactgcaacctctgcctcctgggttcaagcaattctcctgcctcagcctcctgagtagctgggattacaggcgtgtgccaccatgcccggctagtttttgtatttttagtagagacggggtttcaccatgttggtcaggctggtcttgaactcgtgacctcgtgatccacccaccttggcctcccaaagtgctgggattacaggcgtgagccaacgctcccggcctccaaatgcggattttcacttcctccacattttcaaccctgtatcttattcacaccatttgttatccctggtatcctgttaagtcctatgctcttccagttcagtttctcagaagaattatctctggcctcctcctgcttgaaaagggagaagagaaagtggccacctttttttttttttttttttttttttctgagacaggatctggctctgttgcccaggatagagtgcagtggcatgattttagctcactgcaaccttggtctcctgggctcaagccgtcctcccacctcagcttcctaagtagttgggattacaggtgcacactaccacacctggctaatttttttttttttttgtagagatgaggtttcactacattacaccgggtagtctcgaactcctggactcaagcaatctgcctcgctcggcctcccaaagtgctgggactacaggcatgagccacggtgcctggcctccacccaacttaagtagggctggggaaagacagtcgaattattctgtatccagacttgccaccaatctatttttttttatgtctcaagcatcatctcttcttctgagcactgtttccttcagggtactgagcatcttgtttggtatggcttctttctcattgcattgccttttgcagtcactcagttaaagcttctttagttctggttctactaaatcagtcattctttctctacctgcattttgttttccaaaaatttactttactctatcctttgatttcttctctcctgttccatttgtcctcgtgtagttattatattttatggacattttactgagatttcgggaacgaaaacaaaagctaatctgcagtatttagctgggagtcttcaaattgaattgtaaataaccctaaaatataggacatagaaatgtttccatgtttttctcttcctggagagagaaaatcatgatttaattaaaatcaccccacctaagagtcacctattatatcagtggcgattcttattagagctttcttaatatagcagatctatacttgctatagatgaaagcacaatggaacaaacgaaggataagcaatcactgaaaaggaaaatgaataatatatttacaaatatactggtaagacacagaaatttgtaatgcaagtcacattttaatatagttttaaagtcttccaaatatagtagcaaatttaatcagaaaaaacacctgaaacatcttaactattagtacattattttaaaggattatttccctgattccttggcttactaaactgtatttataaaggtataaactactgatttttccatttgagtattatactaaatgtaatttagctgataattataaataaaattgttgactaagatcatgttttaaatagggaaaaaagtttcccttagtaaactggtaaagactgtaagttgatattttcaaacttttgattactataaagtagtaagcaataaaatccacatccccacaaaaacttcacttttcttctattgcaaaaatctttacaaaaaatgtactctgagtgcattatccgtgtttgctttaaaaatcaacaaacataccaaaataattcatcaagaaatcaaagcaaagaaacagttatcagtatcaggtttgctaaaagaataaattactgtggaagacatccgaggagtctaaaatgaatttgttgtagcagtaacaaggcttcaggctgattcttatactgttgttaaagcagccctcccgtgctttacagtgaaaaaaatcagtgaatatttctttattttaaaaaattatcaatagcttcaaaataatgtttaaacttgccttgagaacatgtactggctatgataaatccattatttgacatattgggtgagtttttttagtgatctaaaagaaattggctaaaacccatacatgacaggtttgggaagctctaactcaggtcagaaaagtgggagagagatcagatcctttttatggaatgaaagagcaacaatttaaatatcttttttgaaatagtgaaacattttgggctcaattagtctttattactttctttctttttacagagacgaggtcttgctatattgcccaggctggtctcgaactcctgagctcaagcaatctgcctgcctcagcctcccaaagtgctgggattataggcatgagccactacacctggctagtctctattattttcaaagacagcagtaggccaggcacggtggcacgcgcctgtaatcccagtactttgggaggctgaggcaggatcacttgagcccaggagtttgagaccagcctgggcaacagtgaaacccacctctataaacgaaaacaaaaacaaaaacacgagcagtaagctaaaaatattaaaatatcaacactagcttattctcaaaaacaattttctgctatataaagtgcttgtaactaataatatacattaaaaatggcaactcttaagatcatgaatggcctgtctcactgccagcaatgagagtagtatatgctaagggacaccatgatatttagagaagacaaaaaatatgtattcaattatttcctatagttctaatactgtcattataccagtaagcataaaataatcttattttgatatggtaattaaacaaaaattattatggcagagtaaaatgcaaggaactaactccttagggatttctgaccattaagtatttttactagttcataatgaagttaaatatgactagaacacaattcagaaaaaagagactaatttatttgttttataaaatagaatgagcgcttagtttagataatcaagaggtgacagcttcaggtatcatcttcaccaagaataaatttgtagtgtttcatattcatttaaaggaatcaggaagaaaaattcatttaatttctgctgcctgcccagtcacttcaaaaattcttaagggaagctaaaataaaaataccttggattctggttactttttaaagtaaaaatttccagatgcctcaaaagcagtgagttcaatttggtgtcttgtgttctggcaaagaacagttaagtttacagcactgcagtcacagttttcaaatgctgtgaccaattatttgagagttataatctgcaggctccattttcaaaatatgtgggataacactgtcaattcgtatattgccaatgagacctttgaaaaacaattcttcagtgatggtagcattcatcagtcttaaagctggcaatctgagtagtagtctggataacctaaaaaaagaaagaaaaaagggagaggaacaaggttgtaaaccagaaagaaatttagtagaaaaatatgagtaatttctgcatgtggcctaatttaataaagatagcattttcaaaagttaaaatcaaaactttagtattctcaagccttagaacatatggcaattacctggctattaatgcagtctgacagactccacaggggaaagccctgctcttaatgctacactgtactgcctccacttggctgtaaggactgtggaactgagttgttaaaccatgcatcaagttatacaattttttttttttttttgagagagggcctcgctctgctgcacaaactggagtgcagtggtgtgagctcactgcagcctcaattccttggactcaagtgatccttcccgcctcagcctcccaagtagctgtggctacaggagtgtgccactatacctggctaattgtgtttgtttttttttttttgtagagacagggtctcactatattacccaggctggtctcacactcttgggctcaagcaatcctcctgccttggcttcccaaagtactgagattataagcgtgagccattgtgccgggccaagttatacatttaagaatggcggctgggtgccagtggctcacctctaggaggctgaggtgggcagatcacttgaggtcaggagttcgagaccagcctggccaacatggtgaaacctcatctctactaaaaaaaataataataaaataaaataaaatcagccgggcatgaccagcctggccaacatggtgaaaccttgtctctactaaaaatacaaaaaataattagccaggcatggtggcatgtgcctataaccccagccacttgggaggctgaggcaagagaatcatgagaattgcttgaacctaggaggcagaggttgcagtgagccgagatcatgccactgcactccagcctgggtgacagaccaatattctatctcaagaaaaagaaaaagaatggcttagcaactcatttcaggttttaaaaatggcaatgttttgtgttatcaggacataagacattttcttggttttgctctgcaaaaaactactggaagtaggcaatagttgctattactgggaaaagcacagaatgtggaatcaagaccgctgggttcaaatcttgattgaactgcccactacttatataaatgtgtgcttgccacttactgtctctcacagtgctgttgtgaggatgaatgaaatgatccctgccaatttctgtgccaggtagtgaggtttcttagggtaagaccctatcttgtgtcaaagtgccttataagttgaaaactactatccaaggataatgtattatttttaagtaaccaacaatgtaaaaaactgagaaagctgcagtcacaaaggaaaaaaatttaaatactgtatttatttgtataatgaggcatagagtaacttttaaaacttaaagatgctgaaaaacaaccacaacaaaaccaccttttcaaaaagactgtggtgggtttatccttctgtcctaacgccttgcactctaacacctcagaccaaattagaccagcagcccccaggattatcttcctggagctgtgtgctctactcctcaaattacttagcatccacatcaaattactcagcttttacagaactggtagaaagcagaataggaaaacgagttaaagtaaggctgatatttaagatgagactggcttataaatctacattatttaatatatgtaaaaaaattattatatgtaaaaatgttatcttactagtttgaagtatgccaaactaataaaatgttttatttattataaacaaacacacttatatagcccttactgtatgacaggcacagtcctaagcactgtacatatattaactgatttaatccttaaaataattgtaaaaagtgggtattagtattatctccatttataggtgaggaaacatgcccaaggttatgaagctagcaagtgcaggagtcagaattcaaatccaggtactctggctctataaccaggtgattaacccctcggctataatatccctctttaaagaaagtggctcttataaaaaaagaatttttctcaaagaatattggtgagaaatagcttggagtgaatttcataaaccatgtttcaaaattaattataaaacaatctaatggtatttgtttttattttttaatattttttagacagggtctcactctgtcacccagattggagcgtaggagtatgatcacagctcattgcagtctcacctcagctttctgagtagctgggacttcaggcatgcgccaccaagccgggctaatttttgtatttttttgtagaaacagggtttcaccatgttgtccaggctggtctcttgattattttttatcctccttttgctaacaaaattcattattttatccaaagaaaaagagtttggattttagagtcagactacttgggtcacagtcaggtgctatcatttactgtgtgaccttaagcaaagttaacctctctgtgctgaagtctcctcttataaaaaatataagaactggatgaaatattttatgtaacgtacttgcaacaatgcaatactgctttttatagcattagtatttcaaagttaaggttgcctaaaacatttaattattgtgagagtagtaataatgagataacagatccacaaaaggtttttcaattattttaattatatagaatttaactctagatacctgtaggtgtcatctggatatgttttggttatataatcttggaattccacataagccttttcctgaaatttctctatctgttccatgttttctaggcttggatgatctgaaacattaaagaaaacattggtaccctagttctgaatgttcatttaagacagagtggatatgaaaagagacagaaagaatagtcaaaatagaagccccatcataaaatgtgtggctcaggccgggcatggtggctcacgcctgtaatcctagcactttgggaggctgaggagggtgaatcatctgaggtcaggagttcaagaccagcctgaccaacatggagaagccccatctctactaaaaatacaaaattagccaggcatggtggcgcatgcctgtaatccaagctactcaggagactgaggcaggagaatcacttaaacctgggaggcagaggttgctgtgagccgagacagcgccattgcactccagcctgggcaacaagagtgaaactctgtcttaaaaaaaaaaaaaaaaaaaaaaaagtgtggctcattcattccacaaatattgattgaggccacctactatataccaagcactatattttacatatttaaaattattttttatctcgtatacatatgctaacaactaataaaaaataagcgggtgttaccaaaacaaacagctttctctccattccaaaagtagtaagaatgcatttgataactttgcctttaataggagcaaaaggtaaatgactcagcttaaaaagacatcttaaggctgggtgtggtggctcatgcctgtagtcccagcactttgggaggccgaggtgggggggatcacaaggtcaggggttcaagaccagcctggccaacatggtgaaaccccgtctctactaaaaatacaaaaaattagctgggtgtggtggcaggcacctgtaatcccagctacttgggaggctgaggcaggagaatcgcttgaaaccaggaggcggaggttgtggtgagccgagattgtgctactgcactccagcctgggcaacagagtgagactccgtctccaaaaaaaaaaaaaaggcattttaaatccatgaaatatttgcagattatattctatgccatatttttctaagtcaaaaattctatttttaggtaaaaaggtatataagaaattatgaaaccacaaatattatctctatcagaaaaataacagaaacatgaaaaaatctatataagcatttcaatggtcactataacattacacaaaaacagaaatattaaaagaacttcataaaaattatgcatagcttaagaaatgttgaatatggaaagctctgttctcatggatgaaaattttaaaaagtactaaatggaaaaacctaaaaatacttagtaaaataaaattacattagaatttaaacttcaaatctatgttccttcaattttcacctaaggaaaataaaggtgacaaattgtgctaagaatagagacatacgttactaactcataagaaacattagaagaaatagtacaagctttcatgttcttactggtattactgacagaaagaagcaggtttcctcagataattttattatgatgcacaagaacagaaacatatcagaatgaaaaatacagaacctaagagaacagtcaatttctcttattcagaaattgatcactgagagcttaccgtcattttaccatctgtgaaaactgtaaactggcaggaaaacaagaaaccagttttttaaatttgttggtaactcatataagatgtttggaaatctagcccatcaacatagcaaatagtcatctctcattctgccatttagtaatgcctaaaaaaatacacctaagaattcaaatgttgacgtgacaacagaaataaaggtctataacattttttacattttcatttatttttgagacagggtctccctctgtcacccaggctagaatgcagcagcatgattagagctcactgcagcctcaaattctcgggctgaagtgatcctcccacctaagcctcccaagtagctgaaactacaggtgcacaccagcacatccagctaattttttctgttttgatttttgtagagaagaggtctcattatgttgcccaggctggtctcaaactcctgaccagtcctcccatctcagcctcccaaaatgtgaggattacaggcatgagctactgcgccctgccaaggtctatcatattatttcactgacttctcaacctcccttttcatacccatataaatgtctaacatccttaaaattcaccaatttaaagtatacaattcaggccaggcgggtggttcactcctgtaatcccagcactttgggaggccgaggcgggtagatcaccttaggtcaggagttcaacaccagcatggccaacatagtgaaacttgtctctactaaaaatacaaaaatgaactgggtgtggtggtacatgcctgtaatcccagctactggggaggctgaggcaggagaatcgtttgaacacaggaggcggaggttgcagtgaactgagattgcaccactacactccagcctgggcgacagagtgagactcagtctaaaaaaaaaaagtatacaattcaatagtttttagtatgaatatactgataattgtacaactatcactacaatctaattttggaacatttttgtcactccaaaaaaaacactctacccattagcagtcacttcccatttcttccttctccttagaccctggcaaccacttacctattttatgtctatacaggtttacctattttgcgtattttatataaatgaaatcaaacaatatgactggcttctttcatttagcagaacttttaaaggttcatctgtgttgcagtatgtgttagaatttccttccttttatggctgaatgatattccatcatatgtatatattaaatttatttcttcatctgttgaccgacatttgggttgtctccactttttgactattataaataatgctgctatgactatttatatacacattcttgcatagatatatatttttcatttctcttgggctgacaagagtgaagctgctgagtcatatgataactccatgtttaaccttttgaagaactactgaactcttttcccaggtaactgcaccattttacatccccacttgcaacatatgagggcttctatttctccacatcgtgaaacattttattttgaataaaaagtaaatgtttatatacctggactgaagagtactattgccttcaggtaggcatattcgtatccatcaatgcagagtttaaccatgctgttacaaaactcctgtagtttgaagatgtgctccatcaataattttcttctttctgttgacattttatctttaattaaaaataaacaaatgcttctagtgtttgtctaaaatgaacaactactttcatccaatatatttccctctcaggaattttgaaaaattttttaattcttaaattttttttgagacagggttttactcctgtcgcccaggtggcagtgcagtgcagtgcggtgatcttggctcactgcaacctctgcctcctggactcaagcagttctcctgcctcagcctcccaagtagctgggactagaggcgcatgccaccgcgcccagctaatttttgtattttttgtaggatggggtttcactatgttgcccaggctgttcttgaactcctgggctcaagtgattagcccacctgtgcctcccaaagtcttgggattacaggtgtgagccactgtgcctggccttcctctcatgaatttcaagctttgagtataaccaatctagaaatgtttaaaattaagtatttctgcaattatagctaaaactaatcttaagatattattcattcaagaacaagctgttagtataatctgtataaaaatcgtaagtagaaaggtttatatttatttttcttgagacagggtctcgctctgttgcccaaggctggagtgcagtggtgcgatctcaactcactgcaactctgcctcctgggttcaagcaatcctcccacctcagcctcctgagtagttgggactacaggtaagcgccaccatgaatggctaaattttgtattttagtagagatggggtttcaccatgttggccaggctggtcttgaacccctgacctcaagtgatctgcctgcctcagcctcccaaagtgtgagccactgtgcccagccaggtttatatttcatcttaattcttttgatgttgtaaaagtacttttaaaaaatgaattattttctcatggtaattgcttttggggaaaaaactatatataaaaaatggatttggatgtttatggcacttggcttgttaaaaaaaacaacaaaccaaacaaacaaaaaaagaaaactctaaatgtaatggttccttttttttttttttttgagatggagtctcgctctgtcgcccaggctggagtgcagtggcacgatctcggctcactgcaacctctgcttcctgggttcaagcaattctctgcctcagcctcctgagtagctgggattacaggcgcttgccaccacgcctggctaatttttttgtatttttagtagagacggagtttcaccatgtttgccgggctggtcttgaactcctgacctcatgatccacccgcctaggcatctcaaagtgctgggattacaggcgtgagctaccgcgcccaacacccccctccccaccctttttatttttttaaagaaatggttctcactctgttgtccaagctagggtgtagtggtgccatcatagctcactgcaacctcaaattcctgggctcaagtaatcctctgcctcagattcctaagtagctgggactatgactataggcatgcgctaccatggccagctaatttttaaaaaatttctgtagaggtggggtaccacaatgttgtccaggctagtctcgaactcctaggctcaagcagtctcacctcagcctcccaaagggctggaattacaggtgtgaaccaccccacctggctgaaatgtttgctttcaagatatacctttgagaagataggatgtaaagataaccatctgaaacactagacaactaaaagtacataagactcaaattttggtaataggattttatttaagcttatattggttgggaaaaaatgagcaaaaccatctacatgtttcactaccaagactactataataaaaacagatatttagtaaaaacactgttaagaagaaaaaaactgaagcagaataaagttttacaataaagattttaatttattgtagagggacatgtttaaaacccatccattagtaattagtcaaccatagctttcctgaaggtaggctttataaccattacaggcatataagacatgaaccaggggtaggagtccataagtaagatgggaatgtgatgctgccttctagtagatctatttttgatgacattttaaggtgattacccctctgctgttaaacataaggaggaagcaaatgatttaaaaattatataaaacaataagaaatagaatatgctaaagaactaaaaggtagtccccaatttataaattattcctgagctcaaaaggcaattttccccatttgttgatggggcactgttttgggtagtcataagccattctatagttaagcatttataaatcagtgattgctcgtcttgtgaaatgaatgagggctgcaattaccttggcatctaggaaaggaaaaacagaataaaaaggattgttcctgactcttcagaactatttaggtgagagaatacactctgatgaattgatacaaaatcaacctatcttaggattcaaagggctataataaagaaaggtcatttaaaaattgctgagtagtatatgttttaaaatatttgaccacctctacataagctcaccctggattctttgatagttgcacaaaaattcacaaggcctggtcagaaatagcctgccagacttaagtatactgttttcaattttgttgcactctatttaaaaaatatttttagaggattagtaaatttataaaattgtaaaaattatctaaagtaagaagagcattggtacctaaaacactaatataataattattagatatctaactttagtcataacatttaatgaaactcatgcctcctcctacaacctggaaaaggtaaggaaggtgctttttaccttgttgaagactattgtgaagacaattgacaaatgttgctaatatagttgctacattcatcacttgccagcactgggcaagaccaagagtaaaaagttcattccagtaagctttcaccagtgatatgctgttttcttgcctattaaaaacagtaataaaagcacaaatcagatattattaaaataagttttataaaccttacagctagtccaaatacttaaaaacagcatattactaaactaaaattattctagaaagatttgagcaagtctgtgttttgtatagctgataacaaaatgagaaatgaggaatgcttaggcatttaaatagtagctagctcatcaatcagccagtttataagaacaattgcaagtaatattcaaactaaaaaagttggggctttaacttcacatttcatagaaatggaataaagattgttcttaaaagcaaaagcatatattaaaaaaaaacttttgctttgaatataggtaaataccttttaaaagaaagagcaattcaaattattttattgttttgagacagagtcttgctctgttgcccaggctggagtgcaatggcgtgatctctgctcactgcaacctccacctcctgggttaaagctattctcctgcctcagcctcctcagtagctgggattacaggcatgcaccaccacatgtggctaatttttgtatttttagtagagacaaggttttgccgtcttgaccaggctggtcttgaactcctgacctcagctgatccgcctgccttggcctcccaaagtgttgggattacaggcgtgagccactgctcccagcctctagaattattttatagtaggcaagcaaccaattttaggagaaaaatggttcattgtatgtttcagaggagatattagtatccctataaataagatacccaggattttactatgaataacaagagattagaaaggtcaaaagttctctcctgaatttctaagtaactgatctcagcagcacaaggaggctgaggcaggagaatggtgtgaacctgggaggcagagcttgcagtgagcagaggtcgcaccactgcactccagcctgggtgacacagcgagactccgtctcaaaaaaaaaaaggaaaaaaaaaaagacccccatctctacaaaaaatgaaaacattagccgagcatagtggcatgtgcctgccgtcccagctacttaaacctatttatccatttgaaattaggcaaacttcccaggtctcaggttgtctaatgatacaaaatgcagagacactatacgtcctatatcttgctcagagttattaagaggtgaaaggtaagaattagctggggctgggcgcagtagctcacgtctgtaatcccagcacttcgggaggctgaggcagacgcatcacttgagcccaggagttgcaaaccagcctgggcaacatggcgaaactctatctctacaaaaaatacaaaaattagctgggtgtggaggtgcacacctatagtctcagctactcgcaggctgaggtgggaggatcacctaagcctggggaagttgaggcttcggtgagctgtgatcacaccactgcactccagcttgggtgacagagtgagaccctgtctcaaaaaaaagagagagaattaactgggtgctgtggcacatgcctatagtcccagctactcaggagggttgaggtgggaggactgcttgaggccaggagtttgaaggggtagcacaccatgattgcatctgtgaagagacactgcactccagcctctaacctggcacaggaagaccctgtctcaaaaaaaaaaaaaaaattgagaaagtatatgccaggtactggagaaatagcaattaagagattaagtttgccttcatgaaaaaaaggggaaataacaaatatataatttcaagtattttatataaatatacatatatgattatacataattttaggtaataaaaattctacattagtataaaggatgtatattagaaaatgggaaggttcagataaggtggttagagaaggcatttctgaggtggtgacatttgactggagaaagatggcagagaattaaaacaaacaaacacaaaaaccaaaaatcagatctaggggaatagtatcccagggagaacaagggcaaatgtgctaaggtgagaacaagcatattcaataaaacaatagatattcaataaaaattgttaagtgaattactaaatgctatcctattgtcttggaaggtcctttcgtagccttgttttcctggctaatacctactgatcccttaaaatatagctcagagttcactttctagaaggaacattattcctctctcaacatattcattcccccttcagtgtcacgcacacacgtatcctcactgaaggcagagactcccttgcgcatttctgtatctcagagaccaatgcagtacatggtacacagaaagaattctgcaaatgatttctgatcttagcgagtacagaacaggcagatgtgagaactttgatgaaaagagctgtgggcccttttacaattaatctttaaaccaaacctacagactttattataaataagatgatgcaactataagatttctttccttaaatctctggagagatataagttggtaagaacgtcctgataggaaatatgtccaacttaatgaatggtacttatatatttttcttcttaataaagctttaaaattaggataatcagtatgtttaacagaaatcattcgttaagaatcacagccttatgacattacattttattaaataatcgaacatacttgcaacaaatgctaatactgtcaactcagtcacagcaagtttttttttctgagaattattaatgtgaaattttaacttcaggctgatctcttttccattcagtatccaagaaggatcactggccacaagaaactgcctgtcatttgaaagtaaagtttaaatgcaaagaaaaccggtattttataatattcctatagaaaatgcttaaaaatatcaatcttaaacaaaatcaaaggagataaaaataaaggatactattttcattaaagatggataaaatccagaattgaggaagaggtgaggaaataagtattcattctcatacactgctgacgtgaacataaactggatcaacatcttttcagagaacagtttggtagtacccatcgaaagttgaaatgtgcactttcttagacccagcaatttcacctctaagaaactatgttatagaagtacagtcatgcatagcacaatgttttagtcaacaatgtaccacatatacaatggtggtcccttaagattgtaataccatatttttatggacacttctctatgtttagatacacaaacatttactattgtgttacaactgcctatggtattcagtacagtaacatgctatacaggtttgtcctaggtttgtagcctaggagcactaggctgtagcatatagccttgatgtgtagtaggtttgtgtaagtacactctatgatgttcacaatgacaaaactgcctaatgatgcatttctcagattacatagccatcattaaatgggcaacacatgcctatactaacatgaccatactaaaaaaagtgggcgaaaatacatacacaatgccacaaaatgcacattgtagcactggatataataacaaagaaaactggcaacaacccaaatgtctactaataaggaatgaataagtgcataaaatggaatactataatagaagccatgaggacaaatggggtaaatttacatgtactaacataggaagaagtctatgagtgtaaaaagcaaggcaaagaataggatgtgtaaatatgtgtatgtatttaattgtctaataagtatctcacagaaacattctagtaggacaccaaactgttaacagtggggttagttacctctggtgagtgaggttttactttataatcctatacttcaatattactttaaacattaaaaaaaattaaaagctaacatgaaggaagttagagtaaactcagtttcacttttaacctctgattctgaagttttaaggaggaaacagctaaccaaagtagtttgctagtaaacacaggaaaggaaaaataaatggaaaaaaatcagagctggcttgtgctatgcatcttgtagtaagaaagtaccttggcattgctggagaagctcagaaaaaaaggagtataagtgcaaaggataagaataccaaaattattactaaggaaaaaagacaccagtggcagatgagaaataacctaccagattattgtgtttccaaaagaaaagggaaaaggactgtagaaaccaactacagaaaggtatctatttacatttatctaaaccccaaaccaaaaaccctgatggtatagctagctatgtttttaaaagttcaattatgttaggaaagaaaaacagcaaggctactctaaaaagatggtctttaagagaatgacgaagaatgaccttttattatctactttgcagcaggcaatggcttagatgcatttacattcattatctcacctatgtgatgtagttcataatgaagtgtttctgctcccaatttacagacactgggcctcatttaagttacgtggtccaaagacacaaaagccagcagatgtataaaaacagaatttgaacctttatgctcctttaaacctcattacacaatttagcaagtgaaatgctaaagtcagtaaatttctcagtagagactcctccatttaaggttaatattttgggatggtaagggcatgtttgctaccagtttttcctgttaggaaaataaatgactattgtagtttatgttcaaaacatctttaagaagcaaaaagagctgagtagagactgtagttaaggttatcactaaggcatctaaaaagcaacacgaatgttgagattaaaaaaaaaaaaaaaaaaggccggatatgatggctcatgcctgtaatcccagtactttgggaggctcggctgggagaattgcttgaggcaaggagttcaagatcagcctggacaacagtgagacctccatctctagtttttaaaaaagcattaacttgtaaaattagtaaatatgttaatttcttttacaaataggtacaggtatttttctctaactactacactatattgtgggtttacttttttttttttttttgaaggagagtctcactctgtcacccaggctggagtacagtggcatgatctcagctcactacaacctccgtctcctggattcaagtgattctcctgcctcagcctcctgcgtagctgggattacaggcagctgccaccatgcctggctaacttttgaatttttagtagagacagggttttgccatgttgcccaggctggtcttgaactcctggcctcaagtgatccgcctgctttggcctcccaaagtgctgagattacaggcatgagccaccaggcctggcctatattgttaacattcattataggactcacaattagaggttatataattgtttatactatttattttcataaaggaatataacttttgagcccctcatatctggtaatactgaaggcaccagtcctcagggaaaagtatcagtgatagtcaaaatgaacctaaaaagttacaggtttcaaaactacaaagttacaggaaacattacattatgcttcagtggtaatttaaaagattcagctgtctggcttggcatttaatggaaggctattgattacattattcaataaataaagtctcctgtggtaaacggtggtggcttggagcttttggttatattttaagaatctaggtagagatgactgctgccatacttactccaggcaaatcatgacaagtattctccactaccccgcaatggaatctaccactattcatatagtcacttaacctaaattttgcagggagaacttaaaaccaacaactgaattactctaagtactgaaactacaaatcttaaaacagaaaatcaatacctttgtaaaatacagaagccttgtaaaatattagtagtattaactgtatactgacaatcaacacctttgtaaaatatagaagccttgtaaaatacaaaggtactaaccatgcactgtttagtaaaattatttaagttactgttcccttcaattaaagtgatcaaaacaatcttgatttcagaaaatgattaatgttgcttatctgtttctctctgtaaaattaggactttgtcaccaacttttatatttttagataaaaatgcaatcttggccgggcacggtggctcacgcctgtaatcccagcactttgggaggcccaggcaggcggatcacgaggtgaggagatcgagatcggcctggctaacacgatgaaaccctgtctctactaaaaatacaaaaaattagccgggtgtggttgcaggtgcctgtagtcccagctacttgggaggctgaggcaggagaatggcctgaacccgggaggcggagcttgcactgagcggagatcgtgccactgcactccagtctgggcgacagagcgagcctccatctcaaaaaaaaaaaaaaaaaaaaaggaacctaatgccagtttctacttttagaatagcttttatttccatataatagaatttttccatcatgagcactttgtccttatccgtatgattaagtaaacacataaataagatctatgaatcatctagatagggataaaaaataagagtttacataatggccttgactgctagatcaagttattctaattacaaagaatcttgtggttgttacattgaaactgattctcaatacagatcacaggaaaatgtggctaccactataaaaatgacttattttataaacagaaacctcctgaggccttatttttggtttctcaacatctgcgttatttccataggataattatactcaatttaatagaagtacttaagatcaatggtggtgtaaataattcaaggagttcaaaccactccccaaaattcctcccttttgttgttttattataataactgatagcctatcatgaaaaatatcaccacgttactttttagacatgtgaatgtgagttacaagatgagtgaactacacttaatattttaaaattagtcaattgctggctaggcacagaggctcacgcctataacaccagcactttgggaggctgaagtgagcagatcacttgaggccagcagtttgagaactgcctggccaacatggcgaaatcccatctctactaaaaatacaaaaattagctgggcttggtggtgcacacctgtagtcccagctactcaggaggctgaggcataagaattgcttgaaactgagaggtggagattgcagtgagccgagatcacgctactgcaatccagtataagtacttattttaaaaattttggtcgataatagactaattgttctccagattaccccacccctcagtagtgtgtacttggttttctgtatcctcactatatttgatactattgatcatttcagtaattacaaagtagaaaaaagactctaacccaactaactaaaaaaaaatcaattgccaatatgcaaatttacattttatttttttctacaaacacacacactggacgttgggcgaggtggtgcatgcctgtatgggaggcatccatataggaggattgcttgagcccaggagttccagatcagtctcaatgacagaggaagaactcatctcttaaacaaaaaaaaccccagaaaactagagaaatgctgaaaattgaatgttaaaaaaggactaacaatcattttaaaggttaaccatcctaaatcaggcttttagtctatgtaactataatatctgagcacatgatttaatgcatagtataatgctgattaataaaccaaattataatgttaaatatgcctttattcaattctctgtatgccttttacaatcatgttcacatatttctttgttatattcaaaatagtctttgaggataacaggtgggcaattattattcccatttggcaaatggaagaacaggtatacaggatgtgaaactgaattgtttacaaaatcatactggtgaatagggtcctaggagttgaataaaaactttctaactttgaataaaaactttctaactatgggcttaactttttccattgctttgcctttagacacaccagttattttaaaacaatttaaatacatttggcaaactttaggtaaagcttgagtttcttatagtaggccattttctatctcatctgatttcttcagaacagaatgtagatatactcttttttaagagacagggtctagctccgtcccaggccggagtgcagtaagcaatgtgatcatggcttatttcagcctcgaacttctgggctaaagtgattggccccccttagcctctagagtagctggaactactagtgtgcatcaccatgcccagctaattaaaacattttttttctttttgtagagacagggtttcactctgttgcccaggctggtcttaaactcctggcctcaagccatcctcctgccctgacctcccaaaatgctgggattacaggcgttagttaccatgcccaacctcagatgtactcttgagtggtaagactaaccctctaagtcattgtagtggtactatgaggttttacattttctttttttttttttgaaccacatgattggaaaacaattatctctacttttaacataaccactgtaggcaaaattcagctctttagtaacatgcctgggatgaacactgaaacagtagtgatgagagagaaacaagaacctagggcagtcttacagtctctctatctttgagccaatgaaagatgaggcctgttacaaatgctagccatagtcttatcaattctactgatcatattccatccaaattcttaacttagtcaaactacaaaatatggatactcttccacataaatacagagaaaatactagttagctgccatgatttgtcatttgaatgacacaacttaaagctataatgttatactgttttttcctttaatgcaaatcttcccaaaataaaaagttttgtttaatgtacatttgcactacaaaatcacatttatattcaagatttcaaaacactcaccctagagcctggaaagaaggaatcgaaagtgcccagtgcattgataagaacagcagtctggaggcagactccccaatgtagtgcacattcaggtactcaggcataggagaaggcatggtgagctagtatgaacagggatttaggtaaattatcttatgactgaaaagttctaaattatcatttctttgaaaaagtttaaacgtaacacatcaaatgagagctaatatattcacaaaaaaagctaatcttgaaataatccaagtcactagaatttacagctaacagggcttagaataaataagtagcccatagtttctaacaagccaatatttagacaagcagaacctcaacaaatatcaacgatgatattatctggttatgttacttcctgtcttggtctaacaatatgtttcttttccttccttctctccattaatgatagcatacaacaaattcagtttaaggagaaattctgtccgctaaatgtttctttcatttaggctaaggggttaacaaattcaaatgcttacaaagccaggagagtaaggagtgcaacaggcttgctggtaccaactgggaagagcatatttattcccagataaaggacacagctgtgaattgaattcagtgcagtgaaaacatatggaattgtgggctgagcactgccagctctttcagtttttcaaagagcacattctgtgtgaaacctccctatttaaaaaaactggcaggccgggtgtggtggctcgtgcctataatcccagcactttgggaggtggagacaggtggatcacgatgtcgagagatcgagaccatcccggtcaacatggttaaacctcatctttactaaaataccaaaaaaaaattgagccgtgtgtggtgagcagtcccagctacccgggaggctgaggcaggggaattgcttgaacctgggaagtggaggttgcagtgagccaagattgagccactgcactccagcctgggcaacagagtgagactccatctcaaaacaaaacaaaacaaaaaaacccaaactggcactaaataaaaaaaaaatgttttaaaaattacaggtatgcctgtggacatactactagtaagtggtcagtttatattgctgatctagttctttaaaatgtctgaccactgttgaaacttttttctactttgtaattactgaaatgaccaatagtatcaagtatagtgaggatacagaaaaccaagtacacactaccaagggtggggtagtctggagaagaattagtctaccatctaccaaaattttgaaagtaagtacatgcaataataccacttctaaatctctgttccagcaaaatacttgcatacatgcacaaaaaaagcatgtgtaaggatgtccattgcagctctacatctaacaatgaaattaaatgctggcaacaacccaaatttctatcactagagaaaagaataatccatgctatagaatatatgtgggcattaaaattggaaagataaactgagatgtaatggtatacaaaaaatctcacagacatccaagtggaaaaaactgtaaaacagtatgtattaaatagatgacccaatttatgttaaagagtacatatatatgtatacctaaaaagtacagaaggaaacacgccacacagttaacagtggctacctctgggtggggtaggtagatgtgtccatatgtatttttctggggaatgactattatagctttcatcagattctcaaaggtatcttttttttttttttttttttgagatggggtctcgctctgtcacccaggctggagtgcagtggcgtgatctcagctctctgcccaggttcaaatgaatgtccttcctcagcctccccagtagctgggactacaggcgtgtgccaccaggccccgctaattttttttgtatttttagtagagacggggttgtaccacgttggccaggctcgtctcaaactcctgacctcaggtgatccgcccgcctgggcctcctaaagtgctaggattacaggcatgagccaccgcacctggcctgtcaaaggtatctgctatctaaaataccgcacctggcccctcaaaggtatcttctatctaaaaggcttgaggtttgaaacaaagaaaagttacataaaaatgtaaaaaacaacccctgcctttgttcattattagccaagaatggtttacctatttataaattgtaccaagtaataaaacaaaagggcaattaatagttgaaattctgtaagtgagaagaaaattttttacatatttaagaatgtttgagaaaggtttactacagcagtaagttaaaatacaattatttaagacaattcttggctgagcgcagtggctcgtgcctgtaattccagcactttgggaggccaaggtgagaggactgcttgaagccagtagttcaagaccggcctgggcaacataacgagacccatttctacaaaaaaaaaaaaaaaaaaaccgacacacaaaacaaaaaattaaaaatttagccaggagtgatggctcacacctgtatcccagcaactcgggaggctgaggtggaagagctgcttgaacctaggaattttgagaccaacctgggaaacacagtaagacctcatctctaaaaataaaaaaattagctggacatggtggtgtgcacctataatcccagttacttagcagactgaggcagaaggatccctttagcccaggaggtagaggttgcagtgagccaggattgtgccactgaactccagcctgggtgacagagcaagaccacatcttaaaaaacaaaatatatcatatcttttcagaattacccaaggtgagtaaaaaggaagtctgaaaaactaagggaattaccaaaaattactagttttgggggaaggggcaagtaagatgcaaaacaacaacaaaaaagtcctttgtaaggctaggcgtggtggctcaggcctgtaatcccagcactctgggaggccagggcaggcagatcacttgaggtcaggagttcaagaccagcctgccaatgaggtaaaaccaggtctctactaaaaatacaaaaaattagccgggcatggcggtgtgtgcctgtaatcccagctactcgggaggctgaggtgccaagaacagctggaacccagcgggtagaggctgcagtgagccaagattgtgccactgtactccagcctgggagacagagcaagactctgtctcaaaaaaaaaaaaaatcctttgcaaaatagtttaaaattgcatttaaataaaatattaatacttgtaatgtgtaaacactggatataatggttttgctttacacaacagtggtggtaactctgaaaactttctgctggtttaatcataaaatggaaatagtttacaacacacactaaagggactcgttatttaaaatattactacaccatgttaacttataaagagagaaaatgtttcataatctgttctacatgctcaataaaactctagtattctgaatcagaaagctaatgttggctgaagaaacaatagtccatttcacaagtctttgagactgaaaagacaaagatttattcctatataaagagtgagcttccccaaaatgcctgtatatctttaggtttataaattgaattatacacatttttcaaattagaaaagttcaacatattgagtgaatttttaaagagcattgacaagaactaaacctgaccaatctgttttagaagttattagttgcttctacaattatctttctagcagtttctgtattgaaatcttataacagcctgcgtgatatagctttttttttttttgagatgcagtcttgctctgtcgcccaggctgcagtgcagtggtgccatcttggctcactgcaacctccgcctcccgggttcaagcaattctcctgcctgagcctcctgagtagctgggattacaggtgcccgccaccacacccggctaatttttttttttttttgtatttttagtagagacggggtttcaccacgttggtcagtctggtcttgaactcctgacctcgtgatccacccacctcagcctcccaaagtgctgagattacaggtgcgagccaccctgcccagccgatatagcttttaaaaaatcactggatggccgggtgtgatggctcacgcttataatcccagcactttgggggggccgaggtgggcggatcattggagctcatgagttagcatgggcaacatgatgaaacctcgtctgtatttaaaaaaatacaaaaatcagctgggagtggtggtgcatgcctgtagtcccagctactcaggaggctgaggtgggaggatggcttgagtctgggaggcagaggttgcagtgagtcgcgatcatgccactgcactccagcctgggctatagagccagtctgtctcaaaaaaacaaaaacaaaaacaaaatccttggaggctgagcacaagcacagtggctcaggcctataatctcagcacttttgggaggtcgaggtgggaagatcattgcttgtggccaggagtttgagaccagcctgggcaacatagtgaaacctcatctccacacaaatagaaaaaaatcatttgagttaggagatctggattctgcttccaactttttgttaatcacttcgcctaattaccagtatgaccctagattacatattcattcagtaactatttacttagagttcactgggaaccagtaagtgctattgtctcagtggaagaataaaataaaaactgaatgagctatagaaaagggctaagaaagctaatggcatgtgtgagaaaccatgagcagctgggtcagaatgtggagggccctaaaaggtcaagttatagagaccggacttaatttcataacatatgggcaatgggaagctactgaaggctgggcagagtgacataatttgatttttaacaaatataacgctggtaccagcacacaggacaagatggaaaagaaagactggaagcgaagatattagggtaacaaatcaagaaaggaattttaaaaggcctaaaatatggtgaaggaaatgaagaggaagggagaaattcaagcaatggaatggttaaaattcagttatggaatgagaagagtgaggcttagggagagtaactgcctctaaagttgcaaacatgggcgaccagaaagactgactctaatgtgaaaataataaaattttagaaataagtatatgcaatttccaaaaccacctcacttctgttgcatgtatataatttctaaaatgggaatatgatctaccatattcttaaaatcttctaaggagattttaagaatcaagtaaaataaagtacatgaaatcataccaaaaattatgaagtttaataaaaatctttttctttttttttgaaagatggagtatcgctctgtcacttaggctggaaggcagtgatgcaatcttggctcacggcaacctccgcctccccgggttcaagcaattcttctgcctcagcctcctgagtagctggggttataggcatgcaccactacgcctggctaatttttgtatttttagtaaacacgggatttcgtcatgttggccaggctggtctcgaactcctgacctcaggtgatctgcctgcgtaggcctcccaaagtgctaggattacaggtgtgagccaccacacccggccaataaaaatcttaaatattactactgcccttgatttttcaaaatcaaacttcaagtttcattattagactatttctccctactaccaagattgctttgaacaagacactaaacatctctacatctctttcttcatccaccaaatgagaataaaaattctaaccctaccaggtatggtgggttacacttgtaatcccagcacttcgggaggccgaagtgagaggatcacttgaggccaggagtataagataagcctggacaacaaagtgagatcccatctctacacaaaaattttttaaattagctgggtgtggtggcacatgcctgtggtctcagcaacatgaaagactgaagcaggagaatcccttgagcccaggaggtcgaggctgcagtgagctgtgattatgccactgcgctccagcctgggtgagagtgagaccctatctcacaaagaaaaaaaaaattaaaaattctaacctcagcttatgtggtgaggcccaaaggaaacagtgtatgtgaaaatatgctgcaaactacagtgtacatagaaatgcaacagaggaacaaaatgctattcagctcagcaagtaagaaaggactgagttgtttgattacagatgtaaggtcttgaaacccatgatcagaaaacttcaatgtgagaaccatgaaattaccagactctaggagctaagcagggaaatcactgaaaagtcaaacatttgacttcacaaggctgtaagactccgagaaagatgaagtggtccttttcaggagagtaagaaactttatagtgctgactgtgaggatacttaggaagacaaagatgggaatgacaaaagccaatcctaagaagaaaaaaaagttgtaatttgccaaattcttctgtccaaaacatttcaagcaatcaaaaactttgaggaccaacattaacaataaacaggtaaactacccctactttctaaagagcactctggtccttttccctcacaatgggtcctgttcctacatctgtctcatttcatccttcctcccatttaaatccaaagcagaacataaacctaagaaaacaaaagagtatcttttatttagaatacgaaagaacaatgggaaaaatcaagttttgccttgctccacccttgtccataaatcttaccataattttttagaatgatactgattattccaattactttttcttatagcactcataaaaaattttcctgtagagtgtagaaaaaaaatttctaattttttccatgtaaattatctttggtaaaattttacataaaaattggcttcactgatatattttattgactacatcaaattacactattttaagccactgagttttctctgtggctatttctaccaagtcaaattttatagatacaaatattactttgcactcataacttctactggtatacatatttatttgatagctgtacatattctcctaaaaaaatccatggaattttataatctatagtaaaagtatgagcagtcaccctcaggtattccaagactgctatatattgctaagtgaaatctatatgcattcaatccctttgcatacatcttgctaagagtatccacagctgagtggttaaaatggaagagtcaaaacaacaggatcgtaatgtaaggtctccacagtgagcatggctataactctgtccaagcattatttgaatgacaaatagtagaaagtgattttctagtcttctacatgtattatttctagtattctgcatgtattgtttctgtcataaataaattaggttggtgaaaaagtaattgcagccttaaaagtaatggcaaaacccacaattatttatgggaacaaaataaattataaatgtaccttctccaaaatggctaaaaagtgtaagttaaaaactaaaagttaaaatatattaaataatttgtatctttttaaattttattatgtaattttaatttataatagagatgaggtctcggcatgttgcccaggctggtctccaactcctggactcatgcaatcctctggcctcagcctcccaaagtactgcgatgacaggtgggagcagctgcacctggccaatttgtatcttataataatgctggaagccagctaattaagatgatacataacaaatggagctctttgtagttactatggtaagagcaaactatctgggtcttattgattacgatatagtagtagctaggcattgaacaaaagcagtccattcaacacatcatgaatgccaatacttaaagtttaacaaaatgtgctgaaaagttataaaagctaacttttaaacgcaataactgctattataactgacttaacaggatgctttattacgccattatcttatctacataaggctttagcctcctgcatagatgcacactaacatgcccagcttattcagtatcttgataaacagaagagaaaagcctaaagacattttgtttctatatgcagatgagtttttttttttttttttttgagacagagttttgctcttgttgcccaggctggagtgcaatggcgtgatctcggttcaccataacctccgcctcccgagttcaatcgattgtcctgcctcagcctcccgagtagctgggattacaggcatgcaccatcacacctggctgattttgtatttttagtagagacagggtttctccatgttggtcaggctggtctcgaactcctgacctcaggtgatctgcccaccttggcctcccaaaatgccaggattacaggcataagccactgtgcctggcccagatgagtgttttagctgctgttctgaaattctatcagggatatttctgactttaaaagcacaacaaacatactttgatttttgaaaggtagatcaaaatcaagcaacacaacatacaagttaaaaaaaacatatagaaataccctgaaagctacatgtgaatcgctgagaagtggcccctctttttcggtgtaatttatgcttgaatctccagtgattaggtgtacacttccttccatgcccgctactgagctctggcaggctgtgctctctccaggattcaatgcttttgcaagagtgtcaaatgccctgtatgaagacatcagaagctatgagcttgaccaaacaccgcaataaaataacaattctacataggattctggaattaagatttaagcctaaaaaactggccaggctggtctagaactcaagtgatatgcccgcctcagccttccaaagtgctgggattacaggtataagccacatgcctggcctaaagtctctttttaaaatcttgcataattaagggggagaagcatcttcatattttcatataataatatgtttttaaaagttatatattttatcgcttgagtccaggagggcagggctgcagtgagctatgatcacaccactgtactccagcctgggtgacacagcaagaccctgtctcaattaaacgaaattcttttcaattaattattttttaagaacattatatgtatgatatatatatatatgatactacaagactatcagcctatttattttgtatacaaaagttacttagaacaagggtaagaacttatgtcaactttattatacacagtacaataggtcttaaattttatttaaaaattcagaaaacattttactcatgtttatttttgaaacacattctccctgtgtcagcaaggctggagtgcagtggcatgatcatggctcactgtaatcctgaactcctgggttcaagcaagcgatcctcccacctcaacctcccgagcagctgggactacatgtgcgcaccaccatgctcagctaatttttaaattatctgtagaaactgggcctcactatgttgctaaggctggtctcccaactcctggactcaagcaatcctgccaccttggcctcccaaagtgctgagattacaggcatgagctactgcacccgggcagagagtattttaaaatgtgtggtcacatagctaaatctaaactgtaacaatttgatattagaataataacaaactaatgttagcaaataattactcaaaatagttccccatatttttcaataagcctcctagagtttcttaaaatctcatgttcaacaaagtattacttattgtgactcttaaatgtagtttattcagtatatatattatgttttgttgttgtttgagacagactctcgttttgtcgcccaggctagagtacagtggcgtgacctcggctcactgcaacctccatctctggggttcaagcggttctcctgcctcagcctaccaagtagctgggattacaggcatgcgccaccacacccagctaattttttcatttttagtagagatggggtttcaccatgttggccaggctggtctcaaactcctgacctcaggtgatccacccctctcggcctcctaaagtggtaggattacaggcatacgccaccgtgcccggccaattcagcgtatttttatcatatctttttttttcctttagagatggggtctagttgccggttgactcaaaatcccaggctgaagtgatcttcccgcctcagcctcctatacactaatgtgttcagcttattcaatattttaaatgataaacgcagtgtaggaaaaccctgaataaactgtttctatatcctaagcattaatatttacagaataaaaaacagaattctgatactactttcttcaactgtaacttaaaactgtagttgattaaactaaaccttttacattaattttcatcactagaaattgaggagcaggatcaatatgattgcctagaaagacaagtgtttcgctctccatacacatcttcatctttagaagaaaaaattcctaggttttaagaccacatttctaatcttctaatattcacttactgattttgtcatttagaatataacctttcataatgaatgcaggttttcagtgaaaacttactatgccttaaattttctaagtgaaaatagaaatgtaggttaagcattcctaatactaaaatccaaaatgctctaaaatcagaaactttttgagcaccaacatgatgccacaagtggaaatttcacacctgacctctcatgatgggttgcagtcaaaaagcaggtgtattacagtttattcagtgtttattccctgtccccaagggaaaaaagatcctcccagctgagataaatcttttctgtatacgcccagactcccccaagtaagcacgcccactaaggatgataaaatggcacatgtacaggccagacatgccaatggcaagttcccccgattccccatgaggagccaagacctatgtgtattactcactgtggatttttgcatattctcttctttgtggtgtaaagatatttttgaaaaggtcagaaaggcctgcatggtacccagagtaatgcaaacattccaaaatctgaaatctgaagtgtttctggtctgaacaaagcatttcggataagagataatcaacctgtatttagataatcaacctgtatttgttttctgaaacttttataaatagcatttaacataaaaatgttttaagaaatactgaaagacatgtaaacaaaaggacattgataatcaaaagataccttaccttgaaacatcaccgttggtctgcatttcttgaaattcacacaaagaggtatcatcattgcttaagctttcaatcatagacatttcattactattttgagaaagatctttagtttttccaagattcgctaatgatgtaaccacattggccaatgtacttaaatctccctgacatgattcagcctttaaaaaaaagggtattaaaattctgtgaattggtatcactatttttttcaatctgaaatatccaattatagattatgatatgccaacaaaagaacagtatgataaatgaaacctggaaagttaaagggctgagctttcagaaatttactgaggaaaatacaagtttaaaaacatcaagtgtatttcttaagaaatgtttatatgttactttgttttttttttttttgggagatggagtctcactctgtcactaggctggagtgccgtggcatgatctcagctcaccgcaacctctgcctgccaggttcaagcgattcccctgcctcagcctcccaagtagctgggattacaggcacatgctaccatgcccaactaattttttgtattttagctgagacagggtttcaccatgttggctaagatggtcttgatctcctgacctcatgatctgcctgcctcggcctcccaaagtgttgggattacaggcgtgggccatcgcgcccggccgtatatgttacttttttttaagagacaaggtctccctttgtcacccagactggagtacagtggcacgaccacagatcactgcatccttaaatttctgggctcactgatcctcctacctcagcctcctgagcagctgatcctacaggtgtgcactgctatgcctgggttgttttttcatttttagaaatggggtcttgctgtgttgcccaggctggtcttgaactcctggtatcaagtgatcctccctgcctcagcctcctgagtacaatttctaaaacttactatacaaactataaacttgtatggaatatgaagaatactagtgaagagcgggggaaaaaatggcaaatgaattgttgaacagacttcctaggatgccaacttttgccaaacattgtgttaattaaatgtgttaaaaggcactgtgttaaacacaaacattaaaagaaatagatcagttacccattattctcttcacttttttgtcactggagttgaaaactctctttatataggtaagatactgatctatttgtctttttttttttgagacagagtctcactctgtcacccaggctggagtgcagtggtgtgatctcagctcactgcaacctccaactcctgggttcaagtgatcttcccacctcagcctcctgactacgggcgcataccaccatgtccagctaattttttaattttttgtagagatggggtttcatcatgttgcccaggctggtctcaaactcctgggctcaagtgatctacctgccacagtttcccaaagtgctgggattacagacatgagccaccgtgcccggcttgtcttcatttttttaatgtttgttgaaaatgtgtatattacttgtgcattagctacaattcttttataaaaaagaattttctctcaactcttttgacaactcagaaatataatttgtacgggaaaggcaggtaagtgctttatttttcttttactttgttatcaattttcagagcaagaagctgatatcctagcaatttctaattatgatacatgagtttttctgagtataatttttaattcatagattttcatatatttgatttaaatttattaaattcttttgtaaatcctttcccatcctaacctaatgagaagccttttaagttgccttctatggcctactgggccaaccccttaatggtatcttcttattaatactttcttcatggttttttctttttggtgtttttttttttttttttttttgagacagagtcttactctgtcgccaggctggagtgcagtggtgcgatctcggctcgctgcaagctccacctcctgggttcacgccattctcctgcctcagcctcctgaggagctgggactacaggcgcccgccaccatgcccagctaattttttgtatttttggtagagacagggtttcactgtgttagccaggacagtctcgatctcctgacctcgtgatctgcccgccttggcctcccaaagtgctgggattacaggcgtgagccactgtgcctggccctttttggtgttcttaatactaaaataacacatatgttcccatgatgtttcatttattataacaatcagtttctgtgagattttggtgaatcagtagaataaaataatttttgtgccttctccaaattaatcaatggtccaaaaatcatttactgaaaaccctaccagttatcatgttcttacataattaatacctatatatgcattttatttaactcccataacaactctgaaatagaaatcatcattcctctattgctaaccagaaaaatgacccaaatagtagaggtgggactggctgactgccaaagtctatgcttttttttttttttaagagacagtgttttttagagacactcctatcgcctagactggagtgcagtgccaggatcatagctcactgcagctttgaactcctaggctcaagtaatcctctgcctcagcctcccaaacagctgggactacaggcatgtaccaccatgcctgggtaatttttttatttttagagacagagtctcgctatgtttcccaggttggtctcaaattcctagcctcaaggaactcttcaacttcagcctcctgagctgctgggatacaggcttgagccactgtgcccagaaaagcccataatgttaagcactgccccaagaaattttcttatatttgaataaaaagtacattagttacaattttaaatgctttaatattcacctaaaacttagaagcttatatagtctcttctacctagcaacatatctaactagattcttttttattttattttatttttttattgatcattcttaggtgtttctcgcagagggggatttggcagggtcataggacaatagtggagggacggtcagcagataaacaagtgaacaaaggtctctagttttcctaggcagaggaccctgcagcgttccacagtgtttgtgtccctgggtacttgagattagggagtggtgatgattcttaacgagcatgctgccttcaagcatctgtttaacaaagcacatcttgcaccgcccttaatccatttaaccctgagtggacacagcacatgtttcagagagcacagggttgggggtaaggtcaccgatcaacaggatcccaaggcagaagaatttttctttctaactagattcttaagtttttgcccctaaaggctcttagccaacatagaaaactttcatcttgtgacttcagagttttggggcaatttatcagagaagcttaccatacggttgtcataacaatttaatacaaagatatacaagagagcacagtgtctgggcagagtagtttgtcaaggaaacctagttcccttcctttcttaaaggagttaatatgtcagtaaaaccaattatcattctaaccttgaatcatgcagacagggctaagtgaagttttccaaaatatatggcaagaggccactgcctcacctagcaattacatgctaaagcccaaactgtaagatacttttattactcttattttacagatgagaaagtaaggcactaagaggtcaaataacttgcctaatgttatatagctagtaagtggtagatgaaatttgatttccgagcctaagtatttagagcgccttaaagcatcaagtgacaaatatataacaaatcttgcataaacaggacaaataatcttataggttatataaaatcagatcccggccgggcgcagtggctcacgcctgtaatcccagcactctgggaggctgaggcaggcggatcatgaggtcaggcgattgagaccatcctggctaacatggtgaaaccctgtctctactaaaaatacaaaaaattagccgggcgtggtggcgggcgcctgtaatcccagctacttgggaggctgaggcaggagaatggcgtgaacccaggaggcggaggctgcagtgagccgagatcgggacactgcactccagacggggtaacagagcaagactccgtctcaaaaaaaaaaaaaaaaaaaaaaatcagatcccagctaggtagggaggctcatgcacataaccccagcaatctggaaggctgaggtgggagggtcacttgagcccaggagttcgagaccagctgggtaacacaatgaaactcggtctctacaaaaataggaaaaattagccaggcacagtgtcacgtgcctgcagccctagcttcttgggaggctgaggtgagaggatccctggagcctgagaggacgaggctgcagcaagccattactgtgccaccaccgtacccccagcttgggtgacaagaggggaccctgtttaaaaaacaaacatggttgagagaaaccctgatcataggcttcctaaaatctgttttcagatatgagttttcaggagaaatttttgcttcttgttctcccaaagggcttctgacaagtacagaaactcttcatgttcaatttaaataaacaaactgtttttcctttagacccttggtctaacatagagctgctccaatctctaagagaactggatgacttggatacataaaaggagagctcttgcagtcctattcctactcttgactcaagtaaatattttgatggaggtgagctaagaatttccttttacctgaaatattttaagtattttggcactaaaaaataaaaaaagtattttggcactaacaaatctgtaagggagcataaaagaaatattaagaattgtacggctgggcgtgctggctcacgcctgtaatcccagcactttgggaggccaaggcgggtggatcacgaggtcaggcgatcgagaccatcctggctaacaaggtgaaaccccgtctctactaaaaatacaaaaaaattagctgggtgtggtggcaggtgcctgtagtcccagctattcaggaggctgaggcaggagaatggcgggaacccgggaagcggagcttgcagtgagccgagactgtgccactgcactctagcctcggcaacagagtgagactccatctcaaaaaaaaaaaaaaaaagacttttacacctataataaatgtcttactgaggactcgtatttcaagatgagggaagagtacgtgtttgttgctttcatgttgaagggataatcatcctagtgaaattatgaacatttctgatttttttttttttttttttttttgagacagagtttcgctcttgttgcccaggcgggagtgcaatggcactatctcggctcactgcaacctccacctaccgggttcaagcgattctcctgcctcagcctcccgagtagctgggattacaggcatgcgccaccacgcccagttaatttttccatttttactggagacggggtttctccatgttggtcaggctggtcttgaacttctgacctcaagcgatccatgtgcctcggcctcccaaagtgctgggattacagatgtgagccactgtgcccagccgaacatttctaatttatattaaaaaaaaaaaggcaacttgtaatatggaatatttaagaacaaagcaatttaccaaagcaaaggaagtgattagaaaacattttaaaatgcttaaaattatctaagctttaaattgtactaaacacaccttatctgatgtcatcagcacagctgactcagtttttactccagatggatgaatattcatgaacattcctgaatctaacagtcctgttgacctgtaacaaatcagcacaaattttggcctgagtttcattgggaagaaaaacaaaatgaccagctactcagtgtctgttttactttaccttgtactttcactatctgttacaaaagttggagttgcagttaatgggctacgaaggtcctttcggatatagattttttctgttgaagcggcacagttggaagatttttctcgtgatacttcaatgggttttctttcacattggacagctacaaaaatgtgttaaactattatatcacaatataggatttacagacaattagaaatgtaagctgtaggtaagcttaatgctgctaataggagacatggctaccatactaaactccaaagataaccatcaatctttagaaattatgtgcaagttcaacaaagttgctttagattagtaaaacaaaccaatttgcatctctcattctttttgccaaacacaaactacaaatacgtgctttttacacaggtattcaataaatattagttgaataaataaaaaagtacatacgtaggtctgtattcttatatttttagttggaaaactgtaaactaaaaagtatacatatttgacatattttgttaatttcaatactcttgtagtttgctggaatctttaaaaagtattttctccttaaaagctaatacatacagtcttgcttcattccaaacgcaatacatctctgtaacctgcagtattgacagcggtttcggtggtgcttattaataatacaatcctttgatcctcgacatgaatatactaaattttttcggatgcttcttttaaaaaatcctttgcagccttcacaagttactgctccataatgacgtcctagagagaaaatgtttaagaaaatataaaagtcacattatttcagaacagaaatgacataagccaatttcttccctttaaacaacatataagatgaaactgatttttgagcttctgacatgaaaaacatttttagaagttatttttatttatcataacttttttagagacgggatctcgctctgtggcccaggctgaagtgtaatggtgcgatcacagttcactgcagtctcgaactactggactcaagggatatccccaactagctgggactacaggcttgcgccaccacacccgaccagttttattattatttttttttgtagaggcagtcttgccattttgcccaggctggtcttgaactcctggcctcaagcgatcctcctgcctccactcccaaagtgctgggattacaggcatgagccatctcacctggcctaatgtaatatattattaaagatcagaagtcattatttttaaatgattcctttgccaaaatttctagttttcacattaaaaaatgtttctacagctgggcgtggtaactcacgcctgtaatcctagcactttgggaggccaaggcaggtggatcacttgaggtcaggagttcaagaccagcatggccaacatggcaaaagcccgtctctactgaaaatacaaaaattagcagggcatggtggcacacgcctgtagtcccagctactcagaaggccgaggcaggagaattgcttgaacccaggaggcagaggttgcagtgagccgagattgcaccactgcactacagtcagggtgacagcgcaagactccatctcaaaaaaaaaaaaaattttttttttacatgttcactttcaaaagtgaaatatgcattttatttcattacaaatcatattaaattgcactgaagttaaaaaatataagtgaataaagaactttgggaccgggcatgggggcttacacctgtaatcccagcactttgggaggccaaggaggggagggtggatcacctgaggtcacgagtttgagaccagcctggccaacatggtgaaactccatttccaataaaaatacaaaaattagccatgcgtgctggcatgcaccttagccccagctccttgggaggccgaggcaggagaatttcttgaatccaggaggtagaggctgcagtgagctgagatcacgccactgcattccagccggagcaacagtgagactctatatcacaaacaaagaactctgggaaaaaattagttaaatgttataggctacaaatatgaaccataaaaacgacatactcctttatttctcttcttacttttagtagaagaaacatggtagtgtggtagttatttcaacaacacgacacatataggaggttattttttttttctgtttttaggaggttattcttaatgttacctgatgctttgtctccacatactacgcaaagatcaaaaaccttatttggtccttggtctggagaattatctgttaggagctaaaaaaaaaaaaaaaaaaaaagaaaacaaaaacgaaaacctgttgttactcaacagcactcattctattaaaaaaattaaagaacattcagttggtcttgctttgttgctttctttttcacaagttatttttaaactttgtactctatgaagagctcagaacctttccacatgtaatgacgacaaaaataagcttataatggcataaagagataactctaaaccttttaaatagaaaaggggctataaataaatttccttgaggtaattataatcatgcagatgtgctcgctatacaaaggtatggacttaaaaagctcatcactaggcacagctaataagatactggcaaaggaaactagtttcttctttaaaaaacaaaaaaaggctgggtgcggtggctcacgcctgtaatcccagcactttgggaggctgaggcgggcagatcacctgaggtcagaagttcaagaccagcctggcctacgtggtgaaaccctgtctgtactaaaaatacaaaaaattagctgggtgtggtggagagtgcctgtaatcccagctacttgggaggctgaggcaggagaatcgcttgaacccaggcggcagaggttgcagtgagccgagactgcaccactgcactttggcctgggagacagaacgagactccatctcaaaaacaaaacaaaacaaaacaaaaaacagcaaactagtttcttcctttaggtttatctttcaaccttttcatcattttctttcaatcttgaaatgtgaacaaataaattcaattaaagaaaatggaatggcatttgaattcctccaggaatacttctgattttatgaactttaaatggttcttaaaatgactgccccttactatgtaatatatagcatcatttcttcttatatcaccacaaaaatcagtcttcagtaagtacttaagcttctggtactagatgtcctatgaaagcatctatggcaagtattactctttaatagcctacctgttgcaaatggtgctaatcttttatctattattcctaagtctggaaggagatattgagagattaagggatttacccacattcatgagaaaaacatcagaccaagtccaatagtggcacatcctacaatatacctggccagtactcctcacgtaattgtcaaggtcatcaaaaacaaggaaagtctgagaaactgtcctagccaagagaagcctcaggagacatgtcaactcaatgcaataaggtatcctggatgggatcctgggacaaacaaagccattaggcaaaaactaaggaaagtctaaacacctataaacttcagttaacaatgtatcagtattgctcattaattatatcatgaatgtaaaatgttaataataggggaactgtgtgtatttacgggggagtaatatgggaactctgttctatatgctcagtttttctgcaaatctaaaactattctaaaatatcaagtctactacttaaagaaaaattaaggtacatataatgttatacatttttttgtgacttttgtcttgttgataaaacaacttcttataaatctgtgactgtatccactttctacctttatttccaaaactaatacaaatatcattggatgaatagatgatatcaggatatacagacaaaatttcgtgttttatgaattcagagtttttcaatccaaagaggaattttctttcgtgagtttttcatcataaaagatagaacccaattttaagtagacccccttcaaaaagtttctgaaggcaaacttcagagtacattatatttgtattcaatcatagcaaccagcagtgaaaacatcgacataaccacaggcatgtggtgtataaaagtttttgagtctttgaagaataatgtgtaattttctattctagcgaaaactaaaatgatgtaatgttaacatatactacttcattccagagtaaagcaggagcccatgactgcactgcttgctatttcatgaagatgtgcatgacaacaaaggaggcacaatgttgaagccagcagctatagtccaaacttcttgatttggcagcttcctgtttgtagcacaggcagcttggttctggaaaatacagctacaaaagctgctcctgatttgacaatttcctaattatgaagtaggaggtctcttagaagccagttttgcagcatgctccaatagtcgatcttgaaaacctggcctagaactgtttcttcaaccttcctaacaattctgcaagctctctgtatcctttattaaaggctgttgtcctggctacaatagccagagtggatcttactgtatgcaacaaagaatccccaaaatatatgagtgtgaggaaagtacagtggcccataggagagggctgtcactgtagatactgtgttacacataattttatgcatttttttcctactgaatatacatagatctaaagtcttcatggcagggcttatgattaaaattttttttttatatatgtaagaggaaaagacacttctatagttatttacctgcaggtgttgtgcagacagatcaggagtggtaaaaaataactggttgacacctgctgcatctggagttgtaaggaaaacttttcccggagtggaatcttgcctggccagaatgactttgcttggagtagagccgtcgtgatttgtcagaatgaactgcttgccttgggtattatgatcaagtgctgtcacaatctggattttctgcccagtttgctgctctgtaacaatctaacaaaatcatgaaaaataatcaatgaaactcaataatttttctttaatgacacaattatcttcttagaaaagcacattacatatatattcaatataacacacacgtaccttttaaactaccgattctattgccacaaaattctatcctacagaaataaacaaatgtgcaaacaaaggtacaatagtaagaacattttgacctcactattttgattccctccttccccttccctcccatgttccatttagacaaacatatattgggtgatttatattagctgttctgcatactgggatgtagcagtgaataaaacaaaacttttgccttcatgaagcttttattttagtggggaaagacagataataaataagcaaataataatattgtcatgcggtactaaatgctatgaagaaaaacaaggcaaggtgagacagtaacagaatgagggcaatgagggaagctcacgctaaggaggtgtcatttttgcaaaggcctgagtgaagaaacagaccaaggcttaggactacctaggggaagaacattccaggtagaggaaacagagcatataagtaggtcccagggcaggagggaggtgtttgacacatgtgaggcacaaggcacagcaatagagatatatgatgagtaagacagaagggaagacagggattacagtagaatatgggatctgagtgacagctgggactcagagggctttgtaggccaaacaaaagtctagatttcctaatgtgtgaaatggagagccaccaaagggtttggagcagaggagtgacaggattttattttttaaaaaggaatcagacaggcacagtgacattatctataatcccagctacttgggaggctgaggcaggagaatcacttgaggccaggagttcgagaccagactgggcaacacagtgagaccctgtctcaaaaaaaaaaaagaagtataaaaaaagcattctaaatttagtgtgaagaacagactgcaaatgttcaagagtaggccgggtgcagtggctcacgcccataatcccagcactttgggaggctgaggcaggtggatcccttgaggtcaggagttcaagcccagcctggccaaaatgacgaaaccctgtctctactaaaatataaaaattagctgggcatggtggcgggtgcctgtaatcccagcaactggggaggctgagacaggagaatcgcttgaaccctggaggcggaggttgcagtgagctgggattacaccactacactccagcctgggcgacagaggactctgcctcaaaaaaaaaaaaaaaaaaaaggggatggacacagtggctcatgcctataaccccagcactttgggaggccgaggcgggcaactcatgaggtcaggagattgagaccaacctagctaacacagtgaaatcccgtctctactaaaaatacaaaaaattagctgggcatggtggcatgtgcctgtaatccgagctatgtgggaggctgaggcaggagaatcacttgaaccagggaggcggaggttgcagtgagctgagatcgcgccaatgcactccagcctgggtgacacagtgagagtctgtctcaaaaaaaaaaaaaaaaaaaagttcagaagtaaaattaagggagatcagaaaggacactactgcaggtaccatcaatatctggttatgacatatgggcagaaatactgaccaggaacagggtagcagccatgctgggggtgaaaaacaattaaattgggatttacttacttatttatatattatttatttattttaagaagagagaagtaacaaaataatgctgatagactgaaggggaatatgaagaaagaagagtcaaggatgattataaaattttggcttgagcaattgggaggacagaactgccatctgccatctgggggggaggaacaagttcatgaatacacagaactatttcagcattgagagtttctgttattcagcaaatatatcccagattaaacatcattaagccaattaaattccttgattcaattttaaaatggcaaagtccgtttgtttctaattttccaaaattccaatcctgttccttctgtaccaaattttttctatttttattttcctgaaattatttcaagattcttttctatgcaaaatttaaaacaaagttctgattcactaatcagtttatgtctaaagcaaattgtttggataaaagactaatagttcatactgacttcttagagaagagcatttggcgcattcatggtccaactgctcctgggttgaaacattctgcttaaatgagtaaaaggacattactgcagcataataattgtaataattgaatatttgggcaatccaaagagccttcaatagagaagagtagtaaattatgtaaacagttcttagcttttaggactctttatattctaaaatattactgagggttccaaagagctttttttttgagatggagttttactcttgttgcccaggctggagtgcagtggtgcgatctcggctcactgcaacctctgcctcccaggttcaagcgattctcctgcctcagcctcctgagtagctgggattacaggcgcccgccaccccacctgtctaattttttgtattttagtagagatggggttttctgcatgtgagttagaaattcaaagagaaattttaaaaatagttgattcatttaaaaattaacaacccattaaatgttaacataatttttttaaatttatttttaattttcgtgggtacataggtgtgtattatctttggggtacgtgagatgttttgatacaggcaggcaatacataataatcacatggaaaacagggcatccatcccctcaagcatttatcctgtatgctataaacaatccaattatactcttttagttattttaaaatgcataattaaattattattgactgggcgcaggggctcacacctgtaatcccagcactttgggaggctgaggtgggcggatcatgaggtcaggagtttgagaccagcctgagcaacaagctgaaaccccatctctattaaaaatacaaaatttagctgggcgtggtggcaggcacctgtaatcccagctactcaggaggctgaggcaggagaatccattgaaccagggaggcggaggttgcagtgagccaagacagcgccactacactccagcctggacaacagagcgagactttgtctcaaaaaaaaaaaaaaaaattattgactatagtccctctgttgtgctatcaaatactaggtctaattcattcatcctatttttttgtacccattataacctatttcttaatgactaaaaagtttattttccaaacaaacaaaaatgtagtgcagagagtggctttgttttacatttctacaaattgctttaatatctagtttaacagaagttggaatctcatatctgtttctttatttaatctgttagactatgttgttttggttataacaaggctgggcacagcacctcacgcctgtaatcccagcgctttggaaggccaaggccagtgaactgcttgagcccaggagctccagaccagcctgggcaacatgacaaaaccctgttgctacaaaatatataaaacatcagccaggcacgtgagcacaaaaaatggccacaaaaaatcagccggaaacctatttcttcaccatatatatacatatacatacatacatatatgtatatatgttaaagaaaattcagcttcgtatttattggttgaaaaggggaaggatattttaatacccttttcaaactgtgaaagttgttcgacactacatcaactcaacaagtggcagcttttcaaaggttagcagcaatgtagagtcataaactatattaaaatctgttggtctatcctgcaatttaaatggatccttcactcatgcataattttgtaacattatacactggtcatccggaaagcaatgattcattgagttatgtacaccttataaatgctgacacatttcatcatatagtatcatcacatgtcacacagtctgtagaaaattccattgtatacctgggagagaacaatactgaaaaggcaaataacatttcagtattattataaaaatggtcttcacctggttgattctctgaagtgtccccagataatactttgagaacttccaaattatgtggtatctcttactaagtaataggacacaaccatttaaaaaaatgaagatgtcagtattgatgctgaactcctactgatcccaccaaaactaggctcagattgtaccctctaaaaagaattccctcaaaagcattcctactcactctacagctctttaatttctttccttccttccttcccttcattcctttcaattttcttctgtgctcccattgcacctgatacaatgacctgtcacagaacttaccacattctactatgaattgtctgattattcaactatctctcagtagcttgaaaagctatcttaagttagggaatatcttttatttctggaactccagaacctggtatatgcatttagtaggaattagaaaagtttggtgggccagtgcatcaaccgtaaactagacatacctctcccatctgttgttcaataatttgatgtgcaatttcttctatggttgccatgatctacctgccaaaaataaaaagatgttttataattaaactcacaaaacactcttattaaataatttacaaataaaactatatgatatttaagatttgcttcaaaataatctagttaaggtgggagggttggctttttctgaagtttcttttttccattcatgggttgccttttccatgtgtcttttttattttttttttttttaaaacaaggcccacccaggctggagtgtagggggcaccatcacggctcactgcagtctcaacctcctgggctcaagtgatcctcccacctcagcctcctgagtagctggaactacaggtatacaccaccacacctggctaattttttattttttgtacagatggggtctcactgtgttgcccaggctggcctcaaactcctgggctcaagcaatcttcctgtctcgacctcccaagtgttggtattggaattatcagcataagccaccatgcccacccctccatgtatcttttttttttttttttttttgagatggagtcttgctctgtcacccaggttggagtgcagtggcatgatcttggctcactgcaagctccacttcctgggttcatgccattctcctgcctcagcctcccaagtagctgggactaggcacctgccaccacgccagctaatttttttgtatttttagtagagacagggtttcactgtgttagccaggatggccttgatctcctgacctcgtgatctgcctgcctcggcctcccaaagtgctgggattacaggcgtgagccactgcacccggccccagccctccatgtatctttatatgtttatacggtcttccctctgagtgtctgtgtcctcttcatagaaggacatcagttattttggattacggtacactctaatgaactaattttaactcaattatctcttttaaggccttatctccaatatactcaattctgaggtactggtggtcaggacatcaccataggaatttgggattcatatgattttgtgggagaaccgaattcagcccataacactcaggcataaacccaataaggaacatgcaagatctaggtaggcaaataaaactttaaaatgctgcctaaagacaagaaaatctacacttggaccggccccggtggctcacatctgtattcctagcactatgggaggccaaggtgggctgattaccggagatcaggagtttgagactagcctggccaacatggtgaaacgccatctctactaaaaatacaaaattagccaggtgtggtggtacatgcctgtaatcccagctactcaggaggctgaggcagtagaattacttgaacctgggaggcggaggttgcggtgagccgagattgcaccattgcactccagtctgggccacaagagtgaaattctgtctcataaaaaaaaaaaaaaaaattagccaggcatggtggcgggtgcccgtaatcccagctactcaggagactgaggcagaagaatcccataaacttggaaggcagaggctgtggtgagccaagatcgtgccactgcactccagcctgggtgacagagagagactctgtctcaaaagaaaaaaaaagaaaaagaaaaactacatcttaaaaggacacataagaaagaaaatggatccaataagtacctccaaggaaagaaactgcaagtttggaaacaggaatggaagggagacttatttttcattgaataagtgtttgatgcttttaaattttgcttaaatacaaggattaccacaaaaattaaagtaataaacaaataagaaatctcttccagaaatcctaaaatcaacaccagtgtattggtgcattagactcaaagaagtcacctcctaatgaaaacttagggagataaactatttgtttatctgaatgaattccagggactcattagatcaatatatagtcatgtactgcacaatgttttagtcaatgaatgagactgcatatacaatagcggtaccacaagtttacacccataacactgtatttttactacacctcttccacgtttagatttgttacttacataaatactactgtgttaaaactgcctacagtactcactaaagtaacatgctgtgtgggtttgtaaattaagagcaacaggctatgctgtatagcctatgtgtatggtaagttataccatttagttttgtgtaagtatgctctatgatgttcatctgtgataaaatcacttagggatgcttttctcagaacacatccccataacatatgactatattttccaagactaaatttaactccgaagataaggcaacacacacattcctttttttcccccataattttgtgactggatgactgaaaaaaaatgcttttaaacattaatccatccatccatgcatctatgcatccatgcatgcatccatccatccatccaacactcactgctgctactgcatggggattctcaaccttataaaaaaaaagcaactctccctttccctaactacacctttcagttgattgagtccctgatgtcttccaggatctatgcctgaccctgggataggataataaagatggtctctaccctgaagagatgagaaagaagtaggtaagtaatggtgtaagttaaggctgctctgatagcagtgtctgttttcttcccattcttcccaacttcaaataggatccagcctgataaactggccttgagtagccaatacaaaagtaaaatttacaagttttttttgttttttgttttttgtttttttgagacagaatcttgctctgtcacctaggctggagtgcagtggtgcaatctcggctcactacaacctctgcctcccaggttcaagcaattctcctgcctcagcctcccgagtagctgggattacaggcatgcaccaccatgcccaggtactttttgtatttttagtagagaaagggtttcaccatgttggccaggctggtctcgaattcttgatctcaagtgatccgcccacctcagcctcacaaagtgtggggattacaggtatgagccaccacacctagccaacacacacattctttatacactgttggtggaaggttagactgttttaaccttcctagaaaagtaatttgccaatgtataccaagagccttaaaaatgttcatattgactggctcaaaaatttattcaattttcttccattcaacaaatcacttgttgaatgcttactaggggccaggcattcacagaacgacttatccttattctccagcttcagaccatcagtgctgctttaatggcaagggaacaaagttttaaccccttcccttggtattcattcaatatttattatgcattcacaaggtgcctggcactgtgaacaccacaatggagagttcttttataatccgacttccccctattctcatttcctatcactcccaagaggggcctctgttcaggtcaaactacgatgttctttattcccccaacatattcctactttctccctcatttaaattccacctgacttttaagatttggttcaagccaggggcgatggctcacgcctgtaatcccagcactttgggaggccaaggcacgtggatcacctgaggtcaagagtccaagaccagcctggccaacatggtgaaaccccatctctacgaaaaatacaaaaatttagccgggtgtggtggacggcgcctgtgatcccagctatgcaggaggctgaggcaagagaatcgcttgaacctgggaggtggaggctgcagtgagccgagatcgtgccattgcactccagcttgggaaacaagggcaaaactccgtctcaaaaaaaaaaaaaaaaaattttgattcaaatagttttttacccagtctttcttgaagggtcgaacaattattttgtagactaaggttgttagctaggattcagaaatagatttctgttaactcctaatactgtctgtaaaattttatctaaaggtgcatttttctagacaagttcataaaagacttcaagaggctgtagatggtcttgtcactgaaaaacggcaacgaattatatttatactattatttattgtatgctgttttgtttttattccccaagagtagggattatacattgtgtggcagacacacagacggtgtgtgtttggggatgtttgctccctcaaaatccttccttaagatgcggtgcctgtaattccagctactcaacaggctgaggcaggaggatagcttgaggccagagatctgtctggataacaaaatgaggccccccaccatttctataaaacaaaacaaaaaaacctttcctagaagaaactaacatgccccttgaaaaactaagattagcaacatttcataaaacccacttttttttttttttttgagacggagtttcgctcttcttgcccaggctggagtgcaatggcgcgatctcagctcactgcaacctccgcctcccgggttcaagcaattctcctgcctcggcctccggagttgctgggattacaggtgtgcgccaccacgcccgactaattttgtatttttagtagaaacggggtttctccatgttggtcaggctggtctcgaactcccgacttcagatgatccgcccacctcagcctcccaaagtgctgggattacaggtgtgagccaccgcgcccagccgcgacccacttttaatgatagaaatacacatcgctttttcagatatactaactggacttaaagcaaagtttaaaaacaatcatcggccgggcgcggtggctcacgcctgtaatcccagtactttgggaggccgaggcgggtggatcagaggcgggtacatcacgaggtcagagtatcaagaccatcctggccaacatagtgaaaccccacctctactaaaaatacaaaaaacaaaaacaaaaacaaaaacaaaaaaactagctgggtgtggtggctcgtgtctgtaatcccagctactcgggaggctgagacaggagaatcgcttgaacctggaggcggaggttgcagtgagccgagatcgcgccaccgcactccagcttggcgacagtgagactccctctccctctcaaaaaaaaaaaaaaaaaaagaaaaaaaaatcgagtatcaccaaccacacagcagaaatggttcaaaaaagctcaaaatcgaaggtccatttacaaattctagcggtactaaaccctaaaggccgtaattttaggtctttctgcttttgctttccggttacttttttaaaggctgacctacttactgaagattatgggacaacctggcaacattcgtactgcacaaaaatggtatctgcccgagttggaagaattatttcttaacaaaagagctatctatcggaagcttggacatgccccctgcagtgagaaccctggggccgttccatttcttctgaaaagatccaggcccacaggcagcgacgaccctggccagatttgccgtgagagaaaagtgaaagtggggggagtcattctgtccgtcccgtgaaagcacgggagttagtgacgggatgcaggccgggacttgcggccactagccgagggtcggcctctcccacgtctcactcgtgccggcgttagccgtgcgccctggaagccccggcgctgcgcgcggctctcccgggcggggaaagctgcagcgccgcggaagctttccctgcaggttaaaggtcagaggcgctgcggtaagcgcagctggaaagggggttgtgtgctccaagccgctcgccgtccggccccgcgtcccgccgcccctgtcgcccccgcctctcccggggccccgcgcatttggcgccgcagctccgcgctcccagccgaagtcgagcagccccaagcggcgctcccaaactgaacggctccgctggccgcaggacgccggccgggggatgcgctgggaccgcgtccgttggcggttggggtgaagggcaccccctggcccccgcccccgacgcggtcgctggtgtccccacccagcgtttcttaccggcgcttttgcgccctgctgactccggcgtcgggcgccgacgcgacagtcccgcggctgccactcgtggattggggggcgctccgggaagagaggttgaagaaagccgacgggatgtgggatcgagattcacggcggagagagctttctgtgtttgggtatttctggggggtcagagttcgtgacctctttctcggctcggcggcgcgctatcccgccagcgcctgcgcattagcaacggggagaagcggcgagaggaggtcgtgacgttcccagggtggggtggagggatcggagggccgagcagcggctctgtgagtccactgcccccttttggcttggaggcagagtgccccgccagagctacgcgttcccagccaggtaatttttgaagccacgtgcaaaggtttaagcatcgtttgccaaaggtgggcattaggggaggttttgagtcaacgttttagatttgagtaataaataaccctctgggtcttaggcatatctgtttctaatttctggaaaactgggctctggggtagagtccaatcatatttaaacttttttttttttgtattacactttaagttctagagtacatgtacacaacgtgcaggttcgttacatatgtatacatgtgccatgttggtgtgctgcacccattaactcgtcatttacattagtaagctttatatataatgacaagctgaggccgactcatgcaaatggtaaggcaaagtttcacttataaactgttgtgagtaaagagacataatggctaaacagggcaagaatataatcactagagactgggcacggtagctcacgcctgtaatcccagcaagttgggaggccgaggcggacggatcacttgagcccggttgtttgaggccagcctggccaacatggcgaaaacccgtctctacaaaaaaattagccagtcctggtggcgcgtgcctgtcgtcccaattacttggaggctgaggtgggaggatcacctgagtcaagacggcagtgagccaagatcacaccaccgcactccagcctgggtgacacaatgagtctttctctctctctctatatatacacacacacatatatatgtatattccacatcctctctataatatatatattattatatattgaggattatcctcaatggccgttttttgtctgttttgctcagtgatgtattaccaagcacataggacaatgcctgctattcaataatgatgtatgaaatgaaagccaggcaagtggctgctgggaggccaaggaaagatcacttggggccagcagttggagaccggcttgggcaagataacaaaaccctgcctccacaaaaaaaatttttcaaattgtgaaatgaagagacattggtggaacatcgcattctgacagtggccacctgtagtggcaaggtgtggcaggaataactgccctgtgtgcaaagtactctgcgctttagattttgaagcattcttgaaatttctagtttttttttaaatctcctttgttttgtcatgaaatttctattttatctagcttaggtcggcactgtaggaaagcagccacaaactcagggcagaaatccaaggaaggaaaaacaaacgtttgctgggaatgagaacatctctgttatttctctctggaactaggcagacggacagagatcaaggcatgaaacaatccctaacaagtaaaaatatgctttatccctcattaaaaatccacctctgctgagcacagtggcttctgcccccagagccttgggaggctgaggtaggaggcttgcttgatgccaggagtttgagaccagcctgggcaacatagtgagactccatctcttaaaaaaaaaagaaaaaaaaaaggcatggtggtgcaggcctgtattcctagttactgaggaggctgaggtgggaggattgcttaagcccaggagtctggtccagtgttggcaccattgcattccagcctgggcgagagtgaaacttttttttttttccaacctctaccttttagcattatttgttgtgtatttggtttggttttaagggagacccctgccaataccataagctggtcccaaaggtgaaaattatgaaagtatagtcacgtcagggatatgttctgagaaatgagtccttaggcaatttcattttactctcatcatagagcgtacttatacaaacctagatggtctagcctagacacacctaggctgtatgttgtagtctgttgctcttaagtcacaaacctaggacaaacccgtacagcatgttactgaatactgtaggcagttgtaacataatggtaggtatttgtgtatctaaatatatataaacatagaaaaagtaaactaagtccttttaaaaaaaaagtgcagtaaaaataggggattataatcttatgcaaccattattgtatatgtggtctgtccttgactgaaatattgttatgcagtgcatgactgcactataggcctaatggatacaggcaatctgagacctcttcactattcttggtggagaatatgtatgcctatagtgatgcttgtggttaccccttatcacccaattaattcacttaagtcacaataagttgacttgttaaaacttggaagtagaagccattttaggaacatcatttgtaggtgaagaagcgtttccattaattatgcttcaggaaaagaggtaaatgaagtttatttatttttgagacagagtctcactctgttgcccaggctggagtgcagtggcttgatctcagctcactgcaacctccgccacctgggttcaagaggttcttgtgcctcagcctcccgagtagctgggattacaggcgcacaccacaatgtctggctaagctttttgtatttttagtagagacagggtttcaccatgttggccaggctggtctcgaactcctcacctcaagtgatccgctcgccttggcctccccaaagtgctgggattacaggcatgagccaccgtgcccagccgaagttcatctttaaatgtgtgactctagccgaagttcatctttaaatctatgatgctggccaggctcagtagctcacgcctgtaatcctagcacttggggaggttgaggcgggtggatcacctgaggtcagagtttgagaccagcctggccaacatggtgaaatcccgtctctactaaaaatacaaaaaattagccgggcatggtggtgcgcacctgtcatcccagctcctcaggaggctgaggcaggagaattgcttgaacccaggaagtgaagattgcaatgagccgagatcgcgccactgcactccagcctgggcgacagagcaagactctgtcttgagggggaaaaaaatcacaccaacaaaatatattatagtaaatttattttgtataaatacatattaacattatttacaatgctaatttttttatttataaagtatatatggacaaaaagatacaaactgttatcattttaagtacaaagtatttctagaaatacattataagccattaaaaaaaaaacgatatttcaagattggttcttacatgctatgaccaactcatatgaaagagcaagttgctcccccttcattccttcccccaactccaaagggaaaggaatttgatatttaggctttaaaaaatttcctactacctttatcttttaaaaaaccctactcaaaacaactatctcttataagggaaaatatcatagataagattttcctttagaaaatgacattaaaagtggcatgagccctagaatgatatgtgtattagaggcacttaaaaaaaatcagaagggatccataggaaggaatttaattcagcaaatactgagtgtccactgcatgcaaggtaccctgccagaaatctcaaatgagtaagttgtccttagggatagaaggtgctaagcatcatgcaaaagatatgaactgaaggctgtgtcggggctgcaggaaggagacaggatctagtctggaggaataggggagagaaagactaagggtcagctatcacagagaagtcttggataaacagagatgcggatgggtcaatgaggaaggaaaaggaaactgtgtgaacaaagaaaggttgggtaagagttagctggaatgtatggcaactgaggacgtgttccatgccaagtcactgggaaagccactgaggcatgtaaaagtggggatgaaactagattagagctatgttgttggaagactgctctggccgtgtttaaaatgggatcacacaacggcattggaattagaagttattgcaataatgggaacaagtaacaaggacttgaaccagggcctatgtaataacagcagggcaatgaggatggaaaggatacttgagtaattgcagagtcttgttgagagttagaggcagattctggagtctcaaatggtatctttctcttacagaagaaaataaacagatttgaatgggaaggaagttgagttttattcatgtaaagtctgagatgcttgaggactcatatagatagccaataggtagttacagatgtagctttgcaggatagtggagaaagtaggtctaaggtccaggttataatgtggatattttcaggctgtgttggagttgtagatgacaagaatcctgttttcaattgaacaaatattttctctttaaagaccctcctaggaagccaggcctggtggtgcatgcccctgtagtcccagctactccagaggctgaggtgggaggattgcttaagcccaggcatttgagttcagcatgggaaacatagcgagacccggtctcttaaaaactaaaaagacctagggcagtattatggaagacagtgatatattaagtacagtatctgccttcaaggagtgtgtggtacactaagaaaaacaatatgtatctctggaaatcccattgactacatttgactaaagtggatttcaaacttttcaaaagctgagcacaatggaagcacactccaaaacataccaacatatgctgtgatataacatttacattttaactaaattaccaaataggagactttccccacatctagatatattctatgaaccaaatataaaatacacatttggctgacaattatactttaaaactgtcgccttctctttgttgtgtcattacagctttcatgtgaatcaagggttggtctgatgatctcattttaagaaatgctactacacactcaaagaatcaagaatcttgggcaaccaaaatacaatagggggatgctgggtacattacagaaaaagggaaaagagattggaaagagtcggaaatgtggatgatgccagagataattactctcattttcttaggactctgatgggtcctgtacatttatagctgccacagataaaggtggactgctagttggggacactaacaatgccagccttcccctggttcagcctggcgtctcatctacgttatgcttagcatcatttttagcttagctttataaatgccctactctttcctccttatgaattaaaaggagatacctgaaaaagggtttgatggaagcacaggcacacatatctgtataataaatatagtatccttggaatctagatactacttaacttttctccccatttatagactgtgcccaatatcatttttcctctaaaatactagcaaaatatatttttatagctttttttacaataaattgcatataattaggttcttagttgacaatgaatgagccaggttacataaataacaattggtcagctttagtaagttatgaaggactcataaaggggcaggggaatgtaatactattccacatttaaaacatctttttgggagaaggataattggatagcttccacaaagactacacatttttctaaaccctccatggggctaagccaataggtaatacagtcacatgcattttacatgtaattaaagagactgtaagtttgtgccagatttcttccctctctcactctctttagatttagaactggctcatgattcagccaggtcttagaagatagaatagcctggctgatattttttagattataaggcttaagccaaaccttgtagtcagaaggctgagagctcaagaggagggaaagaaaacccaaataacttgtcttgctaaatgccagacgcagaaacagtttataaggtacaactttagcctccaaaaaggaatacactaaaaactgcaacgattctaacatggaagccttatttatgtgatcttgattatataaaattgagctacaaagaaattttagtgtacctgctatgacagaaaggggatggcatgttaggattgtgtatgaggttcaaatgactccatggcaaaaaatcgccacaaaaaactatagcagccaactctagatctagtagggactctggtgctgtaccaaacagcattcaaaaggccccagaaaggcactcagtaatcctcatggttgctgttaaggatcacactgaattaggaaatcctttatttagaggcagaaaggaaaattcttgtaccctttaaagaaatattatatggataaccttgctgttcaattttttttttttttttttttttgagatggagtctcgctctgtcatcccaggctggagtgcagtggcaccatctcggctcactgcaacctctgcctcctgggttcaagcgatgctcctgcctcagcctgctgaatagctaggactacagccatgtaccaccacgaccggctaattcttgtatttttaatagagatggggtttcaccatattggccaggctggtctcgatctcctgacctcaggtggtccaacggcctcggcctcccaaaatgctgagattgtaggtgtgagccaccgctcatggcagttaagataatttatagtttaaacttagttaataaattgtgtattgtgaacatcagggatggcttttatcacagtgttatttcattttcttctgctaatcaacaattgtatgtgcaaggtagttcatatgttaaacagtaagtgcaccagaattatgaatctaaatctttcctaaggaggtgtgctgatagctgcttatagagaaaggatttgttgtttttttttttaattaggagggaggatatcacaaactggcagaaaaagaccttttgaaaatgaatactatagaatttcagttattactggcttataattatgcttttctgatatagtaattccagttccatttgtaatgcacaatatttttggaaatgtaacattacttatagatacaaatatcatcattgacttgggctcagaactcttataatagcagggaatattatgtgacataatgcttgctatattttgctattttaaaaaatgatacatttatgtttgtttcgaagtggtagattttttaaaagattggacttaaaagccggaagagttggttatttgtggtattctgcaaataaaaacatcttcattcctactcacagttttaaaaaattcagattctatctctttgctataattctttgatgatgtaatattaactcctgccaaagaggtacctaacaacagaaatactttagataatttactgaaatttcagttcacagttactgaggtagaagctggccatgtttttccactaaaagatacaaatattcacccaagtttattgattcaaagacatgcatttttttcatcagcagttttataataatcacaattcctaaaccaagcactttgtggaaatttgctccttgctatgtgttttttccttacaaagactttccaccagtaagattgttacaatgtaaggtaagaaaacagtgtgaactatgtcacgaatagttaatacagtatacagtattaagatagtttttctggtctctaaagaaatggtactttagaattcagtgtgtctcagaaataattctgaccattaagtaaacatcaaaattttaataaataacataaatgaaaaaacaaacaccttttaaaaattgcttatacctaacaaaacaatttctttgatgaagggtctggttggctttatcttggcagtgttcatttttatacaatttttgaattgcatttactccattctgatgaaattccacctctttggaatcacagaagagatgaaaccaatactgctacaatattgtgccttcctgaaatgcttctatccacctattgataagagaaatcggttagatttgtaaaacctaatcatctgacgtgtgaacaccatatagatgacagctgggcctgtggtcctcattaccataacaacataggtaagatatatatatatatgtattttttttttttttttgagacagagttttgctctcgttgctcaggctggagtgcaatagtgctatctcggctcaccacaatctctgcttcctgggttcaagcgattcctcccaagtagctcgaattacaggcatgtgccaccacacctggctaattttgtatttttagtagagacggggtttttccatgttggtcaggctggtcttggactcccgacctcatgtgatcggcctgcctcggcctcccaaagtgttgggattacaggcgtgagccaccgtgaccggccagtaagatcttttcttgcagcaaattggccttctgcatacatggaactaccctttatttggtaatttggtccaaaatttagcctggaaagtgtgcctctcatttctgataggcataaggaagggaccatttcatgtataaaggttctatgaagtcttgatgctaccaattaatttattttggaagttgatatttcagtgaaggctttattacaacttcttttttatctggaatttggactcagtgcttttaggaacactagttccctgtctcctcctaccttaactctagctatcagagtttccttgtatatcccctaatccagacctgtttcaagatttgcaattaaaaggaatctggcatctagtgttgatcaaaagtttgcatgctgtatgagagcttctcggctgggcgccgtggctcatgcctgtaatcccagtactttgggaggctgagttgggcagatcacctgaggtcagaagttcgagaccagcctggccaatatggtgaaaccctgtctctactaaaatacaaaaattagctgggcgtggtggtgtgcgcctgtaatcccagctacttgggaggctgaggcaggagaattgcttgaacccaggaggcagaggttgcagtgagctgagactgcgccactgaactccagcctgggcaacagagcgagactgtctcaaaaaaaaaaaaaaaaaaagagcttctcaaagtttcacagacatctttccaaaattctttagtctcaaagttttatctgacaatatacacagctgcaattattcagaagatacttgagagtagtctttttcctccctactaatgtaattgcttctgaactttttcttctttcttatggaaatatcatttcttacggtattattttatgtaggctgggcatggtggctcacacctgtaattccagcactttgagaggctgagataggtggactgcttgagcccaggagtttcagaccagcctgggcaacattgctagactctgtctccattaaaaaaaaaaaaaaaaaaaaaaaaaaaaatatatatatatatatatacacacacatacacacacacacacacacacacagaagagagtccagagaactatgaacacttgaaatcactcagtttaattattttgtaaaagcaacctataacagattcagttcaaattttaaggaattttcaaaaatttaatattgaacataaatagcatgttatactgccatagcaaggcttttttcccactaaaattaatacattttaatattctgtcatgtacttcaaaaagcaatccatatgatattaataaagagaaatttataatttagcctgggtcaattctaaattataagtaaactgacttcctttacctaactacatgtaattctgtcttggtggcatttctatcttgtcaactcaatgatataagcaaaagatgacatatattgaaaagcagtactttttttcagtttgatgaaaattgtaagaaagctaatatctgacaatattagggcaattactattttgtctaaataatttttatagaaaagatggttaagtgacataatttaaaaatattctccagtagccaaaggaaaatatttggaagaatagctatatactgttggatatcctaaaatagactgaaaaaagagtcttacagagtgtgtgtaacattgtgcctggctggtattcagggatgtgtgcaattctggtacattaatcttaactgtcttaagaaactaaaagctttgctcactcaaagcattcttttttattttcatgcacttttaagcttgtggagaacacatgaacacctcttcctgaaaacaaaaatgtattcttttgtgaagccaaggtaaaaatcaaatgagagatgatgaactattttgttcaaaagagacctaatttcacagaggtagatacgcatctctatgttaagcaaactgataacatctaagtaaagattcttgctggaattctgaggagactgtttcagcctttgccatctaaactgatagccatttccttctactcagtcactggaacagcatgggagtctcttaatgtgtttgaccttttccccaaagaagttagcgagcagctgtttaaactcctgctgttccatggcacaaatgaatcgctggattgccaaagtcctggaatgtttcaagggaagattcttaccctcatagaaggagaggtcaaatgccttagctttccttcctttcagcagagcagcatcacgctgcttcctctgagatcacgtgtagataaaatactttgtataggactacctattttcttttcccctctgcctcctgaaaatattccagatacccctgccttgtctttaaaacaattctgaagagtttaaataatacgttaaatctttctaattaaaatctctgatgtaaattttgagttgtccccatgccttaaagtaggtcattttacaagcaaccattaaaaaactgaaatctcatgaataaaagaaaaatatggccagattacttacttctgagccgaatgagcatcctctgctttgaatacataaaataacatgtttttgtgcagtaactgaaatactttagactcggaattctcatctttaacttgaataacagtgaatcctaataaaggctgactctccaaagcggccacgtcctaatttaaaaacatacaaatggagaaaagtttttagattgagacaaaattcagatttgaaaactcttgatctacatagctctaatttaatttcaattattcacatataaggtaatgataattctaacaacttactcacttctcatttattcaataatattcattgagccactccctccctaggtaccctatatgccaggcactgtggcacacaatttctggcatgttcacatctactgaatttcacaacatcctcactaaaccaaggaaggcacgtgattatattactttcattttatggatgcagaaaacagctcagaaaggtaagctattcacctggatctcactaaggaaaagtgtggaccctacagcagtgttttcataggatggtggaacacagggtgatcaggtaggagaaaaggacagaattagagtaaactgctagaattgtttataatccaaaaaagcctatcttatctatgctgctgtcagatcaatgcaatctaacgatgacagtaaagggagtatcactcaagagagcttggcagaaagaaacacagctctgcctttttttttttttttttttttgagacagagtctctctgttgcccaggctggagtgcagtggcacgatctcagctcactgcaacctctgcctcccgggttcaagcaattctcctgcttcaccctcccaagtgtctgggattacaggcactccactaatatttgtattcttagtagagacggggtttcgccatgttggccaggctagtctcgaactcctgacctcaggtgatccacccccactcagcctcccaaagtgctgggattacaggtgtgagccagtgcacctgggggcagctctgcctttagtaaagtaattagtagtcacacgacacacacaaaaattgcattttaataatatggaaaattcctaacacatttgagaaagagctctccaggtacaaagcaagaacactgttcacattaaaaataacagcaacaacacctcccccatccaaaagcaaagcaaaaaatcttatgtaaaataaatggatttttaaaatattgtaattacttgcagttggcattacaaaaccccaaattactcatctttagatttcagatcttacctcacttgcagcatatgtatatagtactttattttttatgacaaaccaaaagtgtttccagggttttttattgccctttgatctgtacaagtagccactcatagaagaatcctctgtgtttgctgatacctagataagaaaccccatacaaagtttaatggttttcagacaaattataacagcaaaattatttgcaaccaataggtgctgaaagcaataactgtaatgatagaatgtttcagaatgaaatatattttcaaagtgctactatacaaattgaactctgctattaacatgagcacaaaaaagaagacaaccatgttagaggcaattatagaattttacttggtttaactgtgcctgcacgtgtttgcgtatgtttcttggtgggttcatctgtgttttctgggttggcaggtgaagaaaaatagttccagaagactaaaatgcttttctaaaagctggatttggggacttggggatttgttttttattgctcttattttggggcatcagggaaaattatttgaacctttaattctgttcctaaaaaactttttggacttctaaaaaccatacaaacagaataataaacagaaaattctactattaaggaagctcattttaagaatcaatctttgcttcccaaattatagtaagaaagaaaagaggctaatttttacttcataaaaagttgaaaatgttttcatctctatgcaaaaagacagtaagcttttactgattgattttttttttctttttttttttttttttttttgagactgagtcttgctctgtcacccaggctggagtgcagtggcccgatctcagctcactgcaagctccacctcccaggttcacgccattctcctgcctcagcctcccgagtagctgggactacaggcgcctgccaccacgtccggctattttttttttttgtatatttttagtagagatggggtttcatcatgttagccaggatggtctccatctcccgaccttgtgatccacccgccttggcctcccaaagtgctgggattacaggcgtgagccaccacaccggcctttttttttttttttttttttttaagacagtctcactctgtcacccaggctggagtgcagtggcacaatctcagctcgctgcaacctctgcctcttgggtccaagcacttctcgtgccccagcctcccgagtagctgggattacaggcgtgcaccaccatgtccagctaatttttgtatttttagtcgagacagggtttcgccatgttggccaggttggtgttgatttgcctgccttggcctcccaaagtgctgggattacaggtatgagctatcgtgcctggcctattgactctaataatggttattaaaagctgtgttcttaaaaatgtaggagtagataaataacaaaatgtttaggatctaccttagtaatggtatggcaggcacacgcttaaggtggcttcccatgacccttgctgtagagagtcacactgctgtacattctcctccccctgagtgtggacaggacctacgacttgcttctaactaagaatttggtgagggtgataggatgtcactcccatgatcaagctaccttatatatggccctgtcttgttaggagacactctagaaactttcttccttgctggctttgaacaaagtagcaatgttgagaggtccacatggcaaggagctgaggacctccagccaaaagctagtaagaaggcaaggcccccagtcttgcaagtacaaggaaatgaattcccagatgagcctctagatgagaactcagtacttgccaaaactttgattatagccctgcagagtcccagctaacccatgcctggactctggagataataaatgtatgttgttttaagctgctaagtttgtggtaatttattatgcagaaatggaaaactaatacacatgcgctctgtgaatttttaaagtgtatctttaattatattaatttcttataaatttcatgaaaataattatatattgtttagtgggaaatttaagatctaacattaaattagaaatatttgttaagcaacagtaggtttatataaatacatccttataaagactaccaagtaattttttaaaaaactagaattgtttcctatctcagtgaaaaaaaagaggaaaaaaatccaactagaatgtttaacattcaaatgagattttgcttaaaatatagttacattggaatcctactatattcttatctaagttgttattaatgttgctcaaaatatattacatttctcctttataccaatttaggaccagtttagtagccacacaagaagatcaaccataatactgaatagccatgactagacctatattttcaaagataaaactggtgttcaccaacttaatcacctaactgatccacaaaacatgtcttccaatgatttgattatttacaaaataaatcagggttgtgggggtgagggactataaaactacattttgggtacactgtatactgctcaggtgatgggtgcactaaaatcttagactttaccattatacaactcatccatgtaaccaaaacccacaggtaccccagaagcaatgaaaattaaaaaaaaataatccaactccaactcaaaagctgtagtctgccattactgagagtactgaggctctaaatgtaattctaaaaagaggagtttctaaaaatattttaaacattactagaataagaacacaacttcccagttcctcaaaaagttaaacatagaattaccatatgagcaagcaattctacttctgggtataaacccaagataaatgaaaacatatgtccacacagaaatttgcacatgaatatttctgtcagcataattcgtaatagccaaaaggtggaaacaacccaatattcaacaagagatgggtggataaactgtggtatacacaaacaatgaaatattattcagacataacaagaaacgaagtatggatacgtgctgtaatttccatgaacctctaaaacactgtgtttcaactgggaatatactcgtaactttacataagaaacatgatcttgatcaaatttttagagttctttccttccactatgtatgctagaacacctcctcagtaaaaaagcaagagaaccaaattaaaaactactctgctggccacaaaactagcacaggcggacctcactaataaactgatcataacggagtagccaaaatggcaatgctgtttgttctttgacatctaaatttgaggaaatgggataggatatcaacaaagtctgtggattacaccattagcaggtctaagcatacaggctattatcactatttaaagttttcttttaaaggaagtttaaaggaaagacaacctactatcagtgatatcagctgtgcataaccaaccaatgcctacaaataaaccgtgcagatcactaaatgctaacaaaatgcccaaaatatcctgtggacttcttccctctggcaaggatcttgctcaaagtcattttaaaaaattcatgtgtgtccaacttatctttactttctatcactgctattaaatgttctctaaacctttcaatagccattttctaaatgacttaggtcagacgggagaccaagcaagattgtgaggcatcagccacatccatcatcagtattaaaattcatgacttaatagttgtgggaaatgacatcttcctttatgaaagaaaaacggtgtattatatgcatatgaataattcagcctctatcacattgcaaatttaatggaaacacttacttctttgagagcagctgggatttttttctgtttcctccctgatggaatgctatgtaagactgatgataaggcacttgaaggagatttgtgatttccaggagatccaatcctaggggagtgctggtgatctagaacaaatcaggcatgcttatgtaggcaatgctcagcattttgcaattcaatttcattcaaatccataaacactgttgcataaaatatccatggaaggacactaagaaacaacattgataactcctggaaaaggacaatggatggctgggagttgagtggcaggaagactttctactatctatggttttatactttttgaactttatgtgaaaggattactcttgtgtgcctttagaattatgaaacacgtgactatactaccaacttaaaaaaaatccaaaaaaccttccctactgccgtaaaccccaaagaaccctggtattgttaagtgtctagatactagaccagctacaatgaacaaagcagcttaaaaaagggggctatcggacacggatgaagaagtaatgaattctgattgcagagggttcagggaaagctgagaagataataagataaaagctggccatgatggagtaagtaggaatttgccaggttaaaacaagcaggaggaacactgtgcgctaagaggtcagcatgagcaaaggcagagaggtatgaaattaaatcatctatctggagaataatgaggccagattaaaaaaaaggggctggtttgaagcaaactggactgttgtttatatgttttaggctggggagtgacatgagcagattaaatttggaaaaatagattatatctggcagtactaaggagaaaggactaacagcaagaaaacttgttaggaaattattatagttgtctagatgagagataacgaaggccttattagggctgggatggagaaatcaagacaaagatttttgatgataaaattgacaagagttactgaccaaatgggtataggtgatgaggaaggagaattcaaagacgaattttgaatgtttgcagcttataccatatacccagactaaagagaggaacataaaggaagagatggatgggtcttcttggaaaatgtacacaaataataataaattattcatctagaaatatgtggactctgaaataccatgtcatccacttagaaattcctccttgctaatgaaaagctatccttcagggaaatgaagaacagactttcaaaaatttagatcctggccaggcgtggtgccttatgcctgtaatcccagcactttgggaggctgaggcgggtggatcatttgaggtcaggggttcgagaccagcttggccaacatggtgagaccgccccgcgtctctactaaaatacaaaaattagcctggcgtggtcacgcgtgcccgtaatcccagctactcaggaggctgaggtacgagaatcgcttgaacccgagaggcagaggttgcatattgtgtcactgcactccagcttgggcaacagtgcaagaccccatctcaaaaaatatatataaataaaatttagatcctacaggtttcaggaatttaactaaaaatctcttcccaaaacatagacctgagcagtcctgctaagctgcattcattttactggaggatacctgcaaataatgagcagggaaataggaagtatcatttttgtgttcggtcaaaaagctgcacattcagatgtacattaacatctcactaaatcagattaactgactagaattaagctaacgaagtgccacctaagtaaagagaattactttacatatagataaaatgatttgtaatgagcacactatcatgtgaaactatagacttcaaaattacttgaaagttaaagttcccttttactgttttaagtgttttaccctgtaattacatttctacagttttcttagcaaaaccttttacacagactgaaaccaaatttcagcccaacctctcccagaattacaacaaaatatgaattaagaaagcttactacaaatttggagataagtatcaacaatcatattgctaatgtaccgaaggtgtttctctcagaaggttgtttgaaagcatctggggaataaaggaatttttggttaaatccttacttatatattacctaatttctgcagttcttggaaacaatgttcacatactcttgctggttgatttttcaggtaatctaagccatacttattagacgaacaagcttggcatacaatctgaaaacacattggaattatgtcattaatttcattagaataacttgtgtttctacaccataaagtatgttacaatttacagtgctatccacttttcaaaacagtttcagagtcactgagtctcacttcgtctcaataataactctggagttcaggcatatagtgaactaatgcatagtaccacacttgaaagatgaaggggccacagatgattacttacagagggctgactacataaaataataaagtaaagcagttaatatatgcaaaatgcttagaaccgtacctggcatgcaaaaaggcctgtgaggtatactgatcaccagcactgtcatcatcataatcactgctgcagcaacgaccacgtctctgcaactctaccaagtttttgggctccatactaaatgctctctaaatacaacctcatttaatttttagagtgactctctgatgtcactgtttctacacccattttactaatgagatcatgaaggcttagaaacatcactagagataacttcaacactgaacattccccgtactgaatactatggatacttagtactagagagatgcagtttaaataatagctgtaaatgtgagggcctgtttaattgtggatttgttagattttgtttttgaatcagttattactgatgttctaatgtaactctgaagtaggagggtggaagttcactaagaagattgcccctgccccctaaatatttagagaaaacaccattcatgtttgctaccattaacataataataataatagttattgttattcttgaactataatggtttatgaggggaaatatgcttcctcactatgtacagcctggagacagtaaagaccacaatggagatgggtgttatcatcgccaacctttccacaggcccggcagtggtgtcgtctccaggtgagagtgaattcgcttgtgcagatcatacacattgtggctctggtatcaggaatccagatgggagccttcgatccaagaggactaacttcttctttattttctgagtctgcctgtggaagaagaacaacttctgattatctccatgcacactgcctgcctttttattcggcagtggcatctcacactaccaagatggggatgagggtcaggcacagcagctcacgcctgtaatcccagcattttgggaggccgagtcgagtggatcacatgaggtacggagtttgcgaccagcctggccaacacagtgaaaccctgtttctactaaaaatacaaaaattagccgggtgtggtggcgggtgcctgtgatcccagctactcaggaggctgaggcaggagaattacttgaacctgggaggtggaggttgcaatgagctgagattgtcccactgcactccagcctgggcaacagagtgggactccgtctcaaaaaacaaacaaacaaaaaagatggggataaaatatgggccattggctgggcatggtggctcacgcctgtagtcccagcactttgagaggccaaggtgggcagatcacaaggtcaggagatgaagaccatcctggtcaacatggtgaaaacctgtctctactaaaaatacaaaaattgccaggcgcggtggctcacgcctgtaataccagcactttgggaggccgaggcgggtggatcacctaagattgggagttcaagaccagcctgaccaacatggagaaaccctgtctctactaaaaataacgacaattagcatggtggcgcatgcctgtaatcccagctactcaggagactgaagcaggagaattgcttgaacctgggaggcggaggttgtggtgagccgagattgtgccattgcactctagcctgggcaataagagcaaaactctgtctcaaaaaaaaaaaaaaatacaaaaattagctggtcatggtggcacgtgcctgtagtcccagctacttgggaggctgaggcaggagaatcacttaaatctgggaggcagaggttgcagtgagccgagattgcaccactgcactccagcctggcgacagagcaatactccatctcaacaaaaaaaaaaaagaaatatgggctattggccaggcacagtggctcatgcctgtaatctcagcactttggaaggccgaggcaggcggaaaaccagaggtcaggagtttgagacctgcttggccaacatggtgaaaccccatctgtactaaaaatacaaaattagctgggcgtggtggtgcatgcctgtaatcccagctgctagggaggctgaggcaggagaaccacttgaacccaggaggcagaggttgcagtgagctgagtttgcgccattgcactccagcctgggcaataagagtgaaattctgtctcaaaaaaaaaaaagaaagaaaaagaaaagaaatatgggctattatatttttcacgtgctcggaatactaagtttagctacaatctaaaaattttctaatacaaaattaacttaaaaagacgcctgtggtagtgggatggcagctgattagtttctgccttaaactgtttcgtattttctaaatttcctacaatgaagttttatagctgggaagaaacatgaatatgctatatgctatcacagacttgcagtgagacaacaataggaggataaacttttagcgctgaaatgagacattaatctgtagagtaactctctgatgtccagtccaatcattttctgaaacacatgttgctttcttaaacccctgtgaaatgtttaaggtaaaaactttgaaatgcactggaaaaaaaaaaaaaaggagaaaacaatacctcatcaagactcctactaggacagaaggtgattcttttcttggcatactcttctattgccctggaaatcgcttctagccattcatccctttctgtggcagaactgttgggggcaaaaggtttcatcaaccagatgtcagtttttgttcttttcctttttcttcttttctttctcccatggcaacagatcccaccaccctccaacaataccagtcaaaaaagtagcaactcctcagagttgaggcaggtttagtgaacagatcatcagaacagacaacagagaacccgtgatggcattttagcaaatacaatgcttattttttctttccaaaagttctgctttatattaaatagcttttgaactctcctaaacttgaaaatatttttggtttggtttaaaggataattgtacaattaataattatgattatttatatagccagggagtttcttaagacatcatcctagaatttaaaaacattccaataagtcaagtttcaaattccaatttatagcatagaatactaaatatctttagattactaaggattactaaaattttctaggaagggcactggggtgaagggaacatatttttttgtattagaaagcagatgttgacaatgaggttcacacggtaaaggctgcagtttttgttagggcttctctacctatttcacccaccaagttctctgtccctacccagctcatcaggaggtatctttaattcagcgctagatgggaatgggccaaataggggcaaacttggtcagacaagggtattttttttttctgtttttccaaccatgcctttttcccaaaaccatgttaactccaaatcattactggtatcagcatacttatgaaaccactgtttaaattttgttttgtatatttaaaactgagaggcacatgttaggtattataaataaaaataaatatataaatctatacatacacagtacagaaagagcagaaaagaggaagggagagggaatgagagaaagaaagactttaataaataattaaaactccatcataataaaacaaaattcatcagaatgggattgtgactgtgttaaaaaaaaaagtctgtagtttaatttacagaggcattttgaggtatacagaagtaaaatcggccaggcgtggtggctcacgcctgtaatcccaacactttgggaggctaaggcgggtggatcatttgagctcaggagttcgagaccagcatggccaacatggtgaaaccctgtctctactaaaaatacaaaagttagccgggtgtggtggtgcatgcctgtaatcccagctactcagggggctgaggcaggagaattgcttgaaccaaggaggtggaggttgtagtgagccgagacagtgccactgcactccagcctgggtgacagagcaacacactgtctccaaaaaaaaaaaaagcagaagtaaaatgacctgatatctgcaatttgttttaaaatagaaaattatgaaacaggaaaatcagtggcaaaatcttgatgattatttttagtttgggtgcctgaatatacagtttctggtattatttgccctaactttaagtatatttgaactcttaaagagtgtttctaaaataaaaaattccaccattaataatggtacatatagacatatgttgctgtattttagagaacccaggtcagatcaagaatagaaaccactcaccttccctacaatcatcattctcagaaagcgcctccctaatccatggcttgagtgccatttagaatgttcattcatgtggattaaaaaaggtagagatccactttacaaataaaattttaaatcaaattaatttctcaaattttcattacatacaaagaacagcaaaaaagaaataatctctttctctctaaaccaaacaaaaccctgccttatttaccgctactattctagcattactgccaaaacaagatgccatttaacagttactacgtcagccaactctgctaaatgcttagcaaatgtcaccatgtctcaccctcagagcttccccatggaatacacattggatcttacaccccttgcccccaactacaacatcatcacccaccttcaccatttacaggtaaggaaactgagaattagtaatgtttgataatttgctttatagacaacagactaagtgatgagctgttattaaacccaagtgtagttaaggactggacctctcaccaccaggtcattgctagcctctgctcatgttctctgcagaactacatgatgagaatacatgctcagggttccaagcaaacattcataaaacattaccatctctccctccctccccggctcctcaccagaagagtaacagaaagcagagaggcagatggtaaatttgagaattgctgttggattcttctggagcccggggagcatgtggaatgtgattcaactgtgtaaatcatgtcacatatgctgttctttcatttaatcattcctggctctctcctgtgtggggttctgccaagacaatgtttaccagctcttgataacacatttctcacagaccacacacatttgcccgcagcatccagtggagatattctagtctccttttgtaacatgattagcagaagaatcagcatcttcttcaaactgaaaaactgttaagtcaagtattattttctttatagaatgtgtatagtacaagaaagcaaatttgtgtcaagtaagtaccactttcccaatgactgggatgaattgccaagggttaaaaacctggccgggcgtggtggctcatgcccgtaatcccagcactttgggaggccgaggagggtggatcacctgacgtcaggagttcgagaccagcctggccaacatgtgaaaaccctgtctctactaaaaatacaaaaattagccaggcatggcggtgcgcacctgtagtcattgctactcaggaggctgaggcaggagaatcacctgaacctgggaggtggtggttgcagtgagctgagattgtgccactgcactccagcctgggcaacaagtgagactctgtctcaaaaaaaaaaaaaaaaaaaaaaaaagaccatgccacaccatttactacatggactaactgcaggatgcttctctgaggttcaaaggccacatcactttgatttgtgagtaacgctgtgagtaacattcactgggagcctactaagccaggacctaagccaagaactgggcacacaaaatatacctcacttgtaaggatgcacactgaattgaggtgaaacatgtattaacatatgatatgacaaatgtagataaataacatagaagtagtaaattaccttatgtaagtagcagggatggctctgcaaaggtgatgacaaagttaggacttaaagagttacaggagtttggcagggaactctctgtgtaccctcattcagtctgccagccgtggtcatctctaagctaatggtgcccaaatatatgtctctggcccctacttccctctgaaatccagatccttacagaaactgccccttgatggctgcatttggatgttgcatatgcacctcacattccatatgcacacctgaaactcaactcccaatttctcccctaaagctgttcctctcccagtgctccctgtcacagtgcatggcaccatctcccaattcatagtatatgctggagtctcctctgaagaactcctcttataccctgtgtccaatcagtcccctcctttaggccacctcccaaaccagattccatgcagcagccggatactctttaaaaaatgccaatctgatcacatcattcccttgtataagcctttcagcggtttcctgtggctcttaggctaaagaccaaatcccacaagatggttctgcaccatctaagtcacctgtccctccaggcttatcctgggtcattctcttcctcattcttgagctcgtgccacactgaccttccaattctctgaatatgtcatgccccttctcacctaaggacctttgtacacagtgctcctaatgaccaggaggctcttcctttttcctctttgcccctctgactcctacttatctttcctaagtcaatataaacagcagggtttgtaggaaagaggctgccctctctcccccattgcagtttaaggtcctttgctttacagcctcctagcccctggtactttttctgtgcaccatttaatcaccacaatacttaattgtgttaatatttgctaagtgcgtgtcctcctccatggaatgtcagctcagtgaaggaagggcccttttaattttttttttttttttttttgagacggagtctcgctctgttgcctaggttggagtgtagtggtgcgatctcggctcactgtaacttctgcctcccaagttcaagcaattctcctgcctcagcctccagagtagctgggattacaggcgtgtgccactatgcccagctaatttttatattttaatgtaaaatattaaacggggtttcaccatgttggccaggctggtcttgaactcctgaccttaagtggtccgcctgccttggcctctgaaagtgttgggattataggcgtgagccactgcacctgacttgacccttttaatttttaatccactgtgtcccgatgcgcagcacaatgcctggcccaaggtagaggctccatattccttactgaacgaagggatgaactgcaggtggaggtaacacctgtggaaggcagatggctgtggagttgtctggcatgcatggagtcacacgcagatccgtgctgatggagcatgcagtgtgttggtgggaagagatggagagactccttacccactttaatatgggatgcagtacctgcctaactggttggaggaatctggaaggagagcatggcataccgatgacattcaatatgccttagctctctttccctcatgccagcttgatcctcccttggaaatttatttttcctttatcaagaacttttcagttcaatgatttcccctgcagagcccacattcagcccattagtaatcctattgggtttttttctgattcataccattgttcatcactttaacccaagacacaccatcatctgctgggcactcactacctggctgcccaacttctactgtagtctcctgatggtctgtcttctacaaagaagccggtgtgatctttcacaaacataaattagatattatcacttagctgaaaactcttaaaaattcaatgaccttactatgggtggcccctaactcttgcccctaaactgtaactcacatttaatctcccctggtactaggggagtactaggctctccccggagtactaggctctacctatattggaattcttgctgtttctttaacatactataccctttcctgcctccctggtatgtcttttgttcctgctgttccttccatctgggatttgcttctggtctctgatgctcctcagagataacttttctgatcccccccccccccaccccatataagttcttgacctcatcactttctatctgctcagcctactttattcttctttataacattgaatactccaaattatttctatgtgcatagatataaataaacctgattattatgtatctcccactttagaataaaagcttatccttaaggacagggattgcacacccccagctcctggacagggtaggtgatgcccagtaaacatttgttaatggttgatagcagacaatcgccttccctcatagctctccatatgccagtctccaaacaatgactttctctcatcactaaagttagtttgactcagcaatgattgctctcagttatcactgcttatcactaagccccagactactaacaaaagcacaaacaggactgcccagaccagctggctgcttgctgccgtggctacactgtctcgcccaccatgtcactactgctgccatccacaaggctcccaactcggaggctaatcgcactgttggctgtatctgttcccacgactttctaggagactcctgtggcattcttttttcccacccttgggactctaaaccagtgtgcactatggagcttggcagagctgcaaagctggcaccagaattcaccaagagcaatgtgaagttgactgcccttgcaacagacagtgctgaggaccatcttgcctggagcaaggatatcaatgcttacaatagtgatgagcgaacagaaaaatgcccttttcccaacattgatggtaaggatcaggaccttgccgtcttgttgggcatgctggatcctcctgagttggaagaaaagggaatgggtgtcagagcttatggtgtttatttttgctcctgacaagaaactgaagctgtctacccagctaccactggcaggaacttggatgagattcacggggtagttatctctctccagctgacagcggaagagaggttgccaccttgattgataagaagaatggaaatagttatgttgctgggcatggtggctcacggctgtaatcccagcactttgggaggccaaggtgagtggatcacttgaggtcaggagttcaagaccagcctggccaacatggtgaaaccccatctctactaaaaatacaaaaaaaaaaaaaaaattagccgggcatggcggcgcacccctgtagtcccagtgactcggaaggctagggcagaagaattgctcgaacccgggaggtggaggttgcagtgagccaagatcgcgtcactgcactcctgggcaacagagcgagactctgtcacaaaaaagaaaaaagtcacagaaatataaatcttgatcagagctgttcattacacctgtctggtactgatctggaaatcatgaacatccagatattcacctaacaaccaaggaaagaaacattcactataatttcttgaatgatttaatcttaataaaatagattactgtttttcaccaaggctcatttttacttgggaaatagaagtgcaattaaaacttgacttttctataggcatttctgccttggaattttgaaaataacctcttgattttaagaaccaagctcaagcactcactgggaacatgatatacatggtcttaatgttctttgaactttcttttttttttttttttttttgagatggagcctcactctgttgccaggttggagtgcagtggtgcgatctcggctcactgcaacctccacttcctgggttcaagcaattctcctgcctcagtctcccgagtagctgggactacagataagcgccaccacacccggctaatttttgtatttttagtagagacggggtttccccacgttggccaggatggtctcgatctcctgattttgtgatccacccgcctcggcctcccaaagtgctgggattacaggcatgagccacttagcaccggccttgttctctgaacttttgttcaaactcctctatccctcaaaaacgaaaaaagggctgaacacaatcctgcctgtagcactttgggaggctgagtgggggtggatcacctgaggtcaggagttcaagaccagcctggccaatatggtgaaaggtcatctctatcttaaaattaaaaaagatggccagacgtggtgactcacgcctgtaatcccagcactttgggagggtgaggtgggtggatcacttgaggtcaggagtttaagaccagcctgggcaacatggtgaaaccctgtctctactaaaaattaaaaacttagctgggcatggtggcgcatgcctgtagtcccagcttcttgggaggctgaggcacaaggatcgcttgaagccgggaggcgggggctgcagtcagccgagatcgtgccactgcactccagcctgggtgacagagcgagaccctttctcaaaaaaaaaaaaaaaaaaaaaaaacacaacaacaataaaggaaaagaaaagaaaaagtcacaatgctaagtgattgagagtttacctgcactctctaaatattggtatctggtggatgcttcaggtacccccaagaaatttgcttgttctgactgctagctgcgaagcatttgacaaaccctagacacaggtatttgtcttctcctgtcatcctgtatgtcaggcagcagtagccattgcatttcagaggagtagcacaccccaggatgactcttgtggtcctctgattttgggaagtcagacatttggtttgagtccttgacattcatggacgtaagcaaaattataaaggttgtcagaaacacctaggttcaaatcacagctccactgcttactactcgtgtaaccttagatgtgttattgaacctctctgagcctccatttttctaatctggaagatcaagataatatccaccccacaaagttatcatagaacttaaaagagaaaataaatataaaacgaaacatgagcactgtgactgatgcagagtaataaatgattctggccactactccacctgctcctaagatcctagttgatttcagtggtatggacaattggaaacagactgcctggtttcaaatcctggctctgctagtatagctgagtggcttttctcagcatagaatgggtataataacgacaacttgccttacaggttgctgtgaagatgaaacgaagtactacacataaagtctttatgatggtgcctggcatacagtaagtgttacaaaagcgtttgcttctatttttattagatcaaaggttaggtctgagaagacagtgtctcattatttagattgtgcagtggagcatgctatgactattggcatctctcccttcaccagtcaaaccttcccaaatacccacttccgccactcagtcagtaactcagtaatgtatttttatgagtcatagagtttcaggtttcctcagcacttgaattacattatggcaacatattaagtcactgcaggttccggtctggggcaaggtggtatcataaataataatggatttcttttcccgccctccctccattctttctgagatggagtcttgctctatcacccaggctggagtgcagtggagtgatctcggttcactgcaacctccaccacccaggttcaagtgattctcctgcctcagcctcccaagtagctgggatcataggcacatgccaccatgtctggctaatttttttgtatttttagtagagatggggtttcaccatgttggccaggctggtctcaaactcctgacctcaggtgatccacccgccttggcctcccaaagtgcttgattacaggcgtaagctactgcacccagcccataacaatggacttaaaagcaaaagacttcgatttgcatcctggctgtgtcaaatatgtatccgtaagacagcaactccatttttctgtaatttagtttcctaatttttagaaggagattacacctacctcataggtttgttagaacctttaagtgacacctacaaatttcctaataacctataaagcactagttgttcttaaaaacaatttgaaatagccacttaaaaaatgatcagcaaagcactttcaccattgttattctattcagaagaacattttaatctctgtgcttctagcatactgttgcctctgctctcagccacttccttgcatggtaaatcaagagtaaaactgcacggtattgggaaagaagaaaaagaagaacaaaaagtcagtagctaacctaagtgcaaaaagtgttggcaatatctttccctgttatactcacaaaaatctatgtttatgtattcttaaaaataggccggcacagtgactcacacctgtaatctcagcactttgggaagctaaggtgggaagattgcatgagctcaggagttcaagatcagcctggggaacatatggagaccccatctctaaaaaaaaaatttttttttttgagacagaatctctctctgtcacctaggctggagtgcagtggtgggatcttcgctcactgcaacctccgcctcctgggttcaagcaattctcctgcctcagcctcctgagtagctgggactacaggtgcctgccaccatacttggctaatttttgtattgttagtagagatggggtttaatcatgttcatgttagctaggctggtctcaaactcctgacctcaagtgatctgcccagctcagcctcccgaagtcctggtattacaggggtgagctaccacacctggcatacaaaaaaatatttttaaagttagccgggtatggtagtgcatgcctgtggtcccagctactcaagaggctgaggtgggagaactgcttgggccatggaggtggaggctgcagtgagccgtgattgtgccactgcattccagcctgggtgacagagtgagatgctgtctcaaaaaaaaccaaaaaccaaaattttcctgacattccctagcaagcagactcagaatgagaaaaaaaaaaaaaaaaagaagaagaaaaaatttacctggctgagagaatgaaggaacgttctacactttcaatctttaattcattctgataggcttcttgggtaggttttctgacctggaagaaagcacaacaatttgagccgactcatcctactgaaaaccatatcaatgagctgaagttgtccaatggccctggctgcttacatccacaaccaatcttcctatccagctttctctactgctgttctccttcatctactctatgcttcagatgaattgaaaagcccacacaccagcccacctttcccacctccaggactttgctcacagtatgccctccacctggaatgcctttcccttacatctcagcatggccaaatgtgacctatactttaaggtccactggctcttcctcctctttctccttctttcctagctgctctcaaaagctacaggccagtccccaccatgaccatcaaacactgcaagttctttattttctgaattcccaaaactgtaattgtgcctttatagtgatatttattactgtctactttataggtatttacgtgtagtgtactgtcttcccaactagttgctaagtccctgggggaggaaagacaataagaatcatgcttcaacttatcttcatatcttccaccaaacccattactgttttgtttatagtagttctcaataaatatcctatgaatacattaatgcatgagtgaacaaatgactacatgaatgaataatcaaatgcataaacaggcagggcgcagtggctcacgcctgtaatctcagcactttgggatgcgacggtgggtggatcacttgaggtcaggactttgagaccagcctggccgacatagtgaaaccccgtctctgtgaaaaatacaaaaattagctgagcctgtagtcccatctactcaagaggctgagtcaggagaatctctcaaactcgggaggcagaggttgcagtgagctgagatcgcaccactgcactctagcctgggtaacagagtgagactctgtcacaaaaaaacaaaacaaaacaaaacaaatgcataaacagtaacatatatagacagaaaagtaaaggatataagaaagatgtttatcttagggaattttctctaaaatatatatttgttgttgttattatttttaatagagatgggggtttcactgtgttgcccaggctggtctctaactcttgagctcaagttattatcctgcctcagcctcccaaagtgctgggactacaggtgtgagccactacgcccagcctttatttgggcttttttttttttttttgagaaggagtctcactctgttgctccagctggagtgtagtcgcgcgagctcagctcactgacacctccgcctcccaggttcaagcgattctcctgcctcagcctcctgagtagctgggattacaggtgtgcgccaccacgcctggctaatttttgtttgttttttttttgtatttttagtagagatggagtttcactatgttggtcaggctgatctcaaactcctgaccttgtgatccaccggcctcagcctcccaaagtgctaggattataggcatgtgagccaccacactgaccttatttgggtttaaaaacaaatcacctgggtgggcatcatgtctcacacctatgtaaccccagcactttgggaggccaaggcaggctgatcacctgaggtcaggagttcgagaccagcctgccaacatggtgaaacccgtctctaccgaaaatacaaaaattagccaggcgtggtggtgggtgcctgtagtcccagctactcaggaggctgaggcagaagaatcacttgaacccaggaggtggaggttgcagtcagccaagattgtaccactgcactccagcctgggtgacagaatgagaccccgtctcaaacaaaacaaaacaaaacaaaacaaaacaaaaaacaaaacatctaacagatgcacacaccttcattccagccagtgagagcatgttgttcagtttatacatcccagactgcactggtgttgtatacagcagggcatcattaaactgaaagtagaaacatttcaggggagaaagtaaagaaacacattactgccacaaagattttgacaagatacaagattaaaggataaataatacctctttgctaatagctctctgaataaaatacttatattctgctatatacactagaactacccagaatgtttattagaatataatttaaaaggcactttctggaaaacgtgctttatttccaagttctgtaacagatttaatgttttttgaattctaaatcccacaaaggtattagtctgcctaaacaaatgattagaacaattttccaagttagaaatggaataaattccaaaaagaaataatcttctggttatacatcataacagacgttatttcccatacttgaaatgcaattaagtggtacggccagttcaagaagctggtgaggctgatatttgaaggtgctaagcttatctaccatgtataaacgtctcctttccttaagcaactatccctacctcggccacatcagaactacacaagtcctcttaccaggaaaaacattcgaggttgcatcactttccgagacagcttcatcagaattccttctttgagaaaaacctgattcacccaaacaaacacccatttagtcctaccatcacaacacaacgacaatataatttccttttcaactttcttccctgagaatttttttcatgacagactggggagccacagtttccttgagattttttacagtcatagttaattttaaacccttaaatcatttaggaatcggacaagcaagcagggttggataattccaatattggcccctgggatactgtatggaggcacatgtaattgactgagcgtgtacttgatcctgaagcatacccaacatcctgacaaccgcattttgtaattttcccgaattaattccctaggccacttttgtgctatatgaggaggatcaaaataccaatctcccccctcccttcataatcctctcttacattaaagatgttaaatgaaattgtcttcaaaactgtgtgaggtcgctggcatcacacaagaaaacgatcccattaaatcagatactctgtggggtcccttgccgctcccctaattgaactggacttacttcataaatgggcttattcctaattgaattgtcacagtgacttacatcatgaatgttttgaacggataaagtgatcaaaattgaatcaatgaagagtaacaaaaacaacctatttttataaaatgataaacagatacagatggtacctaaatgcatcgtattaagtttgcgaaaagcaatgtaaaatgcttacccgaccaggctgcacaatttcatggtgtccatttaagctgtactgaatttgcataagtttctgaaagttgtcctacagaaagacaatggaaagcatatgaaggcctgggctttcaggttcaagaccacaccagccactgacaacaagacacttactccttgcttcatggtgtcattggcgtggttggctacctctataacaacagcaagggcatctgaaataggcaggaacaaaacgtgcatttagtaattacaatggaaacaaatagtttgcaacattaagcaattccaggggacaagatagctagtttatagcaaccaacctctggaggagcttattgactgtgagtaggcagaaatataaggttcaatgaaggcaaaaccaaaccaaaccaaacaacaccaccaccaccaaaaacctggccaaaacaatatatagggaaacaatgagccaaaagaagactctaaagagacactgtagaccatgtttactaacagtatgaatgtcagggttgttttgtgctgtgatttgattatcctattcaagtttacaaagataaggatgggatttcacctggaagataaggaccagcccagtataaactgtcttgggagaaaaggatcgtgaggaaaaaggatcttgttataggaaataaaaactacaagaaatgactaagatcaggtctcagtctcttagtctgattccaagaggcatgaattagaaatgggggaaatgccacatggaagcatcccagatcttaggaatttgcaagtgtcattttgtgagctgggttattagcttcatgggcctatctgtgttttattctttttattaaccctttgcctttagcaaagtgtttttccatactccagccttgtcatctttataactaggtctaaaggaaaaagtctgcattttctcagctttggggctgcagttattctcaacccaaggccatagtgctcccttagggacatgtgaacctgtgtaaagacaatttttgcttgtcacaatgaccaggaagatccactggcctttggtgggtaggaggcagggatgccaaactccatgcaatactccttagaaacccacacaaagattattcagaacaatatgacagtagcattcccactgagaaaaactggtagagtgttagagagggaagcatctcctcctgaggctgctgtggcagtgacagtggtcatcaaaaaaaggactattaaaaaaaagagtggctgggcgcggtggctcacgcctgtaatccgaacactttggaaggctgaggtgggcggatcatttgagctcaggagatcgagaccagcctcagcaataaggtaaaaccttgtttccacaaaaaatccaaaaattagctgggtgtcgtggctcatgtctgcagtccagcaatttggggcgctcaggtgggaggatcatttgagcccaggaggtcaaggctgcagtgagcccagatcacaccactgcattccagcctaggtgacagaatgaggccctgtctcaacaaaacaaaacgaaacaaaaacaacaacagtaaatcaatttctgaaaaggggttgaggtgttttggtccagttattgtaatctatcaaaggactgtcttcctggtaccagccgtggaggcttctgtattctttttttttttcttgctctgtcacccaggttggagtgcagtggcgcgatcttggctcactgcaagctccacctcccgggttcacaccattctcctgcctcagcctcccaagtagctgggactacaggcacctgccaccacgtccagctaattttttgtatttttagtagagacggggtttcaccgtgttagccaggatggtcttgatctcctgacctcgtgatccgcccgcctcagcctcccaaagtgctgggattacaggtgtgagccaccacacccggcctgtattctttccacatgtatcatcatcactattattaaaggaaagcaggtttttccttatatagagaccctgactatatatcagaatttttttttttttttgagacagtcttgctctgtctcccaggctgaagtgcagtggcatgatcttggcttactcaacctccgcctcccagattcaagcaattctcctgcctcagtctcctgcatagctgacattacaggtgcacaccagtatgcccagctaatttttgtatttttagtagagacggggtttcgccatgttggcagggctggtctcaaactcctgacctcaggtgatccacccgccgcagcctcccaaagtgctgggattacaggtgtgagccacggtactcagccatgtatcagaatttacggtgcctggtacccttttcacagcaggttcaagaggttaccgtggacacatttcctgctttctggcctgctggaattcccggtggacaggggagagatgccttaagatttaatggatgacaaagctgctgctgctacttggtcacctggtctcccaagctctaccttccctactccatgctgtgattctactttccccacgtcatcccgttaagaggccctgatgcctctattcctttaactcttctgcctacctttcaaagttattcttgcctcaccttccctcacccttgaagtctcatccacactgctcaccactctttttttcctgagacagagtcttgctctgtcgcccaggctacagtgcagtcgcgggatctcggcttactacaacctccatctcccaggttcaagcgattctcatgcctcagctactgagtacctggtattacaggcatgcacccccatgccccactaatctttgtatttttagtagcaaagggttttgccatgttgcccaggctggtcttgaattcctggcctcaagtgacccacctgcctcggcctcccaaattgctgggattataggcatgagccaccacgcccggccactgctcaccatatgattgctgtgcctctggccatacagtgggcctcactgttcactggttttctcatctatgtctttgctgtcacatgtaatttcctttaaataagctccttaatctctgaccctgaatttgttttatgtgtaaaatggagctaataactcactttcattgaaggcagaagcccaggacccaggacagatgttttctttctattctataagttccatgtataatttgtatcctcacgagaggggctgccgtcgggaatgctcatttttcctctcacccactctcccactcatctccagtcctactttttcctgcaaagcttccctgcctctttaaccttcacacttttctctgtcatccaaataattctgtcctgctcggtgcacccttactttgaagtcatttgctttgttctttatttgatggatattataaacttcttcatcaactagatatgatcactgaagacaggaaacttgtcagatccccaaccacaagcttttcctttaaaaaaaaccgcctttaaaagcataatgtacacaaacagaagatgttaagagaagtaaaatgattaaaagaatatataagaatctctacaaaaagggttaaaaatgttcactttttactctgcaaatgtaaaggatatacaagaatgtgatcaggccaggtgtggtggctcatgcctgtaatcccagcactttgggagactgaggcaggtggatcgcttgagctcaggagttcgagaccagcctgggcaagatagtgaaaccctgtctctacaaaaaatataaaaattagcagggtgtgatggtatgtgcctgtaatcccaactacttggagggctgaggcaagagaattacttgagcccaggaggttgaggctgcagtgagccgtgttcatgccactgcactccagcctgggtgacaaagtaagactctgtctcaaaaaattaaaaaaaaaaaatgtgatcaaaattcataaaattaatggacttgcttaacatgtttctgcagttagacccaggcgttgctgggcatggtggctcacatctgtaatcccagcactttgggaagccaaggtgggcagatcacttgaggtcaggagttcgagaccagcctggccaatatggtgaaaccccatctctactaaaaatacaaaaatcagccgggcatggtggtacatgcctgtagtcccagctacttggggggctgaggcaggataattgcttgaacccaggaggcagaggttgcagtgagccgatatcgtgccactgcactccagcctgggtgacagagtgagactctgtctcaaacaaaaaaagaacaaggggtatacctgtgacatttgaaagaggttgttgggaataaacagaaacacccaaacagaattaatctgtgtgtatgtgtgtgtatctgcgagagagggagggagagagattgtgagggagagagacacaggcacacagacacaggaactccaattatcccactagctatgagtccctcatgttgtaatggattgtttcccttaagtactactagggctgagggaaggctaatatcctattgttagacagtgccagaataatatgcttttttagactcatccctgctttgtagtttagtcacttcatggactcatgattttgaagcttgaggaccttgcagatctggttcaatccctgtttttgaaagacaaagaaatggacctctagggaaactgaatatggcacgggcacagagtgactgagcacaggagggcaaagattcctgacctcagccaccacgctggcttcacagtcgcaagaggctggttcccatgcagggctggccatgggtctcccctgcccatatcatctcacctatccccagcactgctttactacttaactggttctatgttaatctgctcaaaatggagtttccaggaaggcctcaagtctttttttttttttttttttgagaaggagtctcgctctgtcgcccaggctggagtgcagtggcgctatctcggctcactgcaacctccgccttccgggttcaagcaattctcctgcctcagcctcccaagaagctgggattacagacgtgcaccatcacacctggctagtttttgtattttttttagtagagaaggggtttcaccatgtaggccaggctggtctcaaactcttgacctcaggtgatctacccgcctcggcctcccaaactgctgggattacaggtgtgagccaccgcacctgcccttcaagtcgtatgaagagagtttgtaatggattttgttatcaatatatttttactttctagccctacctaaataaacataatataaaaacttctgcaaccacagaagttatttaccttgagtgtctctgtaatctccagcatcttctatgagattcttcaaataatctagaaaagaagaaaaaaaagtatttaagtacaataaaccagtgagccccaaacacatatctttctttttcaatacttcattagtcttgctggttaatatacatgctagtccaacttgtgctaactttctaaaaatgtgaaaaaataaagccctgagatcaatttgaaatcaagacatagagtcagagctagaaaaagccttggaggaaacattggttattttagagatgaggaatcagattactgagcaaaggatctcacccaactcacacaacctctagttggcagagccagcatgagaattcaggtctcctaatgcccaattcagcttttatcccaacacataggaagtactttaatcttgagatcagacacacgtctagtataaaattctaaggcattaatccaatccctaaaagtctcctggatttgttaatctaagagtctaacaatgctcaggacaccaagggaactcaatatatgtatttaaacaggtggttttcaaatggggacaaatttgccccctagggtacatctggcaatgtctggagacagttgtggttgtcataactggggaaaagcgggggctactggtggctagtggttagaagtcagagatgcagactggactcggtggctgatgcctgtaatcctagcactttgggaggccaaagggggtggatcacttgaagtcaggagttcaagaccagcatggccaacatggggaaaccccatctctactacacacacacacacacacacacacacacacacacacacacacacacacacgtcagacgtgctgctaaatatcttataatgcagccctgcaacaaaaaaaaaaattatctgaccccaaatatcaataggtctgaagttgagaaaccttggtttggataaagatagtctgtaaataagtaatatggtatatagtagttcttgtaatacagaaaaagaggtaatagaagaacctatatttaataaatctttaacaccaaggtaagtcatggaatttcaaggcaatacttccttctctgttgagaaatgctggatggcctcccattacctgttaaattaatacaaattcctttctggaatttaaagccccctgctacatggtccctatcaatttttctctctctcttgctactgcctaaaatgggccctttgttctgactaaatttgatctgtgcaaccccttaaacactccccatgtgtccccctggcttcacaccttttgtctctaatagtccctttttctccatcccttcctctgtctcgcttatacaaattctactcacactcttcaaggctcttcttaaatgccccttctcttacaaaatttccatttgaaagaaacgttttctgcctttgaataacacatgacacagcagtctcactttatgcttctatcattttctttttcattagactcaaagctccttgtgagcaagtcatctgacacatctttctctcacatagcacttagtcaggggctttgcacaaaggggacaataaatgcttactgaataaaaacagttcacttactcattcaagacagagtctcaccctgtcgtccaggctggagcacagtgctgcaatcattgctcactacagcctcaaattcctggactcaaccaatcatcctgcctctgcctcccaaatagctatgactactggtgtgtgcctccatgtctgcttttttttttttttttgcagaggcagggtctcgctttattgcccaggctggtctttaactcctggcctcaagcaatcctcctgccttagcctaccaaagtgctggaattacaggcagtgagccactgcacctggccaagaatatattattttttagataggattgtattttagttgaggtaaaaggcaataaatgctgaaaccaattctaatgccagtgggaactgaggaaatgaaaggaggaaaggtgtgttcagtgactgaatatatctttatcagacccaactgctagttagtactattatggaatagatacaacttcatctcatggatttatgacatcatgctcagaggaacaaaggaaaacaggggtattggtgccagatcttcaaacataacagatgacacaaacacgcgcccaattgctgaaacttcgtaagtctttgagacagtgatctaagagcctgtgtgagtctagacgtgcaccttataaatatccagcactggcaataagccatggtgagatgttatgtataaacatattaagcttccctgcgccatggcataggttctatcttgccagagaccatcgctagcaatttagatcttaatctgaatgaagagagcatcccccgcaaaatataaaggaaaaatgaagtgggcacacacaaaaaataaaaaattcccaaattaacaaaatacataagttatatgttacacttagccccatctggagatgaaaataaatattctcactctgaccccactcagaatgcattcaatatattacataatccgtgtctggtgagtgcaaacatttaacatttctatggctgacagttgacagggttggggagacaaacttaccctaccctccctattagatgttctcaaaccctaagctacctcattaatcaagtgattttccttaagctgttagatagttactatatcttgttgtgggaaggaatgcagatttacctaaatattggactcatggcgacttcctagtttgtcttaaatttctgttttttaatacagaagtatatccatgaaaacagagacatttctctaaaccaaaagggctccccagaagatgtccatattaggaaatcctgacctcagaatcactgtgctgagcctcataaacttctaagttgcattttctttgcttgtactcaaacatgaacttttatgaacacagttgaaatacactgagcagaaaacccaccgttaacacgttgcaacatcatgctattaatcaaggaagtaacggagttaggtttaccctccttgccaatttttaaaaatatctttatggtctacaaaatccaactctccaacttatccatccatccatccatccatcaacccatccatccatccattcatgtttttagggcatcttcttgcagtatatctttttgagaacttttaccttggcaaagagagcagggcctggatctccttaaacagttaagaatcacctggggccttaactgcagcataagaatgtgactgatcaccctgagtcagatgggaggaacaggaaaccagtagctgccccagtaactgttataacccaggtgaaacccaggaaaggagaccagacagacacgcctatattggtcatagtgaaccacctattacctatcacttaggacctggtattcggcagaagctttcctaataacaacgaggagagcagtcatttcagtttgccatgttagactggtagtattctatgacctttctgctcctgccaaaacaaattgagcattattcaaaacttcactaataaaactgcctcaaatgccactgaggttatttttatcaaaggaaaaaaaaagcagatgttggttcagcatgtaggtacactacaaaatgtactctctggccaccaggtggcatcactgattaataaaagttaattaactccatcaccatcacccaacatgagtagcaaaaaattaactggaacacaacatactatgtgcaacttctagggatatgcaagctgccttttttttttctttctttttttggagggtctcgctctgttgcctaggctggagtgtgcagtggtgtgaccaatgctcattgtagcttcaatctcccaggctcaagtggctgtcccacacctcagcctcccaagtagctaggacaacagacctgtactaccacgttgggctaagtttttgattttttgtagagacgatgtctcactatgttgcccaggctggtcttgaactcctgaactcaagtgattctctcaccctggcctcccaaagtgctgggattataggtgtgagccacggtgccagtacaagttaattttgttctcatataaaatgcccaaggccaccgggcgcagtggctcatgcctgtaattccagcactttgggaggccgaggtgggcggatcatgaggtcaagagttcgagaccagcctggccaacatggtgaaaccctgtctctactaagaatacaaaactagctgggcatgggggcgcatgcctgtaatcccagctactcaggaggctgaggcaggagactcgcttgaacctgggaggcagaggttgcagtgagctgagatcgtgccactgcactacagcctgggtgacagagcaagactctgtctcaagaacaacaacaataacaaattcccacggccaggcataatggctcatgcctgtaatcccagtactttgggaggctgaggtgtgcagatcacttgaggtcaggagtttgagactagcctggccaatatagtgaaaccccatctctactaaaaatataaaaattcaccaggcatggtagtgggcacctgcaatcccagctactcaggagactgaggcaggagaattgctaactcaggaggtggagtttgcagtgaaccgagattgtacctctacactctagtctggatgacagagcgagactctgtctcaaaaaaaaaaaaaagaaagagagagagagaaaggatgaggacccaatatatactatatcttgttggaaatctaagttttctgtataagggttcccagggagccttaccaccactcattgattacctaatcaatacataaccaacttagagcagaaactagtcggaagtcctgttaaccattaataaaaattagtcatctgtgggaatctgggactttttgcattcaacacccagtcagattcctggaccgtgcactgagaaatgtttggcagcaaagcacagaggaaatgagtgtataggagggataacattccaaagtcaagtgttttgaatttgaggacatgtcttgctttgtatttttcagatttcttctttcctccataaatatgtagtgggatcagcaacacatacagaattatgggatccagagaaaagtaagtctagtcaatatgactttgtaaagttttatgaagtttcagattttgcaagaaacaacctaaaattagcctgacttgtgaaacaaagtactgatcattttaaataccaaaaacaagcatcaagtgtcaacttacaaaacatactgacacttcaaggcagcttggcgaagtggtcaagagcccttgctctggaattagaagacagaaattcctgggccaggtgcgatggctcatgcctgtaatcccagcactatgggaggccgaggtgggaggatacagcctgggcacatagtgagacccatctctaagtctttagatgatgatgatgataataataataaagatagaaatgcttactctgcctggtccagccacatctagttgaggcatgggactttggccatgccccatagcatttttgtgtgttaatatcctcatgcataaaataactaggctgaaccagaatgaaaactgtaacgattctcattccaaaatatcatgaaacatattttgttgaataaaataaaaaatgaaaaatttgaaaaattaaataatgaggaaaacttaaactatgaacatctctgagaaaaacaattactaaactatttccttgtttttataaatgcttgatttgacttaaaaaccatcctaggggtatatcatacagtacttaggtgttctattagctctttagtgcatttaatttgttttggctatttacataagtaggatggcaatacaaccttatctccccatatagtcctgccttatacctgctgtccaggcataattataaatactgtcctcttttacttttgtaagttaatgggtttggatttataagtaacactgattagcactgtcggctggtgtggtggcttacacctgtaatctcagaactttgggaggccgaagtgggcagatcaccggaggtcaggagtttgagacccgccttgccaacatggcaaaaacctgtctctactaattagctgggggtagtggcacacgcctataatcccagctactcgggaggtggaggcaggaggatcgcttgaacccaggaggcagaggttgcagtgagccaagattgtgccactgcactccagcctgggtgacagagcaagactccatctcaaaaaaacaaaaataaaaataaaaaaataggccaggtgcagtggctcatgcctgtaatcccagcactttgggaggctgaggcgggaggatcacgatgtcaggagttcgagacctccctgaccaacatggtgaaaccccatctctaccaaaaatacaaaagttagccgggtgtggtggaatgctcctgtagtcccagctacccaggaggctgagacagaagaactgcttgaacccaagaggcggaggttgaagtgagctgacatcacgtcactgcactccagcctgggtgacagagtgagtccgtctcaaaaataaataaataaaaataaataaataaataaataaataaagcatgccttcttccatatttcagattcttttcttgggatcagggagaataatttatttatttatttatttattttttattttttttgcttcatgatttgtgatatagaaaaaaattaaagttaaaaaaaattttaggctgggcatggtggttcatgtctgtaatcccagcactttgggagggtgaaggaggtggatcacctgaggtcaggagttcaagaccagcctggccaacatagcgaaaccctgtctctactaaaaatacaaaattagtagggcatggtggtgtgcgcctatagtcccagctactcgggaggctgaggcaaggagaattgcttaaactccggaggcagaggttgcagtgagccgagatcgcaccactgcactctagcctgggtgacagagtgaaactccacctcaaaaataaaatgaaataaaataaaatattaaattatttttgggtgcttgatacatatcacaaaaaacctttcctaaagggatgtgaaacttttaatacaaatatatgagaataacagtttcagtaaatgccaattttgtgtgctgcagttttttattgctaatagaattggtaactgttttatttgatagttatcattcgaaggacacaatacaccactatatatttattatgtgctctttttttctaagttattatatttgttcatatttttagtctagatgtctatttttagtatttgtgctgaaatgaaaatttcctagaggtatattttctgatgtgctgtttgcctttttactttgactgtattttaaacttttataatattttaatgttattataatggtgcaaatgtgcctcaaaaaataaaataaataaaatgaaatgaaaagtgtcaatattttcatttacaggctggctgctgtggctcacccctgtaatcccagcactttgggaggccgaagcgggcagatcacttgaggtcagttgtttgagaccagactggccaacatggtgaaaccctgtctctactgaaaatacaaaaaattagccgggcatggcggcaggcacctgtaatcccagctactagggaggctgaggccggagaatcacttgaaccccttgaacccaggaggtggaggttgcagtgagctgagttcacatcattgcactccagcctgggtaataagagtaaaattccgtctcaaaaaaaaaaaaagatatatatatatatatgtatatatatatatatatatattcctttataattaatttttctgggcctacaaaactatctttcatcctgtcctcattttagagtttcaataaatagccagttttataattcttcatatttagctctgattttatttgtagtatatgtattaatgtaggaaccttaatttgtttttcaaattattattatttttgagatggagtctctcctgttgcccaggctggaatgcagtggcatgatcttggctcactgcaatctccgcctcctgggttcaagggattctcctgcctcagcctccccagtagctgggacgacagatgtgtgtcacaacgcccagctaatttttgtacttttagtagaaatgaggttgtaccatgtcggccaggctggttatttttcaaattattaataggttatttaataaacaatcttttttctattgtcttgggtttcctactttgtcatacattagattcttataaacagtccatttcaagttacttccttattacataaggaataattccttttataaaaaaattaatagatctattcttgcaatgctattgtgtaactttaattgttgatgccttagaatatgtatgcactggcatttgcctcccagaatattatttaacaatgtacatatcctatttatttctatacacaaaatcattttgacaagtaacaataaaactccaaaattctaagttaagtttaatgagaatatgtaatgtcatgaatatattagaagctaagtaaatggtactataatataaggtatcattttatgcacaaatgctaaaactgtggccttcctgaggacagaaagcctgattttaattattgttgtagcccctgcacctagaagaagatctgctatgccaggcacagtggcttgcacctgtcatcccagcactttgggaggctgaggcagttggatcacctgaggacaggagtttgagaccagcctagccaacatggtgaaaccccgtctctactaaaaatacaaaaattagccgggcgtggtggctcatgtctgtaattccagctactcgggaggctcaggtgcgagaactgcttgaatccaggaggcagaggttgcagtgagctgagattgcaccattgcactctagcctgggcaacagagcgagactcagtctcaaaaaaaaaaaaaaaaaaaaaaaaggctctggcctttggctctaattcttctgcttctcaaatactcattcaattctagtccttgaatctgtatgtggcctagaaccacctcttatagatgtggtgcttgcctaagttagaaagtgtcatctcgggaggggcacagtggctcatgcctgtaatcccagcactttgggaggccaaggtgggcagatcacatgaggtcaggaattcgagaccagcctggccaacatggtgaaacctcgtccctaataaaaatacaaaaattagctgggcatggtggtgcatgcctccagtcccagcttcttgggaggctaaggtaggagaatcacttgaacctgggaagtggaggttgcacagcctgagcgacagagtgagactctgtcaaaaaaaaaaaaagcgatctttctgggctctcaggttgcctttctgtgaattagaaaaggtccctttcctgggccaatgcaccccctcctcaccagggcacaaaatatggcaaggaaaggatcacctgaggacaggagtttgagacaagcctggccaacatggtgaaaccctgtctctattaaaaatacaaaaattagctgggtatgatggctcatgtctgtaattccagctacttgggaggctcaggttggagaactgcttgcaggcatccttgtccaagaattatgtaaggaagccctgatctatcctagactttgacacaaccctggtcctgaggcggcatccccacagaactcacaaaccaaacccaactccaggctcatcctaaggcaaaattttgacacagatctcatgatagatggtatctccccaggtccctttttagtgggaaagtctagctaggcatatccagaatgttctaagaagaggcaaactgcaaaagtcaatatacattttttttttttttgagatggggtctctctctatcccccaggctggactacagtggcgctatctctgcttactgcaagctccgcctcctgggttcatgccattctcctgcctcagcctcccaagtagctgggactacaggcgcccaccaccacacccagctaatttttttgtatttttagtagagatggggtttcaccgtgttattcaggacggtctcgatctcctgaccttgtgatccacccgcctcggcctcccaaagtgctgggattacaggcgtgagccaccacgcccggccaatatacacactattttgacttgacttgtctgagactgcttttctttcttcctttttttttttcttttttggagacagggtttccctctgttgcccaggctggagtgctatagctcactgcagcctccaccaacctcgacctcctggactcaagcgatactcctgtctcagcctcctgagtacctgagactacaggtgtgtgccaccatgcatggctaattttttttttttaaagaggtggggtctccctatgttgcccaggctggtcttgaactcctgagctcaatggatccttctgcctcggcctcccaaagagctgggattacaggcgtgagccaccgtacctggcctgagactgcttttcttagtggatacattttctagtagctgccagtttattaagcaggaatcttaagtgtacggaaatggccttggcacagtcgagccacacttaaaagaagctgttacccatatttggtctgtaccaccctgagtatcaacaaagcaaacttacgtttagggacataagcacattttattacctaacagccaagcgaagaataaagcaaatgtaagcaccacagttcaaatttgattaaagttcagtgttttctccaactgaaacaggtcctgatgagagcccatgattctgactaaaactgtgagagcaactttagcaacagattctgcttgctatagctctgccaagacaagtcccagcaacagaggcaattggttacttgcaggaaatctgggtcaaatctgcacttagaattggaaaaagaatggctttgtagcaatgtctatgggtagaatttggggtatctgcaaacttggagggcaaaaagaggcacacaaacaaacccaccctattttcactaacctctacgtgtaaaataggattttcttccatcataaatgtaggtgcaaaccacaacagtatcagtgatatctgtgactttatcaccacagatatttttatagcatattacagttgtggcagacatcttatccctcttagcactcctctcacccctacttcaaaatcgtggtacttattacatctgccacctgatcttatttaatgcagtactaaagaagtgcatgcattaattactatgtcatgattaaaaaatattttattactgtgattgtggtatagcaaaaaaaaatttttttttaataactgtacttcagcccagttggttttccctttaatcttatgtagtttattcagcacttaaaaaaaattattctgagaagggctcataggctatatcagactgccagaagaatctaggcacaaaaaaatttaagaactcctgttctacagagaaactaagattacatttaaaagctctaagctaataaaacaggtggatgaaatgtgctacccttgatcttagccaaaaggccgagaagcgatgatgaaatgtgcttgcctcatataccctaaacactttccatagcattaaaatatttcatggatggctaggtgtagtggctcatgcctataattccagcactttaggaggctgaggtggaaggatcccctgaacccaggaattcaagatgagcctgggcaacatagtgagatcccatctctacaaaaaaaatagaaaaaattagccgggtatggtggtgcatgcctgtagccacagctacttggtacgctgaagtgggaggatctcttgagtctggaaggttgaagctgcagtaagccatgatcctgccaccacactctaacctgggaaacagagcaagaccatgtctcaataaataaataaatatttatattttgtggatacctggatacaatttattcaatactatctctcaaaatacctttttcacaactacaattaaaaatgaattccttctcaccgactgccgccaatatggtgttcaggcacttcatggaggttggctgggcaacctacgtcgcctttggacctcatgctggaaaattcattgtgatcatagatgttattgatcagaacagggctttggttggtggaccttgcgctcaagtgaggagacaggccatgcctttcaagtacatgcagctcactgatttcatcctcaagtttccatacagtgcccaccagaagtatgtcccacaagcctggcagaaggtagacatcaatacaaaatgggcagccacacaatgggccaggaagattgaagccagagaaaggaaagccaagatgacagattctgatcattttaaagttatgaaggcaaagaaaatgagggacagaataatcaagaatgaagttaacaagcttcaaaaggaagctctcctgaaagcttctctcaaaaaagcacctgttgctaagggtgctgctgcagctgctgctaaatttccagcaaaaaagatgaccgctgtgggcaagaaggctccagcccagaaggttcctgcccagaaagccacaggccagaaggcagcacctcctccaaaagctcagaagggtcaaaaagctccagcccagaaagcccctgctccaaaggcatctggcaagaaagcatatgaggcaactataaaaacaataaaggttctttaaaaaaaacaaacaaaaaacaaaggccagccatggtggctcacgcctgtaatcccagtaccgtgggaggctgaggcaggtggatcacttgaggtcaggagtttgagaacagcctggccaatatggtgaaaccctatctctactaaaaatacaaaaaaattagctgggcatggtggtgcatgcctgtaatcccagctactcaggaggctgaggcaagagaactgcttgaacccgggaggtggaggttgtagtgagccgagatcacaccactgcactccagcctgggcgacagagtgagactcagtctcaaaaaaaaaaaaaaagaaaaagaaaaagaaaaaacagaacaataaaaattagccagacgtggtagtgggcacccataaccccaactacttgagaggctttggtgggagaattgcttgaacccaggagtcggaagttgcagtgagctgagatcataccactgcactccagctggggtgacagggtgagacttggtctcaaaaaaataaaaaataaaaaaacaggaattgcaacagaacaagaactgagcaaattacaacatgaattctgaattctgagttgcattatcttcctaatttaacatggttggaactaccttatatcagacacctttgggctcgtcagaaactagataactagattccttgtctggagtgcaggacagccctacttttttttttttttaaatcaagttctgccttagagaaagtgttaaaataactttgatacatacaattaaccctaggttttaaaataaatacttgctaaacagaagttttccgtaagggtttttaaaaaagagtcatctattagcggctgggcgtggtggctcacgcctgtaatcccagcagttagggaggccgaggcaagtggatcacgaggtcaggagttccagaccagcctggccaatatggtgaaaccccgtctctactaaaaatacaaaaattagctgggcatggtggcacgtgcctgtagtcccagctactcgggcggttgaggcagaagaatcacttgaacccaggaggtggaggttgtagtgagccaagatcgtgccactgcactccagcctgggcaacagagttagactccatctcaaaagaaaaaaagtcatctattaatttaattgtgatcttttttatatgcgcttgttagcctgtacatagctcaaatttatagcttcagaacactataacagatgttttaaatatctcattttctaccaacatgagaaatcctagatttctaaaacctagaggcagttaatatcatcctaaaggcaaagacaacgagaaaaagtaatataatatgttgttaaagtagccttttatataacataaatattttgaacaagatcaaagaaaccacctgatccacatttaatcaaaggactatttttttctaactacataagtggaaaagacttatcagaggaattttaaaattcctgtatcttatattttctctatcaggatccttactgatttaacttgtttcaacactaatgtaataaccttccacaaatgaaaggcttttttctgaaaaacaaattatacaacatatagcacaggtagatggaaaaaaactaaaaggatatgtgatagccatctctggatggtagaagatgaaaaaagacttagttttttcataatccttaaatatttttgtatgcacaaaagatcccttcaaagacaaaaagtggcccttacaaaaataacacatcaccagaatatactttctcaaactgagtgagtatcttttgtgactgctacttgcactgaagtctgcctctgactttatttttttgagatgggggtcctgctgtgtcgcccagggtgaagtacaacaggcacgatcatggctgattgcagccttgaactcttgggctcaagtgatcatcctgcctcagcttcctcagtagctgggatgaccggtgtgtgccaccacacccagctaatttttaaatttttcttttgtagagacagggtctcactatgttgactaggcaggtttcaaactcctgggctcaagcgatcctcccaactcagtgctgggattacaggcacgagccaccatgcccagccctgcctctgacttcaaggggtttacaatctagtggagaagataaggcacagatccatggtataattaaacaactaaaagatttagtcacaagacaaagggcaagatcaatacaatttttaggaattgagaaggagaaggctcagtgggggcctaagtgattgggcatgacctcaaagaggaagactgtaagccccatcagggcaggggccaccactgggttgtctgccagtgtatatgggtgtccagctcagggccaacttatataaatatttgttggtggagtaattaatggaggagagaatctggttttgaaggacagctttcaggagacagcaagaaacctactatagctagactaaaggaaaagaaggttcaggtaattctgggttataaactggtctttatactatgaataagtgggttttcaacttttctaataaacagaatgaaagtgtgtccttggaagagaaattaggcagtaactgtgctaggctacatggaggggtgataagaggtagcatgaccaccagcaagatattgctataaaatggcgtgagtttagaagggcctggcctggagcctaacagagaaatagaaggagcagaaactagaggtggaggaaaatttgctggcagatcctacagggaggaaagagaaaagggaaggatttcagtcctttccataattttgtgactggatgactgaaagaatgcttttaaacatttattaatccatccgtccatgcatctatgcatccatgcatccatgcatgcatgcatgcatccatccatccatccatccatccatccatccatccatccatccatccatccaacattcattgctgctaccgcatggggattctcaatcttataaaaaagagcaactctccctttccctaattacacctgtcagttgactgagtctctgatgtgttccaggatctatgcctgacactgggataggataataaagatggtctctacccggaagagatgagaaagaagaagataagtaaaagttaaggctgctctgataactacaagttaagaaaacagataagtctgttttcttcccattcttcccaacttcaaacaggatccagcctgataaactggccttgagtaaaatttacaagttttgtttgtttgttttttctgagacagagtcttgctctgtcacccaggctggagtgcagtggtacgatctcagctcactgcaacgtccacctcccaggttcaagtgattctcctgccttagcctcctgagtagctgggattataggcgcatgctaccacgcccagctaatttttgtttttttttgtagagacagggtttcaccatgtcggccaggctggtctcgaacttctgagctcaagcaatctgcccacctcagcttcccaaagtgttgggattacaggcgtgagccatcatgcccagccaaaatttataaatatttaggcttaaattatataaatcactgattttgttatacaactatatgcattcttttagatccggtttgaactgatcttaaaaaaatactaacaagaatgtaggtgtaagtgttttactaccatgcaggaagagattgcccaaatagaataccctatagaaacccaaagtaagtccagaaaagaaaacactggaagacaataccatggttatttgaacagcagtgacagactgctctatctggggatttccgctgatcttttctaaaaggattccagaagaaaccatcttatcttatcatctatgcatatctcagtgggaggcacaaacctacttacattgaatcaggcaggactccttccccttctcagcctgaaacttaaaacagcaaagttgccaggagttgcctcaaatgaatgaagtaccactcctgcctgctcttgtatattttgtgcatttggaatcaatccaaactccaaaatggaaataaaagtacttaacctcacaaagttgttggaggattaaatcatttgagctttattatccaaagtaattaacatgtttgaaagatgcaaatttaagacttaaaatccaactttaaaaaatctcagactgggcccagtggctcaggcctgtgatgccagcactttgggaggccaaggcaggaggatcacttgaccccaggagttcgagaccagcctgggcaacatggggaaaccctgtttttacataaaatttaaaaaaaaaaatctcagtgcctagacagcagtactttcacagcaacagtagatatgtcttgcaaagtaaagagtaatcagaacatcacaaaaatgagtactggaaaatcagaattttaaataaaaataaaaagcatcagttaacaggatggatcacttaaatacaaaaataaaaataaaaaagcaaatctttagtattgacctgcaaggttataggaatgtccttaggattataggaacataggtgcttcaattaaagctgtgtagccttgggaggacatttcacctttgtgcttgtgcctttctttttaggagaagatatcatctctaatataaatgttgtctcaatgtcattctttggacaaaaaacattttggctaaagagtttttttttttttttttttttgagagggaggttgctcttcctggctaggctagagtgcaatggtgcgatctcagctcaccacaacctctgcctctcgggttcaaacaattctgcctcagcctcctgagtagctgggattatgggcatgtgccaccatgcctggctgatttttgtatttttagtagagatggggtttctccatgttggtcaggctggtctcgaactcctgacctcaggtgatctgcccgcctcagcctcccaaagtgttgggattacaggcgtgagacaccacacctggtgagatgttttaaacctagcttaaaaccaatctaaattacttcctgaacagcttcaacatatccaaaactgacccagatattttggaggccactaaattatagatataagacacactccctgaactcaaggttggagaactgaagcaatcagagatggctacaaagagaatggacttctgacctgacttcaggtcaggcttaggggaaggaaagaattttaagcaatggaagaaaaggcataggatgaagaatacaaagtctactacgttctttaattttagtcctgatttcgtggccttgaataagccattcatcacttttcccccttcccaaatccaccagtatcgagggcctattatatataaggtattgtgcaacaattaacgaatggaaaagccgaggtgggcagatcatctgaggtcagaagtttgagaccaggctggccaacacagcaaaaccatatccctactaaaaatacaaaaattagccaggtatggtggcaggtgcctgtaatcccagctacttgggaggctgaggagggaggataacttgaacctggtaggcggaggttgcagtgagctgagattgtgccactgcactacagcctgggtaacaggcaagatttcatctcataaataaataaataaataacagaaaagatttcccaatctaagattaagtaagaggtagctcaaactaaaaataactccaagctcacatgatgttggtattataaaacaaaattcttcttcttttgtttaagagacggaattctcactgtcacccgggctgaagtgcagtagcatgaccatggctcactgtagcctcaaattcccgggctcaagcaatcctcccggctcagcctcctgagttgctgggttataggcataagccactacacctagttaaaatctattttagtaaagagagttttttaaaacctgcttttgtcatttcacactttctcaataaaaaacaaactaagcatgaaacctaaatttaacatatgtagactttttactacttagaacagtcgtagtgtgtaaaataaaataaataatatggccgggcaccgtggctcatgcttgtaatcccagcactttgggaggccaaggcaggcggatcacaaggtcaagagatcaagaccatcctggccaacatgttgaaaccccgtctctactaaaaatacaaaaaattagctgggcgtggtggcatacgcctgtagtcccagctactcgggaggctgaggcaggagaatctcttgaatccaggaggcggagtttgcagtgagctgagattgcaccactgcactccagcctggcaactgagcaagattccgtctcaaataaataaataaataaataaacaaataaataaataaataatatgtaaaaattaatctttgcactaaattttcagattcttgttccattcccctcccatttgaaactacagctgtcttttgccactaaaaacagtacttcatttgacagctatggaaagagcctatgccattcaatagctggtttatgagaagcactgagtttatctagcaaaaacacaacatgtgtatcagtacttccctttgtcctgtgtattctaaatctctgccaaaagcagaagtaagaaagtacagagggacaggatatccttaaattattcagttggctttatgtcattccagacagaaacctagtgcctgattcatccttagaaatttaaattaagggccagttgtggtggctcacgcctataatctcagcactttgggaggccaaggtcggcagatcacttgaggtcaggagtttgagaccaacctggccaacatggtgaaaccccgcctctactaaaaatacaaaaattagccgggcatggtggtgcacacctgtaatcccagctacacaggaggctgaggcaggagaatcgcttgaacctgggagatggaggctgcagtgagccaagatggcgccactgcactccagcctgtcctggggctaaaaggtaggtcttcctcgtgagcagtctgtcactaggcaagctttgaagtgctgaagccttttccctaaagagaaatgaggaaatcctggtttttcaggattcacctattatctccaatatagctcttggcttaagagagtgaagttaagaagaaaagcatggacaccatttcttaaggagagtaacagaaacccagtacctccaaatttacttatagaacacattgactttacggttgtggccacattttgacgttcttgtccattttgatacaattttaatgcgtattatatatgcatattaagtcactgtacatccaatacagttcagcaaatattccagagaccctagtagtaggtgttgggtaactatgtttggtactgagactacactagcctttttgtgatgccaaaccacttaatttcaataagcctgttatctcatctgtgaagataaaactgatatttgcaaggctatggtgaggatttaaagagccagtgaatataaaggcctgattacagcaagttccttcactcaaacacagtgtttttgcttttttctttccttcttttttccttactaaacagacatagctctataatcttgaagcttacagtctagtagaagatagactattatcataaggaaataactatcaggataagaatactactattactaataatagtaaaagctaatacttatgtagaacttgttataattaaagcattattcctgttttttttagacaggggtctatgtttcccaggatagtctcaaactcctgggctcaaagatcctcccgcctcagcctctccagtagctgggactacaggcgtgtccactgcacccagctacggtactattctaagcactgtccacatttagctcattaatcaaaccttataacaaccttctgaggcaagtaactagggctatgataatgctatataaatatgtgggagtgaccctctaaactccactctcgagtagttggggaacgtaccttcttggaattaataatattagccaggtgaaatgatgcacgggtatgggcttgggatggtcaaagatgttctgaattaaaaagcagctacatgtatgaatgccctgaggtgaaaatgcacacatggatggatgatcaaagaaccgaaagccgttcagttcaggcaacgtatatgtaaagtatataagcaatctacaaatccacgtattaggcaacgtggtgacgggggtgatatacaaagagaggcacccgagtttcataaaggcaagaagagttggctgatggataaaccaactgggtggttggcaaaatgctggagaagcccacctgtcagcaacagcctgtactgggggatcctctgaaccggcttgagcaggtagtgcttgagggccagattagcacagcgagggctcatctgaaaggagaaggcatctaaattaacacagtgttttctaagaagcaagggacccagattcaagtgctcaggaagccaaactttaaacatcaagcaactctggaaggagattcgtagagaggctcccttttattttaaggtacagctgttagatacactgagagtgaaccccagccagactgaccaccaacctccaccctttcctgtaggcagtccctgaaaccatttgctcctaggaaaaacttgttaacaaccctctcaaagagcgtggtagccacagtctgtgtcctaggctagttagagcccaccctactcagcagctcccacttgtattgataaatacaaacaaatcccaatggaccaagaaggaaatgcatggcccctaaaataaggcagtggaaatacaactgccaggaattggattcaaatgataatcagagccttgtggtcaatatagtcaaaataatggtggtggcagggagaactgtagaaagtaaagataacctgaaaagcggccttgctaagtatcccttctttaagaagtctgaagaatgtaaaagtcttttgcagatgaatggccttataaaaagatagcccccaaatcacagcatttataggaacatttgattatggaaccacattttggcttgactacaaagacatttggttatcccttgaaacctctcttccttagtatgtacaacagacatctatctcggcccattcctgagcctcaccctcattctccaacctaagagtttactgtgaggtggcatcaaaaaggccaagtgaaaatgtccctgcatcctaagaactacaaaaaagagtcacgcttctaacatagcgcaagttggttgataagttttgttagatttgctcagacttttatcattttctaaatatgtaccaccactatctggtacacagagtgattatgaaattataatgataatgcatgttaagaaagtatctttcatccaagcatcattaacccagattactaattctcctggccttatggctccccgttttcttttgctaacaaggtaacacaactcactggactcttaccaaaacctgggtcaatcatcagttgccacaattacattgcactttgttttttgatagcacaaagacaacagaggagaggaaaagaagaaaaaattacagatgactttaaaatttaattatttgtctattgcacaaatcagaaatcagcaataccatactattttaaaaacttttcattttggttgggtgaggtggctcactcttgtaatcccagcactttgagaggccaaggtgggtggatcatgagatcaggagttcgagaccagcctggccaacacagtgaaaccctgtctctactaaaaatacaaaaatcagctgggcatggtggcacatgcctgaaatcccagctactcgggaggctgaggcaggaaaatcacgtgaacctcggaggcagaggttgcagtgagccgagatcacaccactgcactccagcctgggcgacagagctagactccatctcaaaaaacaaaacaaaaacaaaaacaaacaaacaaaaaaaacccttttcacttctagttttgtgtgactggaattcaccgatcttttaagcttcaaaacagagaagtactaaaatacagtacgcaaattttactccaaactgatggaggggacttgtgattttatctctaattaaatcagggttccaccctcacagctctgagttaaaagtcaaagctttggctgacacatgctctgaacaggttattactttttcttaactttggcaccaaaaccatgttatttatttatctaaagggaaatataaattctatttcccatccatcattgtaagttaattgttaggataaaagaagaagttaaattaaaagttaagacatgttccttaatcaagttcattgagtcagaaagcagaatggtggttgccaagggctgggagggaagagagaatagagttaatgtttaatgcctatagagcttcagttttgcaagttgaaaagagttctggggatctggttgcacaagaatgtcaacgtacttaacattactgaactataaacttgaaaactgttaaaatgctaagtttgtgttgtatgtattttaccacagtttaaaaagtcccatcaaaatattctttccagctaggcacagtggctcacgcctgtaatcccagcactttgggaggccgagcagggtggatcacctgaggtcaggaattcgagaccagcctggccaatgtggtgaaaccccatctccactaaaaatacaaaaaattagccaggtgtggtggcacgtgcttgtaatcccaactactcgggaagctgaggcaggagaatcacttgaacctgggaggcggaggttgcagtgagccaatctacgtgcgaatgtactccagcctgggcaacagagcaagactctgtctcaaaaaaaaaattctttccaagtcaaaatattcccatgtgcaataacagattttcaaaattaagtcatgtacattcttgagttctcaccatttaaattgttcaattccatctttgattttgaagggattactttttaactttttctttgtttgcaagctttgttttcaatgactgcaacttgttattaaagcttcaacaacaaaaagaaagagaagtgttcaacattagatagtagcaaatacctcaaattctctaacaacagcagcaaaacctggatttttcttgcactgttcatccagcaaggctatattcttatcaaattctttgatgtatgtggaatacatttttagatatggtcccttctttacaaagatatcagcaattctttgttgttcagtcctatggatagagaagagatacacaaaaaaatataaagagagattgatgaacatatgcaatgatacgcagagtccacatctaagccgccaacttatctttttttctcttcttgtaagacatacctcaaaatgcctacttttcaccatttccactgccaccatcccatcttgcctggactctaactggtctccctgcttccattcttgccctctccaaaccattcttcaacacaaggagagactcttaaaaaatgtttaccatggctgggtgcagtggctcatacctgtaatcccagcactttgggagccgaggtgggcagatcaccagaggttaggagctcaagaccagcctgaccaacatggagaaacccagtctctaccaaaaatacaaaattagtcgggcatggtggtgcatgcctgtaatcccaagacaggagaattgtttgaacccgggagggggaggttgcagtgagccgagattgtgccactgcactccagtctgggcaacagagcaagattctgtctcaaaaataaataaataaataaataaataaataaataaataaataactcactcactccttggatgggcacgatggctcacgcctgtaatcccagcattttgggaggccgagacgggcagattacttctgatcaggagtttgagaccagcctggccaacatggtaaaaccctgcctctactaaaaatacaaatattagctgggcatggtggcaggcgcctgtaatcctaggtacttgggaggctgaggcaggagaatcgcttgaacccggtaggtagaggttgcagcgagccgagattgtgcccactgcactccagcctaggcgacagagtgagacaatgtctcaaaagaaaaagaaaaaaaaaaaaaaacttcttacctggcatacaaaggcctgccctttctgacccctgtcacacttctcttcctcttccccatttctctcccaccacactggccttctttatcttctttggagacatggaattcatttccactatgcagacttccactaatggttctacatgcctggaaatatagaaccctggctggctgctcctttcctttcagatatcactgtaaatatgccaccttcacagagggctttccctgaccactcaagcttcatttgctaccacagcgtcctatttcaggtctctgcaactcagaaactgcttctggtagttttcttgtctatttatctggtccttcccctactaaatgtctgctccatgaaagcaggatgtctgttttgtgcactgtgatatcctctgcatacttaagagcacagactagcacatagtagatatgcaaaccttcttgaatgtgaaaataaaatatttcatcaattgttgttaaaagccaatggaaaaatgttatttcagaaagtcaactaacaccaaagaatatgtattgacttgaaccctaagagaaaaatattttaataaatagaaaattaggctaggtgcagtggctcatgcctgtaatcctagcactttgggaggctgaggcgagaggatcacttgagcccaggagcacaagaccagccaaggaaacacagggcaacctgtctctacaaaaaattaaaaaaattagccaggcgtggtggggcacacctgcagtcccagctacttgggtgggtgaggtggaaggatcacttaagcctagggaagtcaaggctgcagtgagccatggtcacaccactgaactctggcctgggcaagaggtgaaaatctgtctcaaaaaaaaaaaatcggaagcaaataagccccaattttttttttttaacttaagaaaaaaaaaaagatttgttttttagtagagacaaggtttcaccatgttggccaggctggtctcaaactcctgacctcagcttatctgcctgtctcggcctcccaaaatactgggattaaaggtgtgagccacagcgcccagccagttatattttatttctatcatgactttttttttttttttaaaggagtctcgctctgtcacccagaatggagtgcagtggcacaatctcggctcactgcagcctccgcctcccagttcagcctcccgagtagttgggattacaggcatctgccatcatgtctggctaatttttgtaagtttactagagacgaggttttgccatgttggctaggctggtctcgagctcctgacctcaagtgacccacccgccgcagcctcccaaagtgctgggattacaggcatgagccaccgtgctcggcctatcacgacctttaaagactacattttagtcatttctcagtcctaaattgtgtattattttatacttaggctacggctatgtattaattgcttatctgccatatttacccaacatatagaggcaagatatttccaaaacaagcagaggtatttttctggtttatatataaagaaagcttagagaaattttgaacatgaaagtaggtgatactattttcttattctaatcatgttgtgttccccatggttttcaacagtaaattcaatcctcctacacccatctttctacattatttccacagaagtcaccaagcctctgcatacttattttcttcagcctagtggaagtagcttccaataccaaccttttggtattcttttcctattcttaaatctacagcttctacaagcatgtcatacatatataaatttgcctttctttgggaggccaaggcggatcacctgaggtcaggagttagagaccagcctgaccaatatgatgaaaccccgcctctactaaaaatacaaaaattagccaggcatggtggcatgcgcctgtaatcccagctacgcaggaggctgagacagaagaatcacttgaacctgggaggcagaggttgcagtgagctgcgatcgtgccattgcactccagcctgggcaacaagagtgaaactccatctcaaaagaaaaaaaaaattgcttttccaaaacaaccatcctattatttcagtgaacggcctctttttcaaaactggaaagggagtttcatgacctgcagctccagaaggtaaataaaacatttagaaactattctaatgtgaatatagcatatagcatctatctacactgaatctcaaaaatcttgattgcccaagttcacctatagaaatttaaatcggctgcatcttgcttctgaggcaggattacgaaagatttgtttaaaataatagtattgagcttggtgtgccaaggttgtgaattttgggccattgaaaataatcaatctggtcaggcatggtggctcacacctgtaatcccagcactttaggcagaggcaggcagatcacctgaggtcaggagttcgagaccagcctggccaacacggtgaaacctcatctctactaaaaatacaaaaaattagaaaggcgtggtggcacacgcctataatcccagctactcgggaggctgaggcagaagaaacgctggaacccgggaggcagaggttgcagtgagccgagattgtgccactgcacaccagcctgggcgacagaatgagaatctatctcaaaaacaaaaaacaaacaaaacaaaatcaatctatggataactgcaaagacaatatattcaaacaactcaatgtaatgaaaatatatctctgtcacatgtggggcccttatggcttcatctaaaattggaaacactaggaaaatctgaaaacggtccatttttaccagtgcaacattctttcctccagttccttcaagagatcccggttgagctcatacagctgaggcaagtagtataggatctgatttagaatccggtcctcaatcactggtttcccaagttgcctggaagcatgagctactgcatcccggaaatcctattacagtccagagcaggaaaaacaatacacacacatgtaacttgataacaagcttttatcctcagtccccctcctccctaaaatgatacagattgcacagctgtatttctcatgcagaattacaaatctaaagtacccccttcctcctaccccactcacctagataggaaattaaaaataaaaaatagtgagacgattatttgattttcaaacatactatatgatatttatcttaaaccttttagtttgatctctaaacttagcaattatactaagcgagtgtctggaaattgtaatgcaattctaaatagtctttagaattattccaataccatcaatataaacacaatccatttattttaaaagttcccaggagatcttagctaattttattctggatttaagagtcccactgtccactttcagtcatcatttcccaacaactggagcatcctaggtgaggcatgtggagagaggcacgtgttgtgggtctccctctgtcatccaggatggagcgcagtggcccaatctcagctcatggcaacttcccgagtagctgggactacaggcgcgtgccaccatgccaggctcacttttgtatttttttttttttttttgagatggagtctcgcactgtcacccacgctagagtacagtggcgcgatcttggctcactgcaacctccgcctcccgggttcaagctattctcctgcctcagcctcccgagtagctgggattacaggtgcccaccaccacacccagctgattttttgtatgtttttagtagagacggcgtttcaccatgttggccaggctggtctcgaattcctgaccttctgattcgcccgcctcagcctcccaaagtgctgggattacaagtgtgacccactgcacccagcccatttttctattttttgtagagacaaggtttcaccttgttgcccaggctggtcttgaactcctgagctcaagaaatcctcccactagggcctcccaaagtgctgtgattataggcatgagccaccgtgcctggcaggcacatgcttgataatcagaatcctggatccaagcctttgctccttatttactgtgtttccttgggccagcctgatttccctcatctgctaaatgagtataatactagttatgagactttaattagatattgcacataaaactttttttgcaatgcagttggcacacagaatgaaacattttaactctggacctgaaattctcccctccctcttgtcaacctctcaataaattcaccagggtttacacttttcacaaataagaatctttctcttcacctattatttttcatttactgttctctagactatctgtaccatgttttaatataggtcaatatcaccgcaccctattactccagagcacttggaaagggtggggtaggagataagtatttgcctagatttcattgtcccctaagggtgggcctcaagatataagtaaaacagagtgaaatctgttccacagtcctgaggattcaaaaacaaagattttttcctttttagaaacagcagttttaattaaaatctgaaagcaaagtttgggtaaatgactaataggccttatcttcccttacctttatttccaactgctttcccttcagggatttaccgggcaaatgaaatcaaccaaaaaagtatactgttccttccaatgatcctttcaacacctgcccctaacatacatatattaaccatgaggtttgtttttttttgttttttttttttttaactctggacaaccaaaaacctcatagataacttaaagtatatgaaaggattctttttctaaaggatggctattttgaagaagtccagtcctcttatgcttaatcaatgctaaaaaacctttcacttaggactcagtacctgggactaagtttattgatcccacagtcacattagcccaaaggagccaactactcacaccagtaactaaaggactaacttgtatacctaattagtatcatataaaataagagcatttaattctcatagtattataagctctaatccagaaaaccactcagaacatctccagaaaccaaatggatatcagccatatttcacctcccaacagcttgcttcaatcagcactcacatttactaagagaaaatagagccacttaacacttttgaaaatcattaggctgtctgctatcatgcagggctatagaatacatttacacatcatgaataatgtattcaaagcagaatagttaaacatcctctatggttatcttttttgcttttgttttgaccagtttagtgattaatataatctggatgcaagagttccttgctcagcaaagcaataagcgccaccctttcttctggtggagtaagtaatggctatatttgtctcctggcagcaggataacttttgtttcccagttggaaggtatttcctctgccatgacagtgacagtgatgttagctgctaagtaacttaaggacccggtttgacacagcttttgccagaccctgcattccatatgtctgccaccattgccaaaaagggaacttgtttatttaagacgcatttaacagagaccagccaaatacaaactgaactgaccagtgagatggctgcctctaaatggaggcccttgtcacacaccaggcaaaactctgcttttcccagtactactggatgttttcaggtagctcggaatggactgatggcccacaatgttttcttttaaattaaaagcagtatgtcagaataaaatagaaatttaataattaaaatagcagaagtacacttaataaaggctataagaattttgagagtatatatccatgaaacccacagagttactttttttttttgagacagagtttcactctggttgcccaggctggagtgcaatggcgtgatctcagctcaccacaacctccgcttcccgggttcaagcaattctcctgcctcagcctcttgagtagctgggattacaggcatgtgccaccacacctggctaattttgtatttttagtagagacagggtttctccatgttggtcaggctgggctcgaactcccaacctcaggtgattcacctgcctcggcctcccaaagtgctgggattataggcatgagccacggcgcccagcttacttttttttttgagaaagagttttgctcttgttgcccaggctggagtgcagtggtgcaatctcagctcactgcaacctccacctcccgagttcaagtgatttctcctgcctcagcctcccaagtagctgggattacaggcgcttgccaccacgcctggctaatttttgtatttttagtagatacggggatttcaccatgttggccagctggtctcgaactcctgacctcaggtgatctacctgcctcagcctctgaaagtgctgggattacaggcgtgagccaccgcacccggccttttttttttttttttttgcgacagagtctcgctctgtcgtccaggctggagtgtagtggtgcgatctcagctcactgcaacctccgactcccaggttcaagccattctcttgcctcatctcctgagtagctgggattataggtgtgtgccaccacatttggctaactttttgtatttttagtagagatggggtttcaccatgttggccagactggttttgaactcctggcctcaagtgatcttcctgtctcagcttcccaaagtgttgggattacaggcgtgagccattgtgtccaaccagagaattacatattctaagtaagcactcggcaaagattctgtactggtcaggttcctgaatcttttcttaggcccatctgtgcactttcttgtaaaatccagttttagcaagaacctcccaccctttatattgttcgggttcttcatcctctaccattgcccaggtgatgtatgatcaccctggctggtccgtcttcagcaagaatcctcttaagttggtttagccagaatctcccctgctcctgaagtttcttgttagtaattttccatccactaacgcccactttgctcctccttggctataaattcccacttgcccgtaatatatttggagttgagcccaatctctctccactactgcaaaatcccattgcagtggtccctatgtctgttgttttttgtttttgagatggagttttgctctgtcgtccaggctggagtgtggtacgatctcggctcactgcaacctctgctcttgggttcaagcgattctactgcctcagcctctcgagtagctgagattacaggcatatgccaccacgcccagctaatttttatatttttagtagatatggggtttcaccaggttggccagactggtctcgaactcctgacctcaagtgaaccacccaccttggcctcccaaagtgctgggattataggcacgagccactgcgccaggccccctatgccattgtgatagtcctgaataaagcctgccatactgtgcttttgcttcaacaagtgtcactgaataattgggctccactcccaattttggcctccataaccacatgcagcagccctggccccagtctcattccctcacctcttgggccaccatttcctgacagctgtgtgctacagccccaatgccagatgtaactaattcacacaggaaccacacgcagaatctttaacttctcagctcttcacgaacctcagccattgtcaaaactggtgccactgggaggaggtgacatcttttttttataaaaggattattacaacatatgtctggttatttttctaaatgttaacaaccaggataatttgggaaagtgtgatgacacttaaaagccagaggcaaagctattttgaggcagaagaatctaaattcactaacacctccttgacaaaatcggtgaggatgcaagacagcaggattagctcttcaaaagttagatccagagtttaatttttcacactggaaaagctgggtaaataaaatattaaaatagtggggggaggagttaagagtgtgaaaatgttagttagctatagagtttgttagcatcaagtacctcgacttcatccttacaacaaaacctaccaaagattctgcatgcaaaattgaaccacctacactgtagtttctggtcataataaccaaatgcttgtttaatgtggaatttgtagagctagaaatgggcctctgaattatgaagcatatgataatattattcttactaattccccaaaacctacaaatcagaatcagattaactttaagttgatctttaattcttttgagatattaacataccagcttggccagctcgaatcacttagggaagacctaagcaaaaaatcaatgcaaataaaatcaagtatgagcatctgaggcaatgaagcacaaaacagatggccttgttcatggggtcaggttttatatctccagcaccaatgaggggtatgtgacttaattaccagctgtcctgacccagctgcctgacctcagggcattactgaactactatcatgacacaatgaattacaaagaccaaatgaacatatggacagacatggagccctacaaggttccctgtcctcatgaaggacaccaggaatcacttcactttaagcaaaagcaaagcagctgtggaggtcaaagtgctatgataaatatgcagaaatgagtgtgaaactatggagtaaaagtagaggtgggaaagtccccacattaaccatttgactttgtttttaaaataaaaatattttcccaatgaaattattcttccctctctatatgtagacccagtgatacggtatataatcatcagtggtgcataatcatcaatgcaaaactgtagaaaacataattgaaagcaatcttttatgtctagtttccaatctcctttaataacactaacaagtaatcatcataataactctaagtgaccaaaatctagcttcattgtcatctttagaagatgaaaaataagtttctctggtttccagggcaactaaaagaattctgaaagcaagctaatatatccaaagatacactatatcctatacagcatggtagagatttcaagtaataattttcaatcaattgctaaagaacaactaagtacaagggctcagacagaccagacttgaaagtctggttttcctattaagtagtgggttatttttgacagttagcttactttcttcattgaaaaaaataggaataacatctatttgacagggttgttacgaggattaaaacagataattgatgtaacatagcatgctgcaaggaacatagagagcacttaatagaacaccatttatttaactaaaggggatttggttaagttaaatgattagatgaacatcatttaagatccacaagtcaccttccctccctctctccacaagtccctgaaggcttggaaagacagctgtgaaacagaggcatctaaagagaaggaaataccaaaccaaggtagggaaaacacctcagcagcaaaacaaaggtactctgaacaatgagcttcattcagtgaagaacagttctcacatgaaagaagctgctccagagtgaaggtttggtagccatgtcaacagaagctagagaaagattctttacaactaaagaaaaaatgctgaaaatggttcacaagactcaaaagtcagggtgtattcagtgaaacagcatgaagtgattttaacatggaaaaaaaaatgagaactgagaaagtcttctattccttttacaatgcaaaaaaaaaaaaaaatctatttagtaacagacatctggatccaggcctagggtagccttgcctctggctctatggattttattgagtctctcaaattttcaaggaaatgtacgtctccacctaaagaaattagtgaagcaaagatgcttcattactaatactatatagccagtccatctttgtctaaaaaatcccttccaaatatatatataatataatatatagcatatattatattatatattatataatatatagcatatattatattatatattatatattatataatacatagcatatattatataatacatagcatgttatatatattatataatacatagcatatgttatattatatatattatatattatataatacatagcatatgttatattatatatattatatattatataatacatagcatatgttatattacatatattatatattatataatacatagcatatgttatattacatatattatatattatataatacatagcatatgttatattacatatattatatatattatataatatatagcatatattatatatattatataagatatagcatatattatatatattatataagatatagcatatattatatatattatataagatatagcatatattatatatattatataagatatagcatatattatatatattatataagatatagcatatattatatatattatataagatatagcatatattatatatattatataagatatagcatatattatatatattatataagatatagcatatattatatatattatataagatatagcatatattatataatatatagcatatattatatattatataatatatagcatatataatattatatattatataatatatagcatatataatattatatattatataatatatagcatatatattatataatatatagcatatatattatatattatattacatatagcatatataatattatatataatatattatattatatagcatatattatataatatattatataatatatagcatatattatattatatatagcacatattttatatatatagcatatattacataatatatagcatactatataatatatagcatatattatatataatacatagtatattatacatcacatagtatatatcacatatattatacataatatatagtatattatatatagttttatatagtattatatatatataatatatatagtataatatgtataagaatcccttgagcctagaagttcaaaactgtagtgagctgattgcaccactgcactctagcatggatgacacagcaaacccttttttcaaaaaaaaaggacaatattttgtcaccctaacaaatttgttgagtgtcaagcttattgtcatttcatataaattatgtttgataaataagtgactatacatatagtattatatatagtatatatagtatattatatgatatataatactatataatagtaatcattatatataatatatagtacatatactatataaaatatgtataatatataatagattgctatactacatatcacatacactatactatataattatatatacaatacaaagtatattatatatactacatatcatactatatattatatagtatactatatatgctatatattacacacacacacacacacacacacacacacacacacacactttttttttttgagagggagtttcgctcttgttgcccaggctggagtgcaatggcacaatctcgactcaccgcaacctctgcctcctgggttcaagggattctcctgcctcagcctccagagtagctgggattacagacatgtgccaccacgcccggctaatttttgtatttttagtagagacggggtttctccatgttggtcaggctgtctcgaactcctgacctcatgtgatccgcctgccctggcctcccaaggtgctgggattacaggcatgagccaccgtacccggcccaaatatttttttaaatgcagactatttgtacgtttacataatatttttattgagatatttactaaggctagctcccatcagagagcaataagacaaccaaaaaccttcctattaacttgtacttaattatatcagatgtctacggtgtggtggggatgttcagggcagagcagcaaatatacaagaaattcattttgaaaagccacttatttattaaacatattataatttatatgaaatgacagtaagcttgccactcaataaatttgttagggtgacaaaacattgtccttttttttttggaaaaagggtttgctgtgtcatccatgctagagtgcagtggtgcaatcagctcactgcagttttgaactcctaggctcaagggattcttttggctcagcctcctgaataggtgggattataagtgtgtgctacccatgcctagctttgtcctatcattaaaaaaagaaaatctattacaaaagagaactggctgggcatagtggctcatgcctgtaattccagaactttgggaggctgaggtgggcagattgctcaggagttcgagaccagcctgggcaacatggctaaaacccatctccactaaaaatacaacaaattagcctggcgtggtggatggctgtggtcccagctactcaggaggctgagatgggaggatcgcttgagcccaggaggtagagcttgcagtgagtggaaatcatgccaccgcactccagcctgggtgacaaagtgagacactgagtcattaaaaaaaaggagagagagaggaagagagaacttatcaatattaccaatatagccaaaaatcaatgtgagaaactattcacagggaaatattttctcaaaacacattagcaatgttaagaatttttaaagaatttccaaagctacagatttttcacataggaatcaggcccctatttttgttttgttttgttttgagacagagtcttgatctgtcacccatgttggagtgcagtggtaccatcttggctcactgcaacctctgcctcctgggttcaagtgattctcctgcctcagcctcctgagtagctaggactacaggcatgccaccacacctggctaatttttgtattttagcggagatgggttttagccatgttggccaggctggtttcaaactcctgacctcaggtgatctacccgcttcagcctcccacagtgctgggattacagtcatgagccaccacaccatgccaggcccctgggtttctgttggaccaagtacagagcacaggtaatcatttagtgaatgtgaatcatgcctaagtgtaacttacttttcatgtttgtatgtatccattcaaagaaaacctgaaaataatgatactgtttgccaagacttaaatggatgtatatttggtgaacctttcatttctccacaattaagcctaatttatgatgttaataattacaccacataagtaaactgtcacttcaactccttttttcattttcatctaccttttccttttgttttacccctttcttaagtcttaatatcttgcctaaatataattgaaataaagtaaccctaaaagcactttaactgtcaatgcataatgaaacttgtgaaaacctgcaaggacaaaggagtgcatgagaaaaatgaatatgcaccctgacacatatcataattctttcctaacaagtctgttcaagttgacaattataggctggctgcagtggctcatgtcagtaatcccagcactttaggaggccaaggcgggttgatcacttgagcccatgagtttgagatcagcccgggtaacatgttgaaaccccatctctacaaaaaatacaaaatttagctgggcatggtggtgagtgcctgtagtcccagctgctcaggagcctgaggtaggagaattgcctgaacccaggaggttgaaaggctgcagtgagctaagatcgcaccactgcaccctagcctgggcaacagaataagatgctctctcaaatcaaaaaaacaaaaaaaagttgaccatttaaaaaacagaaaatagaactaaaacttagttgtaaaaatgtctatttctaatctctcctaaatggaggtagtaaaaggaaaaatagtaagaaaattgcctatttcaaatctgtttctgggagcttatttaggtaggagaaaaacacttttggacaatgataatgatgctcttcatgtattgctaatgcaaaactctaacagcaagtatcttcagcaaatgcctaagaaaatatattatcaccttcaaaactgttatgaagacataaagtttgaagactttggacatatagctactaagactctttcagaaatcatgttatctacatatatgaaatacatacattttagaaaatgtctatcattaagttagtaatgctgaaaacttctaggggtagggaaagtacaaaagggaatagtcttagacttcaagaaaatattagcagatacttacaatatgcaaaagttttaacacatccacaaacctgtaaaaaacaacaatgaaaaaaatgttttaaatgtgccaatggggggaaaacagtcttctgaattgtaaactagatacctacactttctctgagctcatgatctccttggcaatatgatgaactttacttttcattccattatcttcatcctgtggataagagcacatttaacatgaactcataaaagaataatgaagatcagctatgagctagtcagacacgaattttaactctgatacttgtaagtttcctcctagcacacagttcataccatataacatttcaaatggcaaacgtggagaattggatgagggataaaccatgtcacaggaatagctgagagcaatcagtaatcttcactgtcattagctggattgatgaactgccctgagtagctccagaaccttgctgggatgcaaccatcagtggttcaaaatggaagtcacaaactaaaaaggctacaggggaagtggccccttacagatagataccagaagaagactcctttgggtgtgtacaaataatttaagaatttggctgggtgcagtggctcacgcctgtaatcccaacactttgggaggccgaggcgggtggatcacctgaggttgggagttcaagaccagcctgaccaacatggagaaaccccgcctccactaaaaatacaaaattagctgggcatggtggctcatgcctgtaatcccagctgctcgggagtctgaggcaggagaattgcttgaactcagaaggcagaggttgcagtgagccgagatcgcgccattgcactatagcctgggcaacaagggtgaaactctgtctcaaaaacaaaaacaaacaaacaaacaaaaataattagttaatatccaataggaatgtagatgagaacttcaccataagtaaaggtattttaactcacaacttaaatatagtctgaacagggctcttcttcaatctataacaaatataagtcaaaattacagtcacaggctctccgaatttccttaaaatcccttttagatatatgcttagagagtcaaggcagttttatgctaaggagctgaaatgaaattcgtgtgtgtgtgtgtgtgtgtgtgtgtgtgtgtgtgagtgagagagagaagagacagagagagagagagacagagtctcgctctgctgcccaggctggagtgcagtggtgtgatctcagctcactgcaacctctgcctccggggttcgagagattctcctgcctcagcctcccgagtagctgggactacaggtgcgtgccatcacgcctggctaatttttttgtacttttagtagagacggggtttcaccatgttagccaggatggtctcgatctcctgaccttgtgatctgtccaccttggccttccaaagtgttgggattacaggtgtgagccactgtgcccggccatgaaattcttttattatggactactttgtataaaaactaaatgccctagcaggaacaaaaaaaatgtgcatctttaacaaaataataataaagatgactcaaaaagaggtctcagtatttaggtgaatttgttgttgttgttttcaataaaatatcgagagttggatttagttccagggaaatcagagaaaaggagagaagcttctctccatttatgttccagttcaagatcagaacactacagttccacagtaaagaccaaaaagagtaaataaggaacaagcaagtataaattttagatgttacacctaaggtgaaaatgatgactgctgacattaaaacgaaaatgcttggatgtttctttgaagaaacgtcagacctggttttagaaagaggtctctttgcattctcgtaggcactggcaacaccaggacacggttattttgtgctgaccagggtgcagctggacaaggcaatgacatgataaacattaaaaatgaccatgacagtccagcagtcattcattaatgaaatgccacaggaaaaaaaaatatggtagcaacttctctctaaagtagtcttctttttaacattggaatcatggatctagcagatctgtttccctgagactcactgtgatggatcacatgactatgttagttcttcatttgggaaaatttttttttcttttttctaagtttccacatacaacactgagggaaaaaacttttttcgactgcttccagaatttcagtgtcacaaccaaggtaaaaaaatagatgcaggtttaacaatgaaacccttctgaaaattacattttaataaattaaaaaaaatatgactatatatgttccatacatacactgaaacccttttatttgttactttattaaagcatgggtgatgttcaagtgaataaatgaggagaggattcctcaaggttttatagtatgttaaaatttagatttttaaaaactgtaatcaggccgggcgcactggctcacacctgtaattccagcactttggcaggccgaggcaggtgggtcacctgaggtcaggagttcgagaccagcctgactaacaaggggaaaccccatctctactaaaaatacaaaaaattagctgggtgtggtggcgcatgcctgtagtcccagctactcgggaggctgaggcaggagaatcgcttgaacctgggaggtggaggttgcagtgagccgagatggtgccactgcactctagcctgcgcaagaaaagtgaaactctgtctcaaaacaaaacaaaacaaaaaacaaaaaaaacctgcaatcacttctatgctcacaagaagtcagagaactataggggaaagttttatttttgcattcattctttttattatattgagaaccattagaatcataaatagtagtcagtcattagagtgaatgaagtcaaacacagggactacgtaaagtgagagttggaccaagagcacagtcccaaagaacacccacttaaaatagggatttgccaagactcaaagttgactatttgttgtgggaagtcaggaaccccaaatggagggactggctgaagccatggcagaagaacataaattgtgaagatttcacggacatttattagttccccaaaattaatacttttataatttcttatgcctgtctttactgcaatctctgaacataaattgtgaagatttcatggacacttatcacttccccagtcaatacccttgtgatttcctatgcctgtctttactttaatctcttaatcccgtcaccttcgtaagctgagggggatgtatgttgcctcaggaccctgtgatgattgtgttaactgcacaaattgtttgtagagcatgtgtgtttgaacaatataaaatctgggcaccttgaaaaaagaacagggtaacagcaatgttcagggaacaagagagataactttaaactctgactgccagtgagctgggaggaacagagccatatttctattctttcaaaagcaaatgggagaaatatcgctgaattctttttctcagcaaggaacatccctgagaaagagaatgcatccctgagggtgggcctctgaaatggctgcttcggggccggcagtcttttatggtcaagctgtagggatgaaataaaccccagtctcccatagcgctcccaggcttattaggacaaggaaattcccgcctaaaaaatttttggtcagaccggttgtctgctctcaaaccctgtctcctgataagatgttatcaatgacaatgtgtgcccgaaacttcattagcaattttaatttcgccccgtcctgtggtcctgtgatctcgccctgcctccatttgccttgtgatattctattaccttgtgaagcatgtgatctctgtgacccacaccctatttgtacactcccacccctgtagaaatcactaataaaaacttgctggttttacggctcagggggcatcacagaacctgccgacatgtgatgtctcccccggacactcagctttaaaatttcccacttctgtactctatccctttatttctcagaccagccaacatttagggaaaatgaaaacaacctacgtgaaatattgggggtgaattccgcccaatatctggctgaatttcccccaataactattagcacagttggaaaaagaacccagatttcccaatatttaacctacaaataattttattacaccttgaatctctcttcaatatctgccagtaatctcagcatatccttacaaataattactgctaaacctaatacccacacatccactctcccaccaagatttaacaaatccaaacattctgaaatacttgttttaaatctttctgtgaaacaaattgttaaattatgatattaaagttctcttcttcctctgacagaagtagccactaatcttacagtttgtgtatatttgtcccttcatgttttcttactttactacagaataatttatatgcaataccaagaaatcctgacccttccataagaatataaatactgggctgggtgcggtggctgacgcctgtaatcccagcactttgggaggctgaggtgggtggatcacctgaggtcaggagatagagaccagcttggccaacatggtgaaaccccgtctctactaagagtaccaaattaccctggcatggtggcagatgcctgtaatcccagccacttgggaggctgaggcaggagaatcacttgaacccaggaggcagaggttgcagtgagtcatgatcgtgccactgcactccagcctaggcgacaagagcaaaactctgtctcaaaaaaaaaaaaaaaaagaatataaatactgttatgcaaaaaatattcaaagaaggttgtgaaaccaactacttgtgaaaataatctttaaatggattactaattcagagtccagtctaatgagcctaggatacttttttcatgctactttaccttagctctcaaactctactgctaaaaggacaattagatagacagatgaatatgacctctattcctgttattattcctctttcctaatgatggagactaccaggttggatatgttttactcaactacattcactcactttttgttttgagacagagtctcgttctgtcgccaggctggagtgcagtggtgcaatctcagctcactgtaacctccacctcccgggttcaagcgattttcctgccttagcctcccgagtagctggaactacaggcatgcactactacactcagctaatttttgtatttttagtagagattgggtttgaccatgttggccagcatggtctcgatctcctgacctcgtgatccacctgtctcagcctcccaaagtgcttgctgggattacaggcatgagccaccgtgcctggccatacattcactcacttttttttttttttttttttttttaacacagggtctcactgttggtcaggctggagtgcagtggcgtgatcttggctcactgcaatctccgcctcttgggttcaagcgattctcctgcctcagcctcctgagtagctgggactacaggtgtgtgccaccatgcacggctaattttttttttttttgtatttttagtagagacggggtttcaccgtgttagccaggatggtctcgatctcctggccttctgatctgcctgcctcagcctcccaaagtgctgggattagaggcatgatcactcaccttttaaactacacatagctatattcctcaggaagactgcagtcttaagcacagtctgaccttgacctggcagaccacatatcaggcactaaataatcatgattacataagtgtctacacacacatacacacacacacacggataactgttattttgaaaacatattttagcaagtccaaacttttctatcacaatggggttctccatataatctgtagatagaaaagtttaatgtttacaaaatacagtgtataaattttaaattagaaatgggcttggcatggtggttcatgtctgtaatcccagcactttgagaggccaaggtgggaggattgcttgagcccaggagtttgagaccagtctgggcaacataatgagaccatgtcgttagtaaaaataataataataataataataacataaataaaattaaaattacaaatgcattataagtgagaaaaacagaaaccaaaaccattcagggaactgaagccctgactcttcatttccaaataatgtgacatcccttaaaggtcaagagcggatcttatcagtagctttaaagaaatgcaggcacactatagatgtggaagcatttgactactggagtcagctaaaatgtgcacgagctcgacacaaaaatttcaagtagctgttaatttatttttggcacctaccctttgtttcctctcctctttttatcactctccttttgttaggtctctactctgtaacttttttttctctccttctcaggaccttgctctgccagggcctgcattacacagacttgtgtagaggaggctactccatacaaaaattaactaaaaatgtgaaaactgtaaaacttctagaagaaaacattttaaaaaatccttatgatcttgaattaggcagagttattagatatgacaccaaaagcataactcatgaaagaaaaaaactgataaatggaacttcataaattgttcatgcttcaaaagacatcattaagaagataaaaagataaaccatagactggagaaaatattcgcaaatcatgattctgagagagaattcgtagctagaatacattaagaactctgatagggctgggagtgttggctcatgcctgcaatctcatattttgggaggccaaggcaggcagattgcttgaacacaggagttcgagacctgggcaacagggtaaaaccctctctctacagacaatacaaaaattagctgggcatggtggtgcacacatgtagtcccagctactcaggaggctgaggtaagaggatcactgaacccaggaggttgaggctgtggtgagccatgattgagccactgcactccagccttggcaacatagcaagaccctgtctttacaaaataaaaaaataaaaaacaattagccaggcataatggcacacacctgtagtcccagctacttgggaggctgaggtaggaggatcacttgagcccaggagtttgaggctgcagtgagctatcatcacaatattgcactctagtttgggtgacagggtgagaacctgtctcttaaaaaaaaaaaaacaaaaccaaactctgataactcaatataactcaaacaaaaaggctgtgtgcggtggctcacgcttgtaaccctagcaatttgggaggctgaggtgggaggatcacttgagcacaggagtttgagaccagcctgggtaacaaagcaagacctcatttctattttttttttaattaaaaaaagagataaaagatgtgaatatgtgaagaaacatttcacagaagaagatataagaatgggcaataagtatataaaaacttgttcaacatagttattagggaaatgtaaattaaaaccacaatgatatacttcacacccacacaatggctataataaaaaaacaaacaaacagtaaatacctagtgttggtgaggatgtggaccaactggaacctttatatattgttggtgggcatggtagcccctactcatacggtgtgaaaaatgaaaaatagctcagagcaaactgagctatgtgaggtatgcaaaatttatcaggcccagagaaacatgggtatgagacttcagtgatggcccaacccccatgcccaggtgcaactgtttgaaggcatttttgtccctgaccagctgcctccacccatagtctccatgttcctagaatttgtgaaacaaagaacaatgtaaagtcaatcaaacagcttatgatattttaatataaattactgacaaacaacttaggaattgcctcttcttttcctttaaaaaacccacctgtgtgggaggctgaggcaggagaatcgcttgaacccaggaggcagaggttgctgtgagccaagatcatgccattgcactccagcctgggtgacgagagcaaaactctgtctcaaaaaaacaaaacaaacaaacaaagaacccacttgtggccaggcatggtggctcatgcctgtaatctcagcacttttggccaaggcagccggatcacttgaggtcaggagttcaagaccaggctggccaacatggtgaaaccccgtctccaccaaaaatacaaaaattagctgggcatggtggcacacacccgtaatcccagctacttgggaggctgagacaggagaattgcttaaaccaaggagatggaggatgcagtgagccaaaattgcatcactgcactccagcctggatgacacattgaaacttcatctcaaaaacaaaaacaaaaacaaaaacacccacttgtggctgggccaagtggctcacacctgtaatcccagcactttgggaggccaaggtgagcggatcacttgaggtcaggaatttgagaccagcctggccaacatggtaaaaccccgtctccactaaaaatacaaaaattagccaggcgtagtggcaagtgcctgtaatcccagctactaggtagcctaaggcaggagaatcactagaacccaggaggcagaggttgcagtgagccgagatcacaccactgtactccagcctgggcaaaagagcaagactctgtctcaaaaacaaaacaaaacaaaaaacccacttgtaactgctcctaacaggagtcttggatctatgctccaggcttgtagtcctcaaatttgacccaaataaactctctacttacattaagtttgctcattttttttcccattaggtcgacagggttttcttctgtctcctaatgtcactgagcacagaattcatatttcttctccttgttattctgagatcattttcaagagaaagatgtcagtaccatctttacactttcattttaaaatctgaagttagtaactgactttctgtcatttgatagcaaagttaataagaaaaaactgttctaccacccgcccattcactgctctacatataaatttgaaaacattagtgatcattagaatcacaggcagatcttaaatttcagattcccaggtactgtcttagaaattctgattgtgtaggtctaaaatggagcattaaaagtaggtgttagaagaaggaattacacagggcaccatggttcacatttgtaatctcaacattttgggaggcaggaggatcacttgaggccaggaattcaaggccagcaaggacaacatagtgacacctgaaaaatacaaaaaaaaaaaaaaaaaaagccaggcatggtggcatgtgcctgtagttcctaatcacttgagagactgaggtaggaggatcacatgagcccaggagttcaaggctgcaggggactatgataaataagaatagccccagttggccaggtgcggtggctcacacctgtaatcccagcactttgggaggctgagacaggtggatcacttgaggccaggagttcaagaccaacctggccaacatggtgtaaccctgtctctactgaaaatacaaaaactagctgggcgccgacagtggtgcatacctgtagtcccagctacttgggaggctgaagcatgagagtcacttaaacctgagaggcggaggctgcagtaagtcaagattgcgccactgtactctccagcctgggtgacagagtgagattctgtctaaaaattgaatgaataaataaataaatagccccagccttcaagaagtgaacaatggaaacgaactgaacatacaaataactacatataagcacaactatgaaaagtgctgccaccttgaagaagagaaagaccataatcaggcagaggtgtgtcaatcaggaaaggcttcacaaagaataaagcatttgatgactccaaatcaccgtttaaacacaatccatcagctactcctatactagctactgtagataccaactcattaatgccagaaacctggactcttcttttttgtccccatagtcaccttttattattacaactgagtcaagtcctatcaatgtgtcccgaagatttaaagcttaaatgatcctttcctctcctttgatgttgcctccttacctcttgccctcactattacagcaacctaaaaggtttccttggctctgtgtttaccccactgcaaccccttctgtacactgccactagaatatttctaaaatgcaaatataaccaggttagttctcaggctaaatgttagcagctccctatcacagatggataacaaagattcaagtttctttcgccaagggtattaggcatttctcaacatgtccactcaccttcaccaggcttctccctcctcctccacactgtgtactctctaacccaccacgctgcaactccagccatgctctccccttctgtgtctgtccctttgcgcatatacctttccttttgccttgacttgcttccccagcacttctccttctccctgaagatttctgcctttcatattccaaacgtcctttaagacaacactccaactttttttttatgatggctcccttgacattctttccctcctactatcaaaggacaagataattttcttattcatgtaatatttataggacttaacccagtagactgtgtttacttgctgaaatgtctgaattccctctagtctccgatctaattcaccctgtatccttctgcacatagcacgctgcttggtccactgtgcaattaatatttacgaataagcaaatgtgtataaggatggctgccaccttctcagaatctgagacagagcatattgcttttgaagatgtgttgcataacacaaaaatgcaaactcgaatgaactaaaagctttaatcacataaaagagtaggaggttggactaaatgattaaggtcttttccaattctaaggttctaggagtctatatattccattgtccattttaccttctaaaccaggaaagctacagagctaaataaagaggtataaaaattattagaaataagtcaatggattataatcatcttcaaagtggacagaaagtcaaatataaattaaaaaaaaattaaaagctctatattatctccaacttgtaagaacaatgactgattgtgacccaagtcaaacagcgatggaaaaacacacaccccatggcatctcaacttttcagctaatgaaaatcctcacttaaattacattgcatttcaaagcagttccctgttaaataacagcgtctcccaaaagtacactgttgtggaagttgaaacatgagccacaaatgaaataactttgtcaaggtcataaaataagtcaaacaaattccaaaacagaacctttgatctgaaatctagttttatgttccaatctcttgacgctagcccagctttgtaaattctttttttttttttccttcctttttttttttttgagacggagtctcgctctgtcacccaggctggagtgcagtggcacgatctcggctcacggcaagctccgcctccctggttcacgccattctcctgcctcagcagctttgtaaattcttaattgtgttcttatcatatgtgttcactacaagtgacattcagtgaaatttatccattccttttttttttgagacagagtcttgctctatcacccaggctggactgcagtggcgggaatctcagctcactgcaacctccacctcccgggttcaagcaattctcctgcttcagtctcccgagcagctgggactacaggtacacactgctgtgcctagctaatttttgtatttttagtagagatggagtttcaccatgttggccaggctggtctcgaacttctgacctcaagtgatccacccacctggacctcccatagtgctgggattacaggcaggaggcaccatgcccagcctatccattactttttaatagaattattaaaaggcctcttctatcctactctagagttctaataaaaaacaaaaaatgttaacatccagactgcctgagaaacatctctttatcattaagttatttcaaaaatgaggtgacatcatgattaatctctaaacaatgctctcttaggttttcgccctttctttatgaaagtatgtatcatatgagctactttacaaagattttttaaaaaaacaaggaaatcaatatataagaaagatgaagacgatgaatattctaaccacaaacaagtagaataaatacatcttactttttaaacaagcatttaagccctgaaaggaaagaccaaaaactataaaaataaaaatttagaaaagggaacaggacagatcagcatggctaggtatttcacctcaacatgtttcattgacatcattcagcttccatggctgtaccaagttgttagtagagacagattgggttaaaaaccccaacttggggttccaaggcaagttacttaacttgtataagactccttttcttcatgcaacatgaagaaaaacagtacctatgtcagatgtgtatcaattttctttttttcttttttttttttttgagacagtgtttcactcttgtagcccaggctggagagcaatggtgcgatctcggctcactgcaacctccgcctcctgggttcaagggattctactacctcagcctcctgagtagctgggattacaggcatgcaccaccacgcctggctaattttttttatttttagtagagacaggttggtttctccatggtggtcaggctggtctcgaactcccgacctcaggtgatccgccagcctcagcctcccaaagtgctaagattacaggcatgagccaccgcgcccggccaattttgttttttcctaagtgagatgaggcctccctgttgcccaggctggaatgctgtggcatgacctccactcactgcaacctccatttcctaggttcaagtgatccttccactttagcctcctgagtagctgggactacaggcatgaaccaccatacctggctaattttttgtgtctgttttttttttgtaggcatggggttttgccatgttgtccagattggtctcgaactcctgggctcaagagatctgtccacctcagcctcccaaagtcctgagattacaggtgtgagccaccatgcctggcttgttttttctttttctgttttttttttttttttcaatagggtcttgctctgttgctcaggctggagtgcagactggagtgcagtggcctgaatatagctcactgtagcttcaacttcccaggggcttgccccaccacacctggctaatcttgtttattttttgtagagacaaggtctcactatgttgcccagcctggtctcaagctatcctccttccttggcctcccaaagtgctaggattataggcatgagccaccatacccagcctgatatcaccgacttttcctgagttgctagaaagccaaatttgtggcccatcctcagctaatgaataggactacatgatatacattactctgtacaaatcttccattagcactattgtttttccttcagcaaggtttattttataacagctttgttgagatataattcatatactacaaaataggtttttacccttttaaagcatacaattcaggccaggtgcagtggcccatgcctataatcccaacactttgggaggccaaggcaggaggattgcttgaagccaggagttggatgccagcctgggcaacatggcaagaccatgtctttaaaaaaaaaaattagccgggcatggttgtgtatacctgtaatcctagctactaaggaggaagggacgagagatcacttgagtcaaggaggttgaagctgcagtgagccatgatctcactactgcactccagcctgggtgacagagcgagaccccatctcaaaaaaaataaataaataaataaaaagaaactccatgcccattatcagtcattcctcattcctattttatggctgaatagtattccattgtaggaatataaagcatttagtttatccactcatcatttgattagtatttgggttctttctacttttttttttttttttttttgagtcagagtctcactctgttggccaggatggagtacagtggcatgaccttggcttgctgcaacctctacctcccgggttcaagcaattctcctgcctcagcctcccaagtagctggaattacagatgtgcaccaccacacctggctaatttatgtacttttagtagagacgggatttcaccatgttggtcaagctgctcccgaactcctgacctagtgatctgcccaccttggcctcgcaaagtgctgggattacaggcatgagccactgcacctggccctttctacttttttgactattatgaataatgctgttatgaacattcctctacaagtttttgtgtggacatatgctttcatatctcttgggtggatacctaagagtagcattgctaggtcatatggtaactctacatttaaacttttcagagctgccagactgttttccaaagtggctgcaccattttagatcctataaggactcccatttctccacatcctgactagcagttgttactgtacatcttcttgattatggctaccctagtgggtgtgcagtggtacctcactgaagcattgctttgtatttctttaacggcttatgatgttgaacacctttttacatctttattggccactgtatatcttctttagtctattcagattcttaagcctgggtgattgatctttttactgtttgaggtttttttttttttttgagatggagtctagctctgtcacccaggttggactgcaatggtgtgatctcggctcactgcaacctccgcaacccgggttcaagcaattctcctgcctcagcctcctgagtagctaggattacaggcatgcaccaacacacagggctaatttttgtatttttagtagagatgggatttcaccatgttggccagactggtatcgaactcctgacctcaagtgatctgcccgcctcgacctcccaaagtgctgggattacaggtgtgagcccccgcgcccagccaaaccaccgcactgggcctgagttgttacatttaggtctataatccattttgagttagtttttgtgtatgttgaaaggaagggggtccaatgtcatccttttgcaggtggatatccagtgattccagcaccatttatatgttgacaacctgatttctttaaaaaaaacattttgactttttgtattacacacattttttttaagtcacctgaagtcaattgtgaagtgatactcgtgtaaataaactgactttaaaaaattactcgaccaaggtcatacagttagtaagtgacaaatctaagactaaaacccaggtcttaggatgccaaatttcaagttttcccattaaacaaaatactaccttacatgtaaataagtttcatatttactcatcaaagataagaaaagccaagccagaaacaatatatttattggtaagattacagaaagcttgatttgagatgtttaagatttggcttgcttattttcataaaaatcgttaatagcagccaggcgcggtggatcacgcctgtaatcccggcactttgggaggccaatgtgggcagataacctgaggtcaggagtttgagaccagcgtgaccaacatggagaaactccgtctctactaaaaatacaaaatcagctgggtgtagtggcgcatgcctgtaatcccagctactcaggaggctcaggcaagagaatcacttgaaccctggaagcagaggttgcagtgagccgagatcacaccactgcactccagcctgggagacaagagtgaaacttcatcttaaaaaaaaaaaaaatcaataataggtaaaaatctactaagcattcactttgtgttaagctctgttctaaacagtgtataatcacttaataatcacaacaatcttagaaaataaagtcaagtgtccactttttttcctcttctttttacagatggggaaactaaggcaaagtaaaattaagtaagttgttcaagatcacagagctagtaagtggtgggaacccaggcaatctgactccaaagaccgtgttctaacaactatgaaagcaaattacttaagagaagggcattcaccaggctgtggccagatggattaacaagtgtctggaaagaaagagactattctattagtgctattgttgtctcagatgaagagacagaaagagaaaattcattagcgtggctgagaattctaaaggagggaaattattagtactagtggcatcaggtaaaaaatgttcaatgtccataattaggggtggagggtattgggaatatttaatgggtacaaaaacacagttagatagaatgaacaaaatctagtatttgatagcacaacagagttattacagtcaacaatttattgtatattttaaaataagagtataatgggaatgtctgtaacacaatcacataaaggcttggtaaatgcttgagatgatgaaaaaaataaatgtactctgttgcactaaaaacaatgtccatgattaactaaagaaatagtcctttaaaaaaaaaaaggataaaaatttaacagggctactgcaatatagcacaactaataacataaaacagtaatataaatacaggaagggaaaggaaaggcaggcacaaacgcagaggaaggaaccctgggagtctccactgcccacagaatgagtgagtcaaccaggcggtgttatcacaggatgtgttggaaacagacataacactgctgggttaaagattaatccttcctttatacgatgtatcagtgagatccctgatagaatgtggaaaccaattttggtcagtgctccaagaagtatggaaagaaatgggaaaagattcacgcaaaacaaacaactagaccaaaacaatagaaaagagtgtctgctaggaaaagaaaaaacttgggagttgcttttcaaagagagtcaggattgatttaattatggccctcaagaagacaatttgaggccaggcgtggtggctcacacctgtaatcccagcactttgggaggctgaggcgggtggatcacctgaggtcagtagtttaagaccagcctggccaacatggtgaaactccttctctattaaaaatacaaaaattagccaggtatggtggtgggtgcccataatcccagctactcgggaggctgaggcaggagaatcgcttgaacctggaaggtggaggttgcagtgagccgagatagtgccactgcactccagcctgggagacagagcaagactccgtctcaaaaaaaaagaagacaatttgaatgttcttcctcaaattcttcacaggctttggttctttccagtcatttaaatcccaggcaaatatcattttctaagaggctttttcccaaagtaccttcctgggtttgtagcacatcactctgatttgtttccttcatagcttgtaacactctgaagttcttcctgattatgattaagcacagtaggttcctcttatcctgttagaacataggctaggccgggcagggtggctcatgcctgtagtgttagcactttgggaggcccgaggtgtgtggattacctgaggtcaggagttcgagaccagcctggccaacatagtgaaaccccgtctctactaaaaatacaaaaattagctgggtatggtgatgggtgcctgtaattccagctcctcaggaggctgaggcaggaggatcacttgaacccgggaggcagaggttgcagtgagccgagatcgcgccattgtactccagcctgggcaacaagagcgaaactccttctcaaaagaaaagaacgttggctacatagaagcttagaacctgagtactgcttatctctagtaaataccagtggtacctggaacatagtgcaaattctataaacatttgtagaatctatgtccatgaagctgcaacatggaaaacgagctttcaaattaaagcaagacagacaccagtaagacacaaaaggaattacttgatagtcaaagtaaaatctatacattgctgagtgctgtgggtctttaagaagagagtcactcatctgtcttaggggttttacaaattcactagcctaagtaatttatagtggttattcccaacaccatgatttaatacttcacagcatagaaatgaagtctggctagttataaataaatgatcactgagctattatgtgccgatcaatattctaatgctttccatgtatcagattatttaatcttcacaattctatgagtactattcttttttttatctataaaatggtactctttagtcccaaaaggttaaataattggcccaaagttgaccagatcatagctggtggatctgggacttaaattcagactgctgcacgtgggccattcatttaagcctgaagataaatttaaacagggcaaaaatattaaacaggaagaacaatagattgataaaattatggcacaggaattaggcgaaattatggcacatgaattttctccatggcttgctatgctatgtggatcttttcaaattccatattgctgtaacattcctggggatattgttgatgtactaactttttccctttaataatgtctcttaaaaaatgtggtttcaaatgaaagagataaatatattcatgccaaactagagagacattataatgaacccctgcatcatgcatcttttttgagacggagtctcactctgtcacccaggctggagtgcagtggcgtgatctcggctcactgcaagctccgcctcccgggttcacgccattctcccgcctcagcctcctgagtggctgggactacaggtgcccaccaccatggtcggctaattttttgtatttttagtagagatggggtttcactgcattagccaggatggtcttgatctcctgacctcatgatccacccccctcggtctcccaaagtgctgggattataggtgtgaaccaccgtgcccagccctcatgcatcttaaacaactctgaacacatagacaatcttcatgtatgctgtgctccccccaaactcatacacacactggattatttcaaagcaaatgatgatgtactattaacagccatctttattctttcccaaaataatttgagtctaaaatgcatataatttctttatttcaaaaaaatctacaaaaaattggtagcagtacagggaacaattctaagggggggggggttgttatcaaaaagcaagccattggacattaggaaaaagaatttctttgcctggcaccatggctcacgcctgtaatcccagcactttgggaggctgaggcgggtggatcacttgaggtcaggagtttgaggccagcctggccaacatagtgaaaccccgtctctactaaaaacacaaaaattagccaggcgtggtggcaggtgtctgtaatgccaggcacttgggatgctgaggcaggaggatggcttgaacccgggaggtaaaggttgcagtgagctgagatggcgccattgcactccagcctgggcaacagagcaagactctgtctcaaaataataatttctcaaaaatcactaagtaatctctaagtgatacatacttggtaacatgagaatattttaggtgccacattatagcaggaattaaatttaaattttgaaagtgttttataagttttaagaaaactcacaagggtttctgtgcctattatgcagacaaatatcattcccaagcatagggagaggtcaagaagcaattaagtaccaaagtatacctgtttatcttccagtgggtcaggctctcctttacttgactcagagctgacatcatcttcatcagaactgttgatgatttcctcctcatcagagggaaggtcaccaagaccaagatcattctgttcctcctgggatgctcctgaactgcattcaacagaaagcaggtattagtcaccttcaataataagaagtgctagcaaaacaaaaaccaaatcaacatcttatcttcataatgcaaacaagatatatctaagggatgtggaagaatgaaaagacccagatcagccaactttcccttccttcaccctgtctcagctgccaaaaactcaaattaattttttgaatttttaatgttaagaaggtgggtgggaagcaagtttcccagctgctcccatcctatgcttctatatatccctcccaaagaagatcaggtctctactcctagaataaactaagaagctttacagaaagtgagctggtttaccataaaaggctgccaggtataccagaagaattgctgtttccttgggccttggtgtttaaaacaacaacaaaaaacaagtaacaaatctatgaggactcgggggtaataatggtgacgacaatcaacagtgcaggtgcaactgtgaacatgtaccctgctctatggttatcactgttctgttcacaagacatggggaggaagaggaaatgttacaaattctcagattatgctcaagacctgctgcattagaactacgaggggcccagggcccagcaatttgcccagcaattacaactacctggggcacagggcctagcaaataataagtaagcttgtttaatgctttccaggtgattctgatacaagctgaacttggaaaaccacagagccaggccatttaccaattcctccttgccagcctgatatcatcaaggttcctccgtttgttttaatatagatctcatgaatctaaaagccactgttgcaatccaatctgtggggggaattccataggaaagttccctaagaagagatgaaaataattccttctagcattggctggaaagattcaggagccaattgcctgtagcaactgcttttctgtcgtaagtctacaagaatatctgcagaatagaagagtataggtggggtcagtaaaagatccacaatcatcaggaaaaacactcaagcagaataaggagacagttgcattccactctggcaggctctttcagcaggtcacaggcaggtcactcaacagccaaggttacaagttacgagaatctctaatgggaatcttaaaagctaaagataaattttctgccagttcctgattacacatggtaggatacagacttgcctcagaagccattcctggagcccaactgttacacaaaccagctggctggaggcacagtgccaaaaggaacacctctcactgctaaagacggggttttccattactcaatggctggggcctctgggagtcatatcatagcctcgtaaggtgggtgcatactttatcacagctccccaagacatgcaggagactcactccccgggggtaagtggtggatagaggatagcaactttctggttagatcactggcaggattcactgtctctgggtgcagggataagagccaaccccgccggatagttaattgttgactgagattagcgagagcaaatgagagttaacagggtggacagactataggatccaaccatatagctagaagaaaaggtaccccaccacttgtttttatcgtaattccttatctctttatatcttctaaaaccctgttaacacaacacatgttcaatttccaatcggcagcagcatcacctggaagctcctcagaaaacacacgctcaggccacccacaacccaccgaatcaggatccgtgctgtaacaaaatcccagtctatgtgtgagaagctctgctctaaaaggctttttgatccagcccatctgggtactgttttagactcctaagtataatagattcagatagttagtaatagggctgtggcacctatgaagaaattaggtttatttggccaggcgcggtggctcacgcctgtaatcccagcactttgggaagctgaggcgggtggatcacgaggtcaggagatcgagaccatcctggctaacacggtgaaaccccgtctctactaaaaatacaaaatattagccaggcatggtggagggcgcctgtagtcccagctactcgggaggctgaggcagagaatggcgtgaacccgggaggcggagcttgcagtgagccgaggctgcaccactgcactccagcctgggcgacagagtgagactccatctccaaaaaaaaaaaaaaaaaaaagaaattaggtttattttgtctgaagagaggggtgaaaggtgtttcttggtcaaacatcatttggaaggctattattaagaatatagtaactaggtgttgccacatccattagggatacaagagggattaaagtacaaagtgaacatctgaaaacaagaaaaaagctttaaatattaaaactacatgaatcaaaacacaatgccatgaaacaaggagagattttggtgtctcttctgaatcctttaactatctcactaaactgcacttggtggtagacttgtttccctcattaaaatgtaaatttccaaagacaaggaaattgaaattgtgttttccagctgaatcctcaccatacagcccaacacacaagagaccctcaagaatttttcaccaaataaatgaaaatgatatcagaaagcaacaggtgttgaattttaatggtgcaggtggcctgaaccagggtggctacatcaggaattgagagaaagggatggatgtaagaggaagaaaaatcagggccgggtatggtggctcacacctgtaatcccagcactttgggaggccaaagtgggtggatggcttgagcccaggagtttgagacaagcctggccaacagagctaaacctgtctctactaaaaatacaaaatttagccgggtgcagtggcatgtgcctgtaatcccagctactagagagactgaggcagaagaatcactggaactcaagaggcagaggttgcagtactcaggaggctgaggtaggagaatcgcttgaaccagggaggtggaggttgcagtgagccaagactatgtcactgcactccagcctgggtaacagagtgagactctgtctcaaaaaaaaaaaaaaaaaaaagaaaaaaaaaaagaaaaatcaccaggacttagggtaaaggggtgaggaggaaaaacttatggaagacatcaaggtgtcaagtccaagtcacaagcagaatgagggtgacatgaactgaaacaaatgttaaaacaagggagcagattttaaaggaaagataatggtttagcagcaaaatctaggatccacattttacatgttcatttctaaaacaattactctattttcccaaacaactgttgtcagcttctgaatctacctagataattttagatttctatttttatttttttgaaaaaatagacaagggtcttgctgtgttgcccaggctgatctcaaactcccaggctcaagcaatcctcccacctcagtcttgccaaagtgctgggattacaggcatgagccaccatatgcagccaattttagatttctgataatgaaacaaggactccttactaatgccaattgtatagtttggagttctgtttatttccttcccactgtccgaatgataacatcctaagactgtctgctttgtggggtaaaggaacaggacatagggcttcctccacgtctttctgcctagttagttcataatttgatatctgaagtaaaaggaaagtaagctccaacagcaaccagaacaaagagtgggctctacttccccaagcaccctaagtcagatttgcttctgcaagaagccacagtttctagaaaatcagtttgtttccagtgcactggaattaagacaaacaagtaaagccagacttaaattcctactgatgggtaactgtttccttcaattccacatgctaacatctacacatctgaagtgaagactacatgatgccatcactttttaaaagttatttttttctatatgctagtttctatatatttacagcacacctccactggaagtatatcaaatttttctttcaggtaataagtcacaactaaagtgaagtccttctcttttagaaggaattatcttttaaaattttaatttattttattattattttttgagatggagtctcactctgtcacccaggctggagtgcagtggtgtgatctcagctcactgcaacctcgcctccctagttcaagcgattctcccatctcagcctcctgagtagctgagactataggtgtacgccaccatgcccagctaatttttgtatttttagtagagacggggtttcaccatgttggccaggctggtcttgaactcctggcctcaggtgatctgcctgcctcagcctcccaaaatgctgggattacaggcatgagccaccatgcccagtggaattatcttttttaaaaatactaaatccatttcctctaagagtttttaggaacagaaaacctgtacaatgataagccagcatagcaactgccaggttcaccaaaaaacatccttctgagcccctactaaattaaaaattccagcaaggagaagggataagggatcggatggccgagagaaggaaaggaaaagctgagttaagaatggcttctctgttgttgacaaattccagctatctttttcttcttttgcctgtggttttattctgagcccctttaccaaggaatgtttcatgtaattcctcccaagcttgaagaaagaagttctttccaattccctcaccttcagaagtttctttcttatttccaagtcaccacatgtaaatctcaacttctgtggtctttctcttcctcttctttctactcctggcccaaactgaacagaaacctgcttgtcctcaggatgttgtgataattttttttcaaatgctgtctcattatgacttggtgattatgtgtttcctttggcacatttcatatttatcacagaatgaggggaaaaaaactaccattatgggctttaaattagcaaaataaatttcaagttatttagtagttattatagcacactaactataaaattggtatacaattttcaccaaaaaattatttctattttgttttaccaggaaacatttccttctgttacttcagttcccttataggactgcagattccactgtcacagtaaaaccatgaatcaaatcaattttaaacaacaatttatttatttatttatttatttatttatttattggtacagacagggtctctccctacattgcccaggctgctcttgaactcctggcctcaaatgaacctcctgccttggcctcccaaagtgctgggatgacagcatgagccaccgtgcctaaaaaaaactatttaaaaaatccttcttactctccttttcaggtcttctcaattacacagcaattctagaattttctccatcccttactcaagtaatgttcttgaggtctaccaccaaaatgagtttggaaacatggcacgacttgtgaaataggcatagttggccatttgcatcctccaaaaagcaaccgtcacgtatgcacatcatgtttttaggtttttcaaacacaagatggtgcacaattattttaagtatgtgcagagccaggtgacaggactgaacaaatatcaagttcaaccagtgtgactcctgagtgctggtaggtaaagtaggtaaactaggtaaaccagatcaactagtaggtctttctccactcctaactgctttcacaaaaaagaaacatcaatgcttcagtaatacgtaaggctatggatgctgatgttcttattgaataagtataatagcagaaatccttccccctgaaagaaaaggacatctatcaatttttttatgtccttgcattataaaggtatcaaatatattgatttttaatcttctcttcgagaggttgcttgattaaaggttaagacaaattttaatttaaaaattaatgattttattatctcaatttcagtttttaaaatcctataatgtatatatgtagtgtataaactttttgagttaaattctttagtattcacaaaataaaaataaataaaatcactaaaatacttaaagggacagtaccacagaattttgttacttaaagatagaaaaaatgaataaacaaagaaacttacaacataaaatgtacacgatcagtgttttattttttcattcttaagttttagaggttttaacaactgagcctttcaaactagcaagctagggttctatggcttcaaaaaaaaagaaatcacacaaaaatatccagcttccctgaaatataaaccagaaactgtttaaaactgtctctgggtgactctgttagggtaaaatgccaggcttcaaatgatggatattttttaaaaacaggcttgcttcattttccagaagcaacctccacctttgcgaataccattactatcaccttcccccaagtaattacgaggattcttagaattgtatgctactgactaaagacataatcagagccggggtggtgactgatgtctgtaatcccagcactctgggaggctgtggggggtgggggtgattgcttgggcctaggagttcgagaccggcctgggcaacacagggagagaccccatttctatgaaaaaaaaaaaaaattgcatggtggtatgtgcctgtggtcctagctacctagctacttgggaggctgaggtgggaggatcacttgagcccaagaggtcgaggctgccttgagccacaattatgaccttgcactccagcaggtgagggaccaagaccttgtctcataaataaataaataagaccaaaatcataatcagtaccttgaggctgctatttaaaatacagtcctcacaagacaactctgaaaattgtttaaaaaacaaatagaatgcaaaattctttaaaatagaagagtacctacccatatgcttgcaacttttatatgtaattggctttaaagtcattcattaagatttaacataaagaagcagtcttaaagggatcttccttcaatagccattaaaaaaagaccggttaaataaattggggttatacattcatataatgaattactaaacagttatttaatttgtttagtaattactaaacagttatttaacaggctaaggcaggtggatcaccttaggtaggaaatttgagaccagcctgaccaacatggagaaaccccatctctactaaaaatacaaaattagccaggcgtggtggcacatacctgtaatcccagctacacgggaggctgaggcaggagaactgcttgaacctgggaggccaaggttgcggtcagctgagatcctgccattgcactccagcctgggcaataagagcgaaactctgcctccaaaaaaaaaaaaaaggaggtagatctatgcacagtggcatagatcattctccaggaaatattgttaggttaaaaagaaatcaaggcacagagtgtgctcctatttgtgtagagaagcaaaaagaagagtacatatacacaaaaccatgtaaaaagtgtgtatatttgtgtgtgtgtgtgtgcacaaacatgctgacatataccaggctgtccccgaacacattcagaaaaactgataaatatagttgaagtacagttgcctctgggactaaagtcctgagaataaaagacagatttttttttttttttttttttgagacaggggcttgctctgtcacccaggctggagtgcacacccaggttagagtgcagtggtgtgatcacagctcaccgtaacttctgtctcccagactcagtgatcctccagcctcaggctcccaggcacttgggacaacaggtgcgtgccaccacacctggctaattttcgtattttttcttttgtagagactgggttttgccatgttgccaaggatgggctcaaactcctaggctcaagtgatctgcctgcctcagcctcccaaagtgctaggtgtgagccaccactcctggctgagagattttattatttgcccttcagtacatttttaaaagttgttatcacgtgcatttttactttttcaaagttgaccacccccccgacacacacagagtctgaaaagcttcataaaaggtggttcaaagcatatatgtatttatacatatatacacatatttttatatgtatataaactctttagggatagtttattttcttcccaggatgatgagattaaagatattttctcctgttctttccctttctcccccaacccccagacttggaggtctgtgtaaacattttcaggattgccgtttcaaaaaaaaaagaaaaaatctcttttaactattgcttaagttgttaagatatataaattacggctttcccttactgccgagaggggtttgtttgggagaaccttaagtctaagtctctaaataataggtaggaaggggagatctggctagccagttgatagctttaaaaaagaaaaaaagaagtcagtagagggatgttcaacagcctgcagggcccacagagtaaccacacaacttgttgactacgtcacagtgaacagcaacataataatagggtccgtctcccatagttctccatttggttgtgggagagcttcctgacctgcaagtaaagatgatcatgtgcttcagggttcctggtcctatcttaatgacacaggaggagccccatggtgacaagagtccaacagacactcttggccatctagcttagctgggaggcatccaggtcaaacttagctagaaggaatccaggtctagctagaaaggaataaattgttacaaaaatgtctcctgaaacaagcactacataaaataaatctgcaacatttaattaccatcaattttgctttcttagaattgggattcacatcacgaaatgtggacaactttcttgttaatacaaatagaaaagcattctgagcttgaggttgcctccaataaaatatggcaagttccagttgggcacagtggctcacgcctgtaatcccaacactttgggaggctgaggcaggcagatcacaaggtcaggagatcaagaccatcctggctaatgcagtgaaactccatctctactaaaaatacaaaaaaattagctgggcgtggtggcgggcgcctgtagtcccagctactcaggaggctgaggcaggagaatggcgaggcagagcttgcagtgagctgagatcacgccactgcactccagcctgagagacacagcgagattctctcaaaaaaaaaaaaaaaacaaaggcaagttcccaatccaattccatcattgcaccaaagatgatgtttctcttattgaaaacgaaaaagttttaagacaaagttagagttgacttagtatcatttctccccttcacatcctcattatgtaatatactgtctgttcctacttgatgccagaaaaaataaaggccattagaaataaataatgaggttgggatggctacaagagaatacttcacagttgcatacacatatttacacatatatatgtatacatactttttttttttttttttggagatggaagctggagtgtagtggcatgatcttggctcactgcaacctctgccacccaggttcaagtgattttcctgcctcaggctccagagtagctgggactacaggtgccccaccacgcccggctaatttttgtatttttagtagagactgggtttcactatgctggccaggctggtgtcggactcctgacctcaggtgatccacctgccttggcctcccaaagtgctgggattacaggtgtgagccaccttgcccagcctatacatacatttttaaaaatacttttgtaatacttagaatatataaaaatggtgatgccatttatttcagtaaacatttatcgagggcctactatgtttcatttactattttaggaggcagatgaagataatattgaattagttacaatgttcaaactacaaattctattgactgcttctctttattttcctactgagaccttcttaaacagatgaaggcagaagggattgagataaccacagtaatttaagacaaaggaaagaaccactttctaaaaagagacaacttggctgggcacagtggctcacgcctgtaatcccaactactcgagaggggcaagactggttagtaagttagtagaaaaaacagctcatcctttgactaccttctctaacagggtgaccactttgtcctggtgtcagctgtacacacccctttgcttcctctaaggtcttgtcatcataatcctaacagccactgaaaaggtggcgagccttttggaaaatatgactactccgcctggccacgctatgctcttgattgtgagtcagcacaaaaccattgcggtgcaaggctgaaaattaaggcccaatattatgctctgccttgacatctggggaaaatcagaagggctccaaatggtctcactacacactgcccttcccactatgcttctgctgataaagtcccctggccaccctcttagtcacaaggaccaggtgcagtgtctgcctagccctgagaagtgggttttagttccctgccagtcagcagagagtcatttaaacaagccaatcacatcctctcatgggaaccaggagtgacccccaccctcttgtatacagcctgcctcccgcaacccctagttgttcctgagtacaggcctgggtggccaggtgtggcatgctgtgccctcctctaggctgggactacatgtgaatgagaaactgctgttgatctcacccgtccagtgtcgagcatcaggattcagccattcccgtaaccctaagcagaaatccctccctcactaacggggtgaagaggaggtaattcaaacaacctccaaggccaggagcggtggttcccagcaatttaggaggccaaggcaggaggatcatttgaacccaggagtttgagatcagcctaggcaacacatggagatcccatctctacaaaacataaaaaattagccaagtatgggggtgaacacctgtggtcccagctacctgggaggatgagatgggaggatggcttgaacccacaagtttgaagctgcagagagcagtgattgtgccactgcactcaggctgggtgacagagcaagaacctgtctcaaacaacaaaaacaacaacaaaacaacctccaaaaaaggtgccattgtctgggatcgcgaggtacaaagcaggtgcactggcagattttaataagattatcctgagaaattacattgagaggtgtacaaagtcagctttgtgtttacctaagtatattttgcatatacatctagactctgccatgatacactcaagcaattttcaagttaaaggcattaacttacatgttccagaaatgtggcatattccatgttacagaatgctaaatgttacattatatacagaccccactataatgaaagggtaggggaattacaaggaaaccaatagccaaaaccaaaggacttctgcaatcattcccagatgttattttatctaaacctatttaagtgtatcagtttccaataggaactacaatcatatctgggatttcccactaacatgggggaaaaggatcaaaggcttcttgggagcccatgaggagccacagagggggaggttagtcattgctcaagaataaatctgtctacttccttatttaaaactatatacaagtaagcctatttgccatctttcttcttcagattctattcacacaaatgatatgtcttcaaggtctactctagaccagttataaaccatcaataaccccccaaaaccataaggaacccacatctttctgagacagcaccctggggaagctgtagagggtgtcaggaaaagacatggatttcttcctgcacgttttttttttttttttgagatggagtcttgctctgtcgcccaggctgtagtgcagtggtgcgcgatcttggctcactgcaacctccgcctcccaggttcaagcgattctcgcgcctcagcctcctgagtagctgggattacaggtgtccaccaccaagcccaactaattttttatatttttagtggagatggggtttcgccatgttggccaagctggtctcaaactcctgacctcaagtgatttgcccgccttggcctcccaaagtgctgggattacaggcaggagccaccacactcagcctttttttttgagacggagtctcactctgtcatccagactggagtgcagtggtgcgatcttggcttactgcaacctccgcctcccaggttcaagcaattcacttgcctcagcctcacaaggagctgggatgacaggcgccagccaccatgcccagctaatttttgtatttttagtagagacagggtttcaccatgttggccaggctggtcttgaactcctgacctcaagtgatctgcctgcctcggcctcccaaagtgctgggattataggtgtgagcacccgggcccttcttccactcttaatcccacgcatcagtgagtccttacaccagttacattgctgactagttctgtgtttatttttagcttctttgattgggaaaccaaaaaaaatcactacttttctatcaaactcagattacatcttcgaaagcgagagtcagggaaaatggaagggaagtgaaaataaacgtgtattcaagtaaaataaacattcgcttctgacaggatcacaaacatttatcacagtttcatacatttctacgagggaaggaaaggcagcagagaagaaaaaaaaaatgctctttcagcctaagagacctgcatttgaaggcagggtccaccactcatggctgtgtgtaactggctagttaattggactaagtttacatttccctatactataaaattgagataataggccgggcgcagtggcttacgcctgtaatcccagcattttgggaggctgaggcaggaggatcatgaggtcaggagttcgagaccagcctggtcaacatggcgaaacctcgtctcttctaaaaatacaaaaattagccaggcatggtggtgcgcacctgtaatcccggctactcaggaggctgaggcagaagaattgcttgaacctgggaggcagaggttgcagttagctgagattgcaccattgcactccagcctgggcaacagcgcaagactccatctcaaaaataaaaataaaaattgagataacataccacctgcaatgaagattaaatgagataatgtgaatatatctgttatatgcaatggacaggaaataaagacagctttttaaaaagcaggcatgagaaaggggacaacatcatagttcatccagtaagcagaatggcaagaggaactgaaagttgttcttgttccccctagaaatcccaaaatgtagtataatacctttcttgcatgaatgtattaacaaatgaatggattccatcctaatatctcacacatacatagtatagtatgattaggcaaatctaacctgctgcctgtttttgtaaggtctatgagctaagaatgcttcttatattcttcttcttttttttttttttttttttttttttttttttttttttgagacggagtcttgctgggtcacccaggctggagtgtagtggcacaatctcggcttactgcaacctctgcctcctgggttcaagcaattctcctgcctcagccttccaagcagtagagatggggttttgctatcttggccagtctgatcttgaactcctgaccttaagtgatcctcctgcctcagcctcccaaagtgctgggattataggcatgagccactgtgcccagcctggctcttatattcttaaatcatgaaaaaaaaaaaaaaagaacaatattttgtgacacatgaaaatgattttcatgtccataatgaagttttattggaaaacatccatgctcatttgtttctgtactatctgtcactgcttttgcactacattggcagagctgaagagatgcaacagagacctatggcctgcaaagtctaaaatatttatcatctggccctttacggaaaacgtttgctgatccttggtacagcagattacccaaaagaagcagtatatttcctttggggcaaaactgcctgtgttcgaatccgagttctgccacatactaagtaggtgaaattgagtcagtttttaacctctccgtgcctcagtttttcctccataaaatgaggatcataatattgcctacctgacagaattttgtggggattaaacaaattaatacaagcaatgcactaacaatgcctggtacacagaaagctcgtttgctcactcactgtttctcttgtatatacttaaaagtctagaactgtataaaaagtgacttcaggccgggcatagtggctcatgcctgtaatcccagaactttgggatgccgaggcgggcagatcatgaggttaggagatcgagaccatcctggctaatacggtgaaaccccatctctactaaaaatataaaaaattagctggtcgtggtggcaggcgcctgtagtcccaactactcggaaggctgaggcaggagaatggcatgaacccaggaggcggagcttgcagtgagccgagatcgtgccactgcactccagcctgggagacagtgcaagactccatttcaaaaaaaaaaaaaacaagttacttcaggctgggcgtggtggctcatgcctgtaatcccaacactttgggaggccgaggcgggcagatcatgaggtgggcagatcatgaggtcagcagatcgagaccagcatggccaatatggtgaaaccccgtctctactaaaaatacaaagattagccaggcatggtggcatgcatctgtaatcccagctacttgggaggctgaggcaggagaatcacttgaacctgggaggcggaggttccagtgagccaagattgcgccactcactccagcctgggtgactgagcgaggctgcgtccccaaaaaaaaaacaaaaaaaaaaaagtgacttcagagaggagcttctgcattatcaatcatgtgaaacagctcatcaccagcttaaaggtctgagtcaagaactcctacagtgaggtcatgtgagccacggttttgcagcaggttactcctagagctcattttccatgtttaatttcactacttatttttggtagcttactacttgtacagtaatatcctgaagctcagaataactacagtttcatgcatatctcaatattctttcttatttctaaaacaattttagtcacatataatgacgaattcacaggtattccactagatctcaaagtaccttttcaagtatgttttgaaaagctggctttgtccctctttgcttaataatgatcacattgatgcgacaaaggccaaggtggccgatgaatgacactgataagcatacctcacgtatgcaataaagttgctgatttctctagtaatgtaaacttcattttgcaatataaagcaaagagtcctatttcttttctaaatggaaattttcatattgcactgaactagaaaaagcccagtagaatgcaatttcaaaacagtgatcacttgctctgagctactagctgaaggcacagaaaaaaaatggggagaagagggaagcagaagaaatgaagaaaccagaaaacagtaagtaaggcaaggtaaaggagagaaataagcagatgggcaaagcaccatccgtgtgtgtgtgtgtgtagaggacatgttaccacagacacaggagaaggaagacaaggttcctgccctggggaaaatggagctgtcagcctttgtctttctcatgtacctcaaagataacaataacctcatagggacagagtttactcctaaactttccacttattctaaaactttccatgtgaaaaatcaaaacaaacaaaacccccaaaaccttatctctccagtggaacggaggtggataaagagaagaaaaggagggaggattttacttttcacttcatgtacatttaactttttttaagacaacaattttatataacttttataactaaacaaatacgtaaagaactgaaaatccccattctctcttctccaagtttactaatctcagttatttcaagtattccttaaaaacaactttttttttttttaatacttggtaaggaaaggtcaaaggtaaagcaggcagagaggatgaattagagaaagctatccccatctgctcttcccacaaaatgcaaagaaagaaaagaaaaaaatctggacatgttgacatgtggattacagcaatagtttttggtctacttcatgtagataatctcaaaatgaattctctaattccctagaccactccccgctctgaaaataataaattccctgtactttgtaaggtaaacccagtgaacaaagaatattttcaccctgggcatcaggaaattatgtatagcaaaatggaagcttctatacacccccacacccgtgttcacagtcacagattttacttaacagaacccatccacagggtattagctgcatagccagcacagatatttactggggccaagatttcaaagaccaggcagagaagacattaatttgtagagtacaaaagagcacacaaaaaatgtttttgcttcttaacactgtgagggctcaataagaattaaagctgcttagaatcactgctatcaagagtcaatctagctgggtgcagtggctcacgtctgtaatcccagcactttgggaagccgatgagggaggatcgcttgagcccagagttcgagaccagccttggcaacatggtgaagccccatctctgcaaacaaatacaaaaattagctgggtgtggtgccgtgggcctgtagtcccagctacttgggaagatgaagtgggaggatcacctaagtctgggaggttgaggctgcagtgagctgtgatcttgccactgcactccaacctgggttgacagagcgagaccctgtttcataggaaaaaaaaaaaaaaaaaaagaatctagtaaggtcatattcaagaaaaggagaagcatcaacagttaatcaagtaaccactgggtataaaaacatacttaaactaattttaccatcaaaaaaacctcctaacctagctagagctaatatatttgcttattttcacagtatttaagttttgccctacagaaagatttcacagagtattttaaaaagacaaaatggatttccttaatagtaatagaaaactttcacctttcagatctttaatattcttcgcttgttagtactaactttcattgtaaaagttccttttatattcaaatatggtgctccacacacagtgaatgtgcagtaagtacctgttaactagaaagagtatttaatacattgagaaaagatgtactatattaaatagttttcagtttgtctttacaaatcctttaagcattttacctgccttctaacagctaagacatgggattttatctgttgtacagtaggaataaaaagataagatgttttcttttgtttttgaaatggagtcttgctctgtcgctcaggctggagtgcaatggcacaatctcggctcactgcaacctccgcctccagggttcaagtgattatcctgcttcagcctcccgagtagctgagattacaggcggccaccactgcgcccggctactttttatatttttagtagggacaggatttcgtcatgttggctaggctggtttcgaactcctgacctcaggtgatctgcctgcctcggcctcccaaagtgctgggattataggtgtgagccactgcacctggccaagatgttttcttaaattaatatttttctaaaagattttatagctcttaggtaatactcttaaatcttttccatatcgatatctaattagtccattccagggctcggaaaaaactgtattttatttaggccgtacccatatgttacatggagacaagacagcagagtctaaaatactatattttggccaaaaaatatatgttgaaatcctgaactatatggattattcatcctgtaagagaaaacatgccttccatagccaaatcattctgatatttccccacatatgtaaaaattttgggcgaggcatggtggctcacacctgtaaccccagcactttgcgaggccaaagcaggaggattgcttgaggccaggagtttgagaccagcctgggcaacatagtaaaattctgtctctatattttaaaaaaaagttaaaaattaaaaaatacattaaaatgtcactagacccttcaccagaacattttagtaaatttttgctaactccaaagctacctacagactgcctagattttttcagtttcagtcttactacatgtaagactacagggacagttctttcatttacagttccatcaaactagatttttttaagtgatacatcttctttgcattttctgagtagcacatttagatatggtaagacctgtactaaccaagaaactgtcaaaactgcttttgattggcatgggaatttagactccatgctttctttctgcaggtttggtgagaggactggtggaatggagtgcttcttgcataaccatcccacaatacggaaggatgctcaccatgtatctaataaagacagatgcatgtgaggtcttttaattcaatttctcttctccaagggagctttgttttagcaaatagcagtaattctccacaccagtgtaattgctttccaaaattaacagatgtttcctgtacattctggaagcctggtcagtgggacactggtttactcaaaatgcagctggattctgacttcacacaagcaaaagcagtgtttaacctgaccactgtttgctcagatgtgactacttaatttgtgccaggtatctgctggggccaaggatacaaaggtgttgtaatctctcacaatatttattcttacatagttgtccctgggtatctgtgggggattggtttcaggaccccccacagagaccaaactccatggatgctcaagtcccttatataaaatggtatggtacttgcatataaactacatatatcctcctgtatactttatttattattattttgagacagtttcgttcttgttgcccaggctggagtgcaatagcacggtctcagctcactgcaaccccacctccaggttcaagcaattctcctgcctcagcctcccaagtagctgggattataggcacccgccaccacgcctggctaatttttttgtatttttagtacagatggggtttcaccatattggccaggctggtctcgaactcctgacctcaggtgatccacctcccaaaatgctaggattacaggcatgagccaccactcgcggctcctcctgtatactttaaatcactgttagactaattataaccaactaatataaatgctacacaaatagttgttatattatttagggaataatgacaagaactaaaagtctaaaagtctgtacatgttcaatacagatgcaaccatccattttcccccaaaattttttcaataagcagcttagtgaatccatgggtgtgcaactgatgaatacaaagagcagaatgtacatgtattttttaggggggaagcagagggaggttaacaaaatgttatgatagaatgatgagttggtgctgtgcaacagtagaagaccaaggaaaggggtccattgtactgtttgatatgtagttaaaatcaatatagtaaatgttagctatttttattataccataaacaggatatgccaggcaatatgctagagaagggagtggaggcacaatgtacaaaaattcacttcctcattcattctttcaataaatatttactaagcacctatgtgtcaggcactgttctgggcactgaggacaaggcagtgtaacaaaatttaggatcccccatccatgcaggctgttttctagtaggagagacacataagcaaacaagtagataatatactgacaagaagaggcagtgttagaaaggaagaacgagatgagtggatggagaacaatggggaagattgggaggggagtgtattttgttacctttcctacattggaaggggaggatttccacaaaaggtagcatgtgaattaggtctagaaagatgaaaaattctctgtctgggaaaagggttttttaggtagtggaacaaagccatgagagaagagcatgttttggaatgtagaatgtggtcaattttgtgtagatgggcaataagatgatcagactgggaaggcagactgccataatgtgatattactgcacacctgtcagcattgctaaaataaaaaacagtgacaactaccaactaccaagtgctggtgaggtgtgcagacactgggtcactcatacatcgctggtaggaaagcaaaatggtatacctactctggaaaacagtttggcagcttcttataaaactaaacatgcaattcccacacaacccctaattgcacttttgggcatttattccagagaaatgaaaatatattcacacaaaaacctgaatatgaatgttcatgacagatttatttgtaaaagccaaacagtggaaatggcccagatgtcctttaagtgaaatactactaatatttagcaatacttagcattaaaaaagaaaaagctattggcatacgcaacaacttggatggctctacagaaaatcatgctgaatttttttttttttttgaggcggaatttcgctttcatcacccaggctggagtgcaacagcatgatctcagctcactgcaacctctgcctcctgggttcaagcaattctcctgcctcagcctcctgagtagctggaattacagatgcccaccaccacacctggttaattcttgttttttttttttttttgagacggtgtctcactctgttgcccaggctggagtgtagtggcgtgatcttggctcactgcaacttctgcctcctgggttcaagcgattctcttgcctcagcctcccaagtagctgggactacaagcatgcaccaccacacccagctaattttcatattttcagtagagacagggtttcaccatgttggccaggctggtctcaaactcctgaccccaggtgatccgcctgcctcggcctcccaaagtgttgggattataggcatgagccaccatgcctggcccatgctgaatttttttaaaatgccaattccaaaaggccacatgctatatgattctatatttttattattttgttacattttattttctactttattattttatattttatttttatttttttggagacagggtctcactctgtcacccacgctagaatgcagtggcgtgattacagctcactggagccttgacctcctgggctccagtgatcttcctgcctcagactcccaagtagctaggactacgggcatgtaccatcacgtttttaaattttttgtagagatggagtctcgccaagttgcccaggttggttttgaactcctgggctcaaatgatgttccttccttggcctcccaaagtgctggggttataggcatgagccactgtgcctggctgtgattccattttatataacttttttttgagacggagtttcactcttgttgcccaggctggagtgcagtggcatgacctcagctcaccacaacctccacctcccaggttcaagcgattctcctgccccagcctcctgaatagctcagattacaggcatgaaccactatgcctggctaattttgtattttcagtagagtcggggtttctacatgttggtcaggctggtctcgaactcccaacctcaggtgatctgcccacctcagcttcccaaagtgctgggattacaggcgtgagccaccacgcctggccttatataacatttttaaacaacaaaacaatctgaaatagactagtggttgccaggggttgacgggaagaggtgggaggggggtgggtgtgggtataaaaggacaagaggggtcttggtggtgatggaatggtgaagatggagatgcaaacctacacatctaataaaattatatagaattaaatacacatgtgagtacaagtaaaaacggggggaatctaaagatcagtgtggattctgtcaatgttaatatactagttgtgattctttactatagttctataaaatgttaccattaagggaaactagctgaagcagactagtttctctctctattgtttctttgccacatgtgaatctacagttatatcgataaacatttcaattaaaaacagtaataaaccacattgcaaattcctcctgggtaagaactatccttaatttctatgctgttttttcacttccacttccaaatgccgagagcagcctcagataaggacataatcggaggtaatttatttgtttcctggttttcctgaggggacatgaagtttactgacttctataaaagtaaaatctattattttgctataaattttatatttaaaatgccatataaattctatgaaataaaatctaacaatccaaatctctctgaagcacctgattagctacaacggactaaaatcacctgacaacatcccctccagcaggtaaaatgtcactatgtttacataagaatcagagatctctgaaatcaactgtcatcaggtaggaatctctgccaaagaatactggcagattgaggccacaggacttcaccaggttctataacaaaagccttcagagcagcatcacaccactgtcccttggccatcctctgttttgtttttagcataaaacagggaaaggcaggaaacaagcgatgaaaggcagtgaaatggacacgtacctacacctgtagactaaaaactgaaagcctatacttatatgccctttgataacgaaatgtcctggcaaccaggccaactgtgtcgctatttgtgggtagattttaatttaatttgagaggaaaaaaaattacaaattcattaaaaagtcagaattataggatattttaaataaaatacagtttgaaagggccgggcatggtggctcacgcctggccttatataacatttttaaacaacaaaacaatctgaaatagactagtggttgccaggggttgacgggaagaggtgggaggggggtgggtgtgggtataaaaggacaagaggggtcttggtggtgatggaatggtgaagatggagatgcaaacctacacatctaataaaattatatagaattaaatacacatgtgagtacaagtaaaaccgggggaatctaaagatcagtgtggccaaacatggccaaaccccgtttctactaaatatataaaaattaggcaggtgtggtggcgcacgtctctaatcagctacttgggaggctgaagcaggataatcgcttgaaaccgggaggcggaggttgcagcgagcttgagatcacgctgctgcactccagcctgggtgacagagctagactctgtctacaaaacaaaacaaaacaaaacaaaaaaacattttgagtaatttcgtatttttaaatatacctttaacagccaagtacagtttttcaaatcagtttggctctacagaagcctgttacataattagcacagtaacagcaggttgtgcatagaaggaagttattatttatttatttagaaacaaggtcttgctacgttgcccaggctggtcttgaactcctggactccagtgattctcctaccatggcctcccaaagtgctggaggccacgcccagctaattttttgtctttttagtagagacggggtttcactatgttggccaggctggtctcaaactcctgacctcgtgatccacccaccttagcctcccaaagtgctgggattacaggcgtgagccactgcacctggtcagaaggaatttaaatatgctttctatactatgactatggcatttattcacttaaaacaagacaaaccaagttcagttcagcatagacagtattaataaacatgccaatttttttctttttttttttttgaaacagggtcttgctctgtcatccaggctggagtgcagtggtgcaatctcagctcactgcaacttctgcctcccagactcaggtgatcttcccacctcagcctcccaagtagctgggactataggtacatgccaccatgcctggctaatttttaaattttttgtagagacaaggtctcactatattgcccaggctggtctcaaactcctgcctcaagtgatcctcctgctttggcctcccaaagtgctgggattacaggcataagccaccagagccagccagatgacaaattaaaaagtcacaaagaggcatctcaatccgttttaccttggaagtagattcagcaagccttttgggagacagggtcagtgactataacctgtgttccagtaatgctagcagtggtttgcctaagaacttctctcaacttatagccagactgaacatgctccctcatccagtatccaggtcctactctctcacaattcaatatgctcaggccaggcacggtggctcatgcctgtaatcccagcacttcaggaggccgaagtgggtggatcacttgaggtcaggagtttgagaccagcctggccaacatggtgaactccgtctctactaaaaatacaaaaattagcccagtgtggtggtgtgcacctgtaatcccagctactcaggaggctgaggcagaagaatcgcttgaacctgggaggtggaggctgaagtgagatcacgccactgcactacagcctgggcaacagagcaagactctgtctctaaaaaataaaaacaaacaaacaaaaagaaccccaaaaggctccataaagtcttccttctctaagaaatcttcaactaattagagggaacatatcacctgcgtcttttgggggactatacccctaccattcatttaaatctattttttccctaagttaataagggtattatcttattacaaaaagtattttagccttacaaaatatttactttggggacccataaataacattattaaataaaagtgctttagacgtcagaatgtacttgacagagagaacaaaatgagaaacagggataaactggttaaaaaaagcagctctcatgtaaatcagtggggaaatatgagacatgcataatcctttccatgccattaatgtccacatgcaactagtaaatgacaggaatcatatttaacttgctttgaatagcagccaccacctaccggactaaatgcaaatatgacataatgaattcagtttccaacctttgaaacacctattacctaaccacaagagctttccaatcaatgaactcttcctgcatgaaaaatctggggtctctacaaatgctcattaatttctattcctatcactgcaggtgtctctgtgttttccctctaaatagtgaacaaattaaagacagaaatagtttgtcccttgtggtcccttgggtagaagattcacagacctctaccaatattaataataaaaaataaaataatagtgaaaccatggctcacagcaaagcacaacatcaacatgttctgattaaatgtcagtctgtctcaggatcagaaaacttggttccatacttcagtttatctacaagttagctctgtgcccttgagcaagttattcaaccccattaagtcttagtctcctcatctgttaaagaaaacaataatatctatcttaaaggacaaaagggacgaaatggtacacgcaagagctcctagcataatgctggcatatcggaaatcttgagtaaatccaagcgattactatttttttttctgttttttgagacaagagtctcgctctgtcacccaggctggattgcagtggcgctatctctgctcactggaagctccgcctcccaggttcacgcccttctcctgcctcagcctcccgagtagctaggactacaggggcccgccaccacgcccggctaattttttgtatttttagtagagatggggtttcaccgtgttagccaggatgttctcgatctgacctcgagatccaccagccttggcctcccaaagtgctggggttacaggcgtgagccactgtgcccgtccacgattactattaagcctaaaactcatgctatttatgtgaatggcacttctaatccttcctcttgtctggttcatagacttttggtgaggtggagtaaaaactggattgatggggagtcagtttgggggaagaaagttttgttaacgtgtattagtagcatcagattatttgtttgctgaaagtttctgcctggtttgaatattcaccttgctgaaatcaccattttaaaaacagccatataattctgtgttcatatgcatctgtgtgtggggcctccttcctcacagcggtaacaacactgttacaaaaggagaaaaaagtgcaatgatgcaagtaaacctgaacctttgtgcaacaactaagatcactttcgtcttctaaattttgctcactttctctataaggctttccaccccagcattagaagctccaggctggagctctggttttggaatttcccatttctgtggtgtgggcaaagtcgacaagtcttcacgggctttggttgcatcagtgagtgaagagactttactgcatgatttataatgattcctttagttctaaactttaatgatcctaagactatatttaacctaaaatcattaacagacatatgttaatttctcacttttttcaaaccacttgattacacaacaaaaaaaaatccttatttatttttttcttacccccagacttctaaaagactaagatttcagaaacttttgttatcaagcaaatcatacctggacttgtaaacgatttcattatctatccctgccttcctccccagtaagaagggcagtagagatggactgtgctttatctgcatgtttttagtggagctatggaaagaaaaattaagtagtggaaaagctaccttttttttttttttttttgagatggagtcttgctcttttgcccaggctggctcaatcttagctcactgcagcctctgtttcccatgttcaagcaattctcctgcctcagcctcctgagtagctgggactacaggcacgtgccacaacacccagctaatttttgtatttttagtagagacggggtttcaccacattggccaggctagtctcgaactcctgatctcaagtaatatgcctgcctgggcctctcaaagttctgggattacaaaaagctacatttctacactgaaatccctttcttcttgggactgtgggatacatcaaaagaccaaaagaaagttagggaaggtggggataagctacaaattattccttctttatacattttgtcgacttaaaactacagttgcccaacaattcaaaatcagaactgcttttcagatataaaacaaaacaaaacaggctattctaagtttattaaaaaccatatctactctttaatttctaatgtttcatacgatactaacatatgccaaagtatgtcaactgttataaatgttatcaaaaaaaactgacttcaaaaaataaatgatctaagtaaaacatgaagttttcgactgaatccacaggagctaaaagaacaagcagttacaccatttcaaacataaaaagcctaaatgtgtttgttttccttttaatttttatggaaacatcagggggaaactggttttctttgttcagtgtttattatttcacctttcctgcatcagaaaccaaaatactttgataaatgggagagtctggtaaacagacccttgaagatgagggctcagaaccactaatccatcgcatttccatcactgttcatttttcatgaaatcacttaaccaccataactcaatttctttgcatataaaagggtaacacagcaaccttactccaattcatgcttatatagaaccaaaagggggcctataataaatgcaaacaagaagggctgagaaacctgggaaagaaaactgaaagaagacagctgttcttcccagaaatacaatcatcatatttactccactgacagtctatttggccactcctatttttattgctccaatcatagattatctctgcctgctgtcaaaactacttacaaatacagtttttgctccagagatccacgaacacaattaccagaagcaggctaagccaccgaagtagtttttccataccacccagaagaaagtaggcagttccattcctgaacttaagacactcagcattaaaaaaaggccagtacttctttgtagctacccacacccaaatgtgctataacacgaactgttctttgtacctaacatagtttcaagaaagtattaaaataaataggctgatataaacatgtctagtctgcttttttttttttaatccaaaagggcttccctaaagaccaaatttatctatgcgattccaggaatagataatgaatttttaaaaaatgtctagaagaacataaaaagctatcaaatgtaatatacaagcacaggcattacttatgaatatgtgaaatatgaatactcattcccttccataaagacacacgcccagatctggaattcccctgaaccacctggaagatcagggagataaaagttcatctccacctcttcatcctgttcccttcccccttgctatttccctcctcaacacactaacctttcccttcttgaaggcaccatcattcaagagtcacaaaagccatttatttaacttcactgctgttttattactgccatagtctcatttcctattactttctatcacatttttcatatattagaagctaaatatgttcttgtgggcgggctgggaaagcaacccccactcagttatgactactgcaaaaatgcattccgatttccaaacaccctactgctaggttttatccattccttgactgaaggatgattgtctgattacctttatatatcaggtcattacaagaagtgcaaatacttaggagaacatagtgggccctccttgtcaccctccccacttctgcccttcccaaaagacttacactggggacatttctctaggacctaggtcagaaattcactttacaaagcaatgtttgtctcactgattaactcaaattttataaaaacaaaataatcatatccttggctaaatttaagatttttagatctttattattcaagaacttgatgaaaacacagcaatggaaaactagttagctctaaaaataataatgcaatcttttattctcccaaagtgtgcaaatttcagctatctcaaaaaaatgttttactaagcaggacagaatacacacacacacacacacacacacacacacacacacacacacacatcttcttcttccatacatttttgtagtctatatttttttcttctatctctaaaaatatgtctctaaaagtgtagagtgacagtctaccacacaaaaacatacatatgggctggccgcggtgagtcatgcctgtaatcccaacactttgggaggccgaggtgggctgacttgaggtcaggagttcaataccagcctggccaacatggtgaaaccccatctctattaaaagtacaaaaaattagctgggcatagtggcagtgcctgtaatcccagctactcaggaggctgaggcaggagaatctcttcaacccaggaggtggaggttgcaataagccaagattgcaccactgcacaccagcctgggcgacacagtgagactccatttcccaaaaaataaaataaaataaaataaaataaaataaaataaaatatcatttatctgctttggcaggaaatgagaccaaagtaacacagctggacaaaatactgcaatttaattcctaatatttaattgatactcttcataatacttattcctaattcctttaaaaaaaatttgtttctcctttttttcatagagatagggtctcaccatgttgcccaggctggtctcgaactcctgggctcgagcaatcctcctgcctcggcctcccaaagtgctgagattacaggtatgagccaccatgcctggcccctaattccttattaaaaggaaaaaagaacagctttattgccaagaaagaaaacccaatgcttctgctgcaatttcaaatgcagggtaagtatgcaaacaaacagatttgccagaactgtgtggctacaattctaacacgagaaacacaaagttaaagaggcatacagattttttacatttcctgagctgtctctgaaaataacttacaggaaagggctgctgttgaatatcagtcccaacccccaccttctaactgtgcataatcttaactgtgctacgacaacatggaaatgttcataggctgttaatgtatactctaatccttacattgaaatccaacaataccatgaggtggtaaatgtaaccaaagagagaggtcttctagactaggtttcctgatttacaatgaaaatcccataataggacttgcagtgtcattcagcagctcttcaagaccagtctcaaatttaaaatggggagaaacaaaaacttagtactttctttcatcagagatgagggtatactgattcatttaaaagaaataattttgaagttcaatttatgttgaattctggtgcttgaagaccaaaagataaatccaaacctgtcaaatgacaggcacttctgggcaaagtttcaagggacaacaatccacatttctgattccacttcctctcttctcagtcccagtttgcaatctggctccttctccaacagtaccactaaaactgctctcaccaacattaaaaaacaacctcctaaacaccagatctaatcacgcccatttaaaaaagacttggttcaagtgttgccatgtaggtgatgttttctttaataccctattcagggtacaactaagaaaaagacaactaattagtaaaaccatgtattataaatttctgtcacctcaatgggcagaagttccttgggagtaggcatcacttttcacctttgaaagtacaatgcttgacatatggtcagtatctgtgaaataaataaatcgagggtttgctaagttgcctaggaaaacccaattatcatactttttctttgaaatatttataataagaacaaattgaaacaacacaggaaaaacttggaatgtttccagggacagttttctttatagaatcaagaaatctgcctcaatttcaaaaaggaaattccaacatttggacactattattttgctgatttgtctatagcccttgaataagggttacagacaaaggctcaaaggctcaaattttaggaacttctctctgaacatcaaacttcttaaataaaaatagtagtaaatgggtacccatcacctgaatatcaataagatagaaagatcctttgcctgctggctattttatgtttattatatctgaaacatttcaaggaagaggtctcataactatactcccaaaatgtcagaataatccagagtggctcacagttgcactaccaacaaaactgcctctgagaacccggagcggtgactaaatgatgacctatctggaacacctaaagctatggtttctccagccatgggaacttcccttccagtctccttcatcttcaggtttggctgttcgtcctttctcctctggggtttctcagtgccactccttacaccctcatccagtctcctcctctggtttcttctactcactctgccaggcatcagaaactcaattagccgaatgatgcagttagcaaaggagaacggggagggaaagagagaagggattggaataagaagaaaaggaggtagagaaactcactgcctactaattcccagccactaccctacccttcccccttatcactcctgacgactttcagtcttccacacagctcacccagcccccagtttcctcattcttccttagtcatctcatccttcccacaaaccctggggccccaggccttgtagatttgctcctctgagatcccaggtgcttaaccccaccctggctaccgcctcagccccagcttgcatcacagggacacacgtgcatgcacgcgcacacacacacacacatacacagtcagagataattcacctcccttgggctggggtagggagaggagtggaggggaagacagggcagtaatggttaatataacctgcggactaaactgaggacttcaccaccatttcaaagctgtttctttgggaaatacactctgagttccaaattaccatgaacttttagaacacaatccttttaggaattggggactgcctacaactactttctgataaattgtaaacatgttgttataaatttgtaaatgtaggctaggcatggtggctgacgcctataattccagcactttgggaggctaaggcaggaggatgtcttgagaccaggagttcgagactagcctgggcaacaaggtgaaaccccatctctacaaaaaatacaaaaattagatgggtgtggtggcacatgcctgtggtaccagctacctgggaggctgagatgggaggatcacttaaccccaggaggtcaaggctacagtgagcagtgatggtgccactgtactccagcctgggcaacacagcatgactctgtctcaaaaaaaaaaaaagtaaatggtaagcaatggatttatgaaacatctatattctaaagaataagaccatatgggctacacccaagcttgtcaaaagtctgtttactaaccagaatttggttggtcacatgtgtagactctgtaaaatacatgattcagtgaattagagccctgacccagactttcttccctgaaggttgagaaactaagacacccttgtgatgaccccagcagaaaaatcttaaacagagttcattttcactttttcttatcattttagaaccccagtcagtgtactggattttgaattaagtattctaaggcacaggtctgtattttcaacagcgagattaccaaacaggaccctttgagctcacctgaaatgtatgcctcactgttcatttatttgatctcagggtgtcaaggtgtcctcctcaggaagacttgaatttcttttctcctctattcaatgttgtttacaagaggaacaacctcccaggcaatactgtgattctgaccctatgactcagggcttttgattcctctggcacattttagtagtctcaagcctgttgcaggctccctgctgcaggcctaaacaaaagtctccttggaaagcgaaattcaaaagcaaagctcacccagcttttaccaggctgccctacttgacagcctataacctgtccaaagccgccctggtttcctgtggcctccagaaagaactctccttatgccactggctggctgcgtccattaaccccttctcaccagcttccacccagtcgagtagcaggccctaacaaactaagcagcataacagataaaaaacaagctccaggattggcagagataatggtaagcccttagggtttaagcctgatggccaacagaaaacacaccccaatggccaaacctccaatttcaagaaaaaattgtactcattcacaaataaagtgattaaaaaaaaaatttatcttaggcaaggatagtagtacattgtgaagaagccaaccaaacttattacacacaaaaaaatatgcaaaagcatgtttaaaaaaaaaaaggatagtaccaataaaatggttctgcagagaagagcaatcctgaaaacagacaatttgaaatatttatgccaagaaccggtagtggtggctcatgcctgtaatcccagcactttgggaggctgagatgggaggatcacttgagcacaggaatttgagaccagcctaggcaatacagggagaccctatctctacaaaaaataaaaaataaaaatcagctgggtgtggtggtatgcccctgtggtcccagctacttgggaggctgaaggtgggtggggatcacttgagcccaggagttacaggctgcggtaagccttgactatacaactgtactccaccctgggagacagagaggggaccctgtctccaaagaaaaaaaaaaaaaaaaagaaaaagaagtacttatgccaaggaaggagctttttgcctaggtactaatattcaggaagcagaaatatgaaaacagaatgcagctggctgtgagaaaaattagacaagggaggaaagtagccatttttaggcaaaaggaggaagggcaggaaagactgactacgagtaaagagaaatgctatgagaatacctgacagttaaaggaacttaaaataatttactttacttggtacgctgacttgctcgacaattttatttattcaattcacccaacaatgcttttttttttttttggagcccccaagatatgctttggctgtgcccccacccaaatttcaccttgaattgtagtccccataatccctacatgtcgtgggagggacccggtgggaggtaatttaatcacgggggcggttttcccccaagctgctgttctagagatagtgagtgggttctcacaagatctgatggttctataatgggcttttcaatctttcggtctgcacttctccttgctgcccccatgtaaagaaggatgtgtttgcttcctcttccgccatgattgtaagtttcctgaggcctccccagccatgctgaactgtgagtcaattaaacatctttcctttataaattacccagtcttgagtatgtttttattagtagcgtgagaacggactaatacaccccactatgtgccaagtattttctagaaaagtcacatttcaagacttgaatttcaaagacctgaagttagtggactaagaacaatctaaagatttccaaaagggtccatgtgcttttttgttaaacacaaacaaacattagaaatacaatggaaaagctacctatgcgactatggagagaaggaagccgctgcagtggttgctctcttggcctattttcattcattctctcttagacccaatcaacatctactgattctactaggcctcttgcttggctttatccagggcaaagagatgactagaactcttcatggagcttaaaaccaaatacagaacatcagacatgccaataaatagttatacattaagacagcctgagatgaaaggatatcacagcataactgggtggtcagaataggaagtaaacacttctgactaggtaattgtagaagcttaatgaagccaaagactgagggggtggattattgaggatgggcacgattttaataagagagatggagtaggtattccacaggtaggaagtgcacacacaaaagtgagaaataggcccagtgtagtgactcatgcctgtaatcccaaccctttgggaggcaaaggcaggagcagtgcttgagcccaggagttcaagaccagcctgggcatgatggcaaaaccctgtctctacaaaaaatacaaaaattatctaggcatggtggcatgcacctatagtcccagctactcaaggaggctgagatgggaggactccttgagcctggggagtcgaggctgcagtaagccatgatcataccactgcactccagcctgggtgacagagtaagacctcatctcaaaaaaaaaatttttttttaattaaattattttaaaagtgagaaataaagagtagttacgtgtttcctgcatttttcctatatccacttgaggtcagcaattagccatcaacaggtaaaatgaccaatcttcaaagagtggtgaacttctaaaaatgtggaggttccacctgataagcgcaccacacgtaaatgcctacatatttcagtaacttcagacttcttatacctagcaaataaatgtcattgaattggccaatttcctgccccaggtttcctgatatgacttctgagctggtgtctggaggcccaggacctctctgttccacgccttccttgcagcagcacctacattgccactggttcaaattctttgaatcggttactaaaataaattaactacttcaagcttgtattgcaaatacccattccaactgtatgctaaaaggaggctgcacttgagaataattacacattttctaaactattccttcaaccacgtgttttttttccccctgcattcctaactcaccaggctgttgaaggttaattgcaatgatgcatgcaaaagtgtctgtctggcacctgttacctggaatgctgatgtctgggtccaagctgcagctggccatctggagcttcatacggctcttctacctcatacacatttgcatcagcgtcctccatgctgctggaattctgccattccaactcttgagttttccgtatagccataataaatggcaagttctcgtactctggtatttcctcataatggcgtatattttcatactccggtgcacagaggcttgtaacagacttgtaaggtgcctgagatgatgactcccgggagagcatttggtcatccaaagactcagctctcagaccattagctgcactggtctggccccgagacttcttcctcttcttttgagattccaggctatagttttctgtggaatatgccttgatgggtttacttctcttctcctctcctaccaacaagccttgccaatcactttcaatccccttctgctccccactggagaggtggcctgtggtggtgtctccgagttggctactcttggaccaaaatttttgaaagtcactcttcatgaaacagatggacagtttcatgctgagcaactttttaaaagagtttttctttgtagagtctttgcaaggcttagtgcacttttccacatccatagcagataacgattttgctctgggcttggttagggctgttgaaggctcactgtttgacgatacggtgacagactttaagaattctgggttccctgaaaagggtaaaataggatgaggtaacttccacactggcttttctgaagcccgtttaggcatatcaaaggaggatgacacaccacggttttgggcacacaaatgctgaaggtgatttctttctagactcttctctgaacttttttcttcacttgaaggataagaacttttttccaaaagctcctcggaggcagcctttttaagcactcctgtagcaggcaagctatgtctttgaggttttttggggacaattcgtagagaattttcctcttttataacagattccttttgcatttgaggggcagaaactcccaggtttctcccagattgcaaatgttcattgcaagttaatttgagctgcttaggcaggctcatagatacagtacatcttataaaaccggtcccttcgtccacagcaagcgacatactagaaccatctacagttgtgctgtcagaactcaaattagagtctttatcaaaagaaggtgccattttttcaaaggaagttgtttcattacacatggctttctgtgaattgactaagtcctgtgcatcactgttggattccatattcaattcacttttatttcctagcttcattttatccacctgttcctgcttacacaaaacattctgatgcagaacactgattttattgattttcaaactattttcagtaagacaggaagagctactgtctgaattccccggttcttcagtgctttcactaggagtatctacacacttttggcgtaacagacgagcagttcgtgtctttctgggcttgggagttggaaattttggggtatatggtactaaatgaatttctaagggaccaaggtctttgacttctgatttcttactaactccatctgaagatattaaagtactccttttcccattttccagagcctctagttcagatgactgaaagcaattattgcttttttcactgtcatcctggcaagtttcaaaatgttcacattcatcactaggaagctgtaagtggcaactgtgatgatcaggaactttttcaaagctggatggggaaggtgacaaatccgcaaattcaattctgaattgtccatttgaattacagccaccattcatttctgggctgtctgtgggcctgtgcttctgtgcagaaataaaaggtggcatttggtgtattaaggcatctttgagctcctcttctaaaacgcttgcctttaaaacaaccccaccctggttcttggctttttcaccatacaaatcacatttactcctagtttttatagtcaaagtctcatcaattttactgttttctaaattttcattcatttccaggggctctaaaacaagctgctttacacacaaattctctctatggcccagcttatggatacactcagaactgcaggaacacattggtgaaatataatcattgctctgattgccttcatatttacaattaaagttgtcagtgctttcagctaattcctgtttatgcccttccaggttcaacatgattttccttgatggcgactgcccaatctctcgaacaggtgaggtcttcaggacttttggttttggggctattgctggtttcattttctttgtcgactgtggaacactagaaatcacaatgtcgggtttaggtgcaataggaggtggggctggcttattatttgccacaacaaacttgggcttgggggccactggtggcttctttatctctagaaaggaaaaaataataatttgatgtcaaaacaaccaaagcacaaaatgatacatgattaaatctgatagcattttttatttttaacaatatgaccttgccttttactgagtatgttacattatatagtatcaatattactcctgaaaattccttaaattgtctttcaattccatacatagctttgggtctattgtacatttttaaataaatccaatacagtttgtttctccagctttggaactgttaccatatctttttttctttttcttctttttttttttttgtgagacggagtcttgccctgtcgcccaggctggagtgcagtgacatgatctcggctcactgcaacctctgcttccagggttcaagtatttctcctgcctcagcctcctgagtagctgggattacaagtgcgcaccaccacatccggctaagttttgtatttttagtagagatggggtttcaccatgttgatcaggctggtctcaaactcctgacctcgtgatccacccacctcagcctcccaaagtgctgggattataggcgtgagccaccgcgcccagcccatcatatctttcattgacaaaaaatgagataattgacttcagtttgggacccacatagttgttcttcaattcatttgccaagtgctgaaagttgaatttgcctaagttaaatgtaggatgcagctctttaaacttcagatcaatgatcaatgatctgtctacctcgatagatagaaccccaaaacaatattaaaaaaggaagacagaaatcagaaattttctaaatttaaaaactgaaaattaattctttggtattatttaaggctcataataaacctggtatttctttctccaagagttattggttgggaattttcattatattccttcacggagctctattttttaaaaagtcacatgtctaggtcctaccctagagtgaactagttagtttctggggatagatcctggacatctgtacatcttttaagttccacaggttatgttgtttatccctcattaacatccactgttctactacatttaaaagataactacaatttctagtgtagcaattcttcctaaacattatatataaggtatttaactaacacctattatacaatgctgcatcggtacagatctgctcctatactataggaacctaataaaagctttacacaacagacctataaagcgaaaagataaataaagcctgtatatctgtaagttcctttatgttcttccacctacactgtcatattattgaccacatttccccaaggagacatgtcataaaaaatattttatcttttacatttatatttgttcgtttgacaggatctaacacttaataaaaacttaatttactgaaaaaacttttcaaaatatctgctgcaaaggactgctggacgttgtttaattacttgaatagacaggggctctgatatttcatttggtgatgacttacttttgaacaaaggaaattagtcacgacacttgggaagctattacacggaactgagtttttttaaaaaaaagaggagtagggtgctctacttccttttaccaaccaaggaagaattccctaaatctctacttctatgtgtgcaataaagattatatgatgtatatgatgatacatgtcctctcactcaatttctaggtataatgtcatcatcaataaaaaattattttcaaaataatgcaaattcctatactacataatttcagttagctgttcaatcatcatagttaattttgtctgagttttttttaggcagaaaataactgaaaaacccttcaaatcctagtgagaaacctagttgtaaatgtctattaaatcaaaccctccatttagtaagtcaagtcttaagagaaagtatgaatgccttaggcctcttcccaacggcccatcttactcagtacgactgtcaagttgattttatttctgtaaccattatcaaaacatcctacctctgggatttttcaaagaattttttaaaaattagttttggcagcctggcatagtggctcatgcctgtaatcccagcaccttgggagggcaaggtgggaggattgcttgagctcaggaattggagaccagcctgggcaacacagtaagactccgtctccatgaaaacaaaaaaaatagtttcgtaaaatgaagagttcttgagattggatgtaccatgtgaatgtacttaacacttctgaactatacacttaaaaatgagtaagacggtaaatttatcttatgtgctattttaccacagttggaagaaaacttcatctctcatcaaattaatcttttactttccgtatcttagaaccttgtcagaagctttagggtcatttaaatatcatttttaaaaaatccctggtaccaattttactctttttaaaaaatgcgttttgtacacaaatctgcttccaagagatataaattcctgttctagtgtcacagaaattcaattaactacgtatgtgctggagttgattcccaataaatatagcaaagtcctattacgtacataaaaccctcaacgcatactcactgaattcaattaataactgtgaacttgggcttgccattgttagttaactgtgtattgaaggaagtcacagacataactcagggagctggctaacctaattgtgggccttgtacagacctggctgcctcactttccttccttataaatgggggagttgaacaggcctctaaagcccataggaatctgagatgataacttctgagacactcatttcagaagaacctcatgtactgtggcctctgtctcctgcgttgatgttttttcagttcacctttgtctgtgttcagcataagacacaagctccagaagggcaggcactttgtctcattcactgatgtatcccagtgctaacaacagggcctgggaataatcacagctgccacatacacatactctttaatatgtctccataacagaaaatttcttctttaaaaataatcacattcaaaaatgtacatccattttaatgtagaataatattttgaaaagttagcaggaatcaatttcaatacgattattgaaaaattccttaattattaataggaacaagtgttcaactaagtcactggtagagcaatatccaaaatccttcattatttttttttcatggctctattttggaagaaacacaactcaaaaaataataagccattatattatggtctactccaatgtgaaataagtgcatgacatttggcaataaatctagcacctttggatcttaatactgcatcaacagtcagacccaaagcttcttagagcaaagcagcaaatcttttatttacacagctgtttggctccagggaaatataaggtaagaaagtaaagcactagtaccattttactaactattacaaacatactcgtcatctgttacacacagatggctgtggttcacgtgtacactctctggctactggaccagccaaaacgcaaagcacagacaatgaagacagtgacctgtacatgttcaaaaggacacaaaatatatacctatatatacctataattctctctccttttttctttttttttttttttttttgagatggagtcttgctctgtcacccaggctagagtgcagtggctcgatctcggctcaccacaacctccgcctcgctggctcaagcaattttcatatcagcctcccgaatagctgggactacaggcgcaccccaccacacctggctaatttttgtatttttagtagagacagggttttgccatgttggccaggctggtctcaaactcctgacctcaagtgatccacccgccttggcctcccaaagtgatggaattacaggcttgagccactgcgcccagcctctcctttttcatatacagcttaaaataattctgaaatctccactaagggcagattattttatagatgtagaaaaacaaagcaagcttttctgctggatacatataacctagatgttctacaacattccttttattttcttaaattaaaccaacccttccaaataccacagattagattcaaaagcaaaaatcccctcccttaacttcaagtaactttcctaaacgtttcaatgaatttgactattgttcccaaaaagcaccataatcagcttgtaagaactatgtatacatataagaatgggtagaaataaaaccccagttctcttccatattccccatctagacaccagaaagaattatgataaatccaacagatgggtgagcaaaaaagtagttgatgcttctcagccagcaatgctaaaaaccaaccaactcggctagacacaggaagtgtcccactttaaacaccacaaaaatttctgtggatttctttaattgtaaagttgataaaatacaaaaatagcttgcattattttaggataattcaaatgcaagaatcatgaacttccagtctgggccctagaaattgggtttacataaatgtgaaattacatgcttctgtgcctgttccttataaactgttaagactggaattgaaaactgatacatataagacacggttattttaaatacatttgacacctccaaaaaggaaagagctaaaactggctggaaggattttaaaatttccaaccacttttaatttaaatcaatttcttgaacgaaggtaaggcacagaaatgtaggatgaaaataatttaccttatgtaagtataaagcctccctttggcaaagaaaagagagtttataaagatatctcatataagtgcatataacatcaaaaaggaaagacccacacaacacccacttcttgctttcttttcctattggctaacttcttgtttcgtttgttgtaatctgatcacagggagcaatgcaacactacaatatatctaggctttagaaataatacaaatcagaacatttgagtgctgttggacagtttcaagttgcaagaattttaaacaaatgccaagaaaagcaatgaaaatttaatctgatacttaagtgctgattctggaagtaaccttgagaagaagctttaaactatttcactataaaatttctaatgaaagtttcaacgtggacaaaaacgtaaaataacccataacactctacttaatacataagttctggtttaaaaattaacctatgtacttacgaagtgaacgtaacaccactttggtaattattttgtaaaacagaaattgttccttaagaatgttcagaaacacaacgtctagaattgctgaaaatccacacaaagatagaggctttgtcatttggatgaaggggaaagaactatgggaggcagacagaaaataaagctttgtttaccctaatcaggtagaaacaaacaaaataattgtaattgggtgcagacaagcaaaaaaaaaaaaaaaaaaaaaacctcaacaatctcaactcctctgcttctcaggtaacagaggtaaaaccaccaggacatgacaatgtctacgcctctttaaaatgggtaaaaggtttaccagcagatacaaggttgaaagcgactcacttagtggccaaattgaacacgctgagaacactgcctttacctataataactgatctattaacttgggaatctacactattttcacatgcaaaggcgaagtcctcgcactgctggagagatgagcgaacgcccttcacacatcgcatttcacctggtgcagagcccccagcacagtcccccttggaagggagatcccgagaaatcccgggtttccaaacagcccctctgggcaggaaaagacgagaaagccggcagcgaatcccattagctccgcgcttgccgaggtgctcggcaaaggtacggggcacacaactcgcccaccccggcgaagaaagttgctcgcgagcccaagcctagcagcgctcgccacaaactttcccgcggcagcgcgagcgccgtcacttaccggctgcagaagtcatgattccccggtgcagctcgcttccccgctcggcccctcaatccatcttcccctttcagtccattgttcccacagttcgggtaggagagaaaagcccccgcagcgcccacattccgtcccgccgccccgcggcgcagcctgagcgccacacaaaggacgcggccgactctagcgaccctgcggcgctcccgggcgcgagccgccggggtcgggcgggcgagcactagcaccgccccgcagagcggcaggctgacagccaggcgcgggcacgagcagtgctctcttcggctccgctggcgcgtgcccttctcgggctccaaaaatcagcagtgctccgggcgccccctgctagtcgcggccgtaaaaggcagacaaaagccctagcctcctccaatcggagggctcgagcttcagctcgctcccgcctctctcgcttacacgctcactctcttctccaataagcgggctcgaaaagggggcgtgagcggcgaggcatattgggaattgtagttttctggacccacgggacgggcaggagctggagctccgtgccgcctgtactcccgccttcatttcccatcgtgctgaggcgggtggcatggcggagaaggatgacaccggagtttgacgaagaggtggtttttgaggtaagaggaaaatggcggtgggtgtggattgcctttgtttgagaaggacgagacggaaatcgaggaagcaaggcgttcccggggcgagggatcgggtgacgcgctccagctggcctcgaccaccgaaccccagcgatttcagggcctagagtccgtcgtcgcctgacaggtgtagccagaggcgccctggccgtggccggcctctatctcgggcccgcccagaattcccagacggtgcccggttgccaggctctgggctggagcggtgtctcttccttcctgggaatggatgtgcggcgggggggactgcgcccggctggggcggggccgaatcgtgccttttagatagtcacaacttagcctcctccttttccatccgcgatttttttgggtcagtatccagagtgcttcaggtcactgttcaccgtcaaggcgtggccctcggaatgaaggcagcaggtgcccgttttctaacacggtttaaagtctatttgtgggacctactgtgggtagttagggccagggcatctcagcatctagattcgattcttttgtcctttgctgttgcgctaggtgtagccagttcttctgactcggggctctagatgtgagtgcttttgtgtgggactattttaagacgttctctgccatcttgaatgaaaaaaatcgggcgagtgtttttgatgccatttttttccatcagacacaggtcaaaactcgcacccctgtacgtatgtgtattgcatgtatacgctttactttcatttatccaactagattttaagaaaatttaaaaatgaagtggcccatgccatacagcgagagagcgaggcacagacaggacagaatgctaaatgttgaaatatgtacaaactgtcattgaaggattaatttctgttcttgcggcctcccagaggctacacccagtacgcgatatccgaggtgaatctttaactatgaattggattagaaaaaccggcaggagaaaatgtattacagggaaagagaactgattatgccaagcttgggaagtgtgaaagtacctggtgtgcatttttagggggcggggtgtggagggtggctatgtaaagtggcttgatgtggctgcaatgaagaagcagtggaaaatgtggccattttaccgaagtgaagagtctagatatgaggcgttcattagggaagacaagggcctgagatgaaatgagagacgtaatggaataatggcttggacagacacttgtaagttaaaatcgaggcaatgtttatagattgaatgtggtagctgaaggagagagaaatattttctagagtaagggtaactgatgggtgtattttttttacccattatttttgatttctgaatataatagtaatatatgctcaaggaacattttattgtagaaaataagcccccaagttaaaatcatccattatcccaccacccaaagatggtaactattaacagtacggtatgtgttcttatagactttatttctatgtaaatgtgtgtttatgtgtgtgtaattttttagcctctatattaagacacaatgtgtgtgtgatattttttaaaacaaaaggtataccacgtagaattttgtatatatttttcacttgactttatcgtgaatcttttcccattcatcattctctgaaaacattaatattataatatcccctcacgtgtatcataatataacctttttttaaaaaaataccattgtaatcaacagtgatataagcctatttttaactacaactctgattttcctcagaataatttttagaagtagaactagtgggtgaaagaatatgaacatttaagacttacgcagaaaggttataccaattccggtttccattaagaataagagagtattggtttcaccaaatcctcaacaacagccttaacagtttcctttaatctttgctaatttgataggcaaaaataacattccattgttttaatttacattttatgcatttatacatttattagctatttttatttctttgaacatttctcttcatatttgttgctcattttcttattagatgctagctttaaaaaaattgacttgcgtgagttcttcatatattactaagcctttgtcatacttgcagaaaaatttccagtttgctgtttgtttgctctttgatatacacaatttttattgcagtataatttacataaggacagggcacagatcacaagtgtgtggatggttatattttcacatgttgagcacacccatgtaaccagcacccagatcaagaaacgggacagatggggcatggtggctcacacctgtaatctcagcactttgggaggctgaggcagatggatcccttgaacccaggagtttgagattagcctggacaacatggtgaaaccctatctctacaaaaaagacaaaaattatttgggcgtggtggcacatgcctatagtcccagctactcgggaggctgaggtgggagaatcacttgagcctgggtaggtcaaggctgcagtgagccatgatcgcaccgctgtactccagcctggatgacagagccagactctgccccaaaaaaataaaaaatgaaaaaagaaacaacatcaccagcacaccagaagctccctcctggtcctttccatcactactccctaccccaaaatgatcactatttaaacataataacctagattaattttgtctatttttattgtttagacactgtgcatttccatttatatactctcttatttctgacttttttttttcctctctggctttatttgtgagattcgtccatattgttaacatgagaatttttattttggcatagtattccatgtgaatatatgatcatttttaaattcattcttctattaatggtcattgagtagttcccaggtttaaactagtgctactgtgaacctttttgtatgtgtttggttaaacatatttctggtggatatatatgtaggaatggaattgctgggtcatagcaaatacctagatatttctgtagatattgccaaactttattccaaagtggttgtaccagtttattctccagccaggaatgtatgagaggtcccattgccccacatcctcatcaacccttgctaattttagtgtttttctttttatgattctaggggctatgtcctggtatctccttgtggttttaatttgtattttcttgataaagatgttaagatttttaatgtgtttattagccaattgtatatccattttgtgaagccacgtcaaatttcttgcatatttttctattgggttgtttctttttcttgctgatttgaaggaattatttacatacactggatacaagtcctttgttagagatgcagttggccctccttagctgagagttccacatctgcagattggaccaaccgtggctcacgcctataatcctagcactttggaaagctaagccaggcagatcacttgaggctaggagtttgagaccagcctggccaacatggcgaaacccagtctctactaaaaaatacaaaaactagctgggcatggtggcatgcacctgtagtcccagctactccagaggctgaggcatgagaatcgcttgaacccaggaggcggaggttgctctgggtgacagagtaagattccatctcaaaaaaaaaaaataaaggaaatactctggcccagtgaggtggctcatgcctgtaatcccagcactttgggaggctaaggtaggaatattgcttgaagccaggagtttaagaccagcctggtcaacattaacaaaaccctgcatattaaaaaaaaaaaagaaaaaaattaaccaggtgtggtgatgcatgtctgtaatgccagctactccacagcctgaggcagaagattgcttgagcccaggaatttgaggctgcagtgagctacaattccagcctgggtgacagagtgagaccatatctctaaataaataaataaatactcaaaaatattcaaaaaataatacaaataaaaaaactatacaggataacaactatttacatagtgttcacattgtattaggtattacaaataatctagagatgatttaaaatatgtgggagactgtgtgtatgttatatgcaaatactatgccattttatataagggacttgagcatccatggactgggtatttgccctagtcctgtgaccaattccccatgaataaagagacaactgtatatacctcatatatcttaccttgggctatatgtggcctctgcactcttttaatcgtgtctttcaatgaacagaagctccttattataatccaattaaaccttattcttttgtgattagtgctgttaaaaaaatatttgcctactctaaggtcacaaagatattttctttaaaagctttatttgacattttcccatttagatctgtcatccatctggtactgatttttgtatggtaacaagtgaagatcaacatttttttttccccgtatggatgtccagttgacctggcaccatttactgaacagatcattttttccccactgaactgtagtgttgcctttgtcataaatcagggaatcttttatgtgtagatctctttctggacactgtcttctttgccattgatcattttgtctattcgtgtgttaataccacattattttaattactataatttaaaaaataggttttaatatctgatagcataagacccttcagctgtatttttcttcaggattgcctttggctattcttggcccattatatttccatataaattttagaatcagcctgtcagtttttgtaaaaaaataaaaaataaaaataaaaaaaccctactgagactttgattgaaattgctttgaagctataaattaatctggggaaacttaacatctttacaatcaatattgaatcttccaatccgtgaacatttattgcttgccttctaaatgaatcaagcaacttctcatctcgttctgtgctctaggactgattttacaaaatgagaattatctgtttcttcagagtatagctaaattggcctttcctggggaaaagagactgaatgttgtctatcagctcaatttcttttatggttattgctcaggtacaattttctattttgataacttttttattctgaaaggcagtgtaatatagttaaagatatgggctctggagctggataacctaagaaatcctaggtcagctatttattagttatattagttaatgtgactttgagcaggttacttaacttgtctaagcttcagttttctccatattaaataaaaataacagtaactatctcgtaaggtagttatgagtactaaatgatttaatataagtgaattacttagatgagtacctgacacattgtaaacactcagtaaatgttaccttttattaaatttttccaacaaattgctttttatctaggttttcaaaattattgatatattcttagtagtctctttagtttcatttatagcacaaattagatctgattgttgttatgtttttctttttgttttgcatagatgtgctggagtttcaacttaccagatagacttttcttttttttgagacagagttccactctgttagccttgtcgcccaggctggagtgcaatggcaggatcttggcttgctgcaacctctgcctcctgggttcaagcaattctcctgcctcagcctcccgagtagctgggattacaggcacccatcaccatgcccagctaatttttgtatttctagtagagatggggtttcaccatgttggccaggctggtcttgaactcctgacctcgggtgatccacccacctcggcctaccaaagtgctgggattacagatgtgagccaccgtgcctggcctcaggtagacttttcaaaaaactagttggttttgtttggtcagttctattgaatttgtttgtggttttaaatttttttaaaatttctacttttatctatttccattcatctatttgtgtttattttgctatttttgttctgttttttttagcttcttgagttaaaaacctaaatgcccaaaataacttgtaaggctataaatttccctgagtattgcttcagttgtatcacgaaagttttgaaatgtagtttgtctcatggttgtataagttccatttttatttcttatttaatacccaagtatatagttgagggattgatgttatcattggtgattatttttctccctgtgtccctcagacccataattccaccctgatcattatggactgcatcactgcattcccttgtcctctgggttccatttaggttcggccagtgggaaggacctgcagatcagaggatggaggaaagagcgccagagaggtttgggtgtttcttgtctgaattctttccctctacggctactatttgttagtgattgcattcctgtacctaaagccacaactttttttttttttttgacagggtcttgcactgttgcctaggctggaatgcagtgttaaccatcataactcactgcagcctccaactcctggctcaggtgatcctaccacttcagcctctcaagtagctgggactacaggcaggtgccaccatgtccagctaacctgtaactcttatcacgggattcttcttgggaaaggctaggagcagccatcttatttcctgtgtttgggctttaccacctatgagacctgtaaccccctctacccctattaccactttcattcaacttagatctcaggccactgactgagaaaggccttcttttgaagagctgaaagcttgtaaggcatgttttcttgccatctaccacttgattactcagccagtggaacatatttcaggttctgctgagtcagccctacttctagatactaagtactgtgtcacccatacatcctaatgcacagtgactggtttttggcaccagggacttgtttcgtggaagacagtttttccagatggaggatggtttcaggatgaaactgttccacctgagatcatcaggcattagttagattctcataaggagctcacaacctagatctctcacatgcacatttcacaatagggttcctgctcctatgagaatctaatgctgccactgatctgacaggaggcggagctctgatagtaacgcttgctcacccactggcccaccatcctgctggcctcgggctgtattcctaacaggccatggaccggtaccagtgctgtgcaggcctgggggttgaggacccctgttaatgcagtaaacaggaacctgtctatgtgccataagcagaaaggaatttaacatagggaattaatggttagattatcatcggaaggcctacaggatcaagctctatcaaagttgctatatgctcatgaagacaagagcacgtgatcatgatcatagttacaatccaggaattagaagccatcaccactttgggagtccgaggcgggcggatcaccaggtcaggagattgagaccttcctggctaatgctgtgaaaccccatctctagtaaaaatacaaaaagaaattagccgggcttggtggcgggcgcctgtagtcccagctactcgggaggctgaggcaggagaatggcgtaaacccaggaggctgagcttgcagtgagccaagatcgcgccactgcactccagcgtgggcgatagagcaagactctgtctcaaacaaaacaaaacaaaacaaaacaaaacaaaagccatcaccacatctgcctctcaataacctaacaaagtgataccttggtattggaacttggagtctctccactgtctctaccacacctgcagctgtgttatcaagaagctggagaatccatattggaatactgctatagaaacattttgcctccacagctttgtttcatagcaaaaaaaaaaaaaaaaaaaaaaaaaaaaaaaagagagagaaggatggagggaagagaaggaatgagagaacagacaaatgaaagaacaaggccagcagtggggggatcacttgaggccagcagtttgagaccagcttgggcaatatagagagaccttgtttctacaaaaaattattttaaagaattagctgggcatggtggcatgcatctctagccctagctactcaggaggctgacgcaggaggattgcttaaacccaggagttcaaggctgtgatgagctttgatgaggccactgcactctgccttggtgacagattgagactttgcctttatttaaaaaaaaaaaaaaaaaagaacagttgaaacaaaagccaaagaagcaaaaagtggacttctgctcttcttccaccttccaaatctcttacaccatacacctacttggggaaaccctgatttatatctagaatcctagctgcaagataatttgggaaatttcagatgtagctttcctgcctctgtaacacaagagatacattggaagaaggattatagaatagagattgaacaagccaagccaatttaccatatctatcttagggctgaacctctcttcccctaagaaaatttaactgtgatttttttttttttggtatatttgttgtaatactgttattttaatgatcttcagatagaaatcagagtcattcatgtattgagacttacctagagaattacatgctgcatgaaagttaaaaacttaaatcatgcagagttttggataatattccaacaacatcccttcccttaaaacaaactctttgaggtatcttgttttaatttctgtttcttggattatttgtaaattttactgtactatattttgggtcatttgtatttctccttccagtgatcactttgagtcctcttagtctgagaggactagatgtgcactgaaagatgataatataagagaaggactaagggaggaaagaaagagtgaagtgcccaggcccaattcccatttcttgccctagaatctgattacccattttatcagagctagattccgtatgtactttcaatgttaattccattatattggagcctgactcctcctcctataagatcatttgttttaattagaatcttctaccatcattctactctaagaggctgaattgagaaggacagtataacctcagtcttggacctctcaggctaaacagcaacagaacaaagtttagaaaatgatggatactatgtctaatgtgaatattaacaaaataagcatgaaataccaagattgttgttttactctgttatcgtcatcattaattacagtgttttgagagtaagaattctccaattactttagaaaggtattaaagttctgatgttgctttcttaactgttttttagacagggtctcactctgtcaccaggctggcctccaatagaacaatcactgttcactgcagcctccacttcccaggctcaggtgattatctcatctcagcctcccaagtagctgggactacaggcatgtgccatcatgccctactaattttttcttttttttttttttttttgagatggaattttgttttgctcttgtcgcccaggctggagtgcaatggcgtgatctcgggtcactgcaacctccacctcccgggttcaagcgattctcctgcctcagcctcccaagtagctgggattacaggtgcatgccaccacaccctgctaatttttgtatttttagtagagatggggtttcgccatgttggccaggcttgtctcgaactcctgacctcaggtgatccatccgcctcggcttcccaaagtgctgggattataggcatgagccaccatgcccggccaattttttgtattttttgcagagagtgggttttgacatgttgcccaggttcaagtgattgttctgcctcggcctcccaaagtgctgggattacagacatgaacgactgcaccgggccttaaattttaattgcagaaacttcaggtcatctgtcttaaaccttgctattcctagagggaagagtgcctggaaataagactttttaaatctgaaagactaatttttctgcctctttgcatcatttgaagttcatttaaaccattcctttgtaactttcttctagtagggacaatgttgtattaaagggatcttttactcaaatctcttgccttggtaaccttatcctctgtaggtgaactcgttactgtttttggtgtttgtttaaattccttcttcctcttttcttttcttcctggctgagaaagataatttttgcccattttgtcatgatttctttttctcctacttctttcatacttctgtgtaagttattaaatgttaaccctttgttggcagtatgttcagctttcgcccttttctcccatagcatttaatcagttaaatgaaaggaaatgactctcacaaaacctttcacatttaaaaggaagttttaaaaaatttctctcttcctcgagagattcccttttctttgtatttttaaaagttattatgcatctctgaggaacatgaaggtactttttccctaagtaataattgtagattctttcttacttgtattattgatttgaccaatggaagaatattgtttttgtctgtgaacatatacatggacagtatttgctattttgataatggagcttcctgtctagaataattatacatataaaatttaaggtattattatatcatttaattttttttaatatatcctgagtttcagtttgtcaaacataaagccctaaattgtattatttaaaataatcttgttccaagtagtagctgagattagaagtatagcaaaattcatgctatcactatctataataggaataatatttattaatagtgctattaaatcacaactctattgacatcaaagattgaccattaagaccaagtctagccagatatggtagttcacacctgtaatcccaacaatttaggaggctgcggttagaagatcacatgaactcaggagttcaaaaccagcctgggcaacatagtgagaccctgtctctacagaaaatgtaaaaattggccagtgtggtggcatgtacctgcagtgcaacctgcttcggggctgaggtgggaggattgcttgagcccaggaggttgaggctgcagtgagctgtgatttcagcactgcactccagcctgggcattgaaataagaccctttctcaaaacaaaaacaaaaacaaaacaccaactctggtttataaccaagatatgcaagaagaaattccatgtttaatatgaattataaaaattattcttggggaacaagtctgcttttttttctgcttatgttgtgtcatttcttctgttttggcttcttcacagatccttggggctccagtttagattaaaattttgtttctgttttatgtctaaacattcaagaaaagtaggtagttctctcttttatgtattttttattgcatttattaaaatgtaagtccatttgtctcaagctatgacacacacagtgcctacattattttttttagttaccttggtattttatgtgcagctatattgaaggttttcatttttttaaaagcattgtggaaagaggaccagacgaggagtcaagagactgactgacataaattagcaatgaaattctgaataaatcacttaatttctctagagcttgtttcccaggatcatcctttataccatatcatcctttggtatgaaatttttcttaaatccattctaggggatcggaaactatctagtgggttgagtaaatgagagtaggcccttagaggcttccattaattaggaaatacaggaaaagaatctattcatttccagtctctttttatattagaaatcctgactcaattttagttttccctggttctgtaccaggtgttctctgagttcctagaagcaaatcatgccttaaggatttaggagaaaaggcccaaagctcagtgtactcgacaggggcacagtgttagaaagtgtactaacttcgaccagatgtggtggctcatgcctgtaatcccagcactttcagagggtgaggcaggcggatcgcctggggtcaggagttcgagatcagcctggccaacatggtgaaaccccatctctactaaaaatgcaaaaattagcaggctgttacaaatgcaaaaattacagctggtgcctgtaatcccagctactcgggaggctgacgtaggagaattgcttgaacccaggagatggaggttgcagcgagctgagatcacaccactgcactccagcctgggcaacagagagagattccgtctcaaaaaaaaaaaaaaaaaaacgaagtgtactaacttcattgcctctggattttttgagtattgcttatagtatacattgagacttcctgttgttattattcccactataggaaatcagtgtgcccattactttttatttgaaacaatatatttgaggacatcatttattttaaaatctgcattgtaatttatgtagttgacagaatatagcctcctatctcttattgttgaggtttttgctgattaagccacaacttttaatattatctcattaagatctttattaaaatggatttttttttcttttttctttttctttcttttttttttttgagacagtctcactctgtcaacccaggctggagtgcaagtattgcaatcatagctcactgcagccttgaactcctaggctccagctatcctctcctctcacctcatcctgtgtgagccattgtgtccagttatctctccttttttttttttttttatttattttgggataagaagcaaaggaaataaagttggatgttatctcttaatatccaaacattatattaaagtttactgcatgctctcctcacatccaacattttgccaattgtgtttgatcttctggcctttgtcttaaagcagttgaaaatgaagttttgcttcctctccttgcttctgctctgcattcatttaagtgaccgatgtgtgccagttaattagctagatttcaaataatatttaaagtagcatcagaaccaaggggatatcaatctaccattgctgacttctctccatttagttaagacaatccactgctgtccttgctttttagtcaatagagtataaaagctgtgtaagtcagttttctcccattgcatctcttagtcttctgatgggtatgtttgatttttatttagattttggacgtaggtagtattgcacttgagtatctttgtactgttgtataaaaaatcttaaggttactctttttaaaaatgtttgctatttattacatctcatatcagaatcattggataggatttcagcggaaaatattagaagcctgcagccagacaaacttcttaatatatgtgtcttactttttcttggtttatttaaaaacttttaaataaacactaatactaaaaacatcctttgaaggcgtttttaaaactccagtattcctattacctttgtctgtagttgctgagtaataacagcactgaagaaataatgttcagattttttttcagagggctgcttctgataggaaaatgcttagtaatgacagaggcacgccctccaattcagtggccattttgtactgtggttcttctggagaaacaagtgggaatcatcaaagaaagaaatgtatggataaaaaagaatatggacaagaggcagtaaatttttcatttaggtcaactggagaaattagaaccatgctatctgtgagtagtttaattagttggaccaattttaatggacccttttagcttaatctctttaaattctatgattagattttactttgctgattaattaattaatgcttgaatttggggctttggtatattaatttagatattatgttgaaatgtgtaagctccgaaaagcatttcctattattttatatctttaatatcctatgatattatctaaggtttaagggagataaaggcacgaagtagttaatttcagattatattttgtgattgcgtactgaattaaagataagtgaaaaggctatatagaaatttactacattggcaatacaattatggggaaatttattttccatgatggggttttgttaattttgacagagatttagccttttaagtagattcctcattaaaaattgagaaaaatcactgccttttataatttgttaatagtcttactcatcactttattttgtgatactctgcagctagcctggaaaaacatggaaatcatagcaattaacaacaggagtttaatcctttttagtggtattttccaaaaacaatatattgttgttctatatgtgatagtcacatttagacctatagctttaagctatattcaaagataaaaggtttttttaaatgctttaaaataacacataattttcaggcagatattttcccatcaaatccctttagttgcagataccttttccctagagattttattttgaattaaagatcttttagaggttctgttggcatggtagaaactttaaaaaatatgtaatttacatggtagtatgtagagaacactttttttccagagaaattacaagttggtacaaacttgaggaaaagttacgtataacttggtgaattctgtaacttgggaatggaaatcaaaggctttttgatcctttgaaccagaataagcacagattcatataggtgggaagtctgtgttaacaaaattacttctcaaacattacacagtttcgggcttttgtgccaatgctttgtgcctcatactctcttctctgttagtagctagtgtgcctgtgttttcttgttgctttttgtgtttaatatggactgcatggcccaaatgacatctgacatctgacaatagttagcattttgccaaacctgatagtgtggtttagatatcatactgacattttaaataaaggaatgtataatagttgaagtagagcattagtttttgggttggtttggtttgggtttttttgttcgtttgttttgttttttgggttttttgagacagagtctcactctgtcgcccaggctggagtgcagtgacgcaatctcggctcactgcatcctctacttcccaagctcaagcggtcctcctgcctcagcctcctgagttgctaagagcacaggtgtgtaccaccatgtttgactaatttttgtattttttgtggagacagggttttgccatgttgctcagactggtctcaaattccttggctcaagtgatctgcatggcttgacctcccaaagtgctgggattataggggtgagccactgcatccaccccattgttagtttttatatgggaaagtgtattggctcattttattcatttactaaattctcatgtaattaggtaccttcttttttctttttcttttttttttcttagcagaccttaactatgtttttccacacagataacacatgaatatgttctcattgtaaaacattcacataatacagggaaaggatcagctctcccttaatcccccttttcctttgcaggtccacctttctccacagaagtaccactgtaatcactttcgtatattttcttttttaaattattttttatttttattttttatgttttttgagacagagtctcactctcttgccgaggctggagtgcagtggcacaatcttggctcactgcaacctccgcctcccaggttcaagtgattctcccacctcagcctcccaagtagctgggactacaggtgtgtgccaccacgcctggctaatttttttgtatttttagtacacacaaggtttcaccatgttggccaggctggtctcaaactcctggcctcaagtgatccccccacctcggcctcccaaagtgctgagattataggtgtgagccactgtgcctggccaatgttggtatattttctttcagattattctcagcgcaattacattcatctatatgtgtatgtgtatatatatatatgtgtgtgacatacataaatatattgtataattccattttgtgggttttttaaaacacaaatggggtttttaaatggctagtactagtcgatattcttgtatgtatatttggcatacttttataattgtattcatagactggaagcttagtggtaaaattgctaggtcaacggatatttgcatttatatttttatacctatactcccactaatagtgtatgatgtatctgtattccaacgttgccaaaactgagtattctcagacttcttaattattgccaactaataggtaaaaattgtgtctttgtttcaatttgcatttcttcaaaggtgaagtttaacatgttttcattcatattgacccatttgtatttttttctttgaactgcttctttatatcctttacccatttctacaatttaaaaaaatattattactggtttatgtggccttattgtaaattaaaaaactgttgcatcatgttagccaaattttctatcaataatcttttttttttttttttttttgagacagagtttcgctcttggcccccaggctagagtgcaatggcgcgatctgggctcaccgcaacctccccgccggccgggttcaagcgattctcctgcctcagcctgccgagtagctgggattacaggcatgcgccaccacccccggctaatttttttgtatttttttagtagaggcagggtttctccatggtggtcaggctgggtcttgaacacctaaccccaggtgatttgcccgcctcagcctccgaaagtgctgggattacagacatgagccaccgcgccaggcttccattttcagtgagttgtttttaaaacacattaagctagttttgaaagtagttttgttttttttgttttttatttatttatttatttattttttaattgatcattcttgggtgtgatttggcagggtcacaggacagtagtggagggaaggtcagcagataaacaagtgaacaaaggtctctggttttcctaggcagaggaccctgcggccttccgcagtgtttgtgtccctgggtgcttgagattagggagtggtaatgactcttaaggagcatgctgccttcaagcatctgtttaacaaagcacatcttgcaccgcccttaatccattcaaccctgagtggacacagcacatgtttcagagagcacagggttgggggtaaggtcacagatcaacaggatcccaaggcagaagaatttttcttagtacagaacaaaatgaaaagtctcccatgtctacctctttctacacagacacggcaaccatccgatttctcaatcttttccccacctttcccccctttctattccacaaaaccgccattgtcatcatggcccgttctcaacgagctgttgggtacacctcccagacggggtggtggccgggcagaggggctcctcacttcccagtaggggcggccgggcagaggcgcccctcacctcccggacagggcggctggccgggcgggggctgacccccacccacctccctcccggacggggcggctggccgggcagaggggctcctcacttcccagtaggggcggccgggcagaggcgcccctcacctcccggacggggcggctggctgggcgggaggctgacctccccacctccctcccggacggggcggctggccgggcagaggggctcctcacttcccagtaggggcggccgggcagaggcgcccctcacctcccggacggggcagctggccgggcggggggctgaccccccgacctccctcccggacggggcggctggccgggcagaggggctcctcacttcccagtagggccggccgggcagaggcacccctcacctcccggatggggcggctggccgggcggggggctgacccccacctccctcccggacggggcggctggccgggcggggggctgacccccacctccctcccggacggggtggttgccggccggagacgctcctcacttcccagacggggtggctgccgggcagaggggctcctcacttctcagacggggcggctgccgggcagagacgctcctcacatcccagacggggtggcagggcagaggcgctccccacatctcagacgatgggcagccgggcagagacgctcctcacttcctagatgggatggcggccgggaagaggcgctcctcacttcctagatgggatggcagccgggcagagacgctcctcacttcccagacggggtggcggctgggcagaggctgcaatctcggcactttgggaggccaaggcaggcggctgggaggtggaggttgtagcgagccgagatcacgccactgcactccagcctgggcaccattgagcactgagtgaacgagactccgtctgcaatcacggcaccttgggaggccgaggctggcggatcactcgcggttaggagctggagaccagcccggccaacacagcgaaaccccgtctccacccaaaaaatacgaaaaccagtcaggcgtggcggcgcgcgcctgtaatcgcaggcactgggcaggctgaggcaggagaatcaggcagggaggttgcagtgagccgagatggcagcagtacagtccagcttcggctcggcatcagagggagaccgtggaaagagagggagagggagactgtgggaaagggagactgtgggagaggggagaggggaaagtagtttttaagactagagtaccattgtttctgtagtccccaagaatctttgcagccagtttctaaccttgtgtaacgtgaggcaaatgctcttactgaattctttttttttttttttctgagagggagtctctgttgcgcaggctggagtgcagtgtcatgattttggctcactgcaccctccacctcctgggttcaggtgattctcctgcttcagcctctccagtagctgggattacaataagcccacattacagtctcctgccaccacgcccggctaatttttgtatttttagtagagacggggtttcactacattggccaagctggtctcaaactcctgaccttgagtgatccatccatgttggtcccccaaagtgctaggattacaggcatcagccatggtgcttggctcttactgaattcttacatgtgaactatagctcatctgaagcaaaaataaggcaattgggaataaatgtagatattatcaggagaataatgctagcctattttgagttttctaacttaatctgctaaatagatttaaaattacaagtttagtttctagttaaataaaacaactatacacagtactacattagaccaaattaatgaacttgtttactcaaaattatttgcaatatgatggggtaggtaacagcactgaatctgtcaggtttttccaactcagaaaaatccctcttctgttgtttactactatctgtccttgtgaccttgggcaagttcccttggtctctctgtgccttagtttcctcatatctaaaatgagccatgcctcataaggttattgcaaagatgagacaggcttgtacataaaaaaaaaatacttagattaattcctggccctgtctgggtactcaataaatgtttagtactgctgttgtttgtggggagatgggtggaaaagaaatcaaccaaccagataggaactacactggatcatcctcctgtgagaaaattgtgcatctgggtagtatcaagcagaattatcagcctccactgatatcaccaaaccagaggttaaacttgctgtaacctcagaaatgggcagtgggagaagatcaagggccattaccaaacactcaccacgtatagcccccatagccttgggaaaacacagcactggaatattattttgttttgttttgtttttattatcttgttcatgttggtgtctgttgtggctctgtttcccttggaaactaaatttctaaattggtaatccattgcctcttgattatttctcttctctgagtttataccttaaaatttcttgacttcttgccatttgctactttatattagccttaggctaataagtatagagctctccctgaaggatgaataaaagtcatggagcctgtagatcataataacaccaattttatatgagcattttctaaaatgttctcacgagaaaaaagtctgtattggtatgttcccagattctgtagcttctatgaaacttaaagccaccaatggaaggggacaatttaagatgaagttagcttgaagagagacaaaaatatgattgaattaaaaattatgccttgcagggttgagcattttgaaccttatagaatatatcatatgatacatatggtgaacttgagagaggttgtttcttttacatctcaatttttctcaaagagacaattttatattatagtttaaaagtatgggctttggaatcagactaactgggtttatattctgatgggtgactttaagcaagttataacctctttatgactcagtttcctcatctgtaaaatgagggtaataataaaaatacctctttatagagttgttagaattaaatgaggtattataaaacgtgcttaactcaatgcctagtaaataagcaactcagcaaatgtcaactatttttagtgttactacattgtttttcaggcttggctctactgttttctaaaatatatatagtaactctgttagggccttcctgtcttctcttgccattatctctagttgatcttccagactacatatgtttctatactggtatgtcatatgagtttgccaccatatttatatgctaaaaacttgaatgtatacattcagtaggctactttcctgacctccagacattttaggtctaagccattcacatttgactatctcataggcacttctaatacatcaccttcctcctcagatttgttgctacgccactgtttcatatttcattaaatagcaccacctgattcttcaaatcagaaatcttaatcttgatccctccattgccaaccatttcaatcagtaatcaagttattttgattttaatacttaaacacatttattaaatgttttcattttttatacttcttgtagtcccagttatccaacaataagagactggataaataaatcatgatagattcatagaattgaaatgctataaggacactaaaaaggaataaggtacaatatatgtcctaatatggaaaggtctctaaaatacattcgatgaagcaagtgcagagaaaagtatatagtatatttccatttgtatagaaattttgaaggctattcatacatatataagtggatactaaattttgggggaaggattcatgagctaaatatttattaccttttgggtgagagactaggggactagggtaggaaaaacaaagttatttctcattttatatctttttgtattttttaaatttttagtataaaagtagcaaggcagtaaaaaacaaaaaaacaaactgaggttgagcagttgagcttagtgtccttttacagatgaaataagttaacttttcttgtatatccccagagagaagttaatggcagagaactgctaaagtaactagtgcctgacacagagtaggtgctcaataaatatttggctagtgataaaggagtaaatgatgattgtcccttttctatccagatgatctttaccctggaatgctgttagcactcagtcattgccatctgcaagagagaatagatagtgtgagggatcagaatcagaatttggccactagttagtgcagactacaaattgcttttctgaaagggtatatggctctgagatcagctcttctgataaagggaaggagagagtctcaagggtgcatcagggctagtgtgaagagctcggagggttcagacagacagaataagtgacataaggcccagcacggtagctcacacctgtaatcccagcactttaggaggccaaggagggcagatcacttgaggtcaggagtttgagaccagcctggccaccatggtgaaacaccatctctactaaaaatacaaaaattagccaggtgtggtggcacatgcctttaatcccagctactcgggaagctgaggcaggaaaatcacttgaacctgagaggtggaagttgcagtgagctgagattgtgccactgccctccagcctgagcaacagagggagactcgaaagagagagagagagagagagagagagagagagaggagagagagagaggagacagagagagaaagagagaaagaaaggaaggaaggaaggaaggaaggaaggaaggaaggaaggaaggaaggaaggaagaaaagaaagaggaaaacagaaacattgcaacaatgactactgagttggaagatagacaatcattgactgttcttagcccagtagatgtgctggattgtggacctgtagtattgatattaatagtgtgtcaatatccaaaagaaaccattcagtaaagtgccatttgtggaagaggctaggtttattgagatatctaactttcctagttaatatctatggcccagatagtcagatttgcacttcttttcttatgttgacaccccaacataattttttaaataaggaaaattttttattggaagactgaagttcagttagatgagcatgaagtttatgtagaaataatctcccaacagcttagctcagctattcttaaagtttttaaaatttaaggctctactggagtaaaacgatgttatatagaaaattattttcttcagatatttttaatactgtaataacatttcttagcctatttaaaggttcatattgattatcacaatacttagtgtaaccaagtgctataattattttggttttatattagtagctgattaaaatttcaatgcataaattctaatgcagttatttcgaaggtaactcatttcactcttagaaagcctgtttttgcaacaggctgttgagcattgcaagtcatggaaaaacagctaattttccattttggtcattgcttttcaaatcagtcatcgtcccaaaataaaaagtaaataatgaaagcagctgctaggctacatatttttttgtgattttttcaatctttgattccttatactcaaaaacaggttctcagccttagaactattgatgctttgggccagataactctttgtgagggttgtcctgtgcaatataggatgttgagcagcatcccgatctctacacactagataccagtagcgctgctcacatccaccccacagttttttggggatttttttgttttgtttttgttttttaagacggagtcttgctgtgttgcccaggctggagtgcagtggcgctatctcagctgcagcctccgcctcccgggttcaagtgattctcctgcctcaggcctcccaagtagttgggactacagatgtgcaccaccacgcccggctaatttttgtatttttttttagtagagacaaggtttcaccatgttggccaggctggtttcaaactcctgacctcaagtgacccacccatcttggcctcccagagtgctgggattacaggtgtgagccaccgtgccttgccaacaggttttgtttgtttgttttgagacgagtcttgcatggcttactgcagccttgactccaggctcaagcaatccttcactttcagcctcccaagtagctgggaccagaggcgcacaccaccatttctggctaatttttttatttttagtagagacaaggtcttgctttatattacctaggatagtctcaaacgcctggcctcaagcaattcctcctgccttggcctcccaaagtactgggattaaaggagtgagctaccctgcctagcacacccctcagttttaacaatgaaaaatgtctccagaaattgccaaatgtggggagggggagttgtgcagtgatgatttactttgagaaccactgctttataagaacatagtagtttttttgtttctactttttgtttttaactgtcttgtttaatggtgattttaaaacatggctcagaaaaatcacataattgagaatagtttattccatgaactttacattagtttgtggaaagaaaatgtgaataattcaaattgacaggtaagtagacacttatttgtgcctccactgagactagcaacttgaaatcatgttgctagaggatacctttgatatttgttgaccttggcgaaaatattaaaaagcgtagacattgttgcaggaagtttgcaagtccaaatacttgctcatcattttctgaattttttaaaaataaacacaaaaaatagcacatgtacaagttacactagttgatacacatgtgattaactcataaatttattttagatcttatctatattaacatttgctttttgtcgtattctctttcaatagacattaaaactaccactactatggaagtaccactactagatggaagtttgacctggacatggtggctcacacttgtaatcccagcactttgagaggccaaggtgggaggatcgcttgaggccaggagttcaagatcagcctgggcagcatagtgagaccccatctctaaaaaaaataaaaataaaaataaaatcacctgagactattagatagaagtttgtaagactctaatgggttttttctggtttttattttgttttgttttcttttcttttttagagacaggattttgctatgttgcctaggctggagtgcagtagctattcacaagtgtgatcataggccctacggcctcaaactcctgggctcaagcaggcatcctcagtagctgggactacgtgtggagtgttttaaaatctaataaaatgggccgggcgtggtggctcacgcctgtaatcccagtactttgggaggctgaggcaggcagatcacctgaggtcaggagttcgagaccagactggccaacctggtaaaaccctgtatttgtaaaaatacaaaagtcagctgggcgtggtggctggctcctgtaatcccagctacttgggaggctaaggcaggagaatcacttgaacctgggaggcggaggttgcagtgagccgagatggtgccattgcactccagcctgggtgacaagagcataactccatctcaccaaaaaaaaaaaaaaaaaaaatcagtaaaatgatattttccccagattataataataagttgaattttttcaagtttacatttttgttccatagtattttcttaagccttttataccagactttaggaaaacctagcatctgatttttaaaagacttttattatagaccttaaaaatgtattttaagggagagaatactacaatgaaaactccatggccaggcctggtggcttatgcctgtaattcctgcactttgggaggtttgaggtgggcagatcacttgagctcaggagttccagaccagcctgggcaacctggtgaaaccccatcactaccaaaaatacaaaaagtgagctgagggtggtggtgcatgcctgtggtcccagctacttgggagacagagatgggaggatcacttggaggttgccgtgagcagagatagtgtcactgcactccaacctgggtgacagagtgagacaccatctcaaaaaaaaaaaaaaaaaaagctccatttacccatcactcagcttcagcttcagcttcagcagctgttaacattttaccaaactgtctcatctattcctctcaccctcccccatcttttttcttggtgtattttaaagcaaataccatgtgactcccatttggcctgttataaataaataaataaaaataaagcaaatatcagacattacctaatttcacctgtaaatgtatcagtatgtatctctaacagacaagtacttgctgtgatttaggtgtggtttgtccctgccaaaactcatgttgaaatttaattgccatgctacgatgttgggaggtagaacctttaagaggtaggacctaatgggaggcatttaggtcacgaggctccactttcatggatggcttggtgccattctcacaatagtgagtgagttcttgctctctcaaaactgaattagttctcttgggaactgattaattcctgaaagagcaggttgttataaagtaaggactttcttagggcttggcccctttgcacatacccactcccgctttgaccttctaccatattatatctaggcagcagagcccttgctagaagccagtggcatgctcttgaacttcccagcctgcagaactatgagctaagtaagcttctttctttataaaatatgcagtgtcaagtattctgttatagcaacacaaaacagactaaaaactcttttttttttttcctttttcaagataactctggccaggcacagtgccttacacctataatcccagtgctttgggccgaggtgggaggatcacatgagcccaggggttggagaccagcctgggcaacatagtgagaccctgtctctaaaataaaaaacaattagccggacataatggcacatacctgtagtaccagctacacaggaggttgaggtgggaggattcctcgagcccaggagtttgaggctgcagtgagctatgcacaccactgcatgggtgacagaacgagaccctgtttctaaataaataaataatgataaccccaatataattatctcatctgacaaaattaataataatttcctaatatctaatacctagtctgtgtttgggcttccttaaattctcaaaaatgccttcttacagttgttccaagcagaatccaaaacaagtccctacgttgcatttgggtgatacgtcactttagtctttccccaccctcttgcctctttttttttttttctgagacaagatctggccctgtcatccaggctggtgtgcaatggtgtgatctcagttcactgtaacctctgcctcccaggtttaaaccatcctccctcccacctcagtctcctgcctctcacctttttaaaagtcatttatttgttgaagaaatttggtaattttttttggtgtgttttttttttttaaagacaaatgcatttcattatttatttagatatgtccttgagtcatagaaactaaataatttgatctacaggatttccatactctgtatttagcttattttgtagcataagatgacatttggtttagcacaaaattctgtattttaaaataccacttttggccaggcaaggtggctcatgcctgtaatcccagcactttgggagtctgagatgggcggatcatttgaggtcaggagttcaagaccagcctggccaacatggtgaaaccccatatctactaaaaatacaaaaaattagctgggtgtagtagcgcatgcctgtaatcccagctacttgggaggctgaagcaggagaatcacttgaacccgggaggtggaggttgcagtgagccaagatcgtgccactgcactccagcctgggtgaaagggggactctgtctcaaaaaataaaaaataaaaataccaccttttatcttgtttctcagagtgtcgtgagttttgttttactacctgaacaagtttaagagtcccatagcattcttactttgtacttaaggaagctgaaacagggagaggatttttctggaaacagagcatacctagaaagtaccagagcactcaatatttccttgataatgttgaaagcttgatgaaccgtggttttatcagaagtattacaagataaaactcttttgggaaaaactgttcctgttttgttttatcccctgtgcctacatgttgcctgacatggaagatgttcagtaagtatttattattgaatcagttgcctaattctgccatctttggcccattcttctctggcccaagacctgaaagcttacaacttgttctatctataagagtttaaagcagtttaaaagagtgaagctaataataaaagcactgtagccaggtagaactgctcatgcttataatcccagtgactcaggaggctgaggcaggaggatcccttgaggccaggagttggagaccagccagagaaacatagcaagaccccatctctacaataaatttaaaaattatctgagtatggtagcttgcacctgtagtcccagccactcagaggctgaggtgggaagattgcttgatctccagaggttgaggctatagtaagctatgatcgtgccattgcactccagcctgggtgacagagaaagaccctgtctcaaataaaagctaaccagcaatgatgtagtaatgacactggcacttgtacagaatacatcatgaatcatgtagaaaacaagcactgccataagtgaatggttggactttatacatctgggagatctgatatcttttcttttttttctttttctttttttttttgagacggagtctcgctctgttgcccaggctggagtgcagtggcgggatctcagctcactgcgacctccacctcctgggttcaagggattctcctgcttcagtctcccgagtagctgagattacagacatgtgccaccatgcctggctaatttctgtgtttttagtagagacggggtttcaccatgttggccaaactggtctcgaactcctgacctcaagtgatccacccgccttggcctcccaaagtgctgggattacaggcgtgagccaccgcacccacccagatctgatatctttatgtggggcctgcagggagcagggctggcaagaagtgtcagtagtgtaggacttggatgagacattttcttaaagagctttcttcagcaaaaatgtgggattttcctgtctatttttgtttatttttattgcaaaaatgtttcggccaccagaacaatcttagcacaaccaaaggttcttggctgtttttcatttagcaaaattctttctggtgttatgatatgtgttttctgtcagctaaaacttacaggaatagtgaaccacaaagatttcctgaggagctcccacatgctgtgtctgaggtttctcatatttcttttggcatcagtaacattctccaatacttcgaaattatagtttgaatccagtgttaatgatttctcttcaaaaaaacaacttaaataaaacatttgcggttttattttgcttgaaccaaggaaaagtcataatagagacaactacctactctgccttaccctctgcacaaaaacacccctttctaaagctaccatctaatactttatgaaaaataaatatttccctgtatttattagtgtataagcctaatatcccaaaacctctaaaatatagtggtcagaacagttgcaatagggagcctccccttgctgtaaaagaaaaaaagtcaaaataaattatgttgagtgatcaggttttaatactaagacattatttgcctttgtcactgtcattctcatgtgtgtatacagagtacaaaaagctcatcagatggttgcatattctacgttaacatttagctatttgaaactattacttgtttcggtacggctattcttctttgatactacaatgatcagaaaagactattaaaatacttctggctttccaactatattatttgtgtaagcctttatttttctgtatacttcacccaaaacaatacattgcaacacattgaatgcagaagcagatataagtatccggcaattttctattaagccaaacaataaagagatttgcaaaaagtgtaaaacaatctgttcttctcaataaatttttttcattttggagaattttttcattaacatatgttgtttaacattgtaacaggtttattgctattttcaagtaaaataataagttttttttaaattttagttttgagttctaatatgatgtcattagacgtccatgtaaacaaaagctctttggggctctccataatttttaagattataaggagagctgagaccaaataatttgagaactactggttaggatatggttttctgagatctattaaataatatacaagttatttgacagtttcggagaaaaagtgatagcaattttattcctaaacattttaaaagaattaatgtaagcataatgaatagaacttgagtgttcacagtgttcatacagtatctgggtttacatgtgttaggaagtaatatgatttgcactaacagccaaaaatagaaaaatgcaaatatgaaatataatagtagataactagaaattacattttattaaacctgcaatacattcacctcagtctccaaaggttgtcttctatgaaactttgacaaatgctttgttacatacagccatgaaacaaagtatggtgatcaccttggtaagccagatttttccagaactgtaaaacagtgctttctgggataaaactgatctgttactaatgatggggaagaaaccaaaactactgaggaatcactcatagttatatagcacaaatgggtgtgccacacctttaacaagaagcctgtgaaaccagccaaaaagttaatgagaaattgtatttgcagaaaaagcagaataaactactagtagaatttactgtatcacatgatactgttggatatgatctgtgatatataaagtgaatgattaatgtgctgtcattgtgaaatgtgaaatagcaagtgttccagattatggtgatccgaactgaatgtgtatatatgccctcagcttatatacagaacatatttgaagaaaaaagtattcttgtttctcttctggttatcattttttaaaaaacaatctatactacattttgttattttgtgatctgtgacataaagtggaaaaggaaaggacgttggggtcactgatgagagagcatctgctatctgtacagtaaaaaagggcattataatctcaataaaaagtttgtactcatcttgactctctaagtctcttgccagagaacagttagcagtcaagagtttgtctcctggttttgactgagtcttttattaggagaggagggcacgatggcttgcacctgtagtcccagctactcacgaggctgaagccagaggatagcttgagcccaggagttctaggccagcctggacaacacagtgagaccctatctcaaaaaaaaaaaaaaaaagaaagaaagaaaaagaaaaacagaaaacaaacaaaaagaacaggaatcagcaaattaaggtttttgggccggatttgccaccgtgacccgtacccccatttttggatggcaggtttttaaaatgtttttaaacagctggggaaaatatcagaatattttgtgacatatgaaaattacatgaagttcaaatttcagtgtctataaataaagttttattgggacatagccatactcattagtttatgtattggctgagtctgttttctcactacagcagcaaacttgattagttgtgacagagaccatatggcttgcagagtctgaaatatttacgatctggccttttaccgaaaaaggctgctgacccagagttagagtaacttccctttgatccatcttatttattgttcttccccatgggagttcatttgaagaaagggttctactgccttaaaaacaatgtttttttttaaagtatgtaaggtcggcccaaacaaatgaactggcattcttgttcttttgcccccactggggcaagagcagggtggggttcacagttcactttgaaaatgcagattcactaattcaaggcaatatttgaatatacattatgggtgatatcaagattaaccatttgtgctgccagaaattttaaatctggtagagggatatattacttttttaaaaaatatttttcttaaaaaaagagattaaacatagcttaaaagaaaggcatttgactcaattcctgttctctcaaattgatattccacaaattgctaccagtccagcagattcccactcttccttattcttctgaatgcaagaatatattccctaaatgtcttggtctatcttaggtatctctcctgtttccatagtatccaaatactttcctgacattgttaacttgcttggtgtgtttgtactaaactataagtaactttttggtgtcttccttaatagacatggaagggactgtttcttattttaggtaatagagtataatcctgctttttctaactgagtgaacccgtttcctcatctatggaattggaataaaaataataatgataatgatgataataataacttttattgttgtgaaccttaactgagaagatgaaagtaaaatacttagttaagattttgccacatagtactttaactgtgttgctcttttttttttctgttgttttatctctaaaacctaattatagtcttttttttttaattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccacctaattgtagtctttttggagatttaaatatttcattgaatggaatcaagatttattatttttttttttaattttttaatttttttttttttttgtgagacaaagtcttgctctgtcacccaggctggaatgtaatggcataatcccggctcactgcaacctccacttcccaggttcaagccattctcccgcctcagcctcctgagtagctgagattacaggcacctgccatcatgcccggctgatttttatatttttagtagagacagggtttcaccatgttggccaggctggtcttgaactcctgacctcagatgatctgcctgcctcagcctcccaaagtgttgggattacaggcgtgagccaccgcccccagccaagatttatttttaaacatgtcaccaactgtatgctttagagaaggttgaaagttaaaatttaagcttgctgttcagaaatagttgtccagtagattttcatccagtagtgacattgatatttctgtttgatggggttggggtgatttttttttttttttggtctgttctgaaaatctgtgctgtttccacatagcttatatatagttaaaagtataaatggagtgcttactatgtggcaaggactgtcccagatgctttatattaatttaattttcataagaactctatgaactaagtgctattactgctatttttagatgagacagctgatgcacaaaaggattataaatttcctggttacttagctagtaagaggcagagtcgggatttgaatctgtagattggtttttgtttgtttgttttgagatggagttttgctcttgtcgcccaggctggagtgcagtggcgtgatctcggctcactgcaacctttgcctcctgggttcaagcgattctcctgcctcagcctcccgagtagatgggattacaggcacaagccttcatgcctggctaatttttatatttttagtagagtcagcatttcaccatgttggccaggctggtctgaaactcctcacctcagatgatccacccaccttgtcctcccaaagtgctgggattacaggcatgagccactgtgcccagcagattgtattcttaacctctgtgttctaatgcttttgttagccatactgtgttctatttgtcatatgctcgtatgtaagatatagcttatctaaggtaacattattgaagagttttaagtttgttcacagtgctgagcatatggtagataatacgtatttgtgcttgaatgaattaaggaatatgatgagatgataaaaatattataattcatacaatataatcattgtttaattattcttggctttgagtaataacattgtcgtttgagttatctataacattggctattttgaagcaatctaagactataaaatttgggacagtgaaattgcttaacaatctatttatattcctaaattcattttttcttgctggtactcactcaaaaaaaaaatctgtgtgttttatttagagtttttccttttttgggttcctctgttgaattgtttgttgatttgtttgtgttaaatggcattgtattataacagataattcagttcttatagaagaagccttaaagaatttggacatactggtcacaatagtgaagtctggtattaagtttggcccccgaaacttttgaagtagtaatgatcttgaaatttgctttattttgtgtctttttcagaattctccactttaccaatacttacaggatctgggacacacagactttgaaatatgttcttctttgtcaccaaaaacagaaaaatgcacaacagagggacaacaaaagcctcctacaagagtcctaccaaaagtaagaacgcatgctcattctttctggccgaatcttttgcactttaccttactggctattcagatacttcttaagcacttccatatcctccctcacactggtaagactatttatttcatcaatagtacaaaactttctgttagataaacatgaatccttactgctttggaatactttgtaggtaatttatatccagtgaggaaataatttggtagagaattaaaatacattacttatttaaatattgatgctatccaaacagaatcgaaaaaaatatactaaaactttaatgagagcacaactaataggaatcctctactaactggatttttctctttaaatcttttttttaaaaaacagcatgaatgacaagaacgcaaattgatatttcttaaacacagtttcaggtgtagataatggagtgagcataacttctggtgacttttttatctatagaattaaatacttttatacattaaatatctcatagtcgatgtccagcattgaggccgagatactagaaaaatctccattaattatgttctacaaaatgcattttctggattcatttatgtcctgctagccatgtttactaaaataagaaatttatgggccaggcgcggtggctcacgcctgtaatcccagcactttgggaggccaaggcgagtggatcacctgaggtcaggagttcgagaccagcctggccaacatggtgaaaccctgtctctactaaaaatggaaaaattagctgggcgtggtggcgggcgcctgtaatcccagctactcgggaggctgaggcaggagaatcgcttgaacctgagaggcggaggtggcagtgaaccaagattgtgccattgcactccagcctgggcaacaagagcaaaactgtgtctcaaagaaaaaaaaataaatttactctatttttagatgagacagctgaagcataggaggattataaattatcataggttacttagcttgtaagaggtagagttgggattagaacctgtactttactccgagtttatgttcttaacctctgtctacatgtctagtatattttagttttaaccaaaggaattgtaatttaatagaaaaaacataaccaaatttcctcattccttgagcattctagtttaatcagtgttttatcactattgagaggagcatttaaaactttcaattagtcatttacagggaaagtatggattggcagaaggatcctttccccaatcttcttacaaagacacctaaaatgtgaggtaaccaagctggcccatttgtaatagtctagtaaacactagagaattttttgactaacacccagaaggtgagagttaggagagttagagctcacatggatcagaaccagttttcctagtcctccatttataccatttcttccctgtgccccttttaagagtgaatgttcctgggaagtggtttgtatataataggctatttaataagcttggatttgaggttacttggcaacacaaaacaaagaatggccaggggatagtcttagagcagcagatggtcattgacctctaattttttgttttgttttgttttgatacaaacttgggttttataggtattattgtcatttatgacaagtatttttatatatagaaatgttgttgctagtttataaataagtcaagtgagagtttaaaattgaatcccctcagaaactgaggaacaataaaaagcatagccagaggttgttttaaaaaattaccaggctgggcacaatggctcatgtctataatcccggcactttgggaggctgaggcagaaggaccacttgagcccaagtgttggagaccagctggggcaacatagcaagaccccatctcaaaaaaattatcatatgtctagaaagtttgttttgtcttcattttatttatttatttatttatttgagatagggtcttcccctgtcacccaggctggaatgcagtggtgtgattacaattcactgcagcattcacttcctgggcccaagtgatcctcccacctctgcctcccaagtacctgggaccacggacatgtgccaccatgcccagctaattttcttctttattttttgtaaagatttaaaaattaccactcactatgttgcccaggttggtctcaaactcctgacttcaagcagtcctcctaccttggccttacagatgtgagccaccacacccagccatattgcacatttctaagacaagtttttaactgtaggatctatatttttctaaaacgaagttctttttttttttttttttttttttttgagacggagtctcactctgtcgcccaggttggagggcagtgacgcaatattggttcactgcaacctccatctcccaggttcaagcaattctcctgcctcagcttcccaagtagctgggattacaggcacaggccaccacgcccagccaagttttgtatttttagtagagatggggttttaccttgttggccaggctggtcttaaactcctgacctcaagtgatccgcctaccttggcctaaactgctgagattacaggcatgagccaccatgcccgaccaatttttttcctaatttggggagagctaaattttagaaaacttgttgtattgtttagctcattgtcagggaatgtatgtttagaattgctcccaaaattctgttcaaggaatgaagtatcaattatttcctctgaaaagctgtttttctatgagttcttaatgaaaccatccttagcattaattgctctctcttttttaactttatttttgcatatgcttgttagtagttgttaagtagtctgccctgatattcttactatgaatattcattctgtctctttttctggtttcttttcctgtgattattcttaaattcattccatagagttttagcagcaggcttctcgttggcttgatatcttctctggggatctcatctactttcttgccacttatgtccattctccaggctttgctgagttccaggtgcttgttagacattttcttctacatgtgccccacaaagctcagattcaacttgtctaaaataggacttcctcagacacccccaaaacaaacaaacaaaaaatgttccttttaatagtcccaaatcactaccccctcagacacccccaaaacaaacaaacaaaaagtgttctttttaatagtcccaaatcaccaccctctcagttaccataccatttccaatcgcgctgacatagccttggtcatcaagtgatacatcaagtcagcttctgtgtctcttaaatctaactcttattcatgatcttttttgtactcattacctaacttaaaggcctttattgttatttagctgagtgattaattttcttttctcttttttgagatggagtctcgcgctgtcgcccagccttgagtgcagtggtgcgatctcagctcgctgcaacctccacctcccgggtgcaagcgattctcctgcctcagcctcctgagtagctgggattataggtgcccaccaccacgcccggctaattttttgtatttttagtagagacggggtttcactatgttggccaggctgatctcgaactcctgaccttgtgatccacccacctcggcctcccaaagtgctgggattacaggcgggagccaccgcccccggccttgaatatccttttaatcatgcttcttgtctacaatcataccctgccagtttagcccctgcactattgccaattatttttctttattgtttcgcttccttgcataaaaatctttggtagctcctcacaccctacaggataatgttcatactattatggtgtgtaagtctaagatcctttaaaacctatctcagtgtacctttttaacttccttactaatcccttcttctcttgggtcataactgtcctggagtgcgccaccatccccatgacatgtgctttaatggctctttccttcatcctcttcccttgactgaagtgatcttctcttttttttttgagatgcagtttcgctcttgtcacccaggctggagtgcaatggcgcgatctcggctcaccacaacctctgcctcccgggttcaagtgattcgcctgcctcagcctcccgagtagctgggattacaggcatgcaccactatgcctggctaattttgtatttttcgtagagacggggtttctccatgttggtcaggctggtctcaaacccctgacctcaggtgctccgccctcctcggcctcccaaagtgctggggttacaggcatgagccaccgtgcccaactcgttcttcccttctttgttaaattcctactcatccgttaggactgaactccagtgttagctcctctctgacctcctcttttccaatactttttcagactttacattgattgtaattctttatattgtctcttcttctatactaagttcttgaaaacaatagttacatgtatttatcttttttcccatgaccctttgcagtacctgggatatagtaatcactcaatgaatataaactgcacttactggcatgctcaaggaatgggctattaaggtaaattgaatttttggttgattcagtagtaaagcttttttatcaatatatgacagtttttctaaaatggtcaaagtatctttttgacttagtattgtggaatgaaatggtcttaatatttgagaacttgtaaccaccctatgatttttctttctgaaataaatactatcatcatgttgacatagtacatagtctccccaggataaatgggctgcttcagaatgacttctgcctgctctttaaaaatcggattttcaggcctcattccaaatgtattgaatcagaatctttagtttgggggcccaagaatatgtttctaactaaaatctccaggtgatcctgatatgcaacaaaatttaggaactaataaggaggctgagatgtactgacaaggtatataacctggacaatttttttcttccttttctgatataaattctcattgattggaggtaagtactttgaagtttttctgctgtttgggtatgcttttaataatcctatacaatgtcattcatttccttcagcaaggtatcctgttaaaagtggctgaaaccatcaaaagttggatttttttttctcagtgcaataagaaagatgacttacttcacaagttggtaagtggtcacttctttttgccacttttcagggttctaggttattagtgaaataattggtgaatcagaatttgttttgctatcaatttggccagcaattgatttttactagagattctgcagtaactcaggatcttttaatttgggcttactggtattgtttatagcttttaaagaggttattagccactcagaatggaatactctgatagttattgaaacgttatttgttagattgctaatttactattgccctcttcctccattgacaggtatccctctctataggtaaaggaatatgtcattagtgggatcaattcaatctgttaaatcacagaatttcccaaagactcgaaacagtcaacctgaaaggtctttgtgatttttgtgaggctttgtttttttctactctctgctgtaacagaactccaggggggaaatacttcaaccttctgacgtcctaacaatacaaaatccagggagtatagcctaaaaattcaagttatgtggttctcatggctcccagaaggagtaatgtagttacaagtaagcaggtttcaggatctctgctggcctgtaaccttaagaattatcattcctgtaaattaacatttgtaaggagattgtttacaaagtgctttcacattttgatttggtaatctaaacaacactataagatttagtctgcttcagtaacgagaaaaccaaggttcagacaatcagtttgttttaataacttactgagtgaattgtctaaaaatgttcagctagaaagtgatagagccagaatttgaacccaggtctcttggttccaaagccatgctctttctgctatagcatacgacctctctagctcaagtattattattttttggctgactaaaattacttttttagcaatccaaattgtcaagttctttgttcagggtttcatctttgttgaaggtgtattgagaaggtcaatgaagtgtcttatcgtctacatataatgccatttttatccaggtggagccatctcattcttcagtgatactaggactgtggtaaggtatatggatccatatacatttttctgtgatttagtcatagtctgcctaggcctggtcttttcattcttgattctgtgtcactggccacatgtttcatgtgatgtttcactatacagtgccagcttctgtatgcatcccttttgtgcctatattatggagaactataagaatacatacctaaggattagtttactagtaatggaacaagaaattgccaaggtggcttttggcgtgagattgcttgactttttccccttgattgtgacgtatttaaaatgttgttagctatacagatattgaagcaggccctcatttcttttgtaagaatattggcaattgctctgtgatatctgaacattttactaatgttcatttttatagtacttttcttaaaaattaaaaaaatcctttatagcaaccatgatgggtagtggtaatggcactttttaagtgccttttagcttataaagtgctttcacacgtgttatcttatttgatccttgtataaaaagccccatgatatccaaagtgattaagatctttgaagaatactgacaaatgaataagttctcttcttcatccctaaggaaaaagaaatcaaaatctcttaattttttatctgtgccttctcataacctttcatttcatccatgcagaaaggaattcctaagtactttctcatgccacttccctatttagatcctggaaagatctttatcaatcaaatcaagtccaaatttgtcacgtcagcactaaagagtctgcataatttggccctaacctacctttccagctttgtccaccagtatttgtatcaatgaacccagtcttcattttcctttattccgtacttattctgtatgtctatgtttgtgctcttatactgtgatggaatactttctgttttttttttcttgatccattagaatcttttcaataagcactcctagctttttctcaaagctttcccgaaacttcagcctattgtgtctcttattttctgcatcaacctagtaataattactttgtgttctataagtttttgtattgtaatatatccaacgtgtgcttttctttattgtttcagttattgcatagatagtgacaacagtaatagctaacatacagtgcttactatgagccactcttcttggtattttatagatactgacttatttaatcctcataacaaccctgtgaagtagctactgttattatcccacttttgccaaagaggaaactggcacagagagcttattaacatgcttaagttgtggagcaaggatataaagctagacactaagtcctggcactcagacttgttgaaaatgtgccaaagtttacatagtacacatcccaggagcatagagcctccagccatgcaggtgatacctgctaatatttaaatcgatcagaattagcaccttttcagtttcttcatttgtttgagacctggatctgggcttcccagtccaaatagtactgtcatgacatgtttcttaatttgcaggtgtcagtttttctggtagtttgattgttaccttgtaacacagttaacatgttttctgcagttcttatttttataatcaaagagtaatatctaattttacattttatccttaagaaagaaacttaattcattaatctgattcaatttaaaccgttataataatcagtatatagttcaagtttttcctctacgtgaggcaatctaatcactaagataacattgttttagttatttggagtgtcttggtgcctttcaagtttatttgtattcatagatgattgtaggttgttggttgatcactttttttttttttttttttttttttgagacagagtctccttctatttttcaggctgcagtacagtggcaccatctcggctcactgcaacctctgcctcccaggctcaagcaattcttgtgcctcagcctcacaagtagctgggactacaggtgcacgccaccaaacctggctaatatctgtatttttagtagagatgaggtttcactctgttggccatgctggtcttgaactcttggcctcaagtgatctgcccgccttagcctcccaaagtgctgggattacaggggtgaaccacagtgcccagtgggtttgtcacattcttaaatcagatattcctaatgctattaatacttcctctaagcacgttggttttggggaggtgttatcccagttttacacataagtctgatgccagggaatggtgttaaagaaagtgagtaactgattaagtagaatatctgtgaagagagagcactgccattgaatattactggcttttccactctctgtcagctttagccttcaactcgttaggcttcttcaaacttaccttatataggtacatagaagtctcataaaaggtatggtctaaagcttttgtagcaaaagtttgatttttaatacttgcattgaatatggctgtgtctaattggggaaccaaatagtaagatcaatttcagagattactcaaaaagctaccatgcccctgcgctccttttttctcccctctgaacaatagtataaagtgagttgtgttgctctgtttttatgaaagtggggtgggatgtcaaattaagtggttcctaatgttagaatcagaattgtgggaagagagaagaggcagttgttcaaatatgaaacataaaagtgctgcagaggtacatgcagagtgtgtcagtagatggtaaaaaaaaaaaaaaaagccatatcaggctaaaagaaagatcaacattccattgagaagatgctctctttttggactgaagataaataaaatatatctaaatgcacctaatattaaaaatcttcttctctaaaagtggcatataaccctgatcaagaggtcatgggctcagtttgatatatggttcacctcattcttactgaagtcctcattatgatcagcgaggcctggaatgtgtggtgtggggatgattaaattaactaagaagagcaaacctgttgccttcacaccctagacctaacaggttttactttaattgttaatggccttgtccatcattctctttattttgatcatatagtaggatcactctagtactaaatttgtttgtttggttttggtttattttttatttttattttttttgagacggaatcttgctctgttgtccaggttgtagtgcagtggcacaatctcggctcactgcaacctccgcctcctgggttcaagagattctcctgcctcagcttcccaagtagccaggattacaggcatgtgccaccatgcccagctaatttttgtatgttagtagagatggggtttcaccatattggccaggctggtctcgaaatcctgacctcaggtgatccgcccaccttggcctaccaaagtgctgggactacaggcgtgagccactgcacccggcctctatttgtttaaatttaatacaaaatacaactttaaattttcttttgaggcagactatatgcagggaaacacagctaccaaacgcttaggatttgaaatcaaaattctggaaagttacttaatctctttgggctttggtgttctcccctacataatggagaggaggatgataaggtacatcacagggttactgtgagaattcacctatctgccctaacagtgctacctcatctctcacctctctaccatgtgcactctgtgcacaatctattaataatatcatctaatatcgacgactcacacttccccaaattagaaaggcttttatcctgtaccatcccacttctccaactcctttgtctggtcaatttttgttcatcctttaaaacttagctcaggcttcacctcttttactttctctgacttcattacaggcttggtccctctatgccattttcatagtactctaggtgtatttcatcacactcctttgcatgttatattgcaactgtttactttttgggtcacttcattaaactacgaactctttaagaatagagacttgtatatctttttcattttgtgtcttcagtgtcaagcctgatgcctggcttatagaagatattccttgatagatgaatagaaagaagagaaggagaaataaatgagctcgtatatgtgaaggcattttgtaaactataaagtgctatgcaaatgttagtgtgattttacattgcattccttaatagtgtatttttaaatatctgaatatccatttttaggaggccttgatcctgctaataaaattcttaaatattggctatattgttacagcttcagggacagcatcttttatgttataggattatattttccatgtcgtgccctagcaatttaatcaattaggcttaactagacaagtttgttaatctgtaattactttacatcttgttattaaaaatttatcttttacatctgatggctcaataatgtctatctcaacctttactgtttcacatttacagtgaaaataaaacccagctatcatactgaaggtagattggactgttgtttcttcttgaagtatcttctgaaaataaacaccaccaaattttattagtacattaggagcttagcgtttaatgcaatattatatatgtgttaatacctctcttctggtattttaatggcaaggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttggtactgtccagaaaacacctattctttgactgcttacatacagagtattagcagaggaaacccatcattgtgctctccattgtaaaggcataaacattccatacatttagcagtacaattaaagtaacaatatggggggaaaaagtgcctttctaaagtaaatactatttaaagtgaagctagggaaaaaaatccaatttggttattatatacttccaactcattaaaattagttctgtgctcagcaacctagcaaatgggtataacaagtgccaaaaagttactctgccaggtgcagtggctcatgcctgtaatcccaacactttgggaggctgaggtggtaggattgcttaaggccaagagtttgagaccagcctgggcaacgtagcaaaatcccatctctacaaaacatgaaaaaatgagttcaggtatgttggcatatgtctgtagacctagctccttgggagactgatatgggaggattgcttgagcccagcagttgcagagtgcagtgagccgtgatcacaccactgcactccagcctgagcaacaaagcgagaccctgtctctaaggggaaaaaaaaaagaatttattttacccatacacctattcacatgtgtgcatgcaaacctaaccttctttgtgtttctttataattaataggttttatcgtaactatattgtagagacaccaagaataggatgggacatggaggtaggcagttgattctggctgtgttggctgagaaaagatcacagggaatgtgatttgatgattcattcagaccatcctaaaacttttcaacctcttgaactatttgggtctagagcagaagtcccaagcaataatctgttaaaagaaaaaaaaagaatgtgtagcaaaaagcgattatatataaaaaattattgatgtcttcttcctgttaaagtactttattaaatttgacatagaagggaggaatgaatcaagaagtacactaaatcactattcaaactgttcaagttatataggcagttacattcattggcctcaaggttctgtatttatgtcttccctgtcacactgacaaatgcttcattctgcagtcactcagatatgatcatgaagaagtaaagcttcttatccttcaaaaatacaagaatttaaggagctgatagaaggaaccataggttttaagaatttactactttactaactttcctttacccacaaatataatcaagcaactatgagacctataaatgattttagagtttactattaacatacaaaagtatatgatgagattttgctttatggtattgccagtattatctgaaaagtaaaggattctaaaggaaattagggcaaatatttatttatttacttattttttgagacagggtctctgttgctcaggctggagtacagtggtgtgacctcagctcactgcagcctcagcctcctagactcaagtgatcctcctgccctagcctcccaaatacctgggactataggagcatgccaccatacctggctaatttttgtatttttttcagagacagggttttgccatgttgcccaggctggtcttgaattcctgaactcaagtgatctgcctgcctcagcctcccaaagtgctgggattacaggcacgagcccctgcacctggccagggcaaatatttaataagaaattgcatgtgattttctttgcaatatgattattataactctttccaaatattgctgtttttcagctattctcagacacatcccccttatactcccctctttcttttcttttctttttttttttttttttttttgagacaaggtcctgctttgccacccaggctggagtgcagtggcatgatctcggcttactgcagcctgctcaagtgatccctccgcctcagcctccgaatagcagggactacggatgcatgcaaccacacccagctaatttttaaattttttgtagagaaggggtcctactgtgttgcccagtctggtctcgaactcctgggctcaagtggtcctcccacctgtgcctctcaaagtgctgagattacaggcgtgggccactgtgcctggccccctctttcttatatatacacattttcaccaaagcattcattgctttaaagatgtattttagtctgttagacttgcaattgatatgaattttaaaatgtgtacatatttttgtttcaattaaagtagtataaaagtacaaaccttgtccatatcatggtctgtggtaagtatgtatattccaaattgatgatgattatttaaaattagaggactttattcaaacaattactcatcaagtgtgtatcatttctaattggaaaaatgtgtacatattcttgatctagtatgtgtttctatgcaaataaagtttgattttaggaaaagggatttataatatctctgaaatagtatttttacttttaaatctataaaatcggattttaaaatctctaatttgctttttaggttaaggattccatatattttttatttttttaaaagtggtttcagaagatgcctattgttatatttattatcatttttattaatgtcataaagagaaatgtagcaatttctttggggtcacagaagaggggttggctaaaattagaagtaactatttcaagcttttggcaaaatcttcacagaagacttggtgtcagaggaaggtttgaacgcataggattttggtattaaatataagatgacaccaggcaaaaaggaaagagaaggaagagatgttctggtttacaatgcttggagttgagggctgggatgctgatctgactcaagacatgttctgggccaacttctgaaggattttgtagactgagctaatgaagtttgattttatcctgcaggcgatgggtggtatttctagctccagattctgtatatgtaggaaatgtagaggccttttgttggttctgcccagcattcagtcagcacctacagagaatttgagtttcttttgtgaaatcagctttacctgattccagaagatacctgttttcttacttaaatttatcagctcagatgttaatacctaagcactattgtctagttgcgaggtattttaaaaatctttcacatcaccttcttaaatgtcatatatttttaagttatgctttacaaagaagctagcattttatttatttagtaaacctaaatttaaattttgtttttactgattaaagtaattcatctttctttctctaatctgatgcatatcattttcttcctttcttgttcccagggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacactgtgagttcattttttattttatttcttaaatgattattttctattccataaaggagaatatttattacctattttcatttctatgttgcatttataggaaaaaaaagtgcttttctctttagtacttactaaagtcaattaactgctaagtgaaggaataaatacattatgtgctagatttaatatgtagtatgattctgcctatctgctttgaggaactaaagtactttggagatcatgattatttctgtatgttaccatgtgattatatgagataatatatagagagtgtctgatactgaacctaacgtgcagtagttacccagtaaatgcttgctcccattactccctttcaaatgccttctttatgatagacgtatctgctataaatgcattttgaaaactcttgacatgtactaataactgttcaggtaaatattagcagatattatagcactgatactctcagaatatcatgcaaatagtgatgttttccattcttacaggaaattaaatattcaccagtctagctgtaagtatattaagctgtaggatatattgactacttaatctattattaaagggaaagttacatttattgagcaccaactatattccatatactatgctagtcacttttgcatacaactaaaggcatagaattataaatggtaaatattcatatccattccatctgattctaaacccggcttgcagtacactggacacctgccaaacactaacagatgacagttgtgtgctagtatatttaataatttatataacctatataacttttgcaatctataggtgggggaaagtaagcatatggtgaagaacattcatagctcttaattagtcgtatctagaaaatcatgaaaagagggagtgaagaacctctggtagccatcgcatccttcactctgttctgctctagaacattacacaatcttgagataaacactgtttctaaaaaatcatggaatagagaaatggaagaatcccagtagttatcttgttctttactctcttgtgttctacacacaatcccaagacataagatggattttataatttctctttcttctcaatcaaagtataaaagtcagccaggcacaatggctcacacccgtaatcccagcactttgggaggtcgaggcatgaggatcacttgagcccaggagttcaagactagcctaggcaatctagcaaaaccccatctctacaaataataaaaaattagccagacgtggtggcacacacctgtagtcccagctactcgggaggctgaggtgtgaggattgcttaaaccccaggaggttgaggctgtagtgagccaagattgtgccactgcactccagtttgggcaacagaactggagacaacagattctgtctaggttgggcaacagacttggtctcaaaaaaaaaagtataaaagttcttagcatctgttgatttttgtcgttgcattagttgaagtctacttcttattgacttaaaggatagcacgtttttaagttgtttaagtgtcaaattttaaaagtttaaaaaaatcatgcttaaaataagtaatatttccggccgggcacggtggcccacacctgtaatcccagcactttgggaggccgaggcgggcggatcacgaggtcaggagatcgtagctatcctggctaacacggtgaaaccccgtctctactaaaaatacaaaaagaaattagccgggcgtggtggcgggtgcctgtagacccagctacccgggaggctgaggcaggagaatggcatgaacccgggaggcagagcttgcagtgagccgagatcgcgctactgcactccagcctggacgacagagcgagactccgtttcaaaaacaaaaaaaaagtaatagttcctttttattttattgagaggacttactggttgaacaaagtggctttgttcaactaatggttaggcgtgtatagaggattctgtgccttgtgtcattttccaactttatctgtccccatggaatttgcacgaagaggtaaagtgggccagttagacatgatttaccttccagattatgacttctacccattcagatgacagacgaagagaagtattggaagaaattgtgcttcctttgtctctatctaactggataatgggttgaaaaatgaataataagtcttgaatcataattttttagacattttcaaaattagacagtttttaaaactgatttagtaaaatggagcacaagcagtagtgccatatattgaaatcatgaatgctgttttgtttctgactcaaattgtcctctctcacaaataattgaaaccttttttgccttcattcccttgtcttaacataagcctgtcagtcatcatcctctgctttttatagattttttaaaatttggtttttatagatttttaatacctgaatacattttagtatggtttaacatttttaaagttttgagttaggtgtgttgttttatagctttgtgttatagtataagcaatttacaaatgccaatattttgttttactgttgggaaagattactggttaggtgaaaaaatttatctgataaccaggtatttactcatatatactgtaagttatgaaatgtaatacattgtatgtcattgttacaaattaggtactccccattaatcttatgggaagtgccatgaaatgtgcttcctcttgaacagctttgagagtagctatgctactatgcagtaacccttactttgcctttctacttgtattcccctgttggccactggtcctgttatctttccacgtcccctacttcattttgagtaggtaagtgccagtggcagcaggtgggtaagtaattttaccctacttttatgaatgtacagaatgtatttctatacagtattttttctgtacaagtgaccaaaatatgatcagtgaacatatgtgatgaacgtatgtaaatgtatattaagaatttaaaagtgtttataattaaggtcttcatacttcctatggatataggttttgaaaactgaatataaagtagctcttctctaatatatgttagcaagcatagtgtctatgtaaaaaagatgtggattcttaataaatatttctacatttctgttatatctcagccagaatccattgtttccccacatcagaggaagcctttgctctttgagatgttaattttttgtcttttttttagtggttgtctatatatacatatatatatatatctagtcacagaaatgactattttatgagacctgagttgacatatgtataatcattttctagtgaagatcatgaaagaggaatttgttttctacatttaatagaattgtggatttaggaaacaaaaactttaggacacctgtacagttgtatcacattttacttttcaagtttgcttgacagggtcagtgctgcttgcccatttaataaagctggacagcatccaagtcagcatctcatcggtcttcggaaagctgtctaccgaactctaagagccaacttccaagcagcaaggctagctaccctatatatgctgaaaaaatatccttttctgtttatatatgaaactaagcaatgtttctggagtcctgaatatagatattatagttgtatcctgtgaaagtttactgtaaagtgagattgcctattttgaagctaatttccatcatcaattctatgttaaaactggaaatgcattcctgggggaatgacaataacagacaggaagaaagttctgttcttctgtgactgctttttaaacaaggaaaaaacttgaagtctcttcctttactcatccaaagaatgaagtcgaaagagtctggctttgctaggtctgacattttaaacaaatttctcaacatggcagatttgcatcatggcatgttaataaactggcaactggaaatccttcccttttcaaaaaaacaggttctaggagcagaatggctaagttcaaacactggctgtatcagttacttcctaagtgactttaagcaagtttcttaacctctctataccttgctttagtcgtgtttaaaatggcaataataacatcatcttccttattggatttttgttaggatcaaatgagttaatccatgtaaagtgatcagacatcatctagcatacagtaagcacccaaagactgcatgacaataagtctgtcacttaaatttattaaaataggaaattagttctattagccagaaaataaaggcatataagagctttattttagtaaagacatatagataagttaaatcctgactaagtagaaggtaaaaagacaactttgccacttcagaatgctgggtattgtagcactgataaatataatacttaaagtttacagggtgctttatgttctatcatatccttatacaaacctttgtagctagattttcttgtctccattttatgagaaaactgaaatagaggttaagtgacttgtgcagtatcatacaactactaatggatgaagttgtgtcttgactgtaggacttatgacttgaaaccatttttctctctctttctctctctttctatatatatatggaaatttcacatatatatgaaatggagagaaagcattttaatttttattaagaacttttccattttattccccattgcctaaatgccggtctgctatatgtcagccattcttccaggtgctaggaaaactgagtaaaaatatgtactacctacttctaaagacttttgaatgtgatcaatagagaaatcagtattcataatattatataagtgccgtgggtgccttccaacatagcagggcaacatacttggtttatggagtcagagaatgctttcagggaggtgacatctaagttgagcttcagagaatgaatagaagttggccatgaggataagagtctgcattccagatagaaggaagcaaaaacatatggaaagaaatagagatatgacagtgtggcatgtgaactgttggtcattcagtgaatatttatggagcacagactgccaggcaatatgctaatcactagacgtacagtggtaaacataatagacatgatccctgccttatggagcttgtagttcagtgtagggtagggagtgagagggttagcctatcaaagactacagactgtatgagttctttgtgccagtcatttttctagaaactggggacctggcagtgaacaagatagacaagatccttattctcgtggagcttaccttctagtagatgaaataatcaataaaatatgggcttggtgcagtggctcatgccagtaaccccagcactttcagaggctggcttgagcccaggagtttgagaccagcctgggcaatatagtgagaccttgtctcttaaaaaaaaaattcttttaaattagctgcatggtggcacacacccgcagtcccagctacttaggaggctgagacagcaggattccttgagcccaaaaggtcaaggcgcagtgagctgtgtttcagccactgcattccagcctgggcaacagagtgagagcctgtctcaaataaactaaaataaaataataaatggacagatgggattcttcagataaaatagttactatgaaggaaaaaaaaaacgggaataggatagagaatgatcggtggggtgctgctttttattagatggtaagagaaggcctctctgaggagctgacatttaaactgaggtttgcatgctgagaaagatctgggggaagagtatgctggttagatagaccagtgagtagaaagatcttgtggcaggaatgaatttagcatgattggagtatagaaagaagaccatcatgagttgagcacagtaagttggaggttagagtatgaaatgaaacagaggtggccaggggccagatcatattctccatataaaaaaccttaataaatttaactaaaaaagaatccaccaatcattttgagaagaccagtaagatatgtaaacccttatttgcctgatcaaagtaaagagcagaaatatacaagattagtaatgagaacacagtgataaccattgatatagaagacattaaaataactgtaaggggatagtatatgcagctgcacagcagcaactttgaacatgtaggggaaaatggttctttttgtttcttttgagacagtgtctcatctgtcacccagactggagtgtggtggcatgatcatggctcactgtagtctcattctcatgtgatcctcctgccttagccttccgagtagctggaaccaaggcacacagtaccacacctggctaatttttttgcattttgtagagacagggtttcaccattttgcccaggttggtctcgaacacctgggctcaagggatcccacattgctgggattgttataggcatgagccactgagcccagcctcatttcttatcaaaataaaaatctgcaaaactgacctaggaagaattttaaaacttgaagagattggacataggataaagaatactcaattttaaaaagaaaacacctggtttatatgtagacaatgcaaaatatgaaactatttttaaaaaacaatgatagagttcttagtgctctaatgtggatctccaagttatattaagtgaaaaaaaaacacaaagtgcacggattggtatttattgtatccttcaatttgtgcataaaagggactgtgtgtttatacagggataaatatgtatgtatgtatttatgtacatgcatgcatatatacctacgtatctccagatacacatttatatttgaatttgctcttatgtatgtatgcataaacaatcttagaaggtactggtaaatggaattgcctttgcatttggatagtggaactacatggctaaggaatagaggtggaaagtagtttttgctgtatcccttaatacctcatgaattttgaatcctgtgaatatactacctattcaaaaacaaagtgaatttaaaattttttaactaccagatccagatggttttatagttaaaaaaaatttcagactatagaaaaggttagaaagtttccctatatcattttatttatgaaaatactgtaatctcaataccaaaacatgttgtattacaaagaataaaaaccagttgtattacaaagaatatagacccatctcataagtggagaaacaaaatgtttaaatggaatatttataaatttaatattggattgtatcaaaagattattataatatgaccaaataggaatatgctagaaatgcaaagatggttcacgatcaataattatttagaaaaataattaaaaggaaaaatcattattgattttgatgtgtctgtaaggatgagggcagaggaaacctaacagtagtctatgtcaaacaagctagatagaacaggcctggtgccacttatatcagtctgtgtatttcagataacgttcaactaataatgtcctgcagtacgcagactgagaggaaaagaatatttactatagcatagtgagggccctgaaccatgacacagtaaagtgcacaatacagctacaaatggtaggtgtcaaaaataacggagctgagcgcagtgactcacacctgtaatcccagcactttgggaggctgaggcgggcagatcacttgaggccaggagttcaagaccagcctggacaacatggcaaaacatcatctctagaaaaaaatacaaaaatcagctgggtgtggtggcgcatgcctgtaatcccagctactcgagaggctgagacatgagaattgcttgaacctgaaaggccgaggttgcagtgagccgggttggtgccactgcactccagcctgggagacaaagcaagactccatctcaaaaaaataaataaataacgtatcactttaacccttttgaagacttgaactgttaattttttagacattaaaaattgtatccacaagtatccaagatatctgaggtattatgttaatatattagatacttaaaattaatttgtgtttaaaaactgctgtaaacctcctcatccaaaagttcagaataaagattagggaatgtgatataggacaatttcactgtatcttttatgctttcatgaaaaggctttgttgattgccttaacctaatttaacctaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggtaatccatttgtgtaagggaagggctgaagaaaaaatagatgcacttggattgtgtctatgctttctgaatgtaaatagtgcgtttgttccactcattgtttgctgcataccatcatcataaatgcacgggtgatgtttgtaactctgtctttaagagccgagagcataataaagattggaagaggagatccttagattttgacgtccaaatacttaaaatgcttaaagaaatgccttaaattagagtttggagataagtgaatttactttaattggaggccaacgtgagtgattttataactagccatttgtttcaacaaacatggataatgggttatctccaaaattcttaagtttttttttcatacatcaaaagccacatgaaaggatacatttagctacatagaaattaaacttttgggctggccgggtggctcacgcctgtaatcccagcactttgggaggccaaagcaggcagatcacctgtcacctgagctcaggagttcgagaccagcctgaccaacatggtgaaaccccacctctactaaaaatacaaaaattagctgggtgcagtgtcacatgcctatgggaggctgaggcaggagaacccggaaggcagagtttgcagtgagctgagaccatgccattgcactccagcctgggtgacaatagcaaaactccatctcaaaaaaaaaaaaagtaaacttttaacttcaaataatgcatacttcaaatgcaaacaagctcaagaaaaattacaatgatttataacaaagagttttaattttttttttttatgcagagcactctaaagtgtctaagatctatagaagataagttgggtgcatgaactgacagttcacaaaaaaagaaacacaggctagtcccagtgaggttgtattttacaacgaattgatcacaaccagttatagatttctttgttccttcttcactcccgctgcttcatttgactagcctaaaaagaaaaaacaagaaaagaagaaatacaaatggccaataaatatgataaaatttttcattttagtaatgaaagaacacaaataaaaataataagccgaccattttgccaagtatattgaaagttggtaatttcattatcactgaagattcagggagacctcacacaccaatggtgaaagtataaactggttcactttagcagtgaataccaatcttcatacaggtgtatgaagcaaaattgctttattctagcaattttaatttgcccttacagatttatctcagaaagtaaccaaagatatacccaaagtatgttcatgacattagtgtagcagccaacattggaaacaaattttttttgtttttctttttcttttaatttttttcttttttttttttttttttttttttgagacagagtctcactctgttgcccaggctggagtacagtgtggctcaatcacagctcactgcagcctcaacctccccaggcctcaggtgatcctcctacctcagcctcccgagtagctgggactacagttacatgcctccacacccggctaatttttgtattttttgtagagacagggtttcaccgtgttgcccaggctggtctaaaactcctgagctcaaactatttgcccacatcagcctcccaaagtgttgggataacaggcatgagccaccatgcccagcctccagtagtatttttaagacattgatccaaatgtcttaagttcctactaagtatttagtaagctctctttagatgtttctttgtttttagtttttaaaacttcccttgataccgtgaaaattagtgcaagtattgttgttagcatttatcaagatccattttgttttgagactgtattgacttccatatcttttacattttctaaatcaacataaatgttctaataatcttgtttgttttctttctttcctattacgtaaaatttgctttggcttattcctactccccttctaacccatctcaataaatggcaccacaaaaaacctggacaccatctttcttgtccctctttttgcccactcacatccagtctgttagcagattcttatgtcacttctaccttgaaaatgtattttaaacccatccacttttttctatatccacccccgcccccgcaccatcctagtcccagccaccatgctagtcccagccaccatcatttcatacttaggctgctgcagtactttcctcagttatctaaagttatttgtttcagaatgcaacttgacatgtaaagaacctttttaatgatttatcctttgaatttgtaattccccttctacaaactgcaggaaattatttaaaacatagttaaactttatataccaagctgcttattcactttgtgtttataatagtgcacaatggaacactgcctgaaagttcaaaaatagaggaatggctgtgtgagtcatgccagagccacatggtgaaccattgtgtagcagctacagcttgcccgtgaaaattctgtaaaaacttggagaaacatctgttgccagtgaaacaatcaggatacataagtgtatatgcaatatgtccacaaccctgtttaaaaaaaaaaatgaggagaaaataccaagatatatatagctactctttggggtggtgggactatagatactttcacaccctttcgaatttaatatcctaaccttgctttattctttaaggaaaataaagatttttttcaaagtacaatttaagagattcttaatgtggaaaatggagcagacctgtgtttatattttagccctgactgactagccatttgcctttgaataagttattctttgaacttatgtcacctgtgaaaaggagttaccatccctgccttataaggtattagattaaatgagaagacatattaaatacctagaacagggcttgacatataatgggtacccccaaatggtaatagctgttattctttaagaaggacttggagaaagaattatagtatttcatttccttttaaattactttttgttaactcatcaagatgccttggagatttatttctttatgctgttgatgtactgtttttaaaagcttattaaatcctgaattgtactctagcttaagtataggcagcaaagagaagttgtggaccctgtggagtcagattttccaggtttcactctagctccgttatttgactactgtgtggtcctgagcaaatcattgtttctgtgtttattaaaatgggataattgcaatgcttgcctccaaaggattagatgtttgtcagttcagtgcctggtgtagagtaagcaattaatgaatgttagctgatttttaaaattctatctgatatggcctgctctgaaatgtgagacttgttctctgttgctgtatccccatcctaccttccaacaatggtgattatagctagattccttttgctcactcacagtgttttacaaatcaaactataatagtatttttatatttcttttatttttacatataactaacctgtaaccaaactcaatgattgtgttacagttaccacatttatcaggctctgaaaggagccttatcttgaggagctctatagactttgcaaactgttgaaaacccctgtaatgttcaaagactgtgtattacccccttctgtagttaccactgtatcgttattcagataagaaatttaaaaatagattttgtaagttaaatttttaaaagtgtgttgccccctctaaagaaaatacattttggatttattttttattgttcccgtatcttccctcaggaaagtttagtgatagtaagtattgcacctttagaaagaaaagcaacctccaaattgtagcctgaggagacataaataaaatacaggttgaatatttcttatccaggcgtgagtcttatccaggcctggcaccgtggctcacgcctgtaatcccagcactctgggaggccaaggcgggcggatcaactgaggttgggagtttgcaaccagcctgaccaacatggagataccccgtctctactaaaaatacaaaaaattagccaggtgtggtggtgcatgcctgtaatcccagctactcgggaggctgaggcaggagaatcgcttgaacccaggaggcggaagttgtggtgagccaagatcgtgccattgcactccagcctgggcaacaagagcgaaactccgtctcaacataaataaataaattaattgattaattaatttcttatccaaaatgcttgagactagaagtgttttggattttggattttttcagattttggaatatttgcattacacattgaggttgagcatccctaatccaaaaatttgaaatttgaaatgttccagtgagcatttcctttgactgccatgttggtgctcaaaaagtttcaaattttggagcatttgggatttcatttcaaggttttggattagggatactcaatcagtccctagaacacagtccttatccctctcttttcctttaagtttttaactagttttttaaatttatgaagtcatctgtttcctgctctagaaaaaataaatgcacacattgtgaaatgctttaaatcaaaattttctgtttacctatcagctatggttatctccttatccagaggagctttccttatccaaagaacaaacaggaaaaaagaaatacatatttctgagttctggtttaagtgggtaatgtgacagtgattggatgacaaattagtctttagagacaaggtcttgctcagtcacacagctggtgtgcagtggtgcaatcgtggctcactgtaaccctgaactcctgggctcaagcgatcctcccaccctagcctcccaagtagctggaacaacagttatgtgccaccatgcctgactaatttttaagaaaatattttgtagaggcaggggtctcactgtgtttcccaggctggtctcccaactactggcctcaagtgagcctcccaaagtgctgggattacaggtgggagccactgcgcctggcctttagtcttttcaaaagccgcagtaaactgtaccaacttgattcttgcagttatcttgacccaacatgctggaatcatccttgttaactctttttctctcaataccaatcagtcaagagattgtgttagttctgctttcacaatgtatccagagtccatctgctgctcaccttccaccactaaccaccgtggtctcattaatgcttacctggaatattgcagtaacttccttactggtttctccacttctactctcattttcctataatctctcaactcagcagacagtatgggcctgttaacgcataaatcagattatgtcatgcttctgctcagaacccttcagtggctccccattgcttacctggccccagccgtactgagcttcttgctgttccatagatctaccctgtgtgctcccacaacagtactttgcatttgacttcctgctccctagaactctcttccttgatgattatctcatggctcacttccttcaggtgacacttttagagacctccccagccagccccttctcctctctccttcgcgctttctgtctctctccccccctttcatatgtgtacacacacatacacacacacacacacacacactattccccccctttcatatgtgtacacacacacacacacacacacacacacactattcctcttctttgctgtgtttttcccatcaaccaagaaacactatctttctttttcttcctcgacaatcattactgcaaaagggaaatagtatcttttacttgtaaattattatctgtgcccctctacttgaatataagctccatcagagtggggactcttcatttttgctcactgctgtttatctgcacctagaacagtgcctggcacatcatgggtgctcaagaaatcatttctgaatgaacgaacaaaagaataaaaatcattgtaatcataaaatttaacagttgaataagaaggcttgcaagtaaacttgcaagtcaagaatccctagatatcacatctgtagcaactaggaaattaggccttggtcactttaaaaaaaaaataagttaatggtaaaatagatatacatgaaataatcttaattcattattggcataattttaaaattcatttactaaaaccatctaaatactgtctattttcatggttgtgaataattggaatctaaattacccaaagtggtttcatcctctttttattccctgctacctcttgtttcatactacattgtttcctcatgcatttgtttcggagatattgtcctcatcttgaataggactatatctggagaaatattttgctgccaggattcaggatgtatctcaggaacgggcctatgaacatattcagactgcattttaaaaaaaagaagaagaatgggatttatcctggcaacatactgagaccccatctctaaaacttaaatattagctgagtatggtggtacatgcctgtgtttcccgctactcaggaggctgaagtaggaggatcacttgagcccaggagtttgaggttgcagtaagctatgatagtgccattgcactctagcctgggcaacagagcaagactctatcacaaaaattaattaattaattaattaaaataatgggttttgcaatttctcatgtcagacattcctggagtattgattttttttttttttggatggagtcttgctgtgtcacccaggctggagtgcagtggcgccatctcagctcactgtaacgtctgcctcccaagttcaaatgattttcctgcctcggcctccgaagtagctgagactacaagcacataccaccatgtctggctaaattttgtatttttagtagagacgaggtttcaccatgttggccaggctggtctcaaactcctgacctcaagtgatccatccgccttcacctcccaaagtgagccactgcgcctagccctggactgatttttatgttaatttcttagctaattcctagggcaaggtaatagtcttattttgaaacccaagcttttgatccatgtgactcatttctttggagagaaaaaaatatatatatatatgtatatatatccactagtcctactatcttcttttctcctatgtgaaaattttttttaaataatgagtgaagattcacttttactaaattatctcattccatcaacacttcccatctagggcagaactgtagtaaattatatattgatgttacctgctgtattggaatcagaggttcccacacacataatttgaaatcatattcttggctaatcttaaggtagtttaagttcggctatatttattatttaggataaagtgcaaaatttaaaccagaagttaagataaacaaatttatagtttgttttgaacactgaccaatatttttattgatctagttcttttttcttttttctttaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgagtaagtttagaaattataccaagaaaggtctcggtaattagcaagcttcattcgtgtaccattgtggttgttggcttgtgtcctacctagaaaaaagaaacaaaactgaggcatgagcatgaagggtgatttatagctataaatatagcaaaaaaaaaaaataatttataagtactataacttgagggagttattatttatagtttttacttttccttagttcaacagaaaacttggaaaagtaggctaaaagcaggtgttgttcattctctttgagagctgaaatggagatggttataaagaatgagtttcttttaactgtcttaaggtagtgctcttaaactggaacctgcagtccaatagaaatatctaccagtactggaacagtatatatgttatatatagtggaagagtaacatattgctatttttctaaataaattacagcagatctgaaaatttttttgtatcacaggacaagctttgtggtcccagttgaagagcaaaatgtagagtctagagtttatatttgttcatttcctaccttgcatgaaattgttggtatactaccttaattcctaaatttttatgtcccactttggtatacctttatcagctgaaaatactattttcacatatttgtacatggaagttttcaagtttaaaaattgaatcaaggcatttaattgaatacagtcatttccagtgaaatttttctctaacagttaaatactcatcgtgtaggactggatcaaatgaatggttgggttcaaattgtgttggtaatcaggaaggtcctaggaatttaaagagctgacaagattgtagttgatgtacttgaccctgggatacaaggcaagaagtggaatggggaaggcagtatttgattatgtaaataagaatgggtcaaaaggacttgatacatcagcaaaatcaaaaggctaaatcagcaaatcaaaatcactggaattagggaggataagagatacaaggataggaacttaaagtcagaaagatatttttagaagctaagtttttacccatcagttcaaggcctgagttgggcttgatataaggcttgatataaggctgatataaagattatggcataggaaaaatgaagacactatgaactcagggtattccagtggtctatatctgctgttctaagaaagcaggtaaatgctaacgaggctcttagccctgccttctacagggaactgggcgataaggccatctccacttgagtgggtggcaaaggttggattgtcctcaaaggaaaataagatttcagtggacaggttgtaggcaaagccagagcctccgaagaagtaagttttggcaatagaatcagaaatatacggcgcatattagaatgcatttgagtgagggaagatggctcagggaagaaagagtgctacacaaggtagacatgaacacaaaaaagaggagctttgtaccatgagcaggaattgtggattatgcataggaagtttttgtcctgttttaaagtgtaatattctatacatgctaatgtctctcacctttctaagtattttcactagaaagtacaccagtcacaaaccatcatatccaatttgctctgtagtgctgctacatacaactttttgaattgttaactaaataattgttttgtgtttcatattttagaatgctctttttgtgtctcactcctctcccccttgtgttctttgctgttcccactctcagtgcctcatgtggaaccatattgtctcttccctacactagggcattaatttctaactgttctccccacctccagggtgtgtatggccagattagtgttactgaggcatatatttgctttctcacttcactgaaaatcttgactggtttcggagtcatagcagctcaaactaaagtccttacaaaacatactatagaagggtttgtcataacctgactacagtctgtttctatctttaattctcattcctttccttcagtccagccaaactgtataaatgccttttcccatggtccttctataagttggtgcaaaagtaattgcagcttttgccattaaaagtaagggcgggccaggcgaggtagctcacgcctgtaatcccagcactttgggatatgatggtttgtgactggtgtactttctagtgaaaatacttaagaaaggtgagagacattagcatgtacacaatattccactttaaaggctgaggatcacgaggtcaggagatcgagaccatcctggctaacatggtgaaaccccatctctactaaaaatacaaaaaaattagctaggcatggtggcaggcgcctgtagtcccagttactcgggaggctgaggcaggagaatggtgtgaacccggcaggtggagctttcagtgagccaagatcgcaccactgcactccagcctgggtgacagagcaagactctgtctcaaaaaaaaaaaaaaaaaaaaaaagtaatggcaacaacctcaattacttttgtatcaacctaatagaacaagcttccggccaggcgcaatggctaacacctgtaatcctgatactttgggaggccaactagagcagattgctggagcccaggagctgagaccagcctaagcaacatgggaaacccttatctctacaaaaaaatacaaaaattagccagtcatggtggtacacgcctgtagtcccagctgcttgggaggctgaggtgggaggatcacctgacccctggaggttgaggttgcagtgagccgaaatcacaccactgcactctagcctgggtgacagagtgagaccctgtctcaaaaaataaaaataaaaaataaaaagaacaaccttcctcaccttttgtatatgggcccaaattttatccatccttcaatgctacctcaaaaatacctcttccttagttgttccccatctgtccttgcagttggtagtaattttcccttcttctgatttctcataacactgtctctctgtggtattatccttttgtgcctgtattcagcccagttttacatcttactagctttgtgactctaggcaagtttccccgactctctgggcctaattccttattatctgtaaaatggaaataaaatggtagttctaattatttatgatattgtagtctttttcttttctgataaagaaagcaactacagaaagcttgtatttatttattcaaagtaaccagtgctattgatgcaaaaaagaaaaacccaacaattcttccaacactgctttcaaaatgagcatataaaacttgattttcattagagtgtagttattttgtcatactagtaaataaaaaaccaagacgctccccccgaccccttcttttttttttttttttttttttttttgagatagagtctgtcactctgttgcccaggctggagtgcagtggcatgatctcggctcactgcaacctctgcctcccacattcaagcgattctcctaccttgacctcctgagtagctgggatcacaggcacctgccaccatgcccagctaatttttatacttttgtagagacggagtttcaccatgttggccaggctggtctcgaactcctgacctcaggtgatccacccgccttggcctcccaaagtgctgggattacaggtgtgagccaccgtgcctgaccgcaaattttacatgtatgtatgtatgtaacaagaataccaagttagtctttcttcataaaaagcaatttcaatttgaggatacttcatatttgccttttgtgccagcaccaagtctgcctcatctgaatccttccatttcatgagcaacatcaattcttcactgccatctgtggcaccaattattctttcaggatcaagacctctggcaattcctcttggtttgtcaacagcatctcttctttgatttgctgtcatcagattcactgccagataaaggttttctttttgtaccatctttttcttcaccagctttttgagaattaagaaatgcttcaattaactctggacaatctaaattttcttcaggttccaaagtattgtcagcatctgtaaattccttcaggaaatattccactttcccattccctgcgtgtctatctagtacattttccaccacaaattcttcaggctctgcctcttcaacttttttacttttccattctgtttctttcccatgttttgcaatgtggttttgttggaggccattttttattgcagacctgaagagctattattcactgcctccaagctgctctgggtcatgggtctgtggtgtctccagtcttgcatgtcaccagctcgagccacatccaagtggggagggagccagggagctgttgttggcaggggaagtgggggtggggtggggtagggaggggcggtggatattatattttgcttacatatatgtgtaatatcacttgttatttcttatgaatagcagatgagtttaatttttctttttggcccataaaatgcctagtatgtatgcaagaaatatttgttgaataaatatgtaatactctttataagctttttaaaaaattgtgtcaaagaatacataacaaaaattatcatttaatcattataaaatgtacagttcagtggcattaagtgtatacacattgttgtgtagccattaccactgtccaactccagaacttttttcatcttataagccttttttcttttttttcttttaattgagatgggatttcactctgtcccccaggctgaagtgcagtggcgctattgtggctcactgcaacctctacctcccaggctcaagcagtcctcccacctcagccttaggcacatgctaccatgctcggctaattttttgtatttttggtgaaaaaggggtttcaccatgttgcccaagctggttttgaactcctgagctcaagccattcacctgccttggcctcccaaagtgctgagatttaagcttattttaaaataagcctcgtaaattataaatttttcatttcatattatagaaatctgtttctgtttttctttatgactcagggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggtacctgtgagagatttctttgccatatgcttatcagacatgcttattccactctggtaggattttattaggtagacttcttgtctttatgatgaaactagcttcaaaatttcttagtttacttttttttaatgttgaatttatatgtacaaagtgacactgaatacaattcttggctctcattttgtaaattaaaaatgaatatgatttgaaagttcagtgaatcatatctcttttttaaaaagactgaaatgagagaataaattttgatagcatttttctattattagaacttccagaaactctttttcagttaggataataaaagaatgagtttgatagtctggggctaggaacttgagtttttcttttaagataaaatacttaactttagtcattcaaaaataatatacaaatgatataattagtggcactgcatatttagtactaagatctaaagacattgtgtcattatttaataatatatcagattgctttgtgctactaggtaaaaaaatatatatatagtcttgagatttttccaccaagctgcttttatgtgactccgattttatgcttgtttttacctcactgatttcatttttcaatgtttggcatatcaatttttaaaaactgtgctgcaaatcagtaccatatttatctcttggatgtttattgtgaggttactcagacttaggcatagaatttgcattgttgctaaagataattaatgctttaccatcctgttatttttgtgtttacagctagatttgtaataatttctttaatgtcttaaacaagcttgaacaaatccttagataggaaaagtattcactttttccaaaggaaatattaacatgctaattactgatatattacccgtaggttttcttaatatctcaaatgtaaactgtgaataattttttctccaaaggataaatctaccaagaaactctgatatatgcaaatacttatgcatattaaactttctgatatgacatctagagcttttgtgtacattttctacaaatagaaacactcagaagacctttggttgttaaaagatgcatcctggccaggcacggtgatgggagtagctgttacccagcttctcaggaggctgaggcaggaggattgcttaagcccaagagtttgaggctgcagtgagctatgatcgtgccactgctgcactccagcctgggcaacagagcgagactccgtctcaaaaaaaaaaataaataaataaataaataaataaataaataaataaataaaaaaggccaggctcagtggctcacgcctgtaatcccagcactttgggaggctgaggtgggcagatcatgaggtcaggagatcgagaccatcctggctaacacaatgaaaccctgtctctactaaaaatacaaaaaattagccgggcatggtggcgggcacctgtagtcacagctactcgggaggctgaggtaggagaatggcgtgaacccaggaggcggagcttgcagtgagctgagatcgtaccactgcactccagcctgggcaacagagcaagactcttgtctcaaaaaaaaaaaaaaaaaaaaaaaaagaaagatgcatcccattcatccctcctttagcacactatgagatgttgaatcttagtctatcgcttatccactattgttaaccattactgtgaaaactttctccacctcattgggtaggtaattaagataagccattttctaattattttctgtatgtgtggcttttgcttatagataataatgatatggattaagacacaaatagttcacaaacttttttcactaaaaaattcacagtggccatgactacacaggtttaaatttaaaaaatgttcatttgaatattttaagaagcaggtactttagttagccatatctttttttaaaaaggtcttattttgaaatcatttcaaacttacagaaaagttgcaatagttgaaagtctccttcatcaatattccctagttgttgacattctgtcacaattgccttatctatgtatgtatctgtatgtgtgtgtaattcttttgatggtggtgttactctgagccatttgagagtaagttgtagacttgaagccccattacccctaaatatttctgtatgcatttttgtaaaacaggaacattctcctgtgtacccacagtataccatcaaaatcagaaaatgaacaccaaccatgatattgtcattttatccacagaacccattcaaatttccctgattgtcccaatattttttatatgtctagacctagattgtgcatggtgttcagttgtcatgctctttattctccttttccttaaagtctttcatgataaatattttgtaaagaaatactctgaggttttataaatatgctttcttcatcaaaattttaaccactatgaatgcatataccatatgacccagtagtatcattcctacgtatttaaccaagaaatataaaaacttagtgttcacacaaaagcctatacataaatattttgtttataaactaaaactagaagcagctaggctttgggaggtgactaagctgttacatccatccatacagtgaaatactactcggcaacaaaaaaagtgaactaccaatgcatacaacacgatgaatgaatctcaatacattatgccaagtgaaagacatcacattcaaaccactacatactatgttattccacttatgaggtactcttaagttggcaaaggaacagaaaacagatcagtagttgcaaggaattggagatggagggaggaatggcttgtaaaatcttttaatggcaatggcatttagaaaccaagattagggtacttggctttggcggcacatgtattgaaattagaatgatacagagaaaattaacatgtcctttgtgtaaggatgatgtacaaattcatgaatcattccatattttatatagaatttatataaatatgtatgtatacacatatacatatatatacacatatatatctacatatatattgtggtaagctcaggaaatcattgagaataggttataactttggcattactcgaggattaccatagaaaagaatctccagttaataaagtttcccattgttaaaaatatcacaggccaggtgcggtggctcatgcctataatctcagcactttgggagcccaaggagggaggatcacttgaaaccagtagtttgagaccagcttgggcaatatggcaaaaccccatctctaccaaaaaaaacaaaaagttacttgggaggctgaggtggaaagattgtttgagcccaggaggtcgaggcttcagtgagccatgattgcacaactgcactccatccttggtgacacagtgagaccctgtctcaaaaatatatgtgtgtgcgcatgtgtatgtgtgtgtgtcacattattttaaaacgcttcatatttattacctctagggccttgttattcagagtggtccccagactagcatataagcatcacatgagagcttgttacaaatgcacccctgactttaaatccacctgtattttaataagatctggtagttgcatccacgttaaagtgtgagaaatttgagaagcattgctctgggataaaggtctgcaatttttttcctctaaagattttctgccttgcaggccatatggtgtctgttacaactactttactctgctgttgtaatgtgaaagcacccatagactatacttaaatgagtgtggctgtgttctaggaaaaatgtatttacaagaacaggcagtggggcagatttggcaagcccctgctttcagacagtagaattgagggataaggtcttcagggagcttttttcactttataaccttctgtgctgtttgtaaaagctattactgcaagcatgtaattaaaaatctggtgggtttttaaaatttttttaggctttttgtgtttgtttgtttttgagacagagtctcactgtgttgtgcaggctggagtgtggagtgcattggcgcaatttcagctcactgcaagctgtgcgtcccaggttcaaatgatcctcctgcctcagcctctcgaatagctggaactacagccatgcaccaccatgcccagctagtttttgtgttttttggtagagatgggttttcgtcatgttggccaggctggtctccaactcctaacctcaagtgatcagcccatatcagcctcccaaagtgctgagattacaggcttgagccaccacatccggcctcttgctagatttttgttaaatggattgcatgctggagctagctctccaaagattgttaaatattcagaaatttgtgagtcagtttaacatcattggtagcttaaaattggtcacagtgggtgcatttacaccatgggaactggaaatcaggaagtgctgcaaattgggtgttttgttttgtttagagctggattgccagcacactgtttaatgtacctgtttattgctattaataatagtcttatggatttatttggttttttttcttttcattcaaagaactcgatatatggtgtcaccattgatgtaatgaaatctgtgttctgctaattaggcaataatggcagtttttgagcatgtaatctgtagcaggcacttttcatgtattcttttttaatcttacaagatagtactattattttcaccactgttctacagataactgtaattttttttttttttttttgagacaaagtcgcactctgtcgcccaggctggagtgcagtggcgcgatctcgcctcactgcaacctccgcctcccaagttcaagcaattctcctgcctcagcctcccaaatagctgggactacaggcgcatgccaccatacccagctaatttttgtgtttttattagagatggggtttcaccatattagccaggctggtctcaaactcttgacctcgtgatccacccaccttagcctcccaaagtgctggaattacaggtgtgagccactgtacctggccctttttttttttttttttttttgagacagagtcttgctctgttgcccaggctggagtgtaatgatgcaatcttggctcactgcaacctccatctcccgggttcaaacgattcttctgcctcagcctcctgagtagctgggattacaggtacataccaccatgcctggctaatttttctatttttagtagagatgggggtttcaccatgttggtcaggctggtctcaaactcctgacctcatgatcctcctgccttggcctcccaaagtgctaggattacaggcgtgagccactgtgcccagccagttaactataatttaaactagaaagcagcaagagctgggatgtaacccaggtgtgactaactctacagctcttagccactgtgctattctgtctctcattagtgcttcctattaatttattcatcgttctgccatcttgcctacaaactaatcagtcattttttgtaacatttcccaaatacttctttattttaaccatttaactattgttacttttgaaaattaaaaatcaacaagtttaaaccatacttcttttttttaagtagaaagataatgattaatgatagccacctggatatgagactaagtaaccctgtcattaaataccaaacataaattttaagaattaatcaaagttaaactcacttgggtgatctttaaaagatatttccttgtgaattcatttccaattccaacctctgagtgttaaaatagcctcagggtaagtttgaagtttgtattttgtgaagaagagtgatggtctgtcttaagactgttcctatgctgtgaatgataatattttgttcaacaagtacttacagagtacctggtgtgtaccagatactgtgaagaggtgaagagagaagggcaggtcctcttctccaagagtttaaagacttaaagttaagttgtaaatctactaatttattgtttttcactttaatatctttatgtttttataaatacaaagttattagaacaagttggactatgaaattgacaaagtattagtaccaaggatttttttggttgggggagacaggatctagctctgttgcccaggctggagtgcagtggtgtgatcactgctcactgtagtcttgatctccccagctcaagcgatccttccacctcagcctcccaagtagctgggattacaggtgtgcaccaccatgcccagccaatttttatttcagtttttgtagcgacagagtctttgtttccaggctggtgttgaactcctgggctcaagcgatcctcctgcctcagcctcccgaagtgctgggattacaggcatgagccaccacacctggccccaagggtgtttttaattagatgttcactcatttctgtgtggtctgtttcttatctttattcccatctattcccgttttttaaaggcaagcctgaaatagcatgtgaaaacccacattgtacagtagtacctttgaagcagcctactctacacattgcagacaaagatccaatcccagaggagcaggtaagggtgaaaattactgttctttcccttgttggatttctgtttctaatgagcttcaaaattacaacataatatattgaatttatatcagatcattagttcttagtgcttaactctgaattcattgaatctgcctgcagacttttttttgattgttatttatatctaattgtctatatctgagtggctttcaaaagtgattaaacacattgaaaattagtacattggcaaagctaccttttgggatgctggaaatgtgtttatcttgatctgagtagcagttactggtatgtgtacatatgtaaaaatcctgtgcacttgactgcatgtactatgatatacctcacttttaaaaacaattttttaatgatcgcattggatattgacaaaggttacttttgttcattgtaaggaaaacctcttttccttaggtcatattatctattcagtattttttttccgtgtatattgcataacaagttactattcagtattcttaattgcaaatggaaaccaaccctagttagtttaacagacagatactttatttaaacttttaggtagcttacagaatatttcagagagctagataagcaggcttgaatgatgctagggtaaacagccaaatcactcaaaagaactgttgcaatggaactatcattgctaagttaatgggtggagacattgccccttgcttcgtcaatgctgaatagtaaaacttaacctccagaagtgctacttcaagaaacatatctgcaacatcctgccagaatagattttccaaagtgcttggttcttttttatatgagaccgagtctcactctgtggcccaggctggagtgcaggggcgcgatctcggctcactgcaacctctgttgcccgtgttcaagcgattctcctgcctcagcctcctgagtagctgggattacaggtgcctgccaccgcgcctggctaatttttgtagtttttagtagagacagggtttcaccatcttggccaggctggtcttgaactcctgacctcgtgatccgcctgcctcagcctcccaaagtgctgggattacaggcatgagccaccgcgcccggctggtgcctgcttcttttatctcagacttctaagtccgatctgatgcaggtacgtcgattagagaatcccaggtcatttacctgagcctatactgtaaggatactgcttgggtaagcaagcatcctaccctctctgtcttagagatagggagaaccataaggtggggtgttccctaatcctaggaagaatgttcaaacttcctgggaaatctgaaagaaccacaagaaaacaaacatgcctgaccacctccccaaagtgccagcccttctaattttgattggttttgatatagctaatggctgtaacactaagtgtatggtatgttaccagagtagaaaaataactactgaagttgttaaactttttttatccacaatgctttttagtatcaactgttaggttgtttttgaagatttcaatttatccataggtatatatttgcttttttcttttcctagctctgctttaatgacctgtgccaaatgcaagtcctttttttttaatctcagagataagtaagtgcaagtaaatgaatgcttactagagaattgtttgcttcaagtaaagtgctttttcttctattcattttcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatggtaagcactgactttaaagtaacaggttatttcaatgtaggggattctttctttcttgaaccatgaatgttattttagctgaagaattcttggggttttataagggtccaccagtatgcatagtactttttcttctagatgctaaatcaatttgattaataaaagagtaggaatgtaaccacattggaaatatgaagtcatacttttttatgagttatttaattttttagtaaatttgttttagaatgggcagtgagttgaataatttgggatattttaaatgttattttcaaatttagtgaatttgagattctcaactctgttgtccatatgttaaaatatttaaaaatacctcagtgaagcacaaaattaataactgtgctcacattgaaaaaaatggcccaggcgcagcggcacatgcttgtaatatcagcacgttgggaagctgaggcgggtggatcatttgaggtcaggagttcaagaccagcctggccaacatggcgaaaccccatctctactaaaaatacaaaaattaacaaggcatggtggcgcgtgcctgtagtcccagctactcgagaggctgaggcaggagaatcacttgaacccgggaggcggaggtttcagtgagccaagatcacgccactgcactccagcctgggcaacagagggagactccatctcaaaaagaaaaaaagaaagaaaagaaaagaaaagaaaaaaaaggaattaaaacctagaccagtgagccacatcattagcattatttaagtggtttgagcactttagtagatgggaggggagcagggtgcctgtgggcgtactccccatactctgatttcagcagagtggggtagctggtaatacaaaagccttacattcctttctgtttctcacccttcttttcttaagtcaaacttcatgggagacagggaaggaatcaggggaagcttaatacttgacagtatcaacctagctaattcttagttgaattaatgcctatggatttctaagtaggtagagtgtggattctcttccattttacagtatctgtgtggaccctcgaaatcaactgccctgcttttccctcctcactagaagtacatagattacctatacttctggaaagttcctccagttctctttttttttttcccctcaggagccctatgttttctcctgtccagatctgcatttcttggttttatcattcctctttcttcccattggccccctttatagcccaggtcctcagtagattatccttgtacattaaaataccttcttagctgacttccattttcagtacttttttcttctaagctatcttgcaaactctttgcagatttttctccaacactgcattgatgatggctctctatcttaaaacctatagtggtttctccctttcttattgtgttgaatctaaactctttttcctgttttcaagtctcttcatcataagaattcatctatccaattatattttctactgtttttactatagatatcttcttatgtttatcgaattaaactacagttcacaaatgtgttatttttattcatgaaaaaaattcatgctggccaagcacagtggctcacgcctctaattccaacactttgggaggccaaggcaggtggatcacttgaggtcaggagttcaagaccagcctggccaacatggcgaaaccccctctctactaaaaatacaaaaattagccaggtgtgatggcgcacacctataatcccagctgctctggaggctgaggcaggagaatcgcttgaacctgggaggtggaggttgcagtgagccgacatcgcaccactgcactccagcctgggtgacagagtgagactctctctcaaaaaataataataataataataataataataattcatgcttacccctttaccaagaattctgccttctccaccaagctgtcctctctactagtctctccttctccatgaatccttctctgagtgctccagctctgccgcctctcctaacactacagaccctcacactagaggaacattgtgataaaatataaaggaagtcttgaaccccaaagcatatagcagagaagggaaatgattaacagattgatttcctgcaatctgttcattcatatactgggcctacatacatcagagattaattttaggcactgttgttttctatatgttcagggttttgttttgttttgttttgtttgtctctgtaacaaaattacagtcttcttaaataggggccttattatcccacagcattcattcagcaaattactcattcaacaagtagttattaggtacttgttatatgtcaggcactgtttactgctgtatccctagcgcaaagatcaagagacaaaatgtaaagcctcctacctgcctcaaggcttaaattctaacacactcgtcaattgatcctctcattactcagattatatccaccccatttaattagtaataattgtgaactatcaaccaacttctaatatatgttgcttcctttaagagctaacagatttataaactaagaatgtacatatattgaaaatagcattgtatataaacttatatccttttttattgtttagtgtttcttcatatagctttaaaattatgctattgacattatgggaaagatttatcaatgagagaaatgtgtctctttttcaggtatgtgcttttgatatagtttacattggaaagggtcataatgctgttttagtttgtgaaaataagtaaaaagctgctgataccatagaatgcttttcccatgaaaaatttcagtacatcttccagagctgttttcatctctgcctacaggggtaaagtccgcatggaattagagggggaaagtctgcactggaacctgctgtggccattttttttctgttgttgctgcttctctagtggagttactgcagcttagggatggttcctggaagtggacacattttacaaaaacgttttttaaatacacgccagctcttcgagaagcacttttttccttccgtcatgcttcatactatattgtattgtactaacccctcatgctgggatgagcgactgcctagcaagcaacccactgcctactaacatcaagaggggctaaataaaactgcattttccttgcaaggacaacttctaccgtatgaatatatattatatttatgtattatattttgtacaatagttgatcttgaatgcagacttcatttgtatttttcgtggtactacaaaatgtgtagaagttatggcttttctttcattagggtcttgttaggtggttggcaagtaagttaaattgtatgttgcatttttttccatgctgttttaacttgtaaatatatatgtatacatatggaagatattattattatctagattactttaagccttttatctgatgtattatcagtgaaaaccatgctgcttattccctaatacaatggttctcaaactttagtgtgtatcagaatcaagatgagggcttgtaaaatatagctggtccctactcccagagtttccatttcaggaggtctgggatcaggcccaagaatttgcatttttaacaaattcctaggtgataactgataatgttggttcagggaacacactttcagaaccactgctttaatattttaaataagataatatgtgaggtgtcataaaaaccttcatcaaatccctatctcatttcatttcttaggcattttctctcttataaagtttcctggatttataaattttcattgattttactagaaagttttatttagcttttatttatttattgttctttttaagaaaaaaactgagagtttgaattaaaagtttaaatcattgctaggtccttagttattttttttcttttttctttttttttatttgaagccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtggtgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgatacaattgatgtgtgctggggtttggaactaaaagtagtttcaacagtgcgtgggttatgacatttcttatgtttctttgttcatgtgtgtatttagtagttaattttaagatgtcctagtgatctttaaaagaaaaatattgtaccattttttagaattacactttcacctttctttttgcaattgaaagtgatgatgtcaaagtgggatttctgtactccaaggccccacccccaatttagcaagcagaaaaacgttccttgtatcactttaccttggataattgggtgccattaacacaaacaggtcacaatcctgctgttttctagccctgtccaccataatgagattcaggaaacatcctgtcagcctcctggaaagcatccttgtctccttagtatttcatttacaaactacctcttaacagagactgcttttcaaattggccaatcttacctgttttgtgttgtgattgcattttcaaagagtaattattttcagcatatacagttttgaaacctgtagctcctatgcaataacatagttctatagacattatttgggggaaatgtagtaataactcaatctatgttgctgtcctagaaaggaaattgcatgatgaatctagattgtctttagagtaaagaaacacattcaaattcctgtaacttatcactttcagtgagtaaatttacttataccaaaggggattttttttctttcaggaatctaaggaaatttactttttaacctgagaaaaaaacttggttctgctttatataaacagtagagattattgtactataagtgattttgcctttttgccaaaatcctggaactcatctataattaacctcttcggagcaataccttaggttgggccttgctttactacttagaaatagctaaatttcaattttaaaaatctttgtgtgttataactgttaaattattcaataatacttagggtttactttcttatttaaatcacttatttagtttaccgacttcatttttctttggatttagaagaagcaattatggaaaaacttggtaatctctctcaacctataaccttacacaggaagaattagagtttaataatttttaattcttttattgtatgttacttttattacaccagtttgggggaaaatcttcataaaattgtatcagttttattcagtgttctctaaggtgataccttttaattttgaaagactaaataattttaatcgagaatttccagtctttcagtctgatctatttaattcactacttgttacataatccagtgaaaactctacttgttgaaattatgacataaagatcttgcagctttatttgagtatttgttcttttgtgtagtttccatcttttaaaatatttaaaatattttcaagataaagtattatcttctctgcaaaaattcctggagtaattttctctcataatatttgaagtcagtggttctcagttgtattagtggggtaactacatcaaaataaataaagtcttatttttaaaatgcaaattttagaccatactcccagtgattcttagttggtctttttggaatgagccataggtaatgtttatgtccaataaaatctaggaacctctgtctggaactttgctcttcttgccatgaataccttaggaagtattaaaaaacaggccaatgtaatatgagtaggttttcttgtttgttacttttctaagaatattttacttcccttagcaggcttttggctagctttcaaagctgccaccctggccaggtgcggtggctcacgcctgtaatcccagcactttgggaggccgaggcaggcagattgcctaagctcaggagttcgaaaccagcctgggcaacatggtgaaaccccgtctctactaaaaatacaaaaaattagctgggcatggtggtgggtgcctatagtcccagctactcgggaggctgaggcaggagaatggcgtgaacctgggaggcagagcttgcagtgagccgagatcgtgccactgcactccagcctgggcgacagagcgagactccgtctcaaaaaaaaagctgctaccctatatacagaagaagccctctggggaaaaaaataaaacactgcagggaaaacttataattgtgctttttaagttttacaatatgatttttaacagtatgattcttgttaggagtatcatcctgacagtttttaatacagatatttctgtagtttgttttaccaggacaaacctagtacttaatggaagaatgcatgtgagagtctatttaggtcactcttgaagacagaatttgtaccctttgtctacctccaggtaggaaagtccatttaaaactcaattttcttaatagtaatattctgatttacgtaagaaaagttataaagcttttagtgttaaagcattaaaaaaatcaagtcctgatacattccacaaaattgtaagtcagtggagtgtttacagatcatttcactctggtgactaactcttcacttcctatcagtaatgtaaaatatgaaaaagttcaactgatttggtttaatcatagtatattgttcctatacccaaaacaaacaaagaaacagactaaatactataagagtgtattatagctcagctaaatcattgtttgaactaaagtagatattatgctaagaatgacaaccagacaaggcataaaggttggtttatttttccaattctacttacaagaaaatagttatgcagttcacaattagaaaataaagctacaaatattttagaagagaaaatatagaaaaaaaatgcagtaaccatttatctgtcatcatagacaggtgattaatttgcctaagttaacttctcagctaactaaaacaaatccattttaataatttaataactaaatgcactacttctctactttgtctagagtatatagaatataatttaactttttctgtcatctttaggaatatcagtttctatcatggggtgataaacagaaactcatcctcaggggctactgagatatatgtcaggtacccctttacaacatgacctcacactggtgtgcttttttcagttatgtctgtttttcacagtttctctatcttcccttataatcagctgtcacttttgccgccgtcttgtgtgcctgcctcctgcaataggtccctaatttgctgcttctaatctgctgtggactgagaaaccagattgccaagcttgctagaattgtgtctaaaataagagtaagtagactgaaagagagctaaggggcttttctgtcagtaaagtgcatggactttgtgatacctgcttgactgcttagcattgttttgtttgcctcttagttctttactaaaaacttgctaaaacaaatacttggttgaatatgtgattgccatatatttgaagttctaattcagtttttatataatgatgtttctaggacttccattaatgaattcaactataagagaaatttgactatcatttttgaataaataattgtgtatatttcagaaaaatgttaaacgtattgttatcattaattgttcttagtacagtacacagatttaaaacttatggcactataaatgtaacttcaactctgttcatcaagacttatgttctagaaatattgttatgagactaaagatggctaatttagtaagaactgggtaacttgaatatttggggaatgagtcattctagatatcccagtttcctgcagagcttgaacctctttcagccctaaaattttttggaataatctctgaaggaaatcttcataaaattgatatgcattactgtcttaaataatatatgaatgtattttaatttgtttggtatcaaaatgatcagcattaacatcacttattataatctgatagactaatcagacattgagagctgtttgtccctgtactaaatggctccattctgctgtactcgttttagttttcatgtctttaacagtcgttctgattcttccatttctattactgcttgcttaagtgtgcctgtagcagtagcccttctccaccttcataatgtgccttctgatctgctttcattttggagaccagacaaactaagtttattagacttctgtgtaaagtaagaataaataaactcaaagtgaagacttgaggaagtggattatgcttaaatgcatggattttgtgacatctgttactttactacctgtttcattgctatcgttaaaataagtgaagctaccgaattagatacctgctctcaaaatagaaaagttgttatggtacaaaaggaactattttgtttacatactttactttctctaaagttagttctatactagaattatttggcgctgattaaaactggtccactcaagttagcattttctatagtattttctatttgaattggagactacatgctgttaagaatttctttggctttttttttgttgttgttttgttttgtttgagacagagtctcactctgttgccgaggctggagtgcagtggtgcaatctcggctcactgcaaggtccgcctcccaagttcacgccattcttctgcctcagcctccggagtagctgggactacaggcgcccgccaccactccggctatttttttgtatttttagtagagatgggttttcaccgtgttagccaggatggtctcgatctcctgaccttgtgatctgccgtccttggcctcccaaagtgctgggattacaggcatgagccacagcgcccagccggctttttttttttttttttttttttttttaagagagaaatgtatcttcatttccaagacatgaaaatagattaagccctgaaaaataagaaaacattcactattaatgtcacagagacctgagaagtaataaaatttatagactataggcaattataccacaaagaatttattttttgattatgctagttttaaaaacagggtctttatttttattcagctatagtaagcggacgttaaaagcttaccaaaagttatcagtgttagatctaatgatattggcagatatttgaatgactaaattcccactgtcattctgtactgggcatgattaaattgtaatttaatatttaataattaagcaggatcacttttctctcttgaatgaaaaataaaatttgcacactataatatttacaagtaaaagtcaaatctgtatagaaatggatatcctagcatcaaacaacttatttttagcaacatgctgattattttagtaaccatatattgactcatgttttcattacaaagtaactgtcaaatcagtctgtttattttatgaccatgcctcatagtcggcattcagttatccatgctaatggaagggatctgtggtataataatcataaaagataagtggtccaggctgggcgcggtggctcacgcctgtaatcccagcactttgggaggccgaggcaggtggatcacgaggtcaggagttcgagaccagcctgaccaacatggtgaaaccccgtctctactaaaaatacaaaaattagccgggcgtggtggtggtacctgcctataattctagctactcagtaggctgaggcaggagaatcacttgaacccgggaggcggaggttacagtgagccgagattgcgccattgcactccagcctgggtgacagagtaagacttcatctcaaaaaaaaaaaaaaaagataggtggtccaaaccagtttcttgagttgagactgccattatagaagagatagtcaagataccaaagccaggtcagtgataaaagaagaaaacttctgagtgtagttgtgagaggaaagtgattctattcagtgtaattgctgtaaaccaaaaagaggattaattgattcaaggattcacacatgtaaaagtttagcatgaataaggaggaactgattttatagatattctaaaatgtgtgataagctaggacgtagtggctcacacctacaatcctagcactttgagaggctgaggcaggaggatctcttgaggccaggagttcaagaccagcttaggcaagaaacagcaagacttggtctctacagaaaaacttaaaaattagctggatgtggtggcacacacctgtagtcccagctgctcagtaggctgaggcaggaggatcacttgagcccaggaggccacagctgcagtgagccatgattgcaccactgcactccagcctgggcaacagaacgagagaccttgtctcaaaaataaataaatgaaaatgggctgggcgtggtggttcacacctgtaatcccagcagtttgggaggcccaggtgggcggatcacctgaggtcgggagttcaagaaccgcctgaccaacatggagaaaccccgtctctactaaaaatacaaaattagccggatatggtggttcatgcctgtaatcccagctactcaggaggctgaggcaggagaatcgcttgaacctgggagtcggaggttttggtgagccgagattgtgccaatgcactccagcctgggcaacaagagtgaaactctgtctcaaaaaaaaaaaaaaaaaaaaaaagaaggaaaatgaaatgtgtgataaattaaagtgcatatagtattttttatggtatatattttaatgtattttagcttgtcagcaatgaaattagttttatctctatgtattgaacttcatttagcaacatattattgcaatagtacagtatttaagctgcatattctcttgactgcattatcctttaaaatcagtatattctgtgagatatggctatggatatatatatttcctctcctatttatatcctaagattttcttaaaggataattttactgttttaggctttatgtttttcagttttatatcatttcctaaagcttagctacctacaaatgaatattattgaagaatttttctaaaactaaagcatgtcttttataagtttactcttttataatatcctaaacaaagcatatccttttccccttccttaagtaaattcttaaggaaattaacttcatttctaaatcaaagtattttctgcacttttattgcaccaatctgttaccttctgttcataccatgacttaaataatgcttactcaggcacagtactatcagctgacaacgtacagaaggctccagaaatgtcactcccatcccttaaaggttggtatatggtcctggtacagtcgtggaggtccatatgggtgaaaagcccagaagtctacctgagctgaaagcactcccaaggagtttggttttgtttgggtttgttctaggtatggtcccagggatcccagatcaaaccaggcccctgggcctatcctagaaccaacctaagctcgcgcatcattcctggaacatcaagagtgtgaagactgaagataacctgaggcctaccagacatcctatattcaccaagattcacattttttggtatgtgtgcctacattttagcaaaaattggttggttaatccttctaaaattagagggatgacattgggtaacaaagtcttcccagcctttggcattatagtaatttctcgcaatagaaattccatacagatattattgccagtgaagagagctattcttgtttattatcagttctatatttttagctgaagcaacttagccctaaaaaaccccaaaatcaacttcttcctccaaattaaactctcccccaaatttaatggtttctgttttcttaaatgtttttctacttgacactgttatgtcagtctcatgtaactgaataattgttcataatttctgaagagcatttagtctttgccatctggcttcagtgccaaatgattttcaattcttgtttttggagactaatgactttttccttaatttattatcaaatttgccacattttagagctcacttttagaagttctgctatggttaatgaaaacaagctagaatgacacagtagaaattggttaatacgtcacattttacatcactattttgtagaagatttttagtaagtttctctatttttattccttgccactctggattttacaaatattctgacctagttgatccatcacatggtctcatatcacaactgttgcatcgctatattcacatagatgtttttctgtttaatttagaagacagtatttctgaaaaagtatgaaacgaccccaaatccaaaagttatggtgcacaatgaaaatgtatgcttttaataatgctggcttctgcagtaggtgtagaccatgtttcaaataaccacagactaatcagaaactccacctgtgaaaggaacttgaaattgtgctattcctccaagcttataacaccagcaaattgggtcaataggttattcctttaaaataggactatgagcctacagaggctcactctgaagaactcagccgtggagttagttctgtactatatccatcacaacagacatgcttcatcccatagacttcttgacatagcttgaaatgagtgaacccatccttgatttatatacatatatgttctcagtattttgggagcctttccacttttttaaaccttgttcattatgaacactgaaaataggaatttgtgaagagttaaaaagttatagcttgtttacgtagtaagtttttgaagtctacattcaatccagacacttagttgagtgttaaactgtgatttttaaaaaatatcatttgagaatattctttcagaggtattttcatttttactttttgattaattgtgttttatatattagggtagtacatttcctaccctacctgaagacttgagattatagtctttggggggatgggcaaagtactctctttttttgcatcttttaaattgtgatttttaaaaacacatataaattttactatcttaaccatttttatgtgtatagttcaatgagattaagtccagtcacattggtgtgaaacagatcttcagaattttttcatcttgcaaatctgggactctatacccattaaacaactcccattttccccttccccacagccttggcaaccatcattctacttttctctatgaatttcactactttagatacctcatataaatggaatcatacaggatttgtccttttgtagctgacatatttcacttaacataatgtcctcaaggttcatccatattgtagaatgtgataggatttcctgccattttaaggctgaataatattccactgcatgtatttaccacatttttttatccattcatctgttggtggacgtttgggttgcctccatctcttggctattgtgaataatgctgctgtaaacatgagtgtgcaaatatctataattttttaacacagtactttattttcggtatttaatcatatggaatttttgtcaattatgttaaaggattttacaacaacccaactatagatttatatatatatgtattattgttgttccttctaagcttaagaagtctctaataaaatccatacttccttatatctttttgtgtgtgtaccttttttattctgctctttgccatatggattaataccaaaaggtaaaaatcccttttccttcctatctgtttttcttccattatagtatttttcagaatttgttaatatgccaaaagatggcagttgtctgggaaagccattgattcattactccaagttttgtttgttcatttaagtgcctcatatgataatttatcacagtgaaaacagcagtgtaaattttaaagttccatttttgccattcccagtgattgttagccactgaatacattctgggcatgttatatttattgacttatataacctccttgacagaaaagacactgacaccaagaaggtcatgaacacccgatgaagcatactttgacaagttggttgaattaatgttactggtttgaacctttctaggcttacctacactcttaggaacattcatgggaactccaaaatggttctgtatactaaaagctagttaaagagaaagtggcctcccttgaaccggacttttaaataataagccatttctttccagaaaagatttaaagcaaggaataaatatctataaaggcaatttttgaaacttgacccttgtttggaattttctaattgaaagtatgagataaggtagaatatgtgtaattactggattctgaagtcattgagtaggaaatatcccatatagtagtccttccttgtcttcacaatttgcttttgaaggtctttagcagatgtgctatagccattgaaaattaagttggcaaatggtaattttgcctgaatgtacatctgtaaaaatgaacattttcagaatctgatcattaaaaagtagtcccatttaaaagatctccaaatgtgtctttatgagaaaatgttcatggtatacacataaaatagtcatcatacatgttcctagaaatatattcctagaagatattgtttaaagataagaaaacaggctcagtagttttctcactcagtcacacacacaaagtgtcagaaccagtatcctaattagataattagatcctaagagataccaacatctgctcttcatcgttatgataaactgcctatgtatatacatttcattttacagctaatctctaggagacggtacagagaccttgattttggttttttgttgttcttcttctttttctaaaaagagacagggtctcactgtgttgtccaggctggtctcaaactgttaggctcaagtgatccccttgcctcagcctcgggaatagccaggattacaagtgcgagccactgtgccaggcaaagagcccttaaatttggaagtcattagacttgaattctggattaaaaactacttctctaaaactcaggcaaatcacttaaccatattaagccacagtttcttctgtaaaaacaacaaacagcattaattatgatttataaatgggactagacctctgaaagcctcttccatttttaaaactctgttcctctattattaataaaaagatacaactctactaggtaaagccaagtttgtccttctgtgcaagagagttgcaagagagagcttatttttaggcacagtaaataacttgagaatattcaactgttagaggttggacagaaagaataagaggggacttcagaggccaaagcaggcggatcacttaaggtcaggagttcgagaccagcctggccaacatgatgaaaccctgtctctactaaaaatacaaaaattagctgggtgtggtggcacgtgcctgtaatcccaactacttgggagacagacaggagaatctcttgaacctgggaggaggaggttgcagtgagctgagatcgcagtaagctgagatcgcaccactgcactccagcctgggagacagactgagactcggtaagaaaaggtggcaggggaaggagaccctagtttaaaaaaaaaaaaaaaatgtagctagttccagcacagaacttaatactgctgagggcaaagtatacccttatattttcaagcaatccaacgcaagtacttgaaagttaaagtgtacacattcaaaaggaacaatagctccctgtgattacttgttattcctttctccttagatagcataatcttttcattatgaagggatgtcctattgcaaggttttctttgtgggtatacaagtttctggcttatcttcatttctgaaacaaaagaatctttcttatttcatgtctagaaccatctatgaagccattgttggctgtaattgagttctgtgtggttccttaatctaaaatggtttgtctctgttctttagcacccatgcctggctattagccatcaagccatttatcttgcttgaacttagaagattaagctatgatacatgggtcatgatagccaatgacaagattacaataaaaaatacatacgtgaatattttataagatctgaagaacttaatgattctttctaaacagtgacataaggatgatttttagccagtttttttttcccccaaaatgaacatgaaatacttgtatcattggagggggggaagatgaaattttaaaaattgataaggaccaggtgcggtggctcaagtctttaatcccagcacttagggaggctgagatgggaggatcacttgagcacaggagtttgagaacagcctgggcaacattgtgaaactccatctctatgaaaaataaaaaattagcctggcatggtggcacatgcctgtagtctcagctacttgggaggctgaggtggaaggactgcttgagcccaagaggttgaggctgcagtgagccatgattgtgccactgtactccagcctgggtgacatagcaagacgctgtctcaaaaaaatttgttttcaatatgttgataatgtttcattcttatttggggcttatattcacacataagaaagtttaccgttctgtatatattcaagctatcacctcataggcctaacctggcgcctagagaaaccggggcagggctgtgtgttcagttcttgcaggaatagcttagtctgatgatgttttattgagttttaattttagtagaacttcaaaacctggaataatctaacctagaggttctcagcattttaacaaccaagaacccatgatactcaccatgggtgtcatgttttgaaggttttcaccacaaaatctacattcattaaaagccctataatttgtgcacacacacatacacacacacacccttttcaacattaaccaaagccagcctggcatggcagcttacacctgtaatcccagcactttgggaggccaaggcaggcagatcacttgagcccagaagttcaagaccagcctggacaatatggcaaaagcccatctctacaaaaaaataccaaaaaaaaaaatcagtcacgtgtgatggcacatacctgtagtcccagctacctgggaaactgagatgggaagatcaccggagcccagaggtcaaggctgcagtgagccttgattgcacgccactgcactccagtctgagcaacagagtgagaccctatatcgaaaaaaacaaaaattaaccaaagccataatggccactcagagtgtttggtgctaaggacagagcagggaacaaggtttctgccctcattgaatactagaggggaaagttagacaataaatatatattgggaggcaggtgatggtaaatgctgtatagaaaataaagctgaacatgagggctatgtgggaatggagaatacttttttatacaaggtggtcagacatgaaaggagtgagggaaccatccccgcaaataccacagagagaagagtttcccaaaagtagtgagaggtaagtggctaaagccctgtaagaacagggctaggaaggtcaaggagcaccttgtaatgaatggaatatggttttactcttaatgagataggaagccactgaagggttgtaagcagtggagttgacatgatttcacttaggtttgaaaagcattattaagtttaaaaagcattctttttcatggaagtctgacagggatggggagaagggagacctgttggttattgcagtgatctatgtgagggaggatggttggtggtgaaggttgtgaggagggtcaaattctggatatatggtgaaggtaaggccaagagggtttgctgatgtaatgaatctagtctgagaaaggggaagtctaaataattctaaggtgtttggtctaagaatctggaagaacagaggtccttttctgagatgggacaggcagctggttttggataggttcagtacgaaatagctattaatcaacaggtggaaatgttgaataggcagtttgatataagagcccaagttcggccaggcgcggtggctcacgcctgtaataccagcactttgggaggctgaggtgggtggatcatttgaggtcaggagttcgaaatcagcctggccaacatggtgaaaccccacctctactaaaaattacaaaaattagccaggtgtggtggtgcatgcctgtaatcccagctactcaggaggctgaggcaggagaatcgtttgaacctgggaggatgaggttgcagtgagctgagattgcgccactgcactccagccagagcgacagagcaagactctttctcaaaataataataatggtaataccaaagtcatgaacataggttggagtactgtgtcagaactctgacatccttggggaatctacatttcagaggttaggagacaaaaaggaacttgcaaaggagactgaaaaggagcagttggtgacagaagtggtggcctagaagctgaataacattttgttataaaagaggccatgactaacatgtcaaaagctgccataacatcaagaaaggtggggccatttgtatatcttttttgaataaatgtctgttcaggtcctttgcttgtttttgaattcagttgtttatttttcttgttgttgagttgtatagttctttacatattctggatattaatctcttatcagattttgcaaattctcccattctgtaggttgtgtttccactatcttgacagtattctttgatgcacaaatgtttttaattttgcggaagtccaatttatttttcttttgttgctgagtttccttatctttttcaaacaggacaataatgctatctgattcataggcttgttatgttgattaaataaattaatacatgttaatacagataaagggattgagacagagcctcccacataagaagaactccataaatgttagctatcatccaggctaaacttacagtataaaacccagtggtcagcagtataaaattaggacatgtgacacagaagccagaggaggaaggggtttaaagaagcacatgatcaacagcacaaatcttgcaaagatgataaaaacaagcaaacaagcaaacttagacatgacacctaaaagtcagacagtggtgttcaggtcagacgccaaattatactggatgaagaaatgttgctagaccctttctgatctccagagccagatctcctgctgtttcagctcttagggtgctacaaaatgagacaatctgttggactttgctgagacatagcagagagaacactagatttaactgggttaaagtgtctggtcttttaccacttgatctctgtggtcacctcccatagctccagttctctcacttattgagaacaattattcctatttcacaagggcattgacaggttacagtgaagagtaagcataatagtaagtcattaattattaagatcagtacatggctcctttctgactgcatgccttgttctgttattccaacactgttggaatgaacactgttgttcttccagcacaccaggtcccaccagccacaggcacctgtgaggtgggacattcccattttacagatacttggcttataggtttgcaataataaaatgagattaatacacatcaaatgctggcaacaatattggcggcagttttattctcatggaaagttcttgcctgatttttagtagtgcttttctcttcaggtccaatttctgggccactgtattcctcatagcttgcgatgttcaccaacttacccaacctcagtgttgccataagaagcaagtgcttatatattatcattgaacgtatcaatggagctttttgttccctctgctttggttgcagatatgagaacgcacattaagtgggttatgagtgttctgtttgaggatttcatctactggtgaataaacaaaacatggtgctcttgctgggttcctacagctaccaaagcaaagatgtcttcggtagagtaactatgtccggtcctgatcactttcgcccttgcaagccacatttcagagcaggatgtaagtcatgtttatttagtctggtttttaccctgttgtctggttcctgtttattctttttttaaggtttacatttattttctctttcttttcctttttttttttttttttttacaaagtctcactgtcacttagcctggagtgcagtggcacaatctcagttcactgcagcctcaaccttcctgggctcaggtgatcctcccacctcagcctcccaagtaactgggaccacagtcatgtgccaccaggccctgctaatttttgtatttttttgtagagatggggtttcgccatattgcccaggctggtctcaaactcctgggctcaagcgatttgcctaccgcagtctcccaaaatgccaggattacagacatgagccaccgcacctggcctatatttgtttttgatttattacatattctaagataccttaggaatgaatagattttgaaaatagagtaggaaattctatagagaatacctgaatggtttagaaaagccaaaagcgctattatgattttataatattttgtttattaataatgtatggtaacaaatagaatatttaattcaacatgcatttatggaatgaccttccttgtactagacatacattcacagacatgctcacatacatgcatgggaatcctaattaccacttcaggcaacataacaattcccctgttcacatttagtttaatcacaggacccctaaaagaagttaatcaaggccgggcatggtagctgagacctgtaatcccagcactttaggaggctgaggcgggcagatcacttgaggccaggagttcgagactagcctggccaacatggtgaaaccctgtctctactaaaaatacaaaagtcagccagccatggtggcgggcgcctgtaatcccagctactcaggaagctgaggcaggagaatctcttgaacccagtaggcagaggttgcagtgagccgagattgcaccactgcactccagcctgggtgacagagtgagactccatctcaaaaaaacaagaagttaatcaagtgggcaatttatttctctgtgttgttcccttacatattaaaactattcagctcatttctttggaatcactcccccatgccgccatcctcaatgtttaaattccttattactcatcaggttaatgtgagaatcctattgcaaaagcactgtgtaaactgaaaaggttttctttttatctggttgggggatccagtctggcctactttatctagttgactgcagtgagaggttaaatgtttaaaccctaccagttacaccattgttccaggaattgaattgaatggaattaaaagacttttccaaacaactcaaaccaagcaaacactccctgatttgttctctcaaacaaaatatattagcctgtggcgactaaatattgacctaatgactaaatgaaagcaaacagattctataatgctctgaagtactcaccactcaacctcagtgaaactcaatgaaacttcccaagaagcttccagagagcaactctttcagttaagtagggactggaaaaggtgcatgtctttaagtagagagagtagagacctcgaaaacactcccccctgagaatcctaaaagtctcatttatataaaaacaaacaggagacaactccccaccctatctacctgtgtgatatcctattttaaaaaatagaccaggggctcaacattgctaatggacccatttaaccccccatttctacacacacacgcacacacacacacacacacacacacacaccatcctcactacatttaccaccatcatcactagtcaaagtcgtaaagattgagctccatatgtgagtgtgacgcccattccctcaaaatactatcagcccttagtatctaaggttccacattcatggattcaacaaactgcagatggaaaatatttggaaaaaaaagaacaatcaataataagtaataatacaaataaaaatgcaatacaactatttacatgacatttacattgtgttaggtattataagtaatctagagattatttaaagtatatgggagaatgtgtgtaggcatatgcaaatactatgccattttatatcagagacttgagcatcctcagattttagtattcttgggggtttctggaagcccagactacaccactatgcaatataggtatgcaagaaatatgcacttgtgcaccctaaatatacaaaaatttttaaaaattaaaaatggctactaaactaggttaacttttaaagcacagagccattacagctgtcacataaaggataaggaacagctgtgcactgggaattcctgatcttaaaataactatcatggccacccccagtggctcatgcctgtaatcccagcactttgggaggcagatgtgggcagatcgcctgaggtcaggagttcaagaccaacctggccaacatggtgaaaccccgtctgtactaaaatataaaaattagctgggcgtggtggtgcatgcctgcaatcccagctactcgggagcctgaagcaggagaatcgcttgaacctgggaggcagcagttgcagtaacccaagatcatgctgctgcactccagcctgggtgacagagctagactctgtctcaaaaaaaaaaaaaaaactatcacgacatcaatgtcaatcagattttcatacttccttggtaggtactggtttttctctcagtctacgaaaagctttttcttaaggctccaagtagaagacatgtaagcctctgttcaaacatgcctctaaaagcagaaactggaaatgggactacagggtgactggctgctcacataccatgtttggctggtgggatttggtgagggaagttactaagtatatccacattaagagaggacttccatttcccttctctctgtgaccatccagcccccctttaacactgtgaccattccccaaagctcagcatgatgaaatctctgtttcttaccaataactgacccctaagttcttaaacttgttttgataaccacatccctgttgacttgccatacagtcacagaaaaacctctcaatgcagctttataagataggcctccttgccaaggagaacctgcattctaattcctcagattcaaaccagacatgcccaaaccacctgcttctagatatttgtactggtctccatggtaccagactcacatacttagagtgaactttgaagagttcaaagccacactgaaggaggtactagacttggaaagaaaacagaatgaaaaattcaattatttgtaattgtctaattattagttggttttcttcagattaattctttttgttttgttttgttttgttttgttttgttttgtttacaaactctgttttttgagacagagtcttgctctgttgccaggctggagtgcagtggcatgatcttggctcactgtaacctctgcttcccgggttcaagaaattctcctgcctcagcctcccgagtagctgggattacaggcatgcaacaccacgcccagctaatttttgtatttttagtgtagatggggtttcaccttgttggccaggatggtctccatctcctgacctcatgatccgcccgccttggcctcccaaagtgctgggattacaggcgtgagccaccacgcctgaacagattaattcttttcttaaactccatgcagtatttattttgttttttagaggagaactaggggcccataaaaatagctataagtatttatgtttctgtggcccatcttgtacggctctcactgggtaaggtgttaaaagtgaaactgctgtttagctttcaagcatattctgtttgtgtgaattctccctgtcctaagcttcaattacttgatttttctttgagacagagtctctgttgcccaggctggagtgcagtggcacgatcttggttcactgcaacctccgccccctgcattcaagcgattctcctgcctcagcctcctgagtagctgggactacaggcgcatgccaccatgccctgctgattttttagtagaggcagggtttcaccatgttagccagaatggtcttgatctcctgacttcatgatctgcctgcctctgcctcccaaagtgctgggattacagatgtgagccaacgcgcctggccacatttccttgatttttctagccactctctctgttatcatgcaggaaaaagtggagaaaaggtaatttacttagaagaataaagagcaatcaatttcactctcaatactttcccctgtaaaagccctaatggaagtgtcacccaaccttcctaactagcagtgttatattaggttgccgcaaaagtaattgcagtttttaccattaaaagtatgcaattactttgcaccaacctaataggaagcaaactttcaaagtcattgatctctcaacagctatgcctttctattcatgttacactatggaattaggataggcacctatgaagacttttccaaactagagctcatggctaaacacgtgattttgcatgtgattgcacaggtgagtcaaatcaggctcacattatatctcactttatcagtgaggccaatcagactttatctcttatgggctgcatctgaagcagaaactttccaagatagacaacatgaaaagttgatgccatctggaagcagcgccctggaaagaagggtgcagagtgtctgctgctgagattattgaggctgccctggctcccgcctctcccagggttttaccaaggagctgatgaaggctgtctttgactctgtaaattgccctaaatcctttaaaccaacaccccacttaggttaatcagaattggttcctgttgcttgcaactaaagatctttggttgattaagaaacaaaacacagacctgcatgcctgttaagtggagtggaggataacactaggaggaagaatgtcaattttttttgtcactacctcttccttgttgttcaatgtatttataattagaaggtacatttagaaattcaaaaaggaaggaaacctttgagctttgatacagaataatttattcgggaacatttgctggctgagccaaacagatttctagtttgtgtgctatttgtacagctccatgaaaatcagttcacttcctctacagcaaaaataatttttatgacactcttaaccttgatgtctgactacatccttcttgttattttttttttttttttttgagggagcattggggatgaggtccttttttttcaaccttttaaaaattcaaattcagtggtttttactatattcacaaggttgtacaaccattactactatctacttcaagaacattctcatccccctaaaataaaccccatatccactaggagtcacttcccattttcccctcactccagcatctggaagccactaatctagtgtcagtccctatagatttgcctattctgaacatttcatatacatgaaatcatacaatttgtggccttttgcgtctgttttcactttgcatgatgttttcaagattcttcaagagggcttttaaaaatatagcccttaggccgggggcagtgactcatgcctataatccaagcactttgggaggtctaggcgggtggatcacccgaggtcaagagtttgagaacatcctggccaacatggcaaaaccctatctctagtaaaaagacaaaaattagctgagtgtggtggtgtgcatctgtaatcccagctacttgggaggctgaggcaggagaatcatttgaacccaggagacggaggttgcagtgagccgagattgcgccacagcactccagcctgggcgacacagcgagatgcagtctcaatatatatatatatatatataccccttagtcaggctctcatcaaatacaaaattcatctcaataactttctctgtatatatgtagagacactcctggaatcattttccctttaagatcttatgaagatttatgattttgaactctaatgacttgtggatatattcatgaggacggaaggaagggtttttccctttaagatcttatgagaatttatgattttgaaatctaatgacttgtggatatattcatgagaaaggaaggaagggaggaaggaaggaaggaagggaaggagggaggaaggaaaggaagaaagaaaggaaagaaggaagaaggatggaagcaaaaaaaagaaaaatttttataggataaaaacaaggcctagaaccttctaaggaacaccttggggtcacccttttctgctgcccctctttctcactatccctctttttccttatctttatttttattagaccattgatcactcccaacatagtatttattcagatatgttgactcaagtccttggaacacctccaagtggaacagtccagtatgcctttgggtatatgggcccaaggcacagggggatgtctgagctggtggtggacatttgggtgtcaccagcataaagaactagtcactgaagctgcaggaaactgtggacagtttgaagaggactcatggcaggcaggacactgaggcatgtgacatccaggaggggcattcctcaaccaggaatgctctcttaaatatcttgaccccttcatgatccagatcaaaagaattagttttcccatttgcaattcatccttcctttttctggtttttggaggacacaacattctaagccctgtgttctttaatttaacactgactataaattattattgaagcaagccacagcagtttaacagcagacctgagtatttatcaagacaaatactcaacaacccaatacatcttagacagatttaagaaaaaggatgataagtgttacatataagctaccataaagtgtacacttattctgtagcttgtcagtttaaaggtgtctttctcagattgtttgctaaggagggcaaagaactttctgatgatatagaaagatttgttgtaatggttccaagtcaacaagatggttgacttctatccacgagaccataaatatttgtaattagaaactgcatttgttaagatgatatttgtttacttaaagttataaactatatttgcataagaggttgatttttacccaccaagcttgaaataattaacttcatcgactttattctgtagcttctctagactctagagaagcctaggggatgtgggggggagaaaaaataaacaaactggtgcctaaggtttttttccaaccagaaagcatctagatattttgtctggatttcttcctacaggcttgtattttaataagcctggcaactctagcactctagcaattatttctggaatattatttctggaaataattgcgtcagtttttcttcatcacttgcctaagaaacgtgtcttttttttttttcttgagatggagtctcactctgtcgcctaggctggagtgcagtggtgcaatcttggctcaatgccacctccgcctcctgagttgaagcgaagttctcctgccttagcctcctgagtagctgggactactggtgcctgccaccacacctggctaatatttgtattttcagtagagacagggttttgccatgttggccaggctgatcttgaactcctgatctcaagtgatccgcccacctcggcctcccaaagtgctaggattacaggcacaagtcaccacgcctgaccaagaaatgtatcttttccaaagtgttcaaccagcaactgggagctcagtagtaatcccctgatatggctgcagctctgcccttagaaaaggcatttttctgattgactgttagaattagggggatacctagagatcatttaatccaggctcccttgatttacagataaagagactaaggaccagaaaggtaaagtatctgtggtctcccaacaagtcagaggttgaccaggactaggatcaaggtttgctgcttttcctacactgcctctcttttctattgtttttgaaatctttctatattgtgatgaatatatgtatcataaaattgaccattttagccatttttaactgtacagttcagtgacattaagtacattcacattgttgtacaaccatcggcaccatccaccttcagaactttttcattattctaaactcccagagtcactgtttaataactccccgtgctccctcccctatccctgggaaccactgttttgttttttgtgactattctaggtaccttatgtaagtggaatcatataatatttgtccttttgtgtgtctcatttcacttagcattgtcttcaaggtttatctgtgttgttgaatgtgtcagaggttcattcccttttaaaactgaacaatattccactgtctacatacacacacacacacccacccacacacacacacacaccacatttgtttatcccttcatctgttaatggaaacttcagttgtttccacctcttggctgtgtgaatgatgctgctatgaaataattatctgtttgggtatataaccatatgtggaattgccagatcattgaggaaatgccatactgttttccataggggctgtaccattttacattcctgctccttgttattactattattattttgtggagacggaatcttgctatgttgctgggcttgaaatcctaggctcaagtgattctctcacttcggcctcccaaagctctgggattacaggcgtaaaccactgcaccaggcctactcattctttatttatttatttatttatttatttatttatttatttatttgatgtgcagtaacatttagaaagaggattggattgaaatttgtcaaccccaacctcaggactgattagctatataatcttgggtaagccaattcactcctcagactcaacctccccagtcaggacgagagaaatgctttgctgacctcacaaaactgttataaatgtgatatacatacaagatgaaatacaccaaatgctttataaattaaaacaggttctttgatgtaaattattattagccatttatactaaattcaagtcaaatccaactctaaaggagaaaactctgaggtattaggaaggaaagagctctttattagtaaggagagaaacgtattgtccggcaaagatttttttttttttttttttttttatacagagtttcactctgttgcccaggctggagtacagtggtgagatctctgctcactgcaatctccacctcctgggttcaagcgattctcctgcctcagcctcccgagtagctgggattataggcacatgccaccacgcccagctaatttttgtatttttaagagacggggttttgccatgctggccaggcttgtctcgaactcctaacctcaggtaatcctcctgcctcggcctcccaaagtgttgggattacaggcgtgagccactgtgcccagcccaagactttgaactaaaggtctttttttctaaaacctaggcagttggaccttaaataaagaatgctgttcctaagcacaagcactaagttacagtcagcttgggggaggttgagaaaagggcaaaatggcacatttgaaagcagcagtggctggggtctgccagctgcttcagcctgaagctctgtaattcagtgttttatcagaaacatttagaactgtgttcacaatcctctataaacacgtcatccctatgacaatgtggcttatccctttgattgatgataacagttgctgaaatatgtccaacaaatttcttcatctgaacttaaattacaggcttagttttacttctgtagattaaacagtagcctctcaaataggaaataaaaactccatgctcacttttgaaaaaagttagggatacctgttttattaaattcattcttcatcacaaagcaactagacaaatattgattttgtagttactgtaaaggattgaacaaaaatatgaagagcagagtttctactcaaatgtgatcaaagtcaacactgaggatctcacgagattaaaacaatgctactaacctggataaggtggcatcccccgaaagactattttcttacccttttttgtttgtttgacagagtcttgctctatcactcggctggagtgcagggatgcaatcacagctcactgcagcctcaaactcctgggctcatttttttcttacctcacatgcacttatatttcttcaggcaactcttttctgcatctatcctaagtagtatccctgcccttttttttttcttttttttttgatacagagtctcactctgtcgcccaggctggagtgccgtggcaccatcttgattcactgcaacctctgcctcccaagttcaaaagattctcctacctcagcctcctgcgtagctgagattacaggtgtgcgctaccacgcctggctaattttttgtatttttagtagagatgaggtttcaccatgttggccaggctggtctcgaacttctgacctcaggtgatccgcctgcctcgacctcccaaagtgctgggatgacaggcgtgagccaccacgccctgccagtagtatcccatttttaaagacaccaaaggcctatggtgtttttatgacgtgatgctgagctccttaactattaaacaaaaaaggctattggacctagagagtgtgtatatggtcttattggccaggaaagcgactttcttcctaggctccaaaactctatggtagggacagcgaagcaaaatcagtgttttgtgcatctggtactaaggaggggaaaggagatgttcaggatcataaggtcaaggggagactgaagaataggggaagagggtgaaccctgggaagaaaagtaattgccaagaaaaaaggggcccagagaatagaaggaaggcaccccctcagggtaggaatttcttctgcgatatctcctttaaaaattatattctagcctctggaaaaaagagctcactgctttataaggctattcattccaacatttggacaactctaattttttaaacattcttctttaaaatattttaccagcttgggcaacacagcaagaccccatctctaggctgggcacagtggttcacgcctgtaatccagcactttgggaggccgaggtgggcagatcacaaggtcaggaaatcgagaccatcctggctaacatggtgaaactccatctctactaaaaatacaaaaaattagctgggcaatggcacacgcctgtagtcccagctactcaggaggctgaggcaggagaatggcgtgaacccaggaggcggagcttgcagtgagccgagatcgtaccactgcactccagcctgggcgacagagcgagactccatctcaaaaaaaaaaaaaaaaaaaaaaaaaaagacccctctctacaaaaaatgaaaacattagccgagcatagtggcatgtgcctgctgtcccagctacttgagaggttgaggtgggaggatcacttcagcccaggaggtcaaagctgcagtgtgccatgctcacgccactgcactccagtctggtgacagagtgagactttatctttaaaaataaataaataaataagtaatttaatatccagcaacacatgatgtgttaaataataaattatgggatatccacataatggaatattatgcagcccacacaattgatgctactatgaaagaatgtagtaacaatacttagtgatataaggacttccctataatatgcttataatatgttgttctatgtactccagaatcctaatttggcatgtgtatatgtgtatgtgtgtgtgtctataaatattgggaggttctacaagcaccacctcagagatactgcaggtttggttctagaccactgcaataaagcaaatatcacaataaaatgagtcacagatttttcttggttttccagtgaatataaaagttatgctaatactatattgtaggctataaagagtgcaataatagcattgtctaaaaaaggtacataccttaaataaaaaatactttattgctaaaaagtgctaaggatcatctgagctttcagtgagtcataatctctttgctggtggagggtcttgccttgatgttgatggctgctgactaatcagggtggtggttgctgaaggctgtgactgtggcaatttttaaaaataagacaacaatgaagtttactgcattgattgactcttcctttcatgaaagatttttctgtggcctgcaatgctgtttgatagcattttccttagagtataccttctttcaaaatcagagtcaattggctaggtgcagtggctcatgcctgtaattccactgctttgggaggccgaggtgggcagaccacctgagatcaggagttcaagaccagcctggacaacatggtgaaacttaaaaaaaaaaaaaaggtgtaatagaaacccatctctactaaaaatacaaaaattagccaggcgtgatggcacacaactatagttccagctactcagaaggccgaggcatgagaatcatttaagcccaggaggtggaggttgcggtgagccaagatcgtgccactggccgggcatggtggctcatacctgtaatcccagcactttgggaggccgaggtgggtggatcacgaggtcaggagttcgagaccagcctaaccaacatggtgaaaccccgtctctactaaaaatacaaaaattagccaggcgtggttgtgtgcgcctataatctcagctacttgggaggctgaggcaggagcattgcttgaacctgggaggcggaggttgtggtgagctgagattgtgccattgcactccagcctgggcagtaagagcaaaactctgtctcaaaaaaaaaaaaaaaaaaaaaaaaaaaaaaaaagatcgtcccactgccctccagtctgggtgagtgagtgagactctgtgcccccaccaaaaaaaggagtcaatcctgtccaaccctgctgctgctttatcaactaaggttatataaaatgccaatcctttgtgtcatttcagcaatgttcacagcatcttcaccagaagtagattccatctcaagaaaccactttctttgctgatttataagaagcaactcctcatccattcaagttttatgagattgcagcaatgcacatctttaggctccatttctttctttttttctttttctttttttttttttttttttttgagacagtgttttgctcttgttgcacaggctagagtgcaaaggtatgatctcagctcactgcaacctccacctcctgggttcaagcgatcctcctgcctcagcctctcaagtagctgggattaaaggcatgcaccaacacgcccagctaattttatatttttagtagagacagggtttctccatgttggtcaggctggtctcgaactccccacttcaggtgatctgcccgcctcagcctcccaaagtgctgggattacaggcatgagccaccgcgcctggctaggctccacttctaaatcaagtgtcacttctaaatctaggtctcaactgtgagtttaaaatatttagtaaaccatggtagaaacagatgtgctgtcatctaggctttgttgttctatatagagcgcaggcagagtagatttagcataattctaaagggctctagaatttttggaatggtaaatgagcactggcttcaacttaaagtccctagctgcactagcccttaacaatagagtcagcctgtcttttgaagcttagaagccaagcattgacttctctacagctacaaaagtcctagctggcatcttcttccaatacaaggctgtttctgtacaggattcctaacgtatggtaagtaaagatgtcactttctaacaggcccagaagccccaagctatcttgggacctcaagaggagaggaatttactcaactcctaggtatttgaggatacaaacccatggctgggctcagctttaaaaaggtcttatctgagattccttatggaacagagttccatcaacgccaactttaaaatcctatatgaaaaaaaaattattcttgctgtactttatacaaataatcaggccaagtataataaagcaaatcagtcttaccatgatttgtctttagtaaaaatgggagactggagagagaaaaaattaatgtttcaagaactatggtacacctgatattagattctagtctcattggttgtttttgaggggttttttccactgcaatttaggctaactttgcttattcctgtgaaccaatcagtgatctccaactgcagctcagaagaaaccagagggatgggtagtataaaaaatctagatcaatattctaattctgggcacatactggaatcaactagcgaccccatatcagcttggttccagcagttgcccagttcatagaaagccttcttatttagtttactcaggataattttacttattttgctttactcttgtggaatatattgctattgtactctttgtataggaatgaggaataaacttactcaacgtttacctaaattgaacatttattaatcttccagatatcacgtttggtcagaactcaaagttatgaatggacctcaacatactaatgcttttgactgagctcctctctaccctgaatgcaagagacccagtagttaggcaggaatatcattgcgcctattcagcttgaataagttatagaagatggatcttcatccctctgcaacccttaggattaaagtttctcttataaaagagaggggggaaatgtcagaggcatttgaactggagcgactccatcttggatagagactaagtaaaataaagctgagacctcctgggtggcattcccagacggttaggcattctaagtcacaggatgagttaaaaggtaggcacaagatataggtcataaagaccttgctgataaaacgggttgcagtaaagaagtcagccaaaaccaaggtggcgacgagagtaacttctggtcatcctcactgctacactcccaccagcgccatgacagtttacaagtgccatggcaatgtcaggaagttgccctatatggtctagaaaggggaggcatgaataatctacccctcatttagcatataatcaagaaataatcataaaaatgggcaaccagcaacccctggggcttctttgtctgtagagtagccattctttattcttttactttcttaataaacttgctttcacttaaaaagaaaaaaatatatatatggctgtttcatcgatgttaaaaatctgttatttagtgtagccaccttcaccaatgatcttagttagatctagagaacttactgcagcttctatatttaggacttgctgctttaccttgcacctttatattacagagaccacttctttccttaaacctcaggaaccaacatctgctagcttcaactttttctcctgcaccttcctcatctctctcagccttcatacaattgaagagagttagggccttgctctggattaggctttggcttaagggaatgttgtggctgatttgatcttctatccagatgactaaaattttctccctgtcagtagtaaggctgttttgctttattatcatttgtgtattcactggagtagcattttcatttccttctagaacttttcctttgcattcacaactcgactaaactgaatggtgaaaggcagccttgctctcggcctatgtcagctttcaacatgcccttctcactaagcttaatcattgctaaatcatagcttttgatttaaagtgagagttgggcaagtcttcctttcacttgaatacttaaaggccactgtagccctaatttcaatattgttgtgtctcagggaatagggaggctagaggagagggaaagagattgggaaaatagccagtcagcagagcagtcaaaatacacgcaacattgatcaaaattaagccattttatatgggcttggtttgtggtgcctgaaaacagttacaatagtaacatcaaagatcattgatctcagatcactctaagaaatataataataatgaaaagtttgaggccaggcgctgtggctcatgcctttaatcctaatacttcaggaggccaaagtggacagatcgcttgagcctgagagttcaaggccagcttgggcaacatggcgagaccccatagctaataaaaatacaaaaaattagctgggtgtcggggtgcgcgcctgtacatccagccactcgagaggctgaggtgggagctcaggaaatggaggctgcagtgagttaagatcacaccactgcattccagcctgggtgacgggagggagaccctgtccttaaaaaaaaaaaaagtttgaaatgttgctacaattacgaaaatgtgacccagagacatgtggtgagctcatgctgttggaaaaatggtgctgatagacttgcaggacacagggttgtcaaaaatcttcagtttgtaaaaatcacgatatttgtgaaatgcaataactacaaagcacagtagaatgaggtgtgctcatacacctaaccattagcagtgcttagttctgggtagcagaagtgtgaatgcttttaatttctttctttatgcttttctgcattttcaaaaatcaaagtataccagaggaccctccctgcaaataatctgtggtgctgacttctcacaaagcagtcatataagcctccaaagaccttcaggatcggaatactaagaaggtaaaataaattggaagatgtggcctgggtgcagtggctcacgcctgtaatcccaccactctgggaggcctaggcggtggatcacctgaggtcaggagtttgagaccagcctggccaacatagcgaaaccctgtctctactaaaaatacaaaaattagcccggcctggtggaaggcacctgttaattccagcttctcgggaggccgaggcaggagaatcgcttgaacccaggaggtggaggttgcagtgagccgagattgtgccactggactccagcctgggtgacagagcaagactgtctcaaagaaaagaaaagaaataggaagatgagtagatgtgtgcacatctctgcagggacagaaagatatgggtgttcctggagctgcttactgctctgttctggtaagtcccagaaagttctcaatctctgctgcccaaggcctcctctcataaatccttttaccctctctgctgatcatgtggttggtccctgcagggtagaggctaccaaaactctgataaaatatccttaatatatactgaataggatacaaaaatgcatgtggagtggagcacggtggctcatgcctgtaatcccagcactttgggaggccgaggcaggtggatcacctgaggtcaggaatttgagatcagcctggccaacacggtgaaacctcatctctactaaaaatacaaaaattagccaggcatggtggcacacacctgtaatcccagctactcaggaggctgaggcaggagaatcgcttgaatccaggaggcggaggttgcagtgagccaagatcatgccactgcactccagcctgggcaacaagagtgagactccctttcaaaaaaaaaaaaaaaatgcgtgtggttgcagtttgccctaagagggcccatgctgtctgggtgttcggtagctaaagttagaaaaggctttgaagtgtctgaagaggagagacagggaagtgactcacagctcaacagcttcaccctctggctttgatggtccttggctccgtgatgctcagtgtctgtgtgagtctcagagagcaaaagcccaatccacagcccacctgtttgtattcttcaccctcatttgagattctcagaactcaaggagagctcctttagaaaatatgactgcagttgtagtgtagttgaaatatcaaaaacctttgttattaaaaaacccaaacctttattatgtcacttgtaataaaatataaatgtgctaaattggctcaaataagttggatcaaataatattaaataaaacaaaggtgaaaaaagaaacttaaaaataatttttttttgatgggatctcactatgttgcccaggctggtcttgaatgcctggtctcaagcaatcttcctgtctagcttccaaaagtgctgagattacaggcctgagctactatgcccagccaagaaactatttaagtactataagttttgttgtgctcgcttcggcagcacatatactaagtactaaaagttttgtgatataatttcttaagttgataattctattttagtctttcaacctgattataagaatttgggacaaaggctcacgtaaacatgactttggctcggggcagtggctcatgcctgtaatccccccattttgggaagatgaggcaggaggatctatcacttaaggccaggagtttgatgccagtctgggcaacatagtgagacctcaaatctacaaaaaataaaattagtcatgtgtgatggtgtgtgcctgccgtcctagctacttaggaagctgaggcgggaggatcccttgagcccaggagtcaaggctgcagtgagctataattgtgtcactgcactccggtctaggtgacagactctgtctcgcttaaaaaaaaattaacatggcttcattcctcataaaacattgtgatgaagagtcacaatgttttgagtcactattctctttactccatctttggagaggtacggtggaggagaacaaaaaatggcccaaaccaagccttttaaagcctcctgaagcactcaattcattttctgtcttgtccctttaaaggagagacatggctggttccatcattctctctcctctactgcggtgtcactacacacttccaccatttccactggtcacctggaattgtaactacagactacagtatttgttcctgtttttgttgtttttcgaaatggagtctcactctgtcacccaggctggagtgattctcctgcctcagcctcccaagtagctggaattataggcacacgccaccatgcctggctaatttttgtgtttttattagagacggggtttcaccacgttgaccaggctggtcctgaactcctggcctcaggtgatcctcccacctcagcctcccagggaagtgctaggattataggcatgagccactgcagctggcctgttcctgtatttgcatctgaacagtatttgtatctggacaggaactctcttccctcttgaagtcaaggatcacgtcagaacagatagaataatgtaaatatgtgagctggcaatttggaaataatattccacagagacaatcttgtcccaccccagagccctggatgcacatgtgtataaaaaagaacacctcagttaaagaatccttccagccccatgcatccgaacaaacagctgaaatgaattttcagctgagttttcacaacgctcattgcaagctctttgccctcattaaattatcaggaaaatgcaagtaatttattatgtgtaatcacatcattcgcggtagcacttcgcccagagaaacctagcccaatatggtaacatcagaacaatgcttcacctcacatcttcctttgaaagataaagaaaacacagaatcattctgcttctctccgggaaggaaggcaaagcgtttccccaggccctcagaacaccatctggctgcagtctttccttttagggacctggtattttctggcccagggacaaagcgcatttatttcagatggatcaacactgtcacccagcgggcagacagctgggcaggctgaggccttagccttgctcttggcttgacagccagatactgacagccagtatttgaataggaacctgtttgtttcgggtgatcaggattaattgttaatattctcttggagggaactgggacaacctcagctgacaagcctttgatttggatgtcatgggtgagtgcaacttaagaaagacatatattttcatcgtgctgatgcttttttttttttttaagccactagtgaatttataagaagcacaggctgtaaaccaaccaagcatgtctaccaagactcccagaatcaaataggtttgcaggagcagggtgatatttggtcacctgtcaggtactctgggaagactcctctaccacaaaataagactagttgttcattgttcgtagtgacagtgatgaatattttgaaaactgaaaatagatgtgtgtgtgtgtgtgtgtgtggtgtgtgtgtgtgtgtatctgtgtattgaaatgtcaggaaataatctgcattactacggtgaaatcagtggatgagttagtctttgtttctctattttgtatatatctcagaagacatgcacgggatgcaacctctgtcccatctcatttgtactgagtccttttctcttgtctaaactgtcacttgacacttgaaacaagctggattcctttgcatattgaggtaggctctgtgccttcttgctaaatgtacggttgaattatttcttctccccagctggaactcatcaacaagctgaaagcattcatctgggaacactttacacttcttacgagcatgtccgaggaagtgggggctgagacttcaccttgtagaaactcttgcagaattttgattaaaagcagtctctgttcatagtgagaaaatctggatttgaattctgatcccaccacatgcgagctccttgaccttagataagttaacctgtgtctcagtttccacctctgttatcagggataaaattagtacctaccccctggattgctgtgaggatttagataagaaaatacacatgaataacttagcacagtgcctgggcacatagttaaagatcaataaacattagtattaccattgtcataattattataatgatatctatcatatatattattcccaaaatgcaactttcataaagtgcctctaggctagcagatgaaatcatggcatctttttagctggaagggtcctgaaagatcatccagtcattgcttctcattaaaatcacccagagaaacttttaaaacaaacgctaatacctcattgtagccagacaaaataatacttactgtatgaatcctttttttttttttttgagatggagtcttggactgtcacccaggctggagtgcagtgccatgatctccgctcaccgcaacctctgcctcctgggttcaagtgattctcctgcctcagcctcccaagtagctgggattacaggcacctgctaccacgcccggctaattttctgtatttttagtagagatggggtttcactatgttggccaggctggtcttgaactccctacctcgtgatccacctgcctcagcctctgaaagtgctgggattacaggcatatgaatccttttagatgaaattctagaagggacaaacctaatctatagtgacagaacactgatcagtggtgatctggggatgatgttggaaggactggcagctaatgggccaaaggaaacttttagggtgatggcagtgttttctatcttgactgtggaagtgattacatgggtacatacgtttgtcaaactcattggcgcttaaaatattcacttgaacgcattacgttgtatgtaaactatattgtaataaagagaatactgatgctgggtctcatccacagacattctgatttaattgttcgagggtgaagcccagaagtcatttttttttcatgtatccaaagcatcagctgtgattgagagccactgatctaactcagtcttctttttttccagatgacatgaacccaaacaaatacagctggttaaaggggaaggtcttagactaaaattcaggtcacctggtttcttgtgcgccaaaccttatctttacttacaacatgtcctctgcctggaacctctttctcttccttcttctcatctctctgacaaaatcctacctacccttaggggctagtatacagttggctttaaccaatagtatgagcaatagcataccgcataacttttgaggctggagtgcagtggtgtaatcacagctccttgcagccttgacttccaggctcaagtgatcctcttgcctcagcctcctgagtagctagggctacaggcatacactaccaagcccagctaatttttttaattttgtagagacagggtctcactatgttgcccaggctggttttgaactcctgggctcaaacaatcctcccacctcggcctcccaaagtgctgggattactggcatgagccactatgctcggccaggaacattccttcttcaaaccagcaccatgttgtgaggaaacccaactggctatgaggaaacccaagtggctatgcacatatgacacttctcaggaagcctcaggctgtggctcaccccactggactaggagctccttggcagaaggaactgtggctcattttattgactgagtgagtgggtgagtgtatcttcagtattcagtacttgtgtttggcacagagcagacagtcaataaacatttgttgaactgaaaaaccagtggaagggaattagcattcattgcctatgatgtgccaggaattgaaacaagcactttgtgcacattatctcactgaatttttacaataattttatgagttggttattatttctcccttttgaaagggaggatacaagctcagagaagcttagtaatttaccaaaggtcacacagcaagcaaatagtagaatcaaggtttgaactcaagtgtgtttgttttcaaagttcatgctttttctctaccacaccaggctgtcttgcttatggtagttattctactaggtcttacactatggatttttatgtagccatatctcctcaactaggttataagcttcataaaggtgggaattaaattttagcacttaatttttatatgaactcatgaggcgaatgatatggccacctcagttttttttttttttttttttttttttttttttttttgagaaggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatcctcccgcctcggcctcccaaagtgctgggattacaggcgtgcgccaccgcgcccggccggccacctcagttttaacagagtattcaatttttaaattcattagagtaacagtaaagataatgcaacagtgttaaatctgcagttataagaagacctgaagtcaagggttatcccaaggttgtgatttaagctgagctattttggtagccttctgttgaccctatgaataatccccaagtcatgcaaacatcatacacaacagcccagtcaaaagagtcattatatctcaaagcacataccaaaaaaattcctgggattatattgtgcctttgaaccagaagaggacaattgttgcccatgaatttagaagcagatacaatgttatatttgagcaaccgaaaggaatccgaatgactctaaaagaacaaagagttgtaaagatattaaattccaggcaacaaatcttttgcttcattcagcaatatttgcatccttgaacaaaaaatttaaaactctatcctcattcctacattagaaatgccttcataagctcaccaaagacctctgtattgccaagaccagtcgacattttcatgtttctaatattacttgacctatttatttatttagatagagtctcactctgtcgcccaggctggagtgcagtggtgcaatgacggctcactgtagccttgccctactggggctcgggtgattctcccatctcagcctccctagtagctagtgccataggcacacatcaccacacatggctaaattttgtattttttgtagagacaggatttcgccatgttgcctaggctggtctggaactcctgggctcaagtgatccacctgccttcgcctcccaaagtgctgagattaaggcgtgagccactgcacctggcctacttgacctctttatgacatttgaaattattgaacagtgtctcctccaactctctgctgggcttctatggccactttctcttctgtcttctttctgtttctctaggtcttgcttcctagtcttcatttcatgaagactttttctctacttgacctctaaatatctattgtactaaaagcttgcatcttgtctcctgccattcactctcttcacacactctttggataacgcataattctaactactatttatgtctaccaagtgaccaaatgtctatcaaagctagtgctctcctctgatcaccagacctgtgcgctgacttgcctacttcttgatgtctctacattgatgtcactcaggtacctcaaactcaacatgtcccacctgaaattttcatctttttcttcaaatgttcttatggtggattgaaaatggctgtgtattctttgccactctacccatcaagagatggaaggctatttctgttcccattgaatctgggctggcctgtgacaggctttgaaaaatggcagactgtgtaacttttgaggccaggcattaagagatgtatagtttccatcttcacctcttggagtcttccttcttcaaacagatgccacgttgtggggaaacccgagcagctatgtggagaggccttcataaggagaatggggcccactggctaacagtcataactcagctcccaatggcagtggcactgcctgccagccctgtgaaggaggatatttttcagctgtactcaaactgtcccagccagtgctacatgaaagagtcaggccatccctgcagggtcataaataaatataggttgttgtttttaagcttccaagtttgtttgtttgtttgtttgttttttgttttttgcttttttttatagagacagggtctcgctatgttgcccaagctaatcttgagctcctgggctcaagcaatcctcccaccttggcctcccaaagtgctggcattataggcctgggccaccatacccagcctggggtggcttgttgtgcagtaatagataacaagacatttcttctcctcctcctcctgaattctctatctcaaaaaatagtgctactgttctaagtgcccaggtgagaagctggagataccttaaattcttccttcactgacatatcagatcttatagagtctcatttctaactgttactcatacccagcatccttttccattcccacccactgttactgcctaatcatttccctcctagttaaaagcttaacaggtctctctgtcacttggaccctttccataccattcttccaaaataaacaaaataaactttctaaaatacaaaaaaaacctctgcatgtcacttgtctgtttaaggtcctttaatgatgctgggtgtggtggctcacgccttaatcccagcactttgggaggctgaggcaggcggatcatttgaggccagaagttcaagaccagcctggacaacatggtgaaaacctgtctctactagaaatacaaaaattagctgggcgtgatggtgggcgcctgtaatcccagctactcgggaggctgaggcaggagaactgcttgaaccgggaggcagaggttgcagtgagcggagatcgtgccactgcattccagcctgggtgacagagcaagactccatctcaaaaaaaaaaaaaaaaaaaaaaaagaagggggtacatggggtacataaataagaccctctctacatccaaagatatcgtgggatttgatgcaccttgttgtcccaatgagaagtctgacccctcttacctgtgattctaccctcccatccacccagtttctctgtatctgcaggtgaaccagcttctttgtatctgcaggtgaaacctagctcagcaggttacaagcccatagtcctagaaacacctgcaatgagaccaagaaagaattagcagtgaccatggccatcagactgagagaccattcactcattcattggttcattgattcattcagcaaatatgttttcaatgtttaccatgagctgggcccagggatagggactggggctacaatggtgaacatgacacagtcttaccatcaagaagcttccagcctaggggcagaggaagccaacttcaaagcaggctgggaaggtaaggctgtcctccctatactcccagaacccacgacacactctctgtggctcaggccacccttgtaagagctctgtctacaccctgatgcttccaccagagtatctactgctgttcaccttccaggtacagctcaatcatttcactatcatgcaggacttgtggttccctggttaggtggaatgaaagagaattaagagatagctaaggccctcatccagccacgcaactcttttggaggacactagaggtctttgctaagttttctgtgttttataaccttcttcattcttatttgtattctctttaggttctctggtcacgggattattcccttcctcttgctgacctaaaaaataatcaactttctggaaatttaggggactcagccaatgctgttgtgattctccttctttagctttcagttacagaatgacatgtgacctccttgcaaggttgctatcagccccgttgtacaaaataatatgtccttggtcaaaatttacattttgtgcctcttattaaagatctgtctgtttgcctgcgtcatctctaaaggcctagcccatctgcaatgccacctcctgaatgggacacagctgtttaactgaactgatttattcttaggactaagagactgattcaagaagacacggaatgatatatttaaatttgcccgtttttgcttatcccaatttgtttttttccactcctttgcctatctttatctctgcagcctatcacccaaatctctgcaaagctatcaatttagcttttcagatgtgaaactttttcaagtttcaaagtgaggactgaaggaaataaaaatatttcaccccgaaatatacttctttggcatattttgaggtggctgttcagagagccaatgaatagaagtcaccctgcagaactgtcttttgtgggggagatttgcatctgcagagaatctgcactgatgcaggcagaagagggctttctctgaggccttctcttgtccgattgaggaaagattaactgagactctgacattttaaagatctgaaagaaatatttgccatctacaggcagggctgagagagccccagtgggagtgggccctccatgtcagactaaggaacttggacttggcctaaagggaagtccttagagacttataagcagaagaatgatgcagacatgttcggatattaaaaagaacacctggctgggcacggtggctcacgcctgtaatcccagcactttgggaggccgaggcgggtggatcacaaggtcaggcattcgagaccagcttggccaacatagtgaaatcctgtctctactaaaaatacaaaaaattaacgggctgtgatggcaggtgcctgtaatcccagctacttgggaggctgaggtaggagaatcacttgaatctgggaggcagaggttgcagtgagctgagattgcaccactgcactccagcccgagtgacagtgtgagactccgtctcaaaacaaacaaacaaaaaaggccaggcgccgctcacgcctgtaatcccagcactttgggaggccgaggtgggcaggtcacaaggtcaggagatcgagatcatcctggctaacatggtgaaaccccgtctctactaaaaatacaaaaaattagccgggtgtggtggtgggtgcctgtagtcccagctactcgggaggctgagacaggagaatggcgtgaacctgggaggcggagcttgcagtgagctgagatcgcgccactgcactccagtctgggcgacagagcgagacccccatctcaaaaaaaaaaaaaaaaaaaaaaaaaacaccctgaaatgggtaggaaatattagaggtctcaagactaaaagcaagaactagttagagcattggagaaaatcagttcgggagtgatgaaggcctgaagtaggcagaagcagtgggattggaaagaagggacagtcaggaaatgaaagtcgtggtgatagattccaaactcagtttcataagtggcctctgagatcagtctgtggtggctatttggtgtgcaatcagcaaaaaagagtttagggcccagtctaggctcagttgaaaagaatgatgggctgagcatggtggctcacgcctgtaatcccagcactttgggaggccaaggtgggcgcagatgacttgaggtcagaagtttgagaccagcctggctagcaccgtgaaaccccatctctactaaaaatacaaaaaaaaaaaaaaaaaaaattagccaaacgtggttggtgcttgccagctactccggaggctgaggcatgagaatcacttgaacccagaaggtggaggctgcagtgagctgagatcacacaactgcactccagcctgggcaacagaacaagactctgtctcaaacaaacaaacaaaaaaagaatgatggattagtgatgtctgctatagacacagaatgggggaatattggctcatgactggtatttactattcccattctctggtagaagaagcattaaaatgaactgtgtatcaacaagtgcatactgtgtgagtccatgaagatctagaacagatgaaagtaattcatgctgatagaaggcagaatagtggtttcctgggggtgggcaggtgggtaggttactcaatgagaaggagtaggagagagatttttcaagcctggaagaattctgtatttgatctgggtggtgattacacaggtgtgtatatacataaaaattcattatggtatatacccttaagatttgtgatctttattatacgaatgtcatatctcagttaaaaaaaaaagtgtgttgagaagccaacagaaaaaaaaaaagtatatagctccctatatactttggccacttctttgatagtcttgtccttttgcttgaaggagaagacatagactatgatgacctggtccgcagaggacatctggctgcttctaaggtgatcatactccaggtctgtcactttcaggatgctgtgagagctacattggcacgtgtgccctgtgtccctgcacagtgttctccttaggaccatgggacaaaccagctgggaagcaaaccaggtatccttgctttcaatgggaaaaggaaccctagaaatataatggttagaaatcacattaaagaaatgaaaggacagaaaggacacccctgatatacaagcgattactttagtaaagcattgacatttaattctggacaggattttatttaccaacatgttaaaatatttgtcaatacactaaaagagttaaacataagccttttcagctatacaggcaccgatggctctgaaagaaacataaaatacgtgttcagaggaccaatgaatccaaatgattgcaaataattgaccagcaattactagaatgttaattgcactgtaacatacctaagaagaatgcatacaaggctggtctgtaagttacttacttttattcccttacagatgagaaaactgaggctctggaaattcagtaattataccaaaaacacacaagcagtaaatgacagctgtgatttgaacacatgcatatattttttctattgtaatactgctatcttgctggatcctgaaatatctgtaaggtgtttatgagttggttttattgcctctactaaataagctatgtagcccaacagctagaatggaaatcagaaagctaaatttggattcataatctgtcacttactcttttttttttttttttttttagacagaatttttgctctgttgcccaggctgctggagtgcacaatctcggctcactgcaacctccgccacctgggttcaagagattctcccgcctcagcctcccaagtagctgggattataggcacccaccatcatgccgagttaatttttgtgtttttgtagagatgaggcttcaccatgttggctaggctggccttgaactcctgaccacaagtaatccacccgtctaggcctcccaaagtgctgggattacaggtgtgagccaccgtacctggcctgtcactcactcttaatgtgattgcaaatcttctcatttctttgtgcttcagtattaacatctattatgtaggggtaagtttgtgtttccacaaaacttccaggggggttatgaagcatataaaaccaacctttcatgaattttaattagcttaaagaattttatgagacgctgaaatttgtttaaaaatatagtattttaattaggttattttaaactggcattcctgggtagctagaagagtacatcttatttatttttattttttaatacagagatggggtcttgctgtgttgcccgggctgggctcaaatttcacctcaagcagtcctcccaccttggccttccaaagtgctgggattataggcatgagccactgtgcctggccaggagtacattttattatcattaaaatattcactgttgatttcagtgtcctttttttttttttttttttttttaatgagacagagtctctgtctgtcacccaagctggagtgcagtggcgcgatactggctcactgcaacctccacctcccgggtttaaacgattctcctgcctcagcctcccgagttgctgggactacaggcacccgccaccatgtctggctaactttttgtatttttagtagagacagggtttcaccatgttggtcaggctggtctcaaactcctgatcttgtgatctgcctgcctcccaaagttctgggattataggcgtgagccaccgtgccaggccttttttttttttttttttttttttgagacagagtcttgctcttgtcacccaggctggaatgcagtggagcgatcttggctcactgcaacccccacctcctgggttcaagcgattctcctgcctcagcctcccttgtagctgagattacaggcgtgtggcaccatgcccgactaattttagtatttttagaagagacgggatttcattatgttggccaggctggcctcgaactgctgacctcaagtgatccgcctgcctcagccttccaaagtgctgggtgttttcagtttctttacccttaacctgagtgctgtggactcaatgtgtccccccaaaatttgtatgttgacgctccaaacctcaatgtatttggagatagaggctttatggaggtaattaaggttaaatgatgttataagggtgggatcctgatctgataagattagtgtccttataagaagaggacaccagagagctgacttttgctgcctgccacgtgaggacacagcaataaggtggccatccataagccgggaagagagccttcatcagatactgatgctacggaccttgatcatggacttccagcttccagaactgtgagaaaattaatttctgtcatgtcagtcccttgggctctggtagtttgttaaagcaactgaagcaaacaaatgcactaagcaacttagtgtgatgaatgatcagctatgtttgttgaagccatgctttttgaaatgtcttgatgcctttcctcagtagaaacgcatttctacaaaatgatggtgatttacggtatctgcttggcttaagaaaacccatgcatgcaaatataatacattatttcagcatttgccttaatgccccaccagacctattttcaatatattttttcctttttcagcataatgtttattagtgaatttagatgcaggctaacttagagatggatcttctttcatggaaagacaaacacataatatcagcagaatattgtttctttgaaatgttcagaatagtacattttgaattatagtaaaagtttacatatgtgtgttggtgtgtgcatataatggagtagttaatatattcataaaaatatgaagataatataacacccccatgcacaccaccgagctttattgtattaatatcaaatattaatacaaattaatgctttactccatttgctatatatgtttatattttttccattgttacaatttgagacacaactgaaagtccctgaggactcctgcctgatttcactcaacgttttatcctaattttggtgtatgtcattctcatgtatgtcatataagtatgtaataacccataatctgttaggatgagggtttttatttgcaagcaacagaaacaaactggttaatttaagcaaacaaacaaaaaggaatgtattcaataacttggaagacctttgcaagagtggaagacttgggtttggaggctccactgccagggaaaatgtccctaatcatgctgtagaatgtgtccaatagcaacaccacaacaacggctgctggacagaccctacggcttgcactgttggtcctcctgacccaaaacacagctgcaggaaccacagccattacagccactagaagccaagcggaaccactgctcttcctcccagaaagtccgggcagcccctgcagctgcatgaaagtctggggcaggcgcatctgatctttggagcctgggtcatgtgcctgggccctagctgcaggagaaactgggaaatcaagaagatgggactgggtgtggtggctcatgcccgtaatgccagcactttgggaggctgaggtgggcggatcacttgaggtcgggaattcaagaccagcctggccaacatggtgaaaccccatctctattaaaaatgcaaagaaattagccaggcatggtggtgcatgcctgttgtcccagctactcgggaggctgaggcagaattgcttgaacccgggaggtaggggttgcaatgaaccaagattgcgccactgcactccagcctgggtgacagagggaggctgtctcagggaaaaaaaaaaaaaaaaaagtggtatttttggcttttattgtgggaggggactctgcctcagcaggtaggggagtccccaaacttaggagggaggtatagatgctgcatgataagagccaatggcagttgtccacaacaaacaactgatacattctcttgttgatggacatttacataatttccaattttttactacagagaactgctgcaatgaaatttttgcacatttcctacggtatagaatttctctggattattcgtgccttcaattttactagacattgccatattgttcagcaaagggtctatttgccaatcatatattttgctaacatttgtctccatctgtggcttgtcttttccttctgcttatggtgtcctttttatatggaagatttttattttaatatagttaaactaattaatcctatcccttatgtttgtgattttttggtgtgcatttggtttaagaatttattttcagccaggcgaggtggcttatgcctgtaatcccagcactttgggaggccgaggcgggcgggtcaggagtttgaggccagcctggccgacagggtgaaaccccgtttctactaaaaatacaaaaattagccgggtgtggtggtgtgtacctgtaatctgtaatcccagctacttgggaggctgaggcaggacaattgcttgaatctgggaggtggaggttgcagtgagcagatcacgccactgaactgcagcctggttgacagagcaagactgtctcaaaaaaaaaacaaaacaattttctacctgaaggtgataagaaaaaattatcctgatgttttcttctaaatgttttattatttggcttttaatgattagctctttacctggagtttattatggaaaataggaatctaagatagataatcagttgtcccagcaccattgattgaataatccattcctcctggtttgtaattcgatctctgttgtaaatcaagtttccccatgttcctgggtcagtcaggtctttctatttctgttccattggtctatttaactagcctggtgccaatactacaatatcttagttactatcacgtcataaaaaccttaacatctgataaaatgagtcctccacttccccctcaccccaatgtattaatgctatttccagagtgagctattagctatcttatatcctgaagagcacaatgacaaaaaaaaaaaaaaaaaaagagaaaagaactttcagagtgtatggtttggtataaaatatgagtgggccataagaagtagcaagagaatcaacaacaccttcaccagtggctaggtgcctgcagagagctgagagccagaggcagggatttatatcaaagaaatcagatgcatttgaattaaagctctgatctccaccctgtaagaacaggcttctaagactcccagcttcagtgacactcttcttgttttccaatgaccactgactcctccatccccacctttcctttcctggggtttacggcaggtaaacacagcgtggcaacatcaggttcctggagtggcattctgagcatccctgaataattctgatgtgtcagctggtgtctgtggaatcactaaaagtcaagtttcaagctacaaccctctacctctgctcaaaaaggcattttaagtccttgctttgagcaaagcttccaacctcctgcctcaaacacatggcaatgagaggtaaaagagaaaaagaagcaatctaaaggacaaagctgcactccaaccaagatgaacaccctgtgcatggaagccaaatcaatagatttgcggggctgaagccacaggcttgcttggctctaggtctagaagcagcgaaagcagatatgaatttagctcttgtgggaaaacagaataaaataaaatgcccctctccaggctggagagcagggtgggggatgttgcctgttttgcttcttgaatccaagaaccagggtagggcttccactactccgcatgaggctagaatagctgctgtctactcctgcttggccacatgatggctcacaggatgcttcgtgcccaggcagatgagagaacatggccacggccgcccaaccaggactaagctaaactgcttgctggcctggagactggatctgcaatagttctaatattcatgaagtgagacatccaagccaccattattagacctggttcaaccactaaatgggaggaaaccttgctcatgcgcacacacacccgcacccacccatctgccccaacacacacacagagaaagagaaaggaaaaaccttccactcaagatgagcccagaatccaaaattccaaaacatacagagaaagctaattctatttttttatacgaagtctcactctgttgcccaggctggagtgcagtggcacgatctcagctcactgcaacctctacttcctgggttcaagcgattctcctgcctcagcctcccaagtagctgggattacaggcacacgccaccacacctggctaatttttgtatgtttagtagagacaaggtttgccatgttggccaggctgatctcaaacgcctgacctcaggtgatccatgtgcctcagcttcccaaagtgctgggattacagccacctgccaccatgccagctaatttttgtatgtttagtagagacagggtttcgccatgttggccaggctggtctcaaactcctgacctcaagtcatggtgccatcttagctcactgcaacttctacctcctgggtttaagcaattatcctgcctcagcctcctgagtagctaagattacaggcatgcactaccacgctgtctaatttttgtatttttggtaaagacggggtttcgccatgttggccaggctggtctcaaactcctgacctcatgatctgcccacttcagcctcccagagtgctgggattacagatgtgagccaccatgcctggccttaaaagttattttaaaaatgtatgtttagaatcctaaacataaaaaatgacggaataaataactgaaaaaaaggattaaaagacttttagttaccataggatgaattgaacactcaggtttactttaactccttgctaatatcttaccacagagactattaaagggtaataaaggtaaaaacctagaggcctattgtatcacgtgttatatcagtaaggatgcctttctttggctgcaagtaatgcagctcaaactggcttactaaggacacttacgggctcccacaattggaagtctagaggcagggctttgcaggtggcactgcccagtggctccagatctatccccctcgtcttctgtgtcagcttcttctgcaggaaggtaacagatggccaaccagctccaggtctcacacctactcagaacaaccattacagaggagagtgggcttctgatgccagcattccaaaccaaaagcctgggactcactatgtcttgtgtcacatgctcacccccaaccccaccgaccaatgactgttgccagatacatgaaaattctcaattgccttaaatcccaaggctcatccttggagctttggctgtggtcaactgcccccgatgcatctgggtgattgagggaatgggcagacactaaataaacccagggttctatgaggaaggatgaagacagaaatgactccaggtgttcaattaaaaatattcactcagtgctgtatgtggaaactttttttaaaatgttggctaggcatggtggtttatgcctataatcacagcactttgggaggctgaggtgggaggatcacttgagaccaagagttcaaaaccagcctggataacatagcaagaccctgtctctacaaaaaataaaaaaattagccaggcctggtggtgcatacctgtagtcccagctacttggaaggttgaggtgggaggatctcttgagcccaggagtttgaggatgcagcgagctatgattgtgccactgtactctggcctgggtgacagagtgagaccccatctctaaaagaaaaacaaatatttaccaatatcaccacaaatatttggtgcaccacttaaaatgtgcactttctgaaaaaattagaaacaaagcataaaaagttagggaaagggatatgttaatactcgttcactggtaaattgttatttgtatagaccgtgatagcagataaaactctctgataccctgcttatgcgttgcctcacactatgagtgactatattccttttgtcaaatagcacttatatagacagtgctcaaagtaagttatctgactgaatatcacttttaatttatagtctgctctagccttgtcaaaaaacctgcacactgttgcatagacatcctttttcttttttatcagtagtaaatgggctttaaaaataattctgtccttattctcagaagcatgttgcatactgggatggatggttctggaaatgaagggatgtttacccttgccactgtatttcaataccataaatggtgactgtgaatcattacaaaaaatgtggcaacttgcttgtgtctaaaaggagcaactggaactagaaagtgtgattacatagggaccttgtaggtttgttaattgatctgcagctaaaccttaatgtgtttgtgtgtctgctcattgccctcagcatttcaagacatctaaatactaccataaaaccagcattttcctgtgcattgacttctcatgtgaaaacagttactgaagttggcaaaaaataaattttaaagtttggatgaaggtatttttggtctgtttagtgctcttctcaggtttttcaataaacttgcattttgagggttgtatcggcaacttcagctttcaatgtgcatcatggtggaaggtgctgagtttattggaagggaatggaaagacaaagttaccatgaggaggatccgcagaccacgtcctaaaaagaaattggctcagccctccacgaattgggtctttgggctacttaaaatagaagtaaacatttttttaaagttagggaaattaacaagcctctccgtatacccatagatatagggaatctcactgagtttctcagacacatgataaaacagcatacatctctcacttacaggtggaatataacattaaccatcttgcactgaggagttacagattggtagacacagtgccaaaaacttgataagcttgtctcatttcatccttacacaaccttgtgaagtaggtattattattgtgctttttacacataaggaaacagaagcttattctgcaattacagaggaagtaaaaagcaaaagaaagaaacagaagctgggcgcgatggctcacgcctgtaatcccagcactttgggaggctgaggcaggcagatcacctgaggtcaggagtttgagacaagcctagccagcatggtaaaatgctgtctctactaaaaatacaaaaatttagctgggcacggtggctcacgcctgtaatcccagctactcaggaggttgaggcagaagaatcacttgaacccgggaagtgaaggttttggtgagctgagattgtgccactgcactccagcctgggtgacagagcgagatttcatttcaaaaataaaataaaataaaataaaatatagccgggtgcggaaggaagaaagagaaagaagatagaaaggaaagaaagaagaaagagagaaagaaagaaaagagagaaagaaaaagaaagagaaagaaagaaagaaagaaaggagggagggagggagggaaggagggagggaggaaggaaagaaggaaggaagagaggaagagaagcttagagaggcacatgattgcagaagttcacgtagcgaatacattctacttgtgtcgtatcaggacattatgctgttgtccctccaccaggtatcagcctatccatcgcaagtcaaacacaggatttggttggaaatggaactccagcatggaaaccatacagaggagtgatcacaggaaagatagatgttcttgcacatggtgcttatttttaattcataggttaggtgaagtctttatgttttttaattcaagatttagagtccagttgtggatttaaaagttgcagttaagtttttgcagaaataaataaagcccttattgaattggtattaatctcttcaaatgtcattgctatttgagtaactgagccataaaaataattttacagtgacatgtgaaatgattgggttttgacttcgtaaattcgaaagtctgaataaacattttggagctgccttgcacagtgcctgctcgcttcatcgttgcagattttaaaggattgggataattttgttatttgcacacagttctggcctgaggtcaaggggccatgatatggccccaaccctgcctatcattcgtgtcgccctaagacccagcaaaaccaaactgctcagcattcctacgatttgcctgcattgtccctcctacgtgactttgctccaacccctgtgttgctgctcactagctgtgtctttgggcaaattacctaacctctctgagcctcagttgctttagctctaaaatgggggctggggaggacagtgagggttataattataattaactaattataattaatcccttaggtgtgttgtgaacgttaaatgaaatcctgcaagtagagtgtttagcatggtgtctagtgtatggtaactggtcagcaaatgttaaccatccctaacattattagggtcattactatccttctcatcactcatctctccacctagaatacccaaccctccttacctgcctatcccaattctccccctcactcaagactctggtcaaaaatgcactataaaataatcctgtctttctggtcaggtgcgatggctcacgcctataatccctgcactttgggaggccaaggtgggcggatggcttgaggccaggagttcgagaccagactggccaacatggcaaaaccccatctctactaaaactacaaaaattagccggcgtggtggcaggtgcctgtggtcccgcctactcggcaggcgaggcaggagaatcactcgaacccaggaggtggaggttgcaatgagccgagactgcaccactgcaccagcctggtgaccgagtgagaccctgtctcaaaataaataaataaatgaaaataaataaataaataaccttttctttccaaaaatactctccctccccaaaacttctttagcgttctatctatacagctctgctagcagttccttccttatttatttattttttttgagatggagtctcgctctgtcacccaggctggagtgcagtggcgcgatctcggctcactgcaagctccgcctcccgggttcacgccattctcctgcctcagcctcccgagtagctgggactacaagcgcccgccaccgcgcccggctaattttttatatttttagtagagacggggtttcaccgtgttagccaggatggtctcgatctcctgaccttgtgatctgcccgcctcggcctcccaaagtgccgggattacaggcgtgagccaccgcgcccggcctccttccttatttttcatttattaatagtatacactatcttacgtcttcctgcagccttgaagccttgggaagactggggccaagtctttatgttgccccctgggcctagctcacacacctgtcagtagcggataacagccactggttgcatgaattcataccacggtcaggggtctgacagcactgcttgctttagtggcgttagtaaagtatcatggcaatacttcgaatacaggaaacattgccctcattgtatttacaacttttctttcaatgcacagtctgcaccaaatgttactgaagcgatattaggtttgggagctcgagggagtctcagctcctggggggtcttggaagatgtgtgctcagctaaattacagcatgtgtggtgttagggggcaaggcttcgcttaaggcttccaaaggctgccacgcagtagagagaccaagctgctcctgcagcaacccccttccctcccacatgctacctaaacctggagagagtgacacacggccttctctgcctgaggtaggaagcagccctgtttggtggctagtcctggagatacaaatgcagaaagaacagggcattttatgctggtgaagataataagggcacatttcccccaggagagttggtatgagaaggcaagagaagcaggaacttgtggcacttatatactatcaccaagtatagattaaggacttttcagcatagggccaggttttgaacaagcattcactaaagaaatgaaaacaaactgagtcatgatcccagattgatgtggctccactgctaaacaggaagcctcttagcaagcagactgaggagagctcaaaggcttgaatctgggcatgtgcatttgtcccagttttaggaaagattttcagttgattgcatgaaagtggccactccttaacccaaacatgagctgggctatgaattattaaggcaaaggaagctggttaccggaaggtctgattgccggctggggccttccggatgtgacaaagaggcaaaggcttcaagacacccttttgttctaggaaggtatttcggcattgaaggtactccttatcctcgcctttctcctttgcaccttgtttcagagaaacttttgctgatgaggcgttctctttcctgggtactatttgtggaaacttggttattttgcaaatgtgctgcggttccattcctgaaatgtaaacaaaatgtattcctcccagcagcctcagtagaccaaggcatctgtaggctgagctgtttgggttaagttggctgctatagtctggatgctccttcacccatttacagaagttccttctgttcgttcttcaattttaaatgcacctcttgttctactcagaggacacatggcatctatgtaataaagaaagtttccaggctatcaacaaatctaaaccgtaagagtttgattgcacttatcttgtaccgggaaatgagccaggcactttaaatacattatcccattgaaggaagtgcccccatgagttgaatactcttattttcatgatatcacagataagttcaagtcacttggctagacagaggcagaatcaggatttcgacaggcctatgtgattccagactgagcttttacttaccatgctctatagagaccagtgcttcccattttttttacatcacatggaaaagtgtaaattgtaaagcacatatacatatagatccttatcatagaaaatgtactattaagaaagaaggccaggtgcagtggctcatgcctgtaatcccagcactatgggaggcggttgtgagtggattgcttgagcccaggaatttgagaccagcctaggcaacatggtgaaaccactgtctctacaaaaaaaaaattagctgggcatggtagtgtacacctgcagtaccagctactgggaggctgaggtgggaggatcacttaagcccaggaggcggatgttgtagtgagctgacgtgctactgcactccagcctgggcatcagagccagatcatgtctaaaaaaacaagaaaaagaaaagaaaagatgatgtatttgtgtggcacactgggataaatttactaggctgcttgtgggtggaagcaactatcccagtggcttaatcaccccagcccagctgagtggccctgaaggctggtaatgtccacttttcagttcctgtgtacaacatctgaggcacaccctttgggaagctctactctataccacagtatacagcaaactacctccccaaatggagaagcttgcctttggatttagcatatagtcaacgtgcactattcacagattgtgtatcatgtctttgactgcttgctaaaatttatttgtaaacctcagtgtcagtattggtggcactcttgttgtcattcacagataggtgcagagcagtgaaaaatttgagttacctcttgtgaatgttcccagctgaggtcgaacaagcctacgctcttcttgtttcagggatactgtaaacgtgtctctttgtggtctgtttagtggcgtgtttcttgcatttctgtgctgttgttggtgatgctgtttaaaatgagctgcaagtgcaatactgatgtgttgtctagtgttctaagctcaagaagtctgtgatgtgccttacagaaaaaatacacgtggtaagtaaactttcagggtgagttaaagtgctgttggccataaagtcaatgttaatgtatcaacgatatctagtaaataaggtgtttttaaagagaaacacgtaaaatgaggttatgtattgatcaattgacgaaaatattgtgaccctgggagctacccctaccagcaatggttcagtatttgcttagtgtttgccaagactttacagaacctaatttccatgaataacgagaataaaccgtgttatatcatcagtcaagaactgaaactgtgataggctctgtagttaacaccaactacgagttaacattgcaacggcacactccactgtgggaacacaggcctcttctcaacacagcaggtgaaccaaagacatgggcaaggattgaggttttggtgggaacgctaagaggtgatggttgaggggtgagagcattttccaatccaaaaaatgagtatgaaagcacctctccttaagaaaacacagaagtggccagatatattcttttcttcaaaaagagaaaggaaataaaatcaagtttgcttctcttttcctgctacagtctatcacctgcatccatgacaagaatccttctgcatagggctttacagtttacaaactcaccacctcaggaaggagggaagaggtatttaaatgctggttctctggaagtctgaatgatgggaaccggctattatgaagcaacacaatggattccataactgacccaatgcaaatctgtactgattatagccagtgaatgaggatgtgccggacttttctctacagtcttcttagcttgatagctgtggcaatgtcacgcatggggcttatgtccactgctggatcaaatgtatctgtatccactgggtctgttaaacttgaaggcttcaaaacagaaagatgtgtgttccacacacacacacacacacacacacacacacacatatatatagagagagagtatttactatatacatgattagcaaacatcaattctgtcacttgttcattcattaggtaggtcattcaacaagtgtttatgccatttatgggccaggtacaaaaactaagactaaagacatatataaaaatccacattaccttgggaggccaaggctggcagatcacttgaggtcaggagtttgagaccagcctggccaacatggtgaaaccccgtctctactaaaaatacaaaactcagctggatgtggtggcacacgcctgtaatcccagctacttgggaggctgaggtaggagaatcacttgagcccgggaggtggaggttgcagtgagctgggatcatgccactacactccagcctgggagacagagcaagactccatctcaaaacaaaaaacaaaacaaaacaaaagatccacattcccttgtgaatatacttaatgccactgaattacaaacttaaaaatgttaagaaggtaaattttatgtcatgtatatctgactgcaataaaaagggggtaagaaaaagccatttccctccaccaaggagctcacagtcagtgaagaactggttgggttaacaattaccatacagtacaggggctgtgttagatggaagtagaatgttaccagagcataagtaggaaatttaatgtttgtaatattgactttctatttagcagaagtttctaagaagtacatcatgaagacattaaagtatattgttatagtgagtagtatgtgtgatcttttcaaaacatattgggtatatagttattttcatttggatgagctcatgtgactagaaaaattgttgataatttagtttttttgtggggtttttattttttattttttttgaggcagagtctcactcttgttgcccaggctggagtgcaatggcatgacctcggcttggacatttacatacttacatataaaattaggcatgattgtatacttaactcattatccaggtgtaatttgcataattttggcacgtcacagcagacccagaggaaagtgtgcagaaaccaggaagaatatgaagagaacacaggattcaacgacccatgaagagattattgaagtggataatagggagagttttggggaatttggtctacagaaatcaggcaataaaagttgagattttatcttgaatcccggaaaaatcaaccacatctgaagggcagggacttgaacttccttgtcataatgaattcaaaaaagactcagagaacccatttgtgggattgataaaaatcactaaaaaatgtgtatattagttcctgagtctcagcctccaaaatttggtgggtaaataaacttcagaaaagtttaaaatttaagtagagagataaattaatcccacaatattaaaactttaacgtatatgaataaattttgagttatgagataatcttgtgtatttattatgtttgaaatattaaagagatttcagccagttagagaatgtgagagatttcctttgggctttcaacttaaatttgagtaaactgattttagatttgtgattattaagtttataagtttaaggtagtttgactaagttcaaaaatataattggaatatttaagagaacttgagattcctccaaatttaatttatttgctttatcaaagttaagaacttgagaatgtttttcttgttagggttataaatacttaaaggggaagtacttaaaggggaacaaaatatattcaaaatataaatgcactttaaaatatatgaagggggccaggtgcagtggctcacacctgtaaccccagcacattgagaggccaaagtgagagggttgcttgagcccaataggtggaaaccaggttgggcgaggtggcttatgcctgtaatcccagcactttgggaggcagaggcgggctgatcacctgaggtcaggagttcaagaccaactggccaacatggtgaaaccctgtctctactaaaaatacaaaaattagtcaggccttgtggcaggtgcctgtattcccagctacttgaggggctgaggcaagagaatcacttgaaccagggaggccgaggttgcagtgagctgagattgtgccactgcactccagccctgggcaacagaatgagactccgtctccaaaaaaaaaaagaattgattggagaccagcctgggcaacacagtgagacctccatctacacatacacacacacacaagcactatatatatatatatatatatatatatatatatatatatatatatgtatatatgtgtatatatgtatatatgtgtatatatatgtgtatatatgtatatatgtgtgtatatatgtatatatgcgtgtatatgtgtatatatgtgtgtatatatgtatatatgtgtgtttatgtgtatatatgtgtatgtgtgtatatatatgtgtatatatgtgtatacgtgtgtatatatgtatatatgtgtatatatgtatatatgtgtatatatgtatatatgtgtatatatgtatatatgtgtatatatgtatacatgtgtatatatgtatatatgtgtgtatatatgtatacatatgtatatatgtatacatatgtatatatgtatatatatgtgtatatatgtatatatgtgtatatatatgtatatatatgtgtatatatgtatatatatgtgtatatatgtatatatgtttatatatgtatatatgtgtatatatgtatatatatgcgtatatatgtatatatatgtgtatatatgtatatatgtgtatatatgtatatatgtgtatatatgtatatatatgtgtatatatatacacacacacacatatatgaagggttgttattcattaaattgtatatgagtctaatttttatagaaagtttaatcagctcaatttgcgttaaacaaacatttatcaaggaaaaggtaaagacaattgttaccttagagtttacagataaaatagatagatttttaatggccttaaaacttagtgaagagagggtttttaatgggttgctaataaaatgaattttacttttaaaaccaaagtgattgcatttttctatgcacaaaaatatcttgaacatcaaaaccccacacattggcactgcattttttaaggcctctccctgttacatgtttactgaattggttaatcacaaccaaactgaatccttgagaggttttcttttaattttctgccaatttaaatagagtgaaattgacagaaaattttccctgcattgctgaaaaacacaattcgctatcaaagagagacaataaatggagttgacaagatatgatattttgcaggcatgaccactaatcgtgagaaataaatctttgaaaaatataaaggcaaaaggaccaagaaaaagctttcccccccaaatgattagtaaatgcaaatattaggtccaaaaaaataatatacgaaacccccaaattcctgaaacatgactatctccctccacaggtgcatgggccctgtaggaattgtttctttctttttttttttttgagacaaagtcttgctcttgtcacccaggctggagtgtaatggcatgatctcagctcactgcaactgccacctcccgggttcaagtgattctcctgcctcagcctctggagtagctgggattataggcacctgccatcacgcccgggtaatttttgtatttttagtagagacaggatttcaccatgttggccaggctggtctcaaactcctgaccttgtgatccacctgtgtcggcctcccaaagtgctgggattacagacgtgagccaccgcgcccggccagggattgtttctttgagtttatataattaacagactgagccagaaagataatgaggtagcagttataaaaagaatgaataaaataacagaaaacaactgcacttttttttgtctgaaccacttcaacaaataagaactcattatgatttggcaacatcccccagtactctctagtccatgtctcttcatatatacagcaaaatttcatttttcacattttttttcttattttggaggcagggtctcactctgtcccccaggctggagtgcagtggcacggtcttggctcactgcaacttccactgccccggctcaagcagtctgcccacctcagcctcccaagtaactggaagtacaggtgcttgccaccacacccacctaattttttttttttctggttgcagtctcattatgttaccaggctggtcccgaactcttgagctcaagcaatctgcctgccttggcctcccaaactgctgggattacaggcgtgagccactacacccagcttcatttttcatatctgatgctcaaagtgtgtctagtttacggatctcttcttctacttgacccttcactgaatctatactctttcctgaagtgttttttagtttatcaactttttggaggtataatttacatataaatgaccacaccttttaaagtgtgtcattcaggccaggcacagtggctcatgcctgtgatcacaacactttgggaggctgaggcaggaggatcacttgagcccaggagtttgagtctgcagtgagctatgatggcaccactgcattcctgcctgggtgacagaatgagaccccatctctaaatataacaaaataaaaaataatacagtgtatcatttggtgaaatattgatcccttgtaagcaccaccataatcaagtttgagagcccttccattagcctccaaactttcctccttcccctttgcaagaaactccgctttggcccccgagtcctttccagagtttcagataaccggaatcataccatacgttctcattcatgtctggcttcttttgttcagcatgtttttgaaattgatctgtttttgtgtagtggttcattcctttgtactgatgcatgatattccattgtatgcacgtattttgtgtacccatttaccagctgatggacacttggattgtttccagtttggggtattatgaacaaagctgctatcaatattcacgtagaagtctgtgaaaataggtgtccagctttgagtaaataaatacctaggattggaattgctgggtcacattgtaggtagaagtttaactttataaagtgccagaatgttattcatatcaccataacatgttctgttcccacaagcagtgtatgaaagttccagttgtttcacatctttgtcaacacttggtcttgttagtcttttacttacagccattctaattgaggtattaggtgatatctcactgtggttgtaatttgcatttctctcatgctgaacacgttgaaccttttttgtgtgttcgttggtgatatcgtcttttgtgaaatatgttcaaatcttttctgtatttttagtgggtcatttgatttattatagagttataaaaattcattgtatactctggacacaagttctttgtcagacatgtatattatgtatattttctgcctttctgtggcttgcctttccattttcttgctagtattttcaaggtttttttgttctgtttttgattttcagagtccaatttatcaagttcccttaagtttctttggaaatgaagtgtagttgctactctgggccaaagtactgatgacctttatattgctacagaatgatttaaatgggctaaagcctgagtacacatattttactggctttttattacattcactgtaaatttttacttttgatcttgtgcataggaatgtcatgctttccagggtatatgtttccttcttttttttttgagactgggtctcactctgttgctcagtctggagagcagtggcaggaacacagctcactgcagcctcctcttgggctcaagcaatcctcctgcctcagcctcccgggtagctgggactacaggcatgtgccaccaggcctggctcttttttttttttttttgtacagatggggtcttcctatgttgcccaggatggtcttgaactcctggggtcaagcagtcctcccacctctgcctcccaaagtgctgggatcacagacgtaagccgctgtgcttggcgatgtgtactttttaaatgaaatttaaagaatataggaaaaagaatattattaataaaagacatacccatgtacccactacctagcaaaataaagagaacattatcaatgccaataactttaaggcctcgatgcactcctcccaattcatattccctctctccccataagaaagtataggctgggcgtgagctaagctgtgaggacacaaaggcataagaatgatacaatagactttggggactcagggggaaaggatgggtgggggtagggataaaagactacacattgggtacagtgtgcactgctcagatgatgggtgcaccaaggtctcagaaacaccactaaagaacttattcatgtaaccaaacaccacctgtttcccaaaaaatattaaagtaaaaataaaattaaatttaaagaagaaagaaaatataggtcggttgtggtggctcatgtctgtaatcccagtaattcgggaggccgaggcaggtagatcacttgaggccaggagttcgagaccagcctgaccagcgtagcaaaaccccgtctctactaaaaacacaaaaaattagctggacatggtggcaggtgcctgtaatcccagctattcaggaggcagaggcacgagaatcgcttgagcccaggaggcaaaggttgcagtgaaccaagattgcaccaatgcactccagcctgggtgacagagtgagactctgtctcaaaaaaaaaattatttacaattttggttttagcggttttattctgtttttaccattattttatttcttatgtatgaattattaaacaataagactagtttccttactttcttgtaactcagtaatacatttaaaattttcttagttataatgtattcagtatccaggtgttttgcaataaaagggcttctcagaatctctcttcggctatataaatagaagcaaagctgtccaggccagattttttttttaaacagctttattgagatatcattcacattctagacaatttatttcatttcaaagtgtagaattcaattgtttttggtatattcatggagttgtgcaaccattgccacaatctaatttcaaaacatatttgacaccccccccaaaaaaatcctattccaattaccagtcaccccattctttcccaacccctaagccctaggcaaacactaacttactttgtgcctctagagatttgctagtgccagtcataatccctgaagacacaattccaaatgccataatcctgaacgttgcaagcctgaaacattaaaatccctagagtctaaaatatctaacatctaaaattccaaaaatcgtaatcctgaaagatcaaaatcctgaaattggaaatcttagaaagctgaattctagggaaggaattaatgcgttttgggttgtatttaggacagttgagtcatgttagttgcatcatgttatgcagaactattaccttctcattgtctttatttgcatttggtggaaaattcaggtgagtggattggccacattataatgcagtgatgaaaacttcagtttaaaaatgcatcattggctgggcacagcggttcatgcctgtaatcccaacactttgggaggccaaggcgggaggattgcttgagcccaggagttcgagtcctgggcaacatggcgagacctcaactctacaaaaaataaaggaaattagccaggtgtggtggcatatgcctgtagtcctacactcaggaggctgaggtgggaggatcacttgagactgggaagttgaggttgcactgaactgtgatcacatcactgcactccagcctgtgtgacagagtgagaccctgtctcaaaaaaaatgaaaaataaaaataaaaatgcatcctttgtctgcattggcagcccttccagctgatgaaattctaggaatttttaatgaattaaagccaaatttgcttgaagaagccagcaaagttactggctggttcaaaaataatcatgtgcacagtaggataaaagaatgcacaacgatgttggagttcaatcaacaacatggtttctgtgaaatttgtggtctccataaaagtgcttgtggagtggattactgtatacccaaaattacacagaagtatggcacaaaagatgtgaacattatacaggaatgttcatgttggtgtatcttaactcagaagaatttcaaaaagagcagtgccacgtagaaaagcaatgtgaatgtattctttgtaaatgtattcataccctaaaaggggaaaaagaaagcaggtattcatggacatgagaggcttcaaatatagttaatgattgtgaaagttggtcagctctatggacaacctctgtgcaattgcccataatcgatatactttttcacatgccgaattttcttcttaatttttttagttttttttttctttttttagtattttctccactattttatttaattaattaatttatttattgagatggagtctcactctgtctcccaggctggagtgctgtggtccaaacttggttcatggcaacctccgccttccagattcaagtgattctcctgcttcagcctcccaagtagctgggattataggtgcccgccaccatgtccggctaatttttgtgtttttagtagagacagggtttctccaggttggccaggctggtctcaaactcctgacctcaggttatccgcccacctcggcctcccaaagtgctgggattacaggcatgagccacggagtcccagcccttccccacaattttaaattgtcaacattatttttttgcaatttgctatgctatggatttcatctttgcattatttcaatactggaggtataaattgtgtaaagacttttagagttctaattcattttatgtattttgttttttacaaatttgacttcacaaaagtacattatcacattgactctgtgtgtaagcgtcacgtgtgtatgcaaaaatgttgaatcttcctcaatagatgaagagatgtcctttctgtgcacatgcatttgtgaaagagaaaacttctcgagatcttggctctttgggtggctgcatatgtggtgctgacccatcgtggtttttgatcagtctcatcaaaagacttagtttgccggtcacagtatttcagatgactgaggttataaagctgggtgcatgcaattaccaaccatagtgatgtatttattcattttgctttctgacctatttctttaataatacatttcatccacttgtaactgtactcttgcaactgtagttagtatacctagatgtttatgcttaaaaatatgtatattattattgtcttttattgtgtattctgttgtgtttctatgtttctcaaatgaatctcctttaaaaatgtaaataaatgtccttgtattttctaaaaattattttttccagaattcttttttttttttttttttgacatggagtctcactcatgttgcccaggctggagtgcagtggcacagtctcgtctcactgcaacctctgcctcccaggttcaagcaattctcctgcctcagcctcctgagtagctggaattacaggcatccaccaccacgcttggctaatttttgtatttttagtaaagacacggtttcaccatgttggccaggctggttttgaactcctgacctcaagtgatctgcctgccttgacctgccaacgtgctaggattacaggtgtgagccactgcgcccagcctattttttccagaattctaattttgagatattgatcttttgggattgtggtttttgggactttagactttagggattttgatcattccaggtcacagcactcaggattgtgccttttgggattatggcccaaacctgagatttgcccatcctgaacatttcatataaatggaatcattcaacctgtcatcttttttttactggcttctttcactttgcatgttttcaaggttcctccatgttgtagcatcgatcagtacttcatttatggctggataatcttctattgcacggatataccacattttgtttatccttttctaagttgatggacatttttgttgtttcccctttttgcctgttacgaataattctgctatgaacattcatatgcaaatttttgtgtggatgtatgttttcatttcttttgagtatataggagtagaattggtgttcatatggtaactccatgtttaatttttttagtaactgccagactgttttccaaagtggctaaacttatattcccactaatgaagaataagggctccaatttctccaaaccctcacaaaaactgcttgtctgggccgggcgtggtgactcatgcctgtaatccccagcactttgggaggccgaggcaggcagatcacgaggtcagaagttcgagaccagcctgaccaacgtggcaaaatctcgtctctactaaatatacaaaaattagttgggtgtggtggtgggcacctgtaatcccagctactcaggaggctgaggcaggagaatcacttgaacctaggaggcggaggttgcagtgagccgagatcacgccaccgcattccagcctgggtgacagagcaagattctgtctcaaaaaaataaaaaatgaaaataaaacaaataaataaaactagttgcccgtctttttaagtatagtaacttaaaatagtttagccattctagtgggtgtgaagtgatgtttcatggtggttttggtatgcatttccctgatgacaaatgatgttgagtatcttttcacaggcttattggctgcttatatgtctttggggaaatatctattcagatctttttcccactgaagaaactgggttatcttttcattgtggagttgtaagagttctttatatattcttgatacaagtccctcattagatatatgatttacaaataatttctcccattctttggattgtcttttcactttcttgattatattgtttgcaacacaaatgttttaaaattcattaagtctaattgatctactttatcttccctcacttgtgctattggcactgtgtctgggaaaccattgctgaatccaagattgtaaagatttatgcctgtgtttttcagacagggtctcactgtgtcacccaggctagagggcagtggtgcaatcatggctcactgcagcctcaacctcctgtcctcaagcaatctcctcctacctcagctcccccaagtagctgggactacaggcacatgcaccacgcccagctaatttttttatttttggtagagatggggtcccactatgctgcccaggctggtcttgaagtcctgggctcaagcaatcctcacacctctgcctctaaaagtgttggaatcacaggcatgagccactgttcctggccagttttcagctcttaagttgtcaaaagaacttggcactgttaaactggtgatcattttttaaaagatatttaatataaaccaatgtttagaaattatactttttaatgtttataaattgatgaaatatgcttatagtcacggtttctcagtgtgaggaatttgcttccttttcatatgtatggactttagcttctaaggaaagtagtatcacaaaggccctttgatgttcatagaacgttgttaagtgtggagaaaaaagtagatgtcaaggtagcatgtactatatgattccgtactgagtcaaagaaaaaatattcttatatgcatttatatagactgggaaaatgcatcattaattttttgtgttgaatacattacttttgaaatgagaaaagaagatacttgtgaaatgtgtaaggaaactcacaaacgtgaaaacgttatgggtaatattagcagagaaaccaaatcagaaaacaacattgtaattatcaaaggactgcagttctgaaggtttgagtggaacaatttatattcatttctgccatgaaattgaccattttccaaaggctgtgaatgcagacaccctctctatatgcatggaaatcttccttatgctattttcataataaatattgacatatttatttctcacattcaaaaatggcatgaaataatcatcagagtccctttttgtaacttccataaacaactcctacaatctgtaattttcccaggcatcccacccctcaaaaataaatgttcaagtttgcataacaagaatcaacttctcaaactgtgaaaatgtattcttttttcaaatctttttaaaatatgcgttatttttagatgttttatattatctttgtacagtatttccaaaggagaatgttaaggcatgacattttcaaggtagatttttgtttgtttaattttctcccagtagtgtgagctttcacatgaatatctgatgggctaactccagcataccaaaacactaacaattgtaacaagcataccactgagtcttctacttttggagccatacacataattcacagatagatgtctgacacttaggaaatggtttttcatgccaaacatttctttctttttttttttttgagacggagtcttgctttgtcgtccaggctgcagtgcaacagcgtgatcttggttcactgcaacctctgcctgccaggttcaagtgattctcttgcctcagcctcctgagtggctaggattacaggcatgtgccaccatgcccagcgaatttttgtatttttattatagatggggtttcaccatgttggccaggctggtctcgaactcctgacctcaagtgatcctcctgcctcggccccccaaagtgctgagattataggcatgagccattgcgtctggcccaaacatttctttcaacctactttctttgcagcccaatgtgaaaggcaagctactttccaaattcattacctttcacagacccctcattctacccaatatgtttgtaaattaagccaatcatgaagtccagaagggggttgggaaaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaaccaaacaccgcatattctcactcatagatgggaattgaacaatgagaacacatggatacaggaaggggaacatcacactctggggactgttgtggggtggggggaagggggagggatagcattaggagatatacctaatgctaaatgacgagttaatgggtgcagcacaccagcatggcacatgtatacatatgtaactaacctgcacattgtgcacatgtaccctaaaacttaaagtataataataataataataaaaaaagaagggggttgggaaagtatagtacagatcaagtaagtgataggaatacaactcaaaaaagcccagtgaaaaatgaaatgaaggccaggcatggtgcctcatgcctgtaatcccaacattttgggaggccaaggtgagtgcactgctcgagtccagaagctcgagaccagcctaggcaacatagttagatcccgtcactaaaaaaaattaaaaaaaaaaaaaaatagtcgggtgtgttggtgtgcacctgtagtcccagctacttgggaggctgaggtgggtgggaggctcgcttgagcccaggaagtggaggctgcagtgagccgagatcatgctactgtactctagcctgggcaacagagtgagtgagactccgtttcaaataaataaataaataaatgaagaatcatgatgactagaggctggaggaaggggaaaatggagagttagtgtttaatgaatgggcacagagtttcagttttacaagaggaaaaagttctagagattgatagtgatgttgcatgacaatgtgaatgtatgtaatactattgaattatacacttaaaaattgttacaatggttagtggggaaaagtgaaatatcaaaaacaaacaaacaaacaaacaaaaaccaaacaaacagaagtcagccaatgctcctttctgtgagtatatacatgggcctacctgtgttcaatagcttggctctttggctctcgaaaacaaatccagcttacattggaagagaaaaccatttctagagtaacatgaaaactacaaccctcctttgcctacagtatcaaaatatttcacatgttttagttctgtgttgtgaatctcagtcacttgtacttcattttataggccttgaacaactccctggcttctccggagatggaattgatatcagggaatgaatgagagagagtataaggtcttttcagatgacatcgttcataaaaacccagaggcaagacagcttgacataaagacgctaatcacggcaaaaagtatataacttcagcatattcaaaatcaccatagtaattctaaagagtaacacagttttgatgtcagtccctaaaaatacaaatctcatatgtgctcatattctttctgtattttgtgtcacattcacataaatgcactcaacatttgtaaaagtttcaaaagtttggccaggtgtggtcgctcatgcctgtaatcccaggacttcaggaggccgaggccagcggatcacccaaggtcaggagttcaagaccagcctggctaacagggtgacactccgtctctactaaaaatacaaaaaaaaagaaattagctgggcatggtggctcactcttctaatcccagctactcagaaggctgagacaggagaatcacctgaacccaggaggcgaaggttgcagtgaggcaagatcactccagtgcactccagcctgggtgacagaccgagactctgtctcaaaacaaaaaaaagtttcaaaagtttgatcaaaatcaatcaagctagctcactacttatctacatgaaagtagagatattcatgttaagtgtttcacctcttgacaaacaaaggttttagcctagacttcctcaacagaggtttagtgagtgtgaaatgattatttagagaagttattctgggccacaattttaacaatgctctaacatctccatgttttttggaatgttactaatgtcttaaaagagtaactttaaattgatttaatttcatctgacttataaaacaatatgtaagccctatgctgtttctatttttaagagataatagattatataatgcaaacaattcaaccaagtagcacagaagaaattaattctctcttttaaaaaattattactagctaatgtttactaagttcttgggtttttttattttgttttgtttttgagacaaggcctcactctgtcacccaggctggaatgcagtggtcctatcacaactcactgcagccttgacctccccaggctcaggtgatcctcccacctcagcctcccgaatagctgggactataggcgcaccaccatgcctggctaatttttgtatttttgtaatttttttttttttgagacagagtattgctctgttgcccaggctagagtgcagtggcgcgatctcagctcactgcaacctccacctcctagattcaagagattctcctgtctcagactcctgagtagctgggactacaggcatgcaccaccacgcccggctcattttttttttttttttttttgtatttttagtagagacagggtttcaccatgttggctaggctggtctccaactcctgactgcaggtgatccacccgcctcggcctcccaaaattctgggattacaggcgtgagccaccgcacccggccaatttttgtattttttgtagcgatgggatttcgccatgttgcccagtcggatccaaaactcctgaactcaagcaatccacccgcctcagcctttgaaagtgctgggattacaggcatgagccaccaagcccggccagaagattcctaacctttctctaaaagcttaggaatcacagccttagaataaactaggtattcattttttttcccaattctacctttaccttctaacctctcctctttctaaacttttagttgtttcacgagtaaggttcataaacagccctggtaggatttctaactaggcaagactccagcatccttattgtagaaattaccaggtgatactaaaagttaagaatatgacatcagtcaacattgctcccgctctgtccggccaaagtggtggcatgaagatgatcaagacatctctggacctaccactttgggtaggcatggagggaaaggctggcgttttacaggtgccaaagatagcttcaggctttgggaatgccacttgtagaccaaggtggtggcagaatgtccagaaatcttcacagtgatgaacctatttacctgggggtaacagaaaggagggtcatttcctgcgtggaatcctcattctcataattcagatggaaatcatgtatttgcatgacatgtggatggaaatttgggactgacattcacagacagctgcagtctcttgatttaatactattacatttttgagttttgggctttgtgctgcaatttcgtgtgttgttatgacttagggagggaaaaagacaagggaggagaaactattttgcaagtaatgtagtcatgtctggtaaagaacatcaggtccattttagattgaaaaaatgctaggtcaacctacaggcacttctgagccctaattctagcccctgagacatagtcagtctcacctgtaaaatccgattaacaacatctgactcccttggtgttgagaaaagtcaatggctgccaagtgcttagatgttttacaagccttaatcttcctgtgaaacccattaaagttggagagattttacaaaggacaagaatgggaaagtaacaataaacgaacaactttgaacatcggcagatttgtagagcatatttaaaaggctttcagtaaataaagcatcttaattaagtcagctgctctaagcaggcaaagactcttggtttggttatagtttacattcccttgcttcctgaaggctactagctgaagtaatctaagctaaataacctacttcattggtgatcctgattgttttttagatgataggtgaggaaattctgactttaaagtgtcaggaaatttgcatatagaatcctggtacagcctttttatctactctactttcctaagcctccagagttaaacagtacttctttaaaagttaccatctaaatagtccatgcagagcatgtggctaccacagatgattttgtaagtcgcttagaacagagacctagaggttattccctatccagtagcctataatggtgcagtccagtcaaaatagaatgcaagccacaaaggtaaggcaagtgagtaatttttaaccaaccttccttatttacttctttcctccctccctccctctctctctctttctttctttctttttctttttgagatggagtcttgctctgtcgcccaggctggagtgcaagctctgcctcccgggttcacgccattctcctgcctcagtagctgggactacaggcgcccgccaccacgcccggctaatttctttttgtatttttagtagagacggggtttcaccatgttagccaggatggtcttgatctcctgacctcgtgatccgcccgcctcggcctcccaaagcgctgggattacaactgtgaaccaccgcgcccggccctttattttttttaagagacaatgtctcactctgtcgcccagcctggagtgcagtggcacaatcatagctcaccacagccttgaactcctggcctaagtgatcctcccacttcagcctcccaagtagctgggactacagatgcacaccaccaagctcattttaaagttttttgtagagatggggtcttgctatgtttcccaggctgatctcaaactactgggcttaaatgcttctcccaccctggctttccaaagtgctgagattacaggtgtgagccaccatgtctggcctaattttaaattttctagtagacaggttagaataaaaagcaggtgaaatgaataactttgttttataaccaaatatctccaagtattagcattttgacatgtactacatataaaaattattaatatgatagtttctattctctttgtactaagtcttcgacatctggtgtgtattttatccttacagcacatttcaatgcttcaataaccatggatgcctagtggctgccatattggatagcatagctctctataaatggtgccgtgaaggttggttgtgcagtgaggcacctgcacatctgtatacagtgagcctggactaatgcatcccattttgtacatataaacatgcatgtgtgtgtgcgcacgtgcgcacacacacacaaacacacacttgaggtaactatatacaaaggagaaaatctagcgcagaggttttgagaggtgacagtgtgctggcagtcctcagagccctcgctggctctcggcacctcccctgcctgggctcccactttggtggcatttgaggagcccttcagccccccactgcactgtgggagcccctttctgggctggccaaggctggagcccactccctcagcttgcagggaggtgtgcagggagaggcgtgagcgggaaccggggctgcgtgcggcgcttgcgagccagctggagttccaggtgggcgtggtcttggcgggcccgcacttcgagcagccggccagccctgctggccccgggccagtggctgcggagtgtgtactgggtcccccagcagtgccagcccaccggcgctgcgctcgatttctcaccgggccttagctgccttcccgcggggcagggctcgggacctgcagcccgccatgcctgagcctcccacccactccatgggctcctgtgcggcccgagcctccccaacaagcaccaccccctgctccacggtgcccagtcccatcgaccacccaagggctgaggaatgcgagcgcaaggtgcgggactggcaggcagcttcacctgcagccccggtgcgggatccactaggtgaagccagctgggctcctgagtctggtggggacgtggagagtctttatatctagctcagggattgtaaatacaccaatcagcaccctgtgtttagctctgtatctagctgctctgctggggctgtggagaacctttatgtctagctcagggattgtaaatacaccaatcggcactctgtatctagctcaaggtttgtaaacacaccaatcagcactctgtgtttagctcaaggtttgtgaatgcaccaatcaacactctgtatctagctgctctggtggggccttggagaacctgtgtgtccaaactctgtatctaactaatctgatggggacctggagaaactttgtatctagctcagggattgtaaatgcaccaatcagcgccctgacaaaacaggccactcggctctaccaatcagcaggatgtggctggggccagataagagaataaaagcaggctgccctagccagcactggcaacctgctcgggtccccttccacagtgtggaagctttgttctttcgctctttgcaataaatgttgctactgctcactctttgggtccacgatgcttttatgagctgtaacactcaccgcgaagatctgcagcttcactcttgagcccagcgagaccacgagcccacccggaggaacaaacaaatccagacgcgctgccttaagagctgtaacactcaccgcgaaggtctacagcttcactcctgagccagcgagaccacgaacccaccagaaggaaaaaactccgaacacatctgaacatcagaagggacagactccagacgcaccaccttaagagctgtaacactcactgcgagggtccgcggcttcattcttgaagtcagtgagaccaagaatccaccaattccggacacagtttcagactggcagctcagaagtgtttgaattaatcctgtcaaagtttgaattaattgtcagcagttaaatttcaggatatttcacataaaagtctgaatttctagctggaaaaaaccgtaaaatgtagtaaccccaggcccgtattcccatgtggcaacaaccttctggccctgagtagaggctgtccccctcaggtgggacacttccagttcactgccgttcctacttggtagactcactcttatattatctcagtttggaatctttgatcctacagagatacataccaagctatgaatatggttgatttctgcagagtgaaattgaggaggaggagactttcactttgaacaccatactttcctattttagaaatgtttttacagtaggcatgaactgcttttctaataacaattttaaaaaattgctgtttaaagcaactgctgtttagcaaagataaatccattaagaaagggccaagtatagtttgccaagtgaaatgaagaactgaagtaaaaatgtatcacatccaggaactggttattatctgaaatgaaataagccaggcacaaaaagacaaatatcgcatgtcctcacttatatgtgggagctaaaaaatgggatcacatggaggtaaagagtggaaaatagagaacagagactgggaggggtggggcaggggtaaagggaggatgaagagaagcgggttaaagggtaaaaacacacagtaagaaggaatacataaaatgtttgacagcacagtagggtgactatacttaacaaaaatgttttgtacttgggctgggcatggtggtttatgcctgtaatcacagcactttgggagactaagtctggaggactgcttgagcccaggagtttgagaccagcctgggcaacatactgaaatcttgactctataaaaaaacaaagaaacagaaaaccccaaaactgttttttactcgggtgacagacaccccaaataccctgacttgaccactacatattatatacatgtaacaaagttgtacatgtaataaatatacatgtaataaatttgtacaaataaaaaaatttatagccagcaaattaattcagtcttctcaaccttgtttcctttaatagcatatatatttttttattttttattttgttgtttttttgagatggagtcttactctgttgtccagactggagtgcagtggtgcaatcttggctcactgccacctctgcctcctaggttcaagtgattcttctgccccagcctcccaagtagctgagattacaggcatgtgccaccatgcccagctaatttttgtacttttagtagagatggagtttcaccatgttggccaggctggtcttgaactcctgacctcaggtgatccacctgcctcagcctcccaaagtgctgggattacaggtgtgagccactgtgtctagtcccataatagtatattttagatacccaaagtaaattactgttgcaacataaaaataaccataagaatgctaattgtaaaataatacccaaatttccactggattatcaagttttccttttgaaggccaggtccattcccttatgatgtttccttttctgctgatcaccaggcctccttcctaattaaacatcactgctactgtttgtctacaaaaaagacagaaattgacccatttagaacaagaaaaattcatgcactcattgatttggctgaggtgatggaagtcaccaagatacagcttttaagagcatgggaatctctcctgtcacattcctggaggatagtcactctctctgcctgaatatctttctggaaggaagcttgatacatacctgctcagctgattagtgtcccttctctgagacatgccttctccctccccttgcatctatagggtcataggaatggatcctgccagccacaattatcataccatgtgggcctgctaccttggctatggctgattgaatcaggggtggacatttaaccacagctgtgttccaaatggatacacccagatgtgtcaaaggacttaggagaggaggtgggcatagtgcattcaaaggactgaaaggaagacagcatgactagggtcaagagtggcgtaaattagatgggagtgattggcaggcagtggtcagatatgcaggaatccttggccatagcatgagttttatcttaagggcaaaaaaccaggctgggtgcaatggctcatgcctgtaatcccaacacttcaggaggcctaggtgggaagactgcgtgaagccaggagttcaggaccagcctgggcaacaaagcaagacctcgtctctatttcaataataataataatgataaaaagaaaaaagagcaaaaaataatagaagggttttaacaactaagcaaggaggctacatgatcaagtggattagggagggaccacagtacatgctgggagaccagttaagaggtcatgactagctgagtggtccagggaagatggcagcttggatgcgagtacaggtgagaaagacggagacccaggtatggattcaagaaccatctagggtttggatggatgggatttgggtggtgaatgagaggaatgtgttgatgttatctccactatactctcttggtctgtgaatgcagccaagcattttattagtttcagatcagtagcatcacactatgagtccttgtccaaatcatctttgggccttctgtcttttgggcagagcccctggcacagagaagaagcttaaagaaagtctgttgaatcatgttgacaaaatggattgttaagccaatatattttgaataattattagacgcaggacactgtttaggcattccagggatgccctgattgcagttctctctctacacttaggacattttctgtcttgaggtaataattattttgatagacaacatttattatagcgcctactaagctctgagtgttgtatgagagccttaactacaggcttttagtaggtagtgttgcttaatggttccaaaccctatacggccagactggtatgatattgaatctggttcgtctgtgtgctattgttgaaggctgagtgagggttgtgatcaactcagtataccactggaggctgtatgagtaaacagcaaactgttctcatgaaagcaggatgttggcaaactgacaaactgcgtctgctgcccagaaggaacgctgagggcagtcaagccccaagcacagtgtttcttgtgattaggcgcatctgaagcctgttaccaataatgtgaacctgtgatcaattaagcagctgaccagtcgttacccgctcctccctgctcttgctacccaataaatacgaagggctgtagaaactcagggtggctgctgcctttgctcactagaagcagggagcccttttcttcttcccctggccccttcctttaaaacagtttcttttgtcttaagttttcatttctacgttcgtcccccttcgttcggtctcgtaatgatggtctcaagtagtaacagtagtaactgtcgtagtgatggtctcaagtagtaaccatggcagtctgccacatcctatttttgtagatttggatttccctccattctcttctcttctttctttctctttctttctttctctttttttctttttctttctttctttctttctttctttctttctttctttctttctttctttctttctttctctctctctctctttctttttctttctttctctttctttccctccttccttcctccctcctttccttccttccttttttttttttttcttgatctgttgcccaagctggagtgcagtggcatgatcaagctaaggtgaccctcctgcctcagcctcctgagtatttgggactacaggggcatgccaccatgcttggctaattttgtttattttttacagagacgctctcactatgtttcccaggctggtcttgaactcctggggtcaagtgatcctcctgcctcaccctcccgaagtgctaggattagaggcatgaaccactatgctcggcctgacttggacatatttctcaacctttctgtggctcagtttccttgccttaaaagtgatgataacaatagcacctacctcatagggctgttgtgagagctaaatgagttaatacgtgtaaaacacttcagagccaggcaccttgtaagttctataaaaatgttggctttcatgattaagtcctcacaatcccatctataggtattatgagtcccatttcatagacgagaaaacagaggctgagagaggttagttaataaactacctgcagcctaatataaagtttgataggctcaccctctaccagaaggatgagaatagttcatagtataaaaggagcactttgggcttaaccaaggagcctgcaagctgggctggaggagcaaagcgacctagccagtggaaaaaaaaaaagagcagaaacagcagtgccaagtcttggccacctagagtacattcctttcttgaacagcctaccctttcactcaccctgagcggtctagccttcagctgttctcgttcctgccagaagcctcaggaaagaccttacccatccaccgtgcatttcggtaggagctttggctaaagcagctgtcttcctgtccacacggtgtttccctatccgctgaatcccagtaacaggggtctcactccacacccctcttttattcctcttcctaactgcatgggctgctgagccttctcaccaagaccccctttggtgggagggcagatgcccaaaaggaggattcttttaaaagatcgttaatagtgaaatactgaaatccctttaaaggcagctttctttttgttttgccttgtctctttcagagtcttcagttctgctgaaagtagacattactctctgccaagaaatgggctatgaggctcggataacattacacaggggcaggacttagcgttttggcttagtgttttggacttgtgtgaagttcccaaaataccatcagcagatggtgttgcatttatctgcttagatgctattatcaaagaagacagggggaggatgaggaaggcaaccaccccggaggggcgagtggagaaaattttttcatctcctgtttatttcacagatataattctcatcttgggcatttaattttatgtgtcaaataaagggaacaatttcccagtgcaaatttaactgttgggaaaagtctgatcagggcactgaacattctagcttctgcctagaaagtgaagatttgtgatgtatttttatttccattttaacgttgttgacttctaattctctaagactgtcaattagtcataaaggacatctcaggaatcatgttgctcaactcttgcatcaaccactacctattaattttttcatgtatagcttttatttttaatttagtattcctggaatgataattcttttaaatttcataaaattggagtgaacaagaaataccaagtgcaggtccaattttcttattaggtgaaagggaaataatgacacctactttaatcatgcaatacaagacagcaaattatatattaatttattgagctgtgtctctctttattttttaaatacatttatttatatttatttatttatttattttttgagacggagttttgctcttgttgcccaggctggagtgcaatggtgtgatctcggttcactgcaacctccacttcccaggttcaagtgactctcttgcctcagcctcccatatagctgggattacaggcatgcaccaccatggccagctaattttgtgtttttagtagagatggggtttcaccatgtcggccagggtggtctctaactcctgacctcaggtgatccgcccacttcggcctcccaaagttctgggattacacgtgtgaacaacagtagtttttaaaaatacctcccttttttatataatagctttactgaaatatagttctcacatcatactagtcaccatttaaagtatagagttcaatggtttctagaatatttacagagttgtgcaacaatcatgataatcaattttagaacattttttatcaccccaaaaagaaaccatgtgtccactagcagtgacccgcatcgctccctctccttggcctctgggcagccactgatctatttgctttctgtacagatttgcttaatctagatatttcgtgcaaatggaatcatacaatatgtggtcttttgtgactatgcttttacttagcacaatgcattcaagattaatctacgttgtaacatgtatcaatacttcattctgtgttatgaatgaaataatatttccttgtatggctataccacattttagttatcagttatttgtcagttgagtgctccttttgaggatgtgttaatggtactgtaatgaaattatcatagggcctcacaaatggtgactctgtttttagctcagacttcaggacaagaagtactttttttcattgggaatttaaaagagagagaaaagtaagcaaacatatgcatatatagatgtgggtatgtggatataaactcaccgtatttttaagactatataaaatacttttttttttttgagacagagtcccactctgtcacccaggctggagtacactggcatgatcttggctcactgcaacctctgcctccggggttcaagtgattctcctgcctcagccttccaagtagctgggattacaggcacaggccaccatgcctggctaatttttgtatttttagtagagatggggtttcgccatgttggccaggctggtcccgatctcctgacctcaagtgatccacccaccttggcctcccaaagtgctgggattacaggcgtgagccatagtgcctggcccaaaatactctttgccatggatatatttgcagaatggctaagaggttgagaggaagagaaaattttaatttccaggtaatactctgtagtttaattttttaccacatgcatgaattacttttattaaaatacatgtatacaaaaatcaatataccttcacccctgtgtcagagtgggctttctcactgagaagttataaacagtaaattctctggttagagaagcagaaagctgtaggagcccttagtcagagccagcatttgcaacaggtcagaggaacgttgaggatcacacaggaatcaattcgtaaggactcaactttaataaatgatacttaagtgaagatttagacccaattataaggatggtgccacaagaagaggcatctcagcagagtctgattctccagagttgagtgtggtaggacacagtttgcactgaactcaggcttcagtcctgccagggagatgttttcaccttcttagctggattaagggaggagaccacccctcatattgtcttatgcccaatttctgcctccaaagaaagaagaagtaaaaactaaaaggcagaaatgaaatccacaagcagacagcccagcgccacaccctgggcctggtagttaaagatccacccccgacctaatcagttatgttatctatagattccagacattgcatggaaaagcactgtgaaaatccctgtcctgttctgttccattctaattaccggtgcatgcagcccccagtcacgtaccccctgcttgctccattgatcacgaccctctcacgcagactcccttagagttgtgagcccttaaaagggacaggaattgctcggttgttggaggcgtgagtcttgccgaagctctcggctgaataaagtccttccttctttaactcggtgtctgaggggttttgtctgtagctcgtcctgctacagatgaaactgaacactgatctcagatgcttctgaacatccttggcagttcacttcatatcagtacctataatatggagtttatcactatagtttataggcttagatcttctcaaccaattctttacaatctctacactgtcccaagtgtcactacatattgacatctcaattagatggaccctgtgaaaggaaaatcttgaggcccccaaattactaagctgaagaataaagtgaagctgggaacttctcagggcaaaacctgcctcccattctattaagtcatccctctgctcactgagatagatgcatattctgattgcctcctttggaaaggcttatcaaaaaccccaaagaatgcaaccatttgtctctcacctacctgtgacctggaagccccctccctgcttcgagttgtccctgcctttctggatggaaccattgtacatcttacatatattgattgatgtctcatgtctccctaaaatgtataaaaccaagctgtgccctgaccaccttggggacatgttgtcaggacttcctgaggctgtgtcacaggcatgcatccttaaccttggcaaaataaatggtctaaattaactgagacctgtctcaaattttcagcgttcacattttggtaaccacaaagggattctgagtagagatgcccctgcctttgacaaatctcctatcggtgcctggtaccagcatgagctaactttatgtctcaaaccaataggacaatttgctgaggtctgagagcacgccctccagaaagtccctgatctcccaaaatttggtcgagatctaaagtttattttgctgtacaattcctgctttttttttttttttttggagttttacttgcttccaacacaaggaaggcaagtttttcctgcctccatgacgatgtaagacaaataactcctttatggaatttgagcgcgcatccaacagggaagatcagtttactttttcctgcttctaggttggtagagagcagtcctcagcctgagacccatccctaggtaagtaactgaattggtgtttgtcttggctaaagttaagattaacaaacagctggtcttaatttccccttaccattagcgcgctcagtgatgataaggttgggattttttgttgttgtttgttccagtctttctcccaatggatttgaccaactctacctgacttggtcaaatctgagtgagaattccaaattatgggttacatggcctctctaatttggctaaaattccttgcagctgcaaaaagcaaacaaacgaaaaaaacgtgtttggtttctgtgtttgcagcctgtcttaaaacaaacaaacaaacaaacaaacaaacaaaaaactcgtcctttcatctacttttcttccaccctatacctccttcccccttttgccatttgcagtaccaaaaaatctagagaaggcgtctaatgacttgaaccttgaaccccttttaaagaattcagaacaaaggtgctctcacccccttttagggtgttctgtcttctttgtggagtttcaagagtcatgggcagattctttttaggtctaaagctctgttttcctggattgcatgacctgacttttttggctttggggtaccagagatgactttgcactgtgagatgatttgcccttgacatgtacagtggcaaatgacagctgtgaagttacaggtggttgagcacagtttacaggaagtggtcttggctgtttatttttcttttctctcctaggaagctgttgtttaaggatcctaattctagttcagagatgcattctaaagggtcttctgtattgcttttacttgcaaatttaatcttaattcggtttgtgtgtgcatttgcatgaggaactgaactgttattttcttttcttttttcttttttttttttttttgagacggagtctcgctctgtctccaggctggagtgcagtggcgtgatctcggctcactgcaacctccacctcctgggttcaattctcctgcctcagcctcctgagtaactgggactacaggcgcgtgccaccacgcccagctaatttttgtctttttagtagagatggggtttcaccatgttggccagcatgttgttttcatacgttaatgagagactgagttttctcagcttcaaagagaaaaggcatttgctcctcctagttgaaagttgcccctgggtgaccaggggccttgtgggagtgtctgggggttgacccccctcaatgtgcagtggccctgcagggaaatcactcaaaaacaatttttttaaatggctcatccaagaaatgcatgtaagggctgatcacccaacgttttgagccttctctgaggtcatagacctctagagagagaaactaagacacataagagggtggaaacaactcagtggtaacacactgtggagtcctgttcacaagcggcacatattgatccaccacacaaaaccctaggccacagctcagttcctccttttaagaaaaaagaaagtgggaaacaaataatctaagaatgatgagaaagcaaggagaatgaccccctttggagcagtctgtggattttccgacacatctacctgccaaagattatgtaaaatggaaataatatggtctttatacacatttacttaaggaaaaagagccctaaggtcaatctgcaaactacagtgttcctaagtcctctttttctctattttttcttttctgcctactctaaatctgctgttatttttgtattaagataaataccactgtttagatccaacaagttctttttgcaagttggtgaatttgtgtttatctcatggctaaaagttctgaagtaaaagctataggatctttgtgtgtatgtatgtgtgtgtatgtgtgtgcatatatatttcaaaggcctttataattcctataatttgtttaattggcaattaaatccattttaatttcccgccagcacaccaaactttttctctctgcaccttataatgtaaaatttgctatttgactttcacctgagttgcttcctttaatatacaaatgtaaggctatttagctgacaactaccgagggttgtgaaacaagtcatcaagaatctgaaagtctaacataggaaaataaaaggtttttatgactctataagatgtatttccattggcatgcctagtatgtctatgtatttgtgttttgcatatacagtgtttcattcctaaaaatatataaaagagttctaattaatcagcttaaaaaataaaaacacaagccagatactaaaaaggaaaagactagtcaaatgctttttcaagttatgtaacaagtaaaattaataaataagctagctttaaaattattggtaaagtaatagttgaaatgtctcaagaattaccagaatacatttttgtttgcatttattaatcaagcaatttcatacttatccgggccaaatactataaggtgtcaaaatttgtcacagaggttacaaaactataagcccatctcaagacagaatgatctttgcttgtgtaatctttaataaataagacattgatattggtttaatgaaaatagctacatcttgaattatttagtataattaccgtaacttctaatcttgtggcttcaggcagtctagtccacatggagtaaggaggtctgttttgggaaaggattgttattgcctttgtttcaaagctcaactataaattaaatttctcccaaagtccaggaatgaacaaggacaccttggaggttagaagcaaatggagttagttaggtcatatctttttcactgtctcggttacagttttgcaacagtagttccataactttaaatgactattgcagttttcataaataatctaggtaaacaatatattaaaacaaaataattaggtaaatgtaataggatacttgcagacaaattcatcataatttagaatataaagttttattaaattaaataatagaaatttcattatttgggtattttccaataaaaatataattgtaggaaaacattctttctaaaaaaaagtgtttcctcttaaaaaagttgaacagtttttttctaattcaaagcttatttaaagatcatgtgtaaaacaaggtaaaaggaaccaggaaataaaagagatataaagacagttttttttttttttttttttttttttttttttttttgagacggagtctcgctctgtggcccaggcgggagtgcagtggcgcaatctcggctcactgcaagctctgcctccagggttcacgccattctcctgcctcagcctcccgagtagctgggactacaggcgcgtgccaccacacctggctaatttttgtatttttaggagagacagggtttcaccatgttggccaggctggtctcgaacgcctaacctcaggtgatccacccgccttggcctcccaaagtgctgggattataggcatgagccactgtgctcagccaaagacagttacaaaaataaagaggtattctttattggtaagaaagcttaaagagaaataattttatttgtggaagaatcttgtatggtaaatttagtcctaaaataaaataactagttgtttaagaaggagggatgttcaggacaaactagaaagtccaagcatgtcatgaatggttggtataagtcacaataagaggattaatattttttaaaaatccaaaaacttttaaatgatcaggttgtcatattaagttttggtttgcttaggaaaaaaaccgacatataaaaaatgtttttaactaaggttattacatccatatagcttcctgtatgtgcttttatatttcttgtgactgagttacagggctttgactccctcgcactacacagctcacattctagttgcaaaaactaaactcaataaatgaaaatttaatttcagattgtgaatagtgctaagaggaaatgaataaagtgatgggcaagagtaaaggaaagggcaggacagggcttcttaagatgatcggaaaatctcttttgagaaactatctggaagttgctcagaaggttaaaaatagagttatcatgtgacccagcaattccagtcttagaaatggaaatggaaacataaatccacacaaaaacttgtacaagaatgtagtagcattattcacagctgccaaaaagtagaaatacaaatgttcattaactgatggacagaaaaataatgtgcgatatatccatacaatgaaatattattcagccataagaagaaatgaagtactgatacatgctgcaacagggatataccttttttttgagacatggttttgctgtatcactcaggctggagtacagtggtacaatcatggctcactgtagccttgaactcctgggctcaagctctccttctgcctcagcctcccaagtagctgggatgacaggcgcatgccaccgtgcctggctttcttttttttttgtagagacagtgtctccctatgttgcccaggctggtcttgacctcctggggtcaagtgatcctcccgacttggcctcccaaaagtcctgggattacaggcatgagttcctatgcctgtgcccagcctggatgcacctcaaaagcattatgctaagtgaaagaagccagtcacaaaagactctatgttgtataattctatttgtatgaaatgttcagaagaaacaaatctctagaggcagaaggtaggttagtggctgcctaaggttggagataggatgggaaatgatgagtgactgctaattggtacaagttttctttttaggataatgaaaatgttctcaaattagatgatgatgatggctgccaaactctgtaaacatactaaaagctattgagttgtatgctttaaatgagtgaatttaatggaatgtaaattatgtttcaataagctgtttaaaatacaaagaaaaaaagaaaagttttctccaagaaggtgatatttaaactgggacctgaaagataagaagaaaccagtcatgcaaagagtggggacaagagctttcaggcacagggcacaatgtgtgcaatggtcataaagagagaaagaagggccaggtgtgctggctcatgcctgtaatcccagcattttgggaggccaagttgggaggatcacttgagatcagcagttcaagaccagcctggccaacatggcaaaaccctgtctctactaaaaatacaaaaattagccgggcatggtggcgtgcacctataatcccagctactcgggaggctgaggcaggagaatcacttgagctggggaggaagaggttgcagtgagccaagattttgccactgcactccagcatacgtgatagagtgagactccgtgccaaaaaaaaaaaaagagagagagagaaagaaggctcataaagaaggggcagatcgtagacaaggttggaaaggggccagagcaggcagcgtcttctgaaactttccaggtcaccacgttccatttagacacaaactataatcagacagtatcattcatatggaagtcaacatgaaatatgttaacagcaaaacccatggatgggacagcaagtgaaaagctgttaaccccaaattctacagctgcaaaacacctgactgtggagaaaagaggtatcatcaaattttaaaagggaaaatatttaaaacaacacttagcctataaccagggaagttcattaaattactcccaccattgtcataaagatcaatttctgtagccagctcataaagaattcacatctctagaaggttgttaatgtgttgggtcctatagaacaccaaacaggaacagaaatcaataaagcaatataaatacagacttcatagtatctgaactttgtgagtagctgtaggtgacagatctgagacctgagataaaaggaggagatcaatccaggttgcaccagcatgggatgtagaaagggatcagaggatgaaacagaattccaagtgagaatatatgaatatccaggaaagagaagataaccaatccttacaagttttcatcaacatccttgataaacacactaatactggcctggtcatccatcttatat

SEQ ID NO: 94 - DNA, 3402 bp, Homo sapiens
aatgctactccaacattttcagcactgtttgtatatacatgaactacctcttgcaggaaacacaataaattgataaaaaggccttaggtagcagaggaacaggggagaagagacatgatttttacatatatcctttttgggctttaaaattgtataccagctgtgcacagtggctcacgcctgtaatcccagcactttggaaggccaaggtaggaggactgcttgagcctaggagttttgagatcaacctgggcaacataaggagacccttgtctctacaaaataaaaaataaaacaaaaaacctagctaggcatgatggcatatacctgtggtcccagctacttgggaggctgaggtgggaggattgcttgagcccaggaggtcaaggctgcggtaagccatgatcgtaccactgcactccagcctgggtgacactgagatcctgtctcaaaaaaaagaaaagaaaaattaaaattaaaaaataaaatttgataccatgtagatataatgccaattcagaaagttttttttcaaaagctttttttttttgttttccactctgtcacctaggctggagtgcagtggtgttatcccagctcactgcaacctccacctcccgggttcaagcaattctcctgcctcagcctcccgagtagctgggagtacaggtgaatgccaccacaccctgctaatttttgtatttttggtagagtggggtttcaccatgttggtcaggctggtcttgaactcctaacttcaggtgatctgcctgccttggcctcccaaagtgctgggattacaggcgtgggccattgcccaggtcccaaagttcttttattagataaataacacggatttgctaggagtagtggctcataccatttgaggatgggagtttgagaccaacttggctaacgtggtgaaaccccttcggtgctaaaaatacaaaaaaattagctgggtgtggtggcacgcacctgtggtcccaagcaactcaggaagctgaggcacaaggattgcttgaacccgagaggtgaaggttgtagtgagctgagattgcaccatgcactccatgcacaccactctgtcgctgggcgacagcaagactttctcaaaaaataataataataaatgaaaaataaagcctgtgctaaatacaaatatgaaggttagagaaacctgtgtctttctaaagtgcagtttcttttcctcattattaggtacttaagactgaattggaggccgggcgtggtggctcaagcctgtaatcccagcactttgggaggctgaggcgggcggatcacaaggtcagaagttcaagaccagcctggccaacatagtgaaaccccgtctctactaaaaatacaaaaaattaagtgggtgtggtggtgtgtgcctgaaatcccagctactcaggaggctgaggcaggagaatcgtgtgaacctgggaggcagaggtcgcaatgagccaagattgcgccattgcactccagcctgggcgacagtgcgagacactgtctcaaaaaaaaaaaaaaaaaaagactgaattggaatagttggtaggggacagggacattggagctttgacaaacatctgacttgctatgattcttgttatttgctcctgggcttctctggctggttttagattactaagtaatgtgtgcacaaaacaatatgatagttagggtggctgagtagtgggctccctctaatattttattttcctttatagaacattgtggcaggaacaaaaggggaagctgtgactcttaaataattaaatacattaaaaaagggtaggagaatcaagggttggaagagaagattgcagtagatactcttggctttccttgccctatactaaaacacacctctcctagatatgcatattaactgcctcattcctctgttttgtaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtgtgagttgtgcttgggattagggaactagaatggtatcaaaatcccaaggcaaatgggaacagggctttggggccagatagatcttgattatagaaacccgactgtagctgagtaacactgggaagaatacctctctttcctataaaatggaaataacctccattggattatagttagggttcataatggtgagtatgatgacagtgttgtaaatagccaacacttatacagattgagtatcccttatccaaaatacttggggccagaagtggtttggcttttgaagtatttgcattatatatactggatgagcatctcaaatctgagaatctgaaatccaaaatgttccagtgagcattttctttgagagccatattgatgcccaaaaagtttcaaattttggatttttggattggtatgctcaacctgtatcttatttcccttaggcatttgcaaagtgctttatacgtattaactcatttaattctctcattatttgaaggtaggtaaatttgaaggtagaactgagatttgaattcagataatctgacctcgtgctttaaaccattctactgtaattcagaaaataagtataaaatgtttagcacagtgcctgtctcataattatggctcagtaatattgcttaataatacagttagaataataatggagccttttcacagggcagactttaatgttcaaagctaggagacccagagggtgaagagagctagttgaacatggtcatttttattccttcccggatgcctgtaaaccttgactatttgctaggcatggacttgagttgagggtggtaacatttctaatgtatcctgaatgttggttggtttttttttttcagttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtag

SEQ ID NO: 95 - DNA, 86985 bp, Homo sapiens
agtctgtaatgaatcagttgaattcagagacagagcagtctaaaaagtggcttaaaacgtgctcagatttgttacctgatcctcaagaggtaggaattaaagagggaaaaaaagcccctagtggcaaattgacttaaaaggctaagaacaattagccatttgtagccagcaggtgttaattaataaaactgtccagtactgcatttcagggaaggcatgaatgatgtgatgaactctacaaaaataaagtcagctatatgaaaaaaatctctacatctcaggctctagagagaaccaaatcagaatgaggactcgtttccttgtgtgggcacctggaggggatgaggctgtcctgggcccagaagactcatggcaccttccctgtaccattttgataagaaacagtgaactcttcattcatttcatattggaggaactctgagggctgcagcgttgccctggggggacagcacaagcaagaatgcatcagaaggctagtgccgcaggaatgacacaatctaggtgtctgctctgcacagtgctatgcttactgaattttttgactaataactcatattctacacaatacaaaaaccagactccttttatcttcccttcctgctcctcactctcctgcaaacatttaagacagtgaaggaagattcctcttctaggtgagggagaagtggggtgggatgtttggagagggtggtgatgaactaaaaaataaagaaacacttaggctagtcttcagaatcagtttctgagtttactgtatcaaaacactggagcacacacttagggttggcccaggacactcttcaataaaagtctctgaagataaggaggtagatgtaaaatagaaataatccattctataactctggaagttccaacttcctggaaaactcaatatggagtcatcagctgtctttgttatggaaactgaactctctctctctctctctctccctctcctgtttcacagctaaattaggagacacaaaagagctagaagccttcattgctgatcttgacaaaactttagcaagtaagtacatgtctgatattaaaaacaaaaaaacaaaaaactaacagacacttctgataaagtgttgtaatgttaaccagcttgccctggggcagaaagtttcatcctaagccttctataggtttagaaacaggaccctaggccggggcagtggctcacgcctgtaatcccagcactttggaaggctgaggtgggtggattacctgaggtcaggaattcaagtccagcctggccaacatggtgaaacccaatctctactaaaaaatacaaaaattagctgggcatggtggcgcacacctgtagtcccagcttcttgggaggctgaggtaggagaatcacttgaacccgggaggcagaggttgcagtgagccgagattgcgccactgtactccagcctggtgacagagcaagactccgtcaaaatagtaataataataataataataataataataataagaagaagaagaagaagaagaagaagaagaagaagaaacaggactctagtggctaggaatgaaattctgggataagcttgtgttaaagtagaccatgtgcgtttccaaacagtgagaacaggtcactagcaaacaatggcattttgtttgagaaatggagagcgagcaagactggagcattaccatcatgatggcctgtcaggcttttcagagaagaaatgaactgattaaccacaagtgcattattccaacaagccaaaagtcttccatcccatgggccagggtaattttcccaggttagatccagggtttgggtgaaatttaactttaagatgtgggtgccaaaagagagaattggcttgtggggcctttcaccagagacccatgccagtgactgaatgacctggattaggtatgcatacttgcaagcctcttatttgggaattacactaatggttacctgttttgtgtgaccaaaaatgttgagaactgaagacatcaaattataactgcagtataggggcccagaagaagggaccctcacaatctatctacacactctatttccaaaggataagattgcaagagccaggaggaccaactccagcttctgggatggaaggttcagcaactctactacggggggtcctgtttagtcacagagtgggctaggaaaattttgtcccagccccttaattttccagggtaagggttgattttctgtgagaagtatttaatgctattctttgctaaagagccgggtaaactctgaaaaattaaatccaaagctggttatttaaaaataactatgttcttaacactcttgcagacaaacctaaatatcagatagaaagtccttgtatcatttctatttgaaaattgaagattttattgcctcttttcttatgtactgcaccatcttacatcagaagaccagggcttgttttgacagggattattataattgcagcataatttgtattagacccatgtaacaagcctgtctacttcatggaaattgcagtgggttgcccagtcattccagttaatcagacactcatcgtgtgggaagcccagcattgagtttggtgctttgatgcacgtctgagacagtgtgatgtggttaagcataggaattgtgagcctctgagtggataaccttacctatctctcatttacaggtatgtgaaacaagaagttctgggtcctttcatcataagggagaagcttcagaaagttccgaggacctgctaaaatcagctactagaatctgctgccagaggggacaaagacgtgcactcaaccttctaccaggccactctcaggctcaccttaaaatcagcccttgatcccatttctgggcaatttagacagtgaaactgactttgtttacctgcttgcagcatattagaacagacgatccatgctaatattgtattttctcttaaaacatagctttcctgtaatttaaagtgcttttatgaaaatatttgtaattaattatatatagttggaaatagcagtaagctttcccattataatatatttttgtatacaaataaaatttgaactgaagtctgcttccttttctttttctttattttttaaaatatatttccattcaaataatattctagtgggagtaacatgcctcttgtttccttagcaaggcccctgggtgctgtctgattgcactagacaagaggacagtaaacttaaagtgttcctttagctcattcagtgctctggaaggaaatgctggcagacggctgctgggaaattttaatttcaggattgtgatttcattggaagttaggtttctattctgtctctgccctccttctcatatcttggcaccattgcaggtggcatggactctttctttgaattaagggaagtaccagttcttacaatccaggacttaaatacgagggaaagttgagatagctggaagacttgaaaatgatggtgcttttctaagatctgtgtggaggaagattgatggtgctggttttcatggaatgtccagcaaacctctggtgtgaagagtttgacgggtgggctttgcacatagaagccactgaccacttctcccacttgcctttgtgggggctggagagaggcataaaaataagaaagctcataattttcgtatctatgcttttctgtctttaaaacctcctctaaaataaccaggcattactttcataatcagaataaagttattttaaaacttgaatccctatattcctaaaggacataaatccaaaacataactacttataattttacttgtatcttcaaaagctaactactatatttgatgtgttttttagggaatcgggaaactaaattgcttttctttaacttttttcttttcctcagcttccaggaaaacttttgggttgaactcaaatattttctttatttcttttttaaaaattgagatctaattcacatactacagcacccagttcagcggtttttagcatatccacaggtactgcagccatcaccactgtctatctacttctctgtctccacgaacgtgtctattctggatctttcatataacgaatatgtaatcttttgtgtctggcttctttcacttagcatagtattttcaaagttcatccatgagtagcatgaatcagtacttcatttcttttcacggccaaatcataatccactgtgtggatatgccacagttgtttatctgttcattggttggtgaagatttgggttgtttccactttttagctaacaaataatattgttatgaatacccatgtattagtttttgtgtggacatatgttttcatttctcttgggtgtataactaggagtggaattcctgggtcgtatgttaattctgtttaactttttgagaaactgtcaaacttttccaaagcagtttggaaaaaccattttacattcccactagcaatgtatgaggattccagtttctctaaatccttgccaacttgttattgtctgccttgtcattctagcaggtgggaagtggtatcacattgtggttttattttacatttcttttttttttttttttttgagatggaatcttgctctgtcgcccaggatgggtgctagtggcgggatctcggctcactgcaagctctgcctcccgggttcacgccattctcctgcttcagcctcccgagtagctggactacaggcgcccgccaccacgcccggctaattttttgtatttttagtagagacagagtttcaccatgttagccaggatggtctcaatctcctggcctcgtgagcggccctcctcggcctcccaaaatgctgagattacaggtgtgagccaccacgcccggcctattttgcatttctctgtgactaatgatgtcttttcatgtgcttactggccatttgtatatcttctttggagaaatgtctattcaaatccttggcccattttaaaattaggttgtctttttaactttttttaattttagtttttgtgggtacatagtaggtgtatgtatttatggggcacataaattgttttgatatgggcatgtaatgtgtgataatcacatcatggaaaatggggtgtccactccctcaagcatttatcctgtgtcacaatccaattataccattttagttatttttgaatgtacagttaaattattattgactatagtcaccctgtcatgctatcaaatactaggccttattcattcattccaactatactttgtgcccattaaccatgcctacccttcccagcctctggtaaccaaccttctactctataattccatgggtttaactgttgacttttggatcccacaaataagtgagaacatgcgatgtttgtctttctgtgccaggcttatttcacttaacataatgacctccagttcaatccatgttgttgcaaatgactaaatctcattcttacgactaaatagtactccagtttgcgtaagtaccatgttttcttcatccatgcatctgttgatggacacttaggttgcttccaaatcttggctattgtgaatagagctgcaacaaatatgggagtgcagatatctctttgatatactgatttccttttttgggggacatatacccagcagtgggattgctggatcatatggtaggctctatttttagttttctgtggaatctccaaactgctcttcatagtggctgtagtaatttacattcccaccaacagtgtacaaggattcccttttctctacatccttgccaacatctgtcattgcctgtcttttggataaaagccattttaactggggtgggatgatatctcattgtagttttgatttgcatttctctaatcaataacgtagagcaccttttcatatgtctgccatctgtttgtgttcttttgagaaatgtctattccaatcttttgcccatttttaaatcagattattagattttttttcctatagagttgttttagctctttatatattctgactattaatccattgtcagatgggtaatttgcaaatattttctcccattctgtgggttgtctcttcactttattgattgtttcatttgctgtgcagaagctttttaacttgatgttaccccatctagtccatttttgctttagtttcctgtgcttgtggggtattactcaagaaatctttgcccagactgatgtcttggagagcttctccaatgttttctttttgtagtttcatagtttgaggtcttagatttaagtgttaaatccattttgatttgatttttgtatatagtgagagaaggaggtctagtttctttctttgcatatggatatccagttttcccagcatcatttattgaagagactgtcctttccccagtgtatgttcttgccacctttgttaaaaatgagtttactgtaggcatgtggatttgtttctaggttctctgttctgttccattggtctatgtgtctgttgttatgccaggaccatgctgttttggttattatagctctgtagtataatttgaagtcaggtaatgtgattcctccagttttgtcctttttaaaatttttttttattatactttaaattctggggtacatgtgcagaacacgaagttttgttacataggtatacatgtgccacggtggtttgctgcacccatcaactcgtcacctacattatgtatttctcctaatgttatccttcccctaccctcccccaacccccaataggccccggtgtgtgatgttcccctccctatgtccatgtgttctcattgttcaactcccatttatgagtgagaacacgcggtgctcggttttctgttcttgtgatagtttgctgagaatgatggtttccagcttcatccatgtccctgcaaaggacatgaactcatccttttttatggctgcatagtattccatggtgtatatgtgccacattttctttatccagtctattattgatggacatttgggttggttccaagtctttgctattgtgaataaagctgcaataaacatacgtgtgcttgtgtctttatagtagaatgatttataatcctttgggtatatacccagtaatgggattgctgggtcaaatgatatttctagttctagatccttgaggaattgccacactgtcttccacaatggttgaactaatttacacacccaccaacagtgtaaaagtgttcctatttctccacatgctctccagcacctgttgtttactgactttttaatgattgccattctaactggtgagagatggtatctcattgtggttttgattgcatttctatcatgaccagtgatgatgagcattttttcatgtctgttggctacataaatgtcttcttttgagaagtgtctgtttatatcctttgcccaatttttgatggggttgtttttttcttgtaaatttgtttaagttctttgtagattctggatattagccctttgtcagatggatagattgcaaaacttttttcccattctataggttgcctgttcactctgatgatagtttcttttgctgtgcagaagccctttagtttaattagatcccatttgtctattttggcttttgttgccattgcttttggtgttttagacatgaagtctttgcccatgcttgtgtcctgaatggtattgtctaggttttcttctaggatttttatagtcctaggtcttatgtttaagtctttgatccatcttgatttttgtataaggggtaaggaaagagtccagttccagttttcagaatatggctagccagttttcccaacaacatttattaaataggaacattttccaaattgcttttttgtgtcaagtttgtcaaagatcagatggttgtagatgtgtggtgttatttctgaggactctgttctgttccattggtctatatatctgttttggtaccagtaccatgctgctttggttactgtagccttgtagtatagtttgaagccaggtagcatgatgcctccagctttgttcttcttgccaaggattgtcttgtctatgcaggcccttttttggttccatacgaagtttaaagtagttttttccaattctgtgaagaaagtcagtggtagcttgatggggatagcattaaatctataaattactttgggcagtatggccattttcatgatattgattcttcctatccatgagcatggaacgtttttccatttgtttgtgtcctctcttatttccttgagcagtggtttgtagttctccttgaagaggtccttcacatcccttgtaagttgtattcctaagtattttattctctttgtagcaattgtgaatgggagttcactcatgatttggctctgtttgtctattattggtggataggatggcttgtgatttttgcacattgattttgtatcctgagactttgctgaagttgcttatcagcttaaggagattttgggctgagatgatggggttttctaaatagacaatcatgtcatctgcaaacagagacaatttgacttcctctcttcctatttgaatacgctttatttctttctcttggctgattgccccagccagaacttccaatactatgttgaataagagtggtgcgagagggcgtccttgtcttgtgctggttttcaaagggaatgtttccagcttttgcccattcagtatgatattgactgtgggtttgccgtaaatagctctgactattttgagatatgttccatcgatacccagtttattgagagtttttagcatgaaggggtgttgaattttgtcgaaggtcttttctgcatctattgagataatcatgtggtttttgtcattggttctgtttatgtgatggattctgtttatcgttttgcatatgttgaaccagccttgcatcccaggtatgaagctgacttgatcgtggcggatatgctttttgatgtgctgctggatttgatttgccagtatctttttgaggattttcatatcgatgttcatcagggatattggcctgaaattttatttttttgtcgtgtctctgccaggttttggtatcaggatgatgctggcctcataaaatgagttagggaggattccctctttttctattgtttgaaatagtttcagaaggaatggtaccagctcctctttgtacctttggtagagttaggatgtgaatccatctggtcctggactttttttggttgataggctattaattactgcctcaatttcagaacttgttattagtttattcagacattagacttcttcctgatttagacttgggaagggtgtatgtgtccaggaatttatccatttcttctagattttctagtttatttgtatagaggtgtttatagtattctctcatggtagtttgtatttctgtgggatcggtggcgatatcccctgtataattttttattgcgtctatttgattcttctctctttgcttctttattagtctggctagtggtccattttgctgatcttttttaaaaaaacagctcctggattcattgatttttttgaagggctttttgtgtctctacccccttcagttctgctctgatcttagtcttctgctagattttgaatttgtttgctgttgcctctctagttcttttaattttgatgttagggtgtcaattttagatctttcctgctttctcgtgtgggcatttagtgctagaaatttccctctacacactgctttaaatgtgtcccagagattctcatacattgtgtcttcgttcttattggtttcaaagaacatctttatttctgctttcattttgttatttgcccagtagtcatttaggagtaggtcattcagtttccatgtagttgtgcagttttgagtgagtttcttaaacctgagttctagtttgattgtactgtggtccgagagactgtttgttatgatttccattcttttgcatttgctgaggagtgttttacttccaattatgtggtcaattttagaataagtgcgatgagctgctgagaagaatgtatattctgttgatttggggtgaagagttctgtagatgtctgttaggtctgcttattccagagctgagttaaagcctggaatattcttgttaattttctgtctcgttgatctgcctaatattgacagtgggatgttaaagtctcccactattatgtgtgggagtcaaagtctgggagtcttaagtctctttgtaggtctctaagaacttgctttatgaatctgagtgctcttgtattgggtgcatatatatttaggatagttagctcttcttgctgcattgatccccttaccattatgtaataccctttgttgtctcttttgatatttgttggtttacagtttgttttatccgagattaggattgcaactcctgcttttttttgccttccatttgcttggtaaatattcttccatcctttattttgagcctatgtgtgtctttgcatgtgagatgggtctcctgaatacagcacacccaatttgccagtctgggtcttttaattgggcatttagcccatttacatttaaggttactattgttatgtgtgaatttgatcctgtcattatgatgctggctggttgttttgcccattagttggtgcagtttcttcatagtgttgatgttctttacaatttggtatgtttttgcagtggttggtaccagttgttcctttccatgtttagtgcttccttcaggagcttttgtaaggcaggcctggtggtgacaaaatctcttagcatttgcttaactgtataggattttatttctccttcacttatgaagcttagtttggctggatatgaaattctgggttgaaaattcttttctttaagaatgttgaatattggccccattctcttctggcttgtagggtttctgcagagagatctactgttagtctgatgggcttccctttgtgggtaacccgacctttctttgtggctgcccttaacattttttccttcatttcaaccttggtgaagctgatgattatgtgtcttggggttgctcttctcgaggagtatctttgtgatgttctttgtgtttcctgaatttgaatgttggcctgtcttcctaggtgggggaagttctcctggataatatcctgaagagtgttttctaacttggttccgttctcctcggcactttcaggtacaccaatcaaacatagatttggtcttttcacatagtcccatatttcttgaaggatttgttcattccttttcactcttttttctctaatcttgttttctctctttatttccttaagctgatcttcaatcactgataccctttcttctgcttgatcgatttggctatggatacttgtgtatccttcacgaagttttcgtgctgtattgttcagctccatcaggtcatttatattcttctctacactagttattctagttagcaattcatctaacctgttttcaaggttcttagcttccttgcattgggttagaacatgctcctttaggtcagaggagtttattattacccaccttctgaagcttacttctgtcaattagtcaaactcattctctgtccagttttgttcccttgctggtgaggagttgtgatcctttggaagagaagaggcattctggtttttggaattttcagcctttttgcactggtttctccccatctttgtggatttatctacctttggtctttgatgctggtgaccttcggatggggtctttgagtggatgtgctattcctttctgttagttttccttctgacagtcaggcccctctgctgctggtctgctggagtttgctggaggtccacttgcgaccctatttgtctgggtatcaccagcagaggttgcagaacagcaaagattgctttctgatatttcctctggaagcttcatcccagaggggcacctgccagatgccagccagagctctcctgtatgaggtgtctgttggcccctactgggaggtgtctctcagtcaggatacatggggtcagggatctgcttgaggaggcagtctgacccttagcagagcccgatcactgtgctgggtggtccactgctctcttcagagacatcaggcagggacatttaagtctgctgaagctgtgcccaaagctgcccctttccccaggtgctctgtcctaggaagatgggggttttatttataagtgcctgactggggctgctgcctttttttcagtgatgtcctgcccagagaagggaaatctggcagtctggcctcagcagccttgctgagctgcagtgggctctgcccagttcgaatttcccagtggctttgtttacactgtgagtgtaaaaccacctactcaagcctcagcaatggtggatgtccctccccactccaagctcgagcatcctgggtccatctcagactgctgctgtgctggcagtgagaatttcaagccagtggatcttagtttgctgggctctatgggggtgggacccaccgagccagaccccttggctccctggcttcagcacccctttccaggggagtgaacggttctgtctcgctggcattccaggcaccattggggtatggaaaacaagaactcctgcagctagtttggtgtctgaccaaatggctgcccagttttgtgcttgaaacccagggtcctggtggggtaggcaccggagggaatctcctggtctgtgggttgtgaaaaccgtgggacaagcaggagcagactcagtccctcacggcttcccttgggtgggggagaaaattccccaaccccttgcacttcctgggtgtgatgacgccccaccctgcttcagctcgctctctgtgggctgcacccactgtccaaccagtaccaatgagatgaaccgggtacctcagttggaaatgcagaattcacccgcctgcatcgatctcgctgggagctgcagaccggagctgttcctattcggtcatcttgccagcgctattcccagttttgttcattttgctcaggatagctttgactgttctgggtctttggtggttccaaagaaattttaagattatttttctatttctgtaaagagtatcattggtattttgatagcgattgcattgaatctgtagattgctttgggtagtacagacattttaacaatattgattctttcaatctatgaacatggaatatttttccatttttttggtgtcctcttcaatttctttcattggtgattatagtttttgttatacagttctttcactttggttaatccctgggtatttaattttatttgtggctattacaaacaggattacttttttatttctttttcagattgttccctattggcatatagaaatgctactgatttttatatgttgattttgtatcctgcaactttactgaatttgtttatcagttataatagttttttggtggagtctttaggtttttcaaatataagatatcatctgcaaacaaggataacttgacttcttcctttccaattggatgctgtttctgtctttctcttgttgctctagctagaacttccagtactatgatgaataacactggtgaaagtgggcatttttgtcatgttccagatcttaggggaaaggctttcagtttttcctcagttagtatgatattagctgtgggtctgtcatatatggcttttattatgttgaggtatgtaccttttatacccaggtttttgagggtttttatcatgaagggctgttgattttatcaaatgacttttcaacatcaaatgaaatgatcttatggtttttgtcctttgatctgtgatataatgtactacattgattgatttatgtatattgaaccattcttgcatccctgggataaatccatttggttatgatgaatgatctttcttttttaaattattattatacttcaagttctggggtacatgtgcagaatgtgcagatttgttacatagatatatgcatgccatggtggtttgctgcgcccatcaaccctcatctacattaggtatttctcctaatgttatccctcctctaacccccaaccccaacaggccccagtgtgtgacgtccccctccctgtgtccatatcttctcatttttcaactcccacttatgagtgagaacatgcagtgtttgattttctgttcttgtgttaggttgctgagaatgatggtttccagcttcatccatgtccctgcaaaggacatgaactcatccttttttatggctgcatagtattccagagagtatatgtgccacgttttctttatccagtctattattgatggacatttgggttggtaccaagtctttgctattgtgaacagtgctgcagtaaatatacgtgtgcttgtgtctttatagtagaatgatttataatcaaactgaatccagcagcacatcaataagcttatccaccatggtcaagttggcttcatacctggaatgcaaggctggttcaacatatgcaaatcaataaatgtaatccattacataaacagaaccaatgtcaaaaaccacatgattatctcaatagttgcagaaaaggccttcgataaaattcatcaccccttcatgctaaaaactctcaataaactaggtattgatgaaatgtatctcaaaataataagagctatttatgacaaacccacagtcaatatcatactgaatgggcaaaagctggaaacattccctttgaaaaccagcacaagacaaggacgccgtctctcaccactcctattgaacatagtattggaagttctggccggggcaatcaggcaagggaaagaaataaagcgtattcaaataggaagagaggaagtcaaattgtctctgtttgcagatgacatgattatatatttagaaaaccccatcatctcagcccaaaatctccttaagctgataagcaacttcagcaaagtctcaggatacaaaatcaatgtgcaaaaatcacaagccatcctatccaccaataatagacaaacagagagccaaatcaggaatgaactcccattcacaattgctacaaagagaataaaatacctaggaatacaacttacaagagatgtgataaatgatctttctaatgtattgttgaattcagtttgctagtattttgttgagggtttttgcatcaattttcatcagagatattggtagttttcttttttgtttatgtgtctttgtctggttttggcatcagggtcatactggcctcatagaatgagtttggaagagttccctcctcctctatttttcagaatagtttgagtaggattggtattagatcttcttaaaatggttggtagagttcagcagtgaagccattgggtcctggtcttttctttactgagagacttttttattatagctttgatatggttacttgttattggtctgtttgcattttggatttcttcatggttcaatctttgtaggctgtatatgtctaggaatttgtccatttcttctatattttccaatttattggtatgtatttgctcatagtagccactaatgatcctttgaatttctgcaatatcagttgtaatgtctcctttttcattctctgattttatttatttggatcttctctcttttttaattagttactctagctgaaggtgtattttgtttaacttttcaaaaaaccaacttttcatttcattgatcttttgtattgctttcttcatttcaattttatttatttctcctctggtctttattatttcttttcttctactaattttgggtttgggttgttcttgctttttttgttctttaagatgcactgtggatgggtgcggtggctcacacctgtaatcccagcactttgggaggccgaggtgggtggatcacctgaagtcaggagttggagaccagcctgtccaacatggcgacactctatctctactaaaaatacaaaaaattagcagggtgtggtggagggtgcctgtaatcccagctacttgggaggctgaggcaggagaaacgcttgaacccgggaggcggaggttgcagtgagctgagatcgtgccattgcactccagcctgggcaacaagagcaaaactccgtctcaaaaaaaaaaaaaaagaaaaaaagatgcattgttagattacttttttggtttttcctctttttcgatgtaggcacttacagctataaaattccttcttagtactgcttttgctgtatcccataggttttggtatgttatgtttccattatcatttgtttcaagaaaattttcaatttccttcttaatttcttcattaacccactggtcattcaggacatattgtttaatttccatgtatttgtgtagttttcaaaattctcttgttattgatttctagttttattctattgtggtcagagaagatggttgatgttatttcaattttttaaatgttttaagacttgttttgtgacctaacatatggcctgtccttgagaatgatccatgtgctgaggaaaagaatgtgtattctgtagccattggatgaaatgttctgtaactatctattagatccatttcttgtatagtgcagattaagtccaatgtttctttattaattttctatctgcaagatctgtccaatgctgaaagtgggggtgttgaagtctccagctattattgtattgaagtctatctctctcttcagctttaataatttttgccttatatatctgggtgctccagtgttgggtgcatatatatttaaaattggtatatcttcttgctgaattgacccctttatcattatattgtggcattctttgtctctttttatagtttttgtcttgaaatcaatttgactgatattagtatagctactccttctggtttttttttgttttggtttccatgggcatggaatatctttttccatccctttattttcagtctatgtgtgtctttatatgtgaagtgtgtttcttgcaggcaacagataaatggctcttggtttttcatccattcaaccagtctatgtcttttgattggagagtttagttcatttacaatcaaggttactattttgttttttttttgaggcagagttttgctcttgtcacccaggctggaatgcaatggtgtgatcttggctcactgcaacctccacctcctgtgttcaagtgattctccagcctcagcctcctaagtagctgggattacaggcacccactaccacagctggctacttttttttctatttttagtagagatgggttttcaccatgttagccaggctggtctcgaactcctgatctcaggtgatccacccgccttggcctcccaaaatgctgggattacaggtgtgagccaccacacctggccaacaatcagtgttactactgataagtgaggacttctgccattttgtcagttgttttctgattgttctgtggccttcctctctgtcctttctttcctacctgtcttcattttagtgaaggtaattttctctggtgatgtgatttagtttcttgctttttatattttgtgcttatgttgtatggattttagtttgaggttaccttgaggcttgcaaacactatcttataacccattattttaagtggataacaacttaaaactgtttgcataagcaaacaagcaagcaaaaagaaaactaacaaagatgctatgccttaaatttgtccctccacttttaaacttcgttgttgctgtttatatcttattgtattatctatgtcttgaaaagttgtcgtaattattatttttgattggttcattgtttagtctttctacttaagagtagcttacacatcatagttacagtgttataataatctgtgtttttctgtgtacttactattaccagtgagttttgtaccttcggatgattccttattgctcattaatgtccttttatttctgattgaagtcctccctttagcatttcttgtaggacatttctggggttgatgaaatccctcagcttttgtttgtctgggaaagtcttttatttccctttcaggtttgaaggataattttgctggatatactattctagggtaaaagttttttccttcagcattttaaatacatcattgcactctctcctggtctataaagtttccactgaaaaatctgctgccagacatgttggaactccattgtgtgttatttttttcttttcttttgctgcttttggcatcctttctttatccttgacctttgggagtttgattgttaaatgccttgagatagtcttctttgggttatatctgtttggtgctctataaccttcttgtacttggatattgatatctttctctaggtgttggaaattctctgttattatcattttgaatagactttcttctcctctttctatctcctctttaaggccaatacctcttagatttgctctttagaggctattttctagatcctgtaggcatgcttcattctttttcattcttttttattttgtctcctctgactgcattttcaaatagcttgtttcattcttttttattctgtctcctctgactgtacattttcaaatagcctgtcttcaagttcactagctcttttttctgcttgatcagttctgctactaaaagactctgatgcattattcagtatgccagttgcatttttcaactccagaatttctgcttgattctttttaattatttcaatctcttgttaaatttatctgatagagttctgaattccttctctgtgtcatcttgaatttctttgagtttgctcaaaacagctattatgaattctctgtctgaaaggtcacatatctctgtttctccaggattggtccccagtgccttatttggttcatttggtgaggtcatgttttcctagattgtattaatagttgtagaagttcgtctgtttctgggcattgaagaggtaggtatttattgtagtctttatggtctgggcctgtttgtacctatcctttttggcaaggttttccagatattcaaaaggacttgagtgttataatctaagctgtatctgctttagggaagaccccaagcccagtaatgtggtggttcttccagactcatagaagtaccaccttgatagtctcggacaagatctggaagaattatctgggtttccaggcagagactcttgttctcttctcttattgtttcccaaacaaatgggtgctctctctctctctctctctctttgttctgagccacctggagctaggagtggagtgacacaagcacccttgtggccaccaaccctaggactgctctgggtcagacctgaagctagcacagcactgggtcttgtctgaggcctgctgtaaccactccctttctactgcctatgttagttcaaagcctgggggttttacaatcagcaggtggcaaagccagccaggcctgtgtccttcccttcagggcagcaaattcccccaggcattgggtgggtccagaggtaccttcttggagtcagagactagaggcaaaaaccttagaagtctgcctggtgttctattttcctgtcactcagctggcgctcacaccataagacacagtccttcccactcttccctctccattccagaggtagaggagcctcactccatgaccactgtcacctcaggcccacatggagtactgccagactaccactgatgttcccttaaggttcaaggccacctgagtcagctcgtggtgaatgctgcctggcctgggactcacctttcagaggagtggaccctctacacaggtctagaaatgccatccaacagccaagtcctggaatagggaaccccaagagaatacttggttctctaccccactgtggctgagctgatatctaagttgcaagacaaagttccctttactttttgctccactgtctcaagcaggagtcttgccccatagccaccagagctgggaaagtgctgagtctcacctgaatccagcaagactcagtgtctcacccaagaccctcaacctagtacctgggtattgctgctggtattcaggacctaagggctctttagttagcaggtgatgaatcttgctaggactgggtcttttccttcaaggctgcagattctcttctgggccaaggtgtggctagaaatgtccaggggctagggcctggaatgggggccccatgactctcaccagtgccctatcctgctgtggctgagctggtatccaagatgaaagacaaagtcctcctaactcttccatctcctctcctgaagcaaaaggaaggggtcacttttggagccatgagctatgcaacccggggtgggtggggggtgatgccagcactcccttagacaccccaactggtgtctcagtaggtcacgtgcttcccctagtccactgtttctgggcccagttcatcccaggaattgcctaggtgttacaatccttgtggcctagactgcctttcaagtgtatctggggctccagagtactttagtccaaggtgatgaggcttgcgggaactgaagttcgtactgctgggatcagagattcccctctgtctagggtttaaatgtttcctctgtgggcatgtgtcagcttagtttggtctggttttgctttctcttataacaagggtagcactgaattcaatgcctcacaattgctggtttcagtgcctctctcagagatatgaagttaaaaccaggtactgtgagaattcacttgatttttgggtcttacaaaggtgcttttaaattgttaatagttgcttttaaagcaaaggaaaggtgcttttaaattgtttaattgttgttaaattggtgtccttgtgggaggtgatgatctgtggagctttctattccatcttgctccacctctccctaggttgtcttctttctgtttagttgtaggagctttcttttctttttttcttttgagatggtgtcactctgtcacccaggttggagtgcagtagtgccatcacggctcactgcagcctcaaactcctaggctcaagtgatcctcccacctcagcctaatgagtagctggaattacaggtgcatgccaccacacccgcctaatttttgtatttttttgtagagatgaaattttgccgtgttgcccaggctggtctctaactcctggatgcaagcaatccacttgcctcagcctcccaaagtgctagtattacaggcatgagccactgttcctggctaagtcgtaggagtttacaatgtattctggatacaagttccttaccagatatagaatttgcaaatattttcttgtattttgttggttttcatcacttttttgttctttgaaagataaaagttttaaattttgatgaagactaatttattttttattttgttgcttgtgcttttggtatcatacctaagaaaccattacctgatccaaggtcacaaagagttacttctatgtttttttttttttttgagacagagtctccctctgtcgcccaggctggagtgcagtggcacaaactcggctcactgcaagctccgcctcccgggttcacgccagtctccggtctcagcctcccaagtagctggtactacaggcgcctgccacaacgcccagctaatttttgtatttttagtagagatggggtttcaccacgttagccaggatggtctcgatctcctgaccttgtgatccacccgcctcggcctcccaaagtgctgggattacaggcgtgagccaccgcgcctggccactcctatattttatgagttttatagttttagcttttatattaggtcattgatgcactttgtgttaatttttatatatggtgtgagatgaggtctaacttggttcttttgcgtgtgaatatccagttatcatagaactatttgttaaaaagacaattttccccactgaactgtattggtacctttgttgaaaatcaatagactattcataggtttatttatggattcttaattctattctattgatccacatgtctatccttattccaataccacagtcttgatttccatagttttatagcaaggttgaaattggaagtgtgagtctttcaactttattcttcttttgccagattattttgactgttctgggtccctgcatttccatatacattttacttaacttatttattttatttgattttcgtagagatgggggtcttgctttgttgcccaggctggtctcaaactcctggccttgagcgagcctcccaccttggcctcccgaagtgttgggattaaaggcatgagctgccacacctggcctccatattaatttcagtatcagtttattaatttatgcaaaaaaggtagataggatttttcacagagattgcattgaatttatagatcagttttgtgagtattgccatcttaacaatattaagtcttccttgcaattcatgagcaagaaatttatttaggtctttaaattaattttggtctttaatttttttcaactatgttttgtagttttcacagtataatttttgcatacttttggttaaattcattccttttttgatgctattttaaatggaagagttttcttaactttattttcagatttttcattgctagcatagaaataccatttatttttgtatactgatgttgtattctgtacccttgctgtacatatttattaattcgatattaattctaataagttttttttttgcgagggtggatgtgtggattctatacacatcatattatttgtgaataggaataattttacttcttcttttacagtctgaatgccttttatttcttcctcttcccttcttaacctagttagaacttccagtacagtattaaaaagaagtggtgaggtgacacatcctcattctgttcctgatcttagaggaaaaactttcagactttcaccatcaaatatgttagttgtgggaatattttctttgttagccaaataagctcttgacttgttttcaaaacttaatttttccattacctggatctggttcttattcatgcttgggaacctgtatctgctttgggcaatttttttttcatcatggcaccagcagctgttcattttcactgtaacttttattattagtctcttctggaatggaagatctaactgtgtttggctgctgtttcttcacgagctcctgggatctggactccccaagtcagaagtgtaaggtgtgaagctttgtggcttgttgtgaagagaaagtcagtggttttgggaaaagaaatggatctctttacataagtgtgtgtgtgtgagagagagagagagagagagagagtgtgtgtgtgtgtgtgtgtgtgtgtgtgtgtgtgtgtgtgtggagtgggggagggggcgcgggtagtttgtactccataagcttcttttggataatgacttaagggcaaatgggctgtggactcagtcacagtttggagttctgggaatgttgaaaaaagtattttcagagtttcccaagatatgtttcaaggagaacagtcctaactcgttttgcaaaaattgctgttaaggtcatatgtgcttgagaaatgctgcatgctataggctccacttggagattcattatgcatattagtgcttatattacttaggggccagtctaagttctggatcaaagaccccaagatacagtggctcaaacaagatggaagtttctttctaacaatccagagatgattagtacaaggctgagtaggtggctttctggtccaaagtggctgctcctgctcttgtcatcacatttacatcccagccagcagaaaggagaaatggcaagtcaaacataggcttatttctttaaacaacatgactagaagagacacctcacttctgctcacatccccttattcagatcttacatcctcattcccagctgaaagggaggccaggaaaaagcatctagctggcatatatgtgttcagctaaaatttaagagttttattattaaagaaagaggaagagaatgactattggagaacaactagttatctctgccacagcatattgaaggctttgagaaatcctgcagctaagagatttggtctgtttttggtttttgttttgtttgttgatgaaaaagctaccaataatccagagtcattagtgttccttggaacatgccttgggaaatgcttttataggtaacctcaagtcagcggggtctattgcactccccttcctccaagatctgagtgctgagaccatggccttgcaaactgcctgattattatttggagagtgtcagctagtgggcttttctggaacagaacgagactggatattgtatatgggaagctggtagaatattgtgcatgcaaagctggtatgtttttgagtttggaaattctctgttctaatttcagggaggaacagttagagcaaaacaaaatgacaaatactgcacacacccaagagtaagaggctctagtgccagcccaaatatttatacaccagccagcctccagaatgggacagaagaaccaatgaataccttttccctgggggatcatgacagaggtaggctacattgcatgttccacatgtgagaggcatgtctgaaatgaggagcagtagaagggcggccattggcaattagtcaaggttgggaatcctgaggaggcttctccatgggaacatccccctgggtctgggctgaggaaaggaggagaaagtatgagctttcaggctagacagggttcaaatcccagctctgccttgtagtagctgggtgaccttgagcaagctctttaacctctcagaggctctgtttcctcatttgtaaagtgtaggtgtgagtcactgtctcctagggtcattgcaatgatcaaatatagaaaagaaaaagtgtctggcactcctcctcctccttttcataccacaaggacattgggctcctgtacccaaggtaaaattaagctttgcctacagtggctgcagagggcagttctagccccattattccttgtctgatagaagaaagtggcaaatctggcctaatgcaatcacagcgaggaaggcagagaaaaaacactgggcaaaggggcaggagagagggtgaaagccccagtcctgctgtgaactggatcccttcccctctctgggcctcagattcctccaagttaatcggactaaatggcctggggtctgttcagttcatacagttggtgggctctggccttatcctcagactgccagctcttctctgaaaaatagatggaatttttcttgaattttcagtatgtgcaagaagcacgtacttctccaaaatgccttcctgtgttaatttatttgactaagaaggtttgcagtgacagacaccaaacaggaaacggctgtcatagctgctgtctgcaagttttgtttttttttaaggctttctcctgcacaactcaccttctcttcatggcttggtatcaagtgctggggtgaatggaagggaaagggaaagggaaacacatttttagaagggaacattttccttcaagttcagggtctactgaaggttaaggagtatgactatccacaatggcagcgttaggtggctccattgcagggcctttgcacactcagttccctctgcctggaatgtccactctgctcggtttttctagttaattctacttctttaggatcagctcaagcatcactttctcagagtcttccagatccgtctagattgtttgttggtgctgtgttcttgtagaaccttccttcagtgcactcatcttggtttgcaatggcatgttcagtagtgtgatgttttggttaatgtctccctaccctcctgtaactggaccataagccccacaaagacaggagccttgtggcttgccaccacatctctggcagcgagcatggtgcctggtacatagtaagcactcagtccatgtccattgaatgaatgagaaaactcccaccccttccacagcccaggtaggctggccacgacacagtgtctgtgggatacatcttggccttgtcccctcgcctggtcagcctcgtcatgcaggccttttttgctttccattctccaggactttgtttccactctaccaaagcatctgataaattaatccagagccaacactggtgccggaggcccatgacagccccttccgcagctacttataactaacttggggagcaggggcctctgaagactgcgagaactttgaggccaaaaggaatgagtatctaatggtggaacttcaggtaccccaaatggcagtagaggaaaaggctaaccctgatcttaacactgtatcaataccttttcttggaactcaaagactctaagtcagccccgtcttccaagccgcattgagggcattgtgctagcacactgtgggcacatgcatgtgtgtgtgtgtctgtgtgtgcacacgtgtgcctgtgtgtgtgtgtgtgtgatgaattagagggaacagaagacaaagacattggtcttgattggcagacctataggagaaggcagggcccccagatgatctcgtgttgaacaactcaccagactgtcctgctggcaacagcacgacggcctctggaagctcgcccttgcttgtcgacattacagaacaggattatgttcctaactggggtttcatgcagcacatgggaagggcccattcccttgggctcctgggaggtgtgtgacctgctgtcttaggcccagagccaaagcctgttctggaaccagaagagtcagggcttggctgtggcttcggagccaaaggaagcccccacccagccaagatcaggtctgggaggggcaggaccagaatgtgacccttcccttgagggtatcttgaaggtgaggcctggagctacaggaaggaggccctgagagccctaggtggggaagggcgcagcagaattacccactgtcagaggggattctgagggagggcctcctgcttcttaggaaagcacgagtgtagagtaagttcctgggataacttgggcagtagagaggaatttgggaaacaggatgggttttttgggagttttctgggaggtaagtagacttgaaggaaagcaaacttaaagcagaatggagttcaggatcctggaaggtaagttggcagcacatcttccaaagatgagagctgttggtgtctgataccaatgctgcctccaatgggctgatccaaaaaagctcactctagttaagctgcctcatttcagagacaagaaaactgaggctggggccaaaggattaagtgatgaaacattgcatctctcaaacaaaaacgtttcaggaaggtgaaatcagagatgtgaatgtgccatggggaaaatagctccacaaacccaaaatataatctgccaccataatctcaaggggacctaggaccgattgagagattagttgtgtccagaaggctgttcccttaccaagcacgtgtgcacagataagagaggttatataagatgggaggccagggagccaggagcatgcagacaagaaaaacattagtgcagggaggtcaccttgatccgaggaagcccattgtgctaagattagagctggccctcacagaggttacaaaacaaatcagggtcacggccctgtgggccctaaggcacacgggaaaacaaaatctggaacctttaaacactttaaaatctggattgagaaagtgaagagattgctcctctctggcaggctgctcactggaggtttttcaagctgagccagactgcacacaattgttagtaatttgtgatcctgagataccaaattagttaattttcctgcatgtgaattttccttttttaatcccacctcatctttaggtccagaattcagctcctgctgtattaaatcctgtttttaaaggcaaactgtttttttctcctggaaaaaaaaaagagatagatgcattaacatgatctgaaaggccagattagcattttctcctgataattaagattccgcactagacaatcactaccttatttctcctaagatgatagacacctggcttatgtttcttccctcggagattagacacttgttttctgagtctcttactggctgcacaatccaagagagacatggaaaatgtggagatagaggggttgggtaataagacctcttatttcaaagaggactggggttttgcaggctggagaacaaaagactgaatggcaatttaatgctactcaaaaaaggtcacctggcagggtgcagtggctcatgtctgtaatcctggcactttgagggggctgaggtgacaggattgcttgagaccaggagtttgagggtagtctgggaaacaaagtgagaacccgtccctacaaaaaaaattaaaaaattagctaggtgtggtggtgtgcacctgtagccccagctactcaggaggctgaggcaggaggattgcttcagcccaggagttcgaggctacaatgagccatggtggtgtcactgcactccaacctgggcaacgggctccccatctcaataaaaaaaataaggtcacctgcttttcataccaagcaagggaccccagggttaagggacagcacaggacatttaagttggacacacttatctggtggggagtgtgtgggagtgttggggtttgctttctcctgtggctttttcatttcaaaaggatagattatcatttgctctaatgggtgtagggaagtccctttctgaaggcagagggtgggcctggagcctgtaagcttttcctgtcccgtggctgctccctccaggtctctgttcttcactgcccccctcttgagctcttctactttaaggaaccaaatgccacttccacggtggaactgcgtgagctggcgcctctatgcccagaggctgcagggcaggctaaaaagagaatgtggcctgggatcacctaacgttgccgtttcagctccatctcatcaatgcagtggaacaaggtgactgtcagtgaaatgtacccttttctgggcagcaagatcacctcagagctcacacaagtttctgagggcaaagacatcctgtcctgggatttaaatagacaagtctagcatttaaggagcatgaggtcattttcaaagagggcggcctaaagagggatgtttatgtgaatgtgatgccaaaggaatccactccagcttttagagaagctctgaccatctcctcatggtgggaatgcaataccaatgggtaacagcaccatgcacgaggtatttcacgtgggagctctcatttcattctcagaggagccctgtgaggcaggcattattatccccaggcaacagatgaggagaggaagacttgggtcacagtggtggtgaatggcagagccagcctgcacctagtttcactgcagttatgcacatgctctttctttcatactagcagcccccatggaaagatctgggtcagctgatctcctgccattcaggctcaaaggttggcctctttgggactatgatcaggcagaagtctcagagccttgtactttgtcaatgaaatccagtgttttccttcatcttctagccaatgcccgacaacctcagaaggaaccagggtcaacgtcaccacagttaacacatgccttccaaaaaaggagctgggtaaagcaccagggctccctcagtttcccaggctgggccacgggaaatgcatagaaccagtttcctcaggagctgagccacagggatagctggtgtggcagccacccagcttggtcctctagatagttgagtatcctgggaataagattaatgccagctgaagccatggctgcctcatttgtcttcacatcgcccctcgtatctcctacatagcacctgtgtcataccctgcttccaccacgcccagactagcacacaacctgtctcctccgttagaccatgaggtgttgaaaggtgtggctggtgtgcccacaccatgttgccaggaacacgtggtagatagaggcttggatgaactgagttgaaaggagtttgtgttagaagcaggtaagaggtgcttcttccctctttgcacaaactttgatcttaaattcctgtggttagaatatgaaattaatgactccaggtttttaaactagcttggaataatgagaataaagctggagtaggacctagcacaactccctcaaatcctgggtttgctactttctaagatttgggcaagttatctaacctatttcaacttgagtttctggcatcaaatatgagtcctagttaatctgagttttaagagaaatgaatgagatcacaaagatgaaaacacttgtaaacgggaaatacaaggtgaataattttttgtgttgtggaaaaaatataatgaataatccagttgtcttagcagttctagagttttgttttgtctcattttatgacatagccctcaagacacacacacacacacacacacacacacacacacacacacacacacacctgtaactacctaaatcaaaatatagaatattagtaccatcagaggctcattttggggcccttcatagtcaatatcccccaaaagtaaccctagatttgactttcctgttcttgcatttgggattttacctgaaacctctttgtttggggtttccccaacatcccagctcctcctcccctgccttccagttctgcaatgccccctgggttctcccactcaagagaggttacaccgtgagatgatggccacgaggccagcctcagggcccacagaccgtggaggagcccaaggctggaagccactccccgcctctcaggctggatgtacctcacaggcctctgttaccacatttccataacttcacacccatctgcctcagagtcattctctcccaccagcctgtgagcttcctgaggacatggatcatgttctatccattctacattccttgatccctgccgcagagcaggtgtttgcgtaacccacctgagttgtagagtttggtataggacaggatatcaaatttggcaggtaccaaattcattacccaaatcactaatcaggtaacgaattcaccttcttagctgagctcagtggctcgtgcctgtaatcccaataatttgggagactgaggtgggagcaacacttgaggccaggagttcacgactagcctgggcaacataacaacactccatttctataaagaaatgaaataaaaaagaattaacctctagggagtttgccttttcagcaccaaaacatggagaaagtttccaaggttcttgcaactggggaaactaacttgcaaaatatcaccctctccttcagtgggagacatcccaaggatacaaaaatagcttttaaatgtgtgcaattatttattaatttttttaaatgacaaaatgtcaaggagccccaaagccagcagccaacattgcacaacccaggttgctaggagtggcactgctgctgggacagttgaggcaagaaccttgaaaactgtcttcatgttctgttgctgaaaagacaaacacccaggaggtggatccctgagccagcagcatgactgacccagcgactcctcagctgcacacaattggacaggaagcaggcctggcacttcttatgtcctatgcaggttttgcttggccagcttggtagatggggttttacagggagagcggccaagctggttctgtgccttctctgttttttccacctttgacccagcattaactctaggagatttcccctcccccagctactcactagcccagctcagccccattggtaaaaatgtggagctgtcaccaagtccatcaccatctccccttgcttccaccttcctgtcctgtctcaagtccacgtgttctctccatcccagccacccctgccttagctcagctccgggttaagtctcacctgggtcaccagtctctgttcttctcactgctgaatccgctgatgacatcaccaccagtgtgacacctgatggcctcaccatcacctgcttaaaaccattccatgctttcccatgggcttaaagatagattttaaaacaacagcttcactgaatatcttcattaatatataattcaaatatcacagagtccactcttgaaaagtacaattcaggccgggtatggtggctcacgcctgtaatcccagcactttgggaagcctaggtgggtggattgcgtgagtccaggaattcgagaccagccttggcaacatggggaaaccccgtctctacaaaaaatacaaaagttagccgggcgtggtcatgcacgcatgtagtcccagctactcaggtggctgaggtgggaggatggcatgaacttgggagtctaggccattgtaagctgagatcacaccactgtactccagcctgggtgacagagagagagagaccctgtctcaaaaagaaaagtatacaattctgttgtctttagtgtagtcacttggttgtataatcgtcatcactagctaactccacgttttcaccacgtcaaaaaagaaacccttcatccattagcactcactccccaatctgccttccccccagccccagacaaccacgaatctacttctccctctacgggtttgcttattctgcatattttatattagtggaatcacacaatatgcagtcttttgtgtctggtttctttcatttagcacaatgttttcaaggctggtctgggctataacatgtatccgtattttattccttttcatggctaattggcatttgatggtgttgctatgccacattttgtttatccattcatcagctgatgaacattttggttgtttctgctttttggtgattatgaatagttctgccatgaacacttgtgtacaggtttttgtgggggcctacgttttcgtttgttttgtgtaactaactaggagtggagtttctgggtatcttatggtgtttaaggatccatttcaacgccttactgtgaggccagggccctgcccattcagagcctgccacgccctggcccagactccactcctgtcttgccagagcagatgactgcaacactcagaacataccacacccgacacttcctgccatccaccccctctgcatggcctgcctctctccagcctctgcacctggataactccttcaaagctcagttcaggcatcaccactaacagggaattctccagtgaacaaaacaaaatccctgctcttgtggaactcttgttggagagaagtgaaataggtaaaaagaaataaaagtatgtattaacaggcatacatgttatgcacccaactgtttaccaaaaatttaagcttccctttccacagtgtggaattgttgctatcccaacaggaataaggtttctattttccagccttctttctatctggatgtgaccacgtcatgaattcttgttagtgggatggaagtagagagatgtgtgtcacttctgggattgggcttttaagaagtgggtgggtttttgccatactctctcttctattctgcagtttgggtgcaggggactttgaggcactaggaatggcaggtctgcaggatggcaggagcctgagtgcctgaatcaccacatggaagccacccatatgctcaccaggagcaccacatcaggctgatggaggatgaggatccaactcctattgtcttgggccactgaagtgttgagttcctttctgaaggcagttagtgtttccctcatacaattaaaaatgaaaggatttttccatcaggtagtcagacatagttcatcttttctggagcagaaaagaggatgtgaacttttacttgcttcctgctttggtgccttttgtgtgagggtctgctaagtcaaccctgaaaaattttccacctgtcaaaaatattcccaagcccggtgcggtggctcacgtctctaatcccagcactttgggaggtcgaggctggcagattgcttgagctcaggagttcaagactggcctgagcaacatggcaaaaccctgtctctaccagaaaatacaaaaatacaaacattagccagatgtggtagtgcacatctgtagcccagctactgggaaggctgagatgagagaattccttgaactcaggaggtcgaggctgcagtgagccatgatggcatcactgtactccagcctgggcaacacagtgacaccctgtctcaaaaaaaaaattctcaaggtaccctcagcagatccagtcaaacgagaggaagcatggatttttgggaaggggagagaaatggggtttctgccttttatagtaatgaccccctcccaccagttcccaagtctcctcacctaaacatatacaatttactcatgtaactgtctgcaggccgagacatattttctacaccagagttttggaaatgagctctcaaaccctgtgatagcagagctctaggtaaatgaaaacatggcctgtgccccaggcctgctgttctctccttgaagctcatctctgcacattgcgcatgttcaacttgctgagcaggaaaagaagatcccaggtggagacacgggagggggttacatctcactcgagagcacagcgtccccactctcaccttaattggctctgctctgctcaaattctctcctcacagcctctttgcctcctctttattccctcctcccctccccttccctggtcccacctgttcatctcggcctcatgcctcttcaggaagttgcctctgcccagtgtgggaccccctcttttgggtctctccctccttttttcatatacaaagcatcagtatttccattttacccccttaatcctagttacacaaattaactttctctgaatccacccttaaacaaagtagagcaagggcgttataaataaccataaggttgtttatcctagcaggaactcaaaaaatgcctattttcattctttctttctgtcttttacatgcccaaaacatctgccacagtataaacagtcaacacatccttatcaaatgcaaccaaggggctttggaaatatattggaaacacattgaatgtaccaaaagaaggcacaatttaaggtggagttgtgatggcaactagcatcttattcagttgcatgaaagattttaagttgattcaaccaaggatgcagaaggaaagagctgctttgcaccacgtggtggcatctaacagataccaacaggtgttcctggcttatcgctaggtgattgtggtttcgcatttaagttcacgggccaccaacacctgcgattttgcatattcctgctcagaccacaaaaatctttattataacgtttgagtaccctggagtggataactccaaactgacccaaacaccgtccttccatcttcaaggtgagtccagtcttttaagcgttttaaattctgtagacatgagacgtgtgatgcagggtgcctgctccttagagttcacaaggattgggtatcttccagcttggagataatagttttcccatcaagttgtcgttactattattattcttttatcatttttttttagagacagggtctcgctgtgtcacccaggctggattgcagtggtgcaatcataactcattgcagcctcgaactcttggactcaagcaatcctcctgccacggcccctcatcattatagccaaactttattgagcattacgatgtggcaggcactgtcctaagcactttgagattttatctcacaatatccacgcaactgtcctaggaggtagctactattgttgtccctattttaccaaggaggaacctgaggagttaatccatttgtctaaggtcacttggtaagtaaaaattggaagacaggcttccaggtctatcagactccaaagatctgcactctgaacccccgtgtttctcagcaggtggaacacctgacttttatgagtgacacaagtataaagttggaatgcaaatcattactctggtgcatccctgggcccccagcagtatggctggtttggttcagggcctttgttgaaggttcaggtctgcttcgcagatggcttgaaaaggaggatgaagaggaaggggaggaagaggaggagaagtaagttgcttttaggctgtatttagcatattctaaggcaattagtgaatgctcttttttgtgtttcagatgaatggtggccccttcagtgatgatagaatccaccagtctcccatttagaaggaacctaacaacatgtagttgaggcttctgcctccaggaaagattggagagatgaccctccagacctgtttccttatcactacaaatgggcttaggggtgcaggcagaccgatggccttgaggcctgtattagtccattttcatactgctgtgaagaaatacctgagactaggtaatttataaagaaaaagaggtttaatgggctcacagtttcacatggctaaggaggcctcacaatcatggcggaaggcaaaggaggagcaaaggcacaccttacatagtggcaggcaagagagcatgtgtagggaaattgccttttaaaaaaccatcagctctcgtgagacttattcactatcatgagaacagcatgggaaaaaccctcccccatgattcaattacttcccaccagatccctcccatgacacgtggggattatgggagctacaattcaagatgagatttgggtggggacacagccaaatcatatcaaggccctttctggactgggttagaaggctgggagaggtgccagcctctggtgttcctctgtagagtaaagccaaggattccatcttctccctaggatgatgtccattatctgataacctatcaaggtgatctccggctgcagtctctcctctggaggagatgggtagaagaaatgcttgaagttctggggatctgggggctgggttgcaacagagctgttgagaaggtaactaggaacaggagctgtccattagattttggttgaaccactatggaaaacagtgtggacatttcttaaagaactaaaagtagaactacaatttgatccaacaatcttactactgggtatctacccagaagaaaagaagtcattatatgaaaaagatacttgcacacatgtttatagcagcacaattcataattgcaaaaacatggaaccaacccaaatgcccatcaatcaacaagtggataaagaacctgtggtatatatatacaatggaatactactcagccataaaaaggaatgagttaatggcatttgcagtgacctggatgggattggagactattattctaagtgaagccactcaggaatggaaaaatgttctcactcataagtgtgagataagctatgagaatacaaaggcataagaatgacacatgggactttggggactcaggggaaaaggatgggaaggggaatgagggataaaagactacaaataaggtgcagtgtatactgcattgggagatggatgcataaaatctcacaaatcaccactaaagaactcactcgtgtaaccaaaaactacctgttccccaataacctatggaaattaaaaaaaaaaaaaaagattttggctgaggaatctgctcttggtaaattaactttcaccttccatgtttgcattttgatttgtttttccttccttattggttgtgatagattgatttattggccctgattcttcactctttcccgtgttcacacctctacccatgtgacttggcagttccacccactagaggcagatcttacttgttcctcagctttgggctcaccctgtgactggcttggtcaatgggctgttaacagatatgtgagcaggacttaatatgtgtttgcatggttaggcttattttttcaggcctttgccaccatcatgagaaaaacatgccaagcttgcccactggtccaaggagaataagggatgtgtggataagatctgatctcaatttgcagcttagagctattcagccaagctcagcctgtatcagatggccctccagccaataaacagatgcatgagcaaaatgcatgcttgttaggatgtgtcactgagattttgtggttgtatgttatgttgctatggctgactgataaattagttaaagttccttttgacgcactccaatgttctctttgctgaatttataagtaaaagtatttcccaaactttggttagggtatctgctggaatctagatgctcctaagtccaggaggccatctccaaatcctggggagggctgcagcaagtctagaaagaaagaaagaggatttaggaaatgctaatcaacctggaataagaatctgttcttacgctttgaaaagtttgttgtaaaatgaatgcttccattttatctttaggtcaaaactgtagaatgttcagctctgatgagataaactgaggctgcttgggagagaatttttggatctgcctggaatttgtgcaatctgaaatgaagaccatggaggctctatgtgaaccacgagactagaaagaatgatgcccattctcctgcttccaggaaggactgtatttttacacatagtatttttgttctgactatgacaaaaatacatacacattttggaaagtacagaaaataataaagaaaatgaaaacaatctacaattctactacccaaagatgattacgattggcatttgaaattttctgagtttacaaaaaaatgccttttatcctgccttttaaaaaatgcatagcattatatctgaagaattctttcatgttgttaaagactctttgtaaacattagtttcaaggaatgatactatttcggagatggttttcctgttatttgtgttaccaattccctaatgttaggaatttagttattttcaatttttcacaagggtaaataatgcttaaataagcatttttacacacatttttgttacttatttatttttaagacaagttcttgttctgtcacccaggctggagtgcagtggtgcaatcacagctcactgtatccttgacctcccaggctcaagtgatccttccacctcagccttcctagtagctgggactacaagtctgcaccaccaagcttggctaattttttatatctatttttagtaaagatgaggtctcactatgttgcccaagctggtctcaaactcccgagctcaagctcctcccatcttagctcccaatgtgctgggattcgaggtttgagccactgcacctggccctggcctgttagtttttattgttatcttagaacagattactaaatgtataaaaggaacacacacacacacacacacacacacacacacacatatatatgtgtgtgttagtctgttttcatgcttctgataaaaacatacccaagactgggagactgggcaatttacaaaagaaagaggtttattggacttacagtttcacatggctggggaggcctcacaatcatggcagaaggcaaggaggagcaagtcacatattatgtggatggcagcaagcaaagagagagcttgtgcagagaaattcccatttttaaaaccatcagatctcatgagacccattcactctcatgagaacagcatgggaaagacccgcccccatggttcaatcatatcccaccaggtccctctcacaacacatgggaattatgggagccacaggatgagatttgggtggggacacagagccaaaccatatcattctgcccctggctcctcccaagtctcatatcttcacatttcaaaaccaatcatgccttcccaacagtcccccaaagtctcaactcatttcagcattaactcaaaagtccacagtccaaagtgtcatctgagacaaggcaagtcccttctacctataagcatgtcaaatcgaatgtaagttagtttcctccatgggtacaataggagtacaggcattggataaatacagccattccaaatgggggaaattggccaaaacgaaaaggccacaggccccatgcaagtctgaaatccagcagggcagtcaaataaagctccaaaatgatctcctttgactccatgtctcacatccaggtcatgctgatgcaagaggtggattcccatggtcttgggcagctccacccctgtggctttgcagggtacagcccccatcctggctgccttcacaggctggaattgagtgtctgcgtcttttccaggtgcatggtgcaagctgttggtggatctaccactctggggtctggaagacagtggccctcttctcacaactccactaggcagtgcccccatagggactctgtgtgggggctctgaccccacatttcccttctgcactgccctagcagaggttctccatgagcacccacccctgaagcaaagctctgcctggatatccaggtgtttccatacatcttctgaaatctaggtggaggttcccaaaccccagttcttgacttttgtgcactcgcaggctcaacaccacatggaagctgccaaggcttgggccttgcaccctctgaagccacggcctgagttctacattggcccctttcagccacagctggagtggctgggacccagggcaccaagtttctaggctgcacagagcacgggagccctgagcctggcccaggaaactgaatgcctttaacagcacctttaatagcacctcttgaatgctttgctgcttagaaatttctgccagataccctaaatcatctctctcaagttcaaagttccacaaatctctagggcagggcaaaatgccgccactctctttgctaaaacatagcaagagtcatcttttccccagttcccaacaagttcctcatctccatctgagaccacctcagcctggaccttattgtccgtatcactagcagcacttttgtcaaagccattcaagtctctagaaagttggagtttcccacatttttttgtcctcttctgagccctccaaatggctccaacttctgcctattacccaattccaaagtcgcttccacatttttgggtgtcttttcaacaacgccccactctgctggtaccaatttactgtattagttcgttttcacgctgctgataaagacatacccaagactggacaatttacaaaagaaaaaggtttaattggacttacagcaaagatttttaaagtatcctcaaagaataccaaggagaactaaaacagaaaccctcacacatagctggtaagagtataaattggcacaatttgcttcagaaattataccctgagtcttaagaatattcattttggctgagtgtggaggctcacgcctgtaatcccaccactttgggaggctgaggcaggagttcgagaccagcttgggccatatgtcgaggctacttggtattctagaccatgatctgaggtcaagccagtggacaggaaaatcctgaggtcaacctgacctcaggttgaagaactagcccaacaggacggttataaggggaggttcgtttatgattttgctccacgaggattgctcattctacgtatctattatttgtaaaagatcagcacataataatccatccacaaaggccgtttacctttgtctctgctaagggttgattttccatctgatccaaaataagcagccaaatgtactactgtattaaaagtaaaaacatcaggaatccagataaaggtgagttttaatgttctttgctttttattttggcttctaaggtggagtcaaaagctgtctagcaacccctagctggggtaaaataattcctatgaatgaactcagggtcctctgaggaccaggcaggagagaaggaagaaccaagaagaaagcaagggagagacaaatgaggaaacagaacaagagctgagaaaccagacacaaaagttgtctctgatgtgaaattagacaaaatgccatgactattggcttagggcacaccacttaaaatgaacatcttaatgagttttattctatgtgtgtgcattatttccgtgggaaacatggcaggtgttaggctaaggtttgggtaggtgatggttagtccgcttgacatctacaagtttaagaaaggcccctttccttggactttgagaggattttgaaaagaaaagcgatcactggaaggttttaggaccgccaagaaggcaattttacaacattcattagacatacagtgtgaaacatctctgctttgtgtttctggacagtagagatgacatggccttcaatggctggggtgactattcccctccaaaattaaagacttggaacttaattaggaaattgagctttcagaagaatttggccgccttttatttgttctcaaaatccactagtcaattaaacaactcatttgaacttccacttcttgccaaagtagactaagagaggcaggaattaccctcctgtgggcctgtcttacagggtaagaaaaaccaaacggttttgcctgctctgacacacactcaacatgactcccctgacaccagattctccagtggacacagctgggaggtgtcctataattcaattctggagatgctgtcagatcctgcaggttgaagactcagtcccaccggaccacccccacttcagatgccaagtcccaggtggtgacctgaacttttgaccaatgggctataaattggagttcccatgaccgcctccttgggtttgattagtttgccagagtggccctcagaactcaggaaaacactttacttctgtttagccatttattataaaggacattaccaaggatacagatggacagccagagggaggagatgcacagggctaggtatgggaaggggcacggagcttccataccctctctggatgcgccaccctctgggaacctccaggtgttcggccatctggaagctcatctgcacccttggcattttgtgtttttatggaggccttattacatatacatgattgatgatatcattggcccttggtgatcaacttgaccttcagcccctctcttctccctggaggttgggggagggggtggggatgaaagctccaaccctctaatcctgcttggcctttctggtgaccatcctccaccctggagctatctaggggagcccaagaggagacaaagttgcccagagaaagaactctggaagtctgcagaggggtctcgtgagcattatggtgagcactgaagaatatatgtgaggaaactaagccaaggatggggaaagacccacctgaaggactagagggagagtctttccaacaaatggtgctggaacaattggtatccatgggtacaaagatagacctgaatgtaaaactgcaaaacatctagaagaaaacacaggatctttatgatcttcagtcaggcaaagatttctcagataaaacactgcaagcaagatctttaaaagaaaaaatggataaattggccttcatcaaaattaaaaacttctgcatttgaaagagatagctaggagagatttgtacacaaaaatactcatagctttatttgcaatggtaaaaacctggctgcaagtcaatgtcttctttccctcatccttgtcaacaagcgttattgtctgtctttttgttttagccatcctagtgtgtataaagtagtatcatttccctgatcgctaattgtgtggaacatattttcatgtgcttattggccatttgtaaatcttctttggagaaatgtcttctcaaatcctttgcccatttttcaactggcttgtcctattgttgagatgtaaatgttcttcatatattctggatacaaactccttataagatatatgatttgcaaatattttctcccattctgtctgtcgtcttttcattttcttgatgatgtcctttgaagtgcaaaagttttaaattttgatgaagcccagtttaccttttttcttttgtttttttgcacctttggtgtcacatctaagaaatcattacctaatccaaagtcatgaagatttgcatctgtgttttctctgtgagttttatagttccagctctattttaagttaatttttgtatatggtgtgaagttgtggagatatgttctttgtcttgattatggtgatacactggtgtacatacatactaaaacttagcaaattatacacctaagtgcagtttattgtatgtcaactatatctcaatatatcagctttaaagagtgatttcttaataatgtaacaataatacatatttatgatataaatgtttttaaatagaaaggtatatagagataaaaaatcacagatagccccatcactgactgttaacattttgttgcttttccattttatttcagtctttgtcagttttattttaaacatctttatcgtgttttaatatttttcaagaatattaagaatatttttaacactaaataagaatgactattttatttgtttaattaacatttaattaaaattaaaatgtaattaaacagtccattaaaaataaaatttaaaattagctaagattccatatttgaaaaagtttggaacaggagaggactggagtcttacaggatcccagctgggaaaggacttgttctccctagattcctgttgtactgtttaatttttttatagtgtgcataaaaataaattcatttccattgaaaagatacataacctttcttttgtctgttctcagaaagagcacctttaatccagacatgttctgattcctcagtgtcctcacggctgcagcttaagaggctcttttgccctttcttgggctcccttgggtgaatttcgatggctttcccagtgggaaaggagggagaggaccaggcaagagcaagaatctgctgagcacggagcgcagcgcacggaaccccacactgctcacggtccggttggtatcaccatatgctgggtgtgttggcatgagagtgagaggaattcctctgaggggagtcttcaccataccctaatctaagacaggatttaacctaaggctaggaaatggccaccaaacctcagccttccacagcacgaggtggttccagcctaccccatccggaacaggtcagcccctcccgctgcgtgttagtttcacctcctagaagtttctcagggcagctactggctgtggaggagaggtgggggcgctgcctgggagcccctggtggcatgacagggggaaatcttgtttttcccgtaagcgcttcactttatcatcttttacagaaatctgttttccaataatatagcagtagctgaatttccaaccagaagcaaggaaacccatcatctgaaagttgaaattaaaataaattttaggttagcagttcaacaaatagtatctctcctagtccttttgagctgctgtaacccactaccctagacataacacagtgctgggtggcttacaacaatagaaatgtacttctcaccgttctgggggccgaaagtctgagatcaaggtgcctgcaggatcggctcctggggaaggcccctttgcaggttgcagactggaatcctgtctgaggtcccttttataaggcactaatcccattcatgagggctccaccctcatgacctaatcacccctcagagtccccatttcctactactatcctattgatggcaaggacttcaacatataaattctgggggtcataaacagtgactggaggcccactccgtgccaggccctgtgctaggtgttggggatagtgacttaggtaagactgaagtggccctgctctctgggactcaagtgactctatgtgaataggggcctgctcagaggcacagagagggaactcacccagactggtagggtcaggaagggcttcctggaggaagtggcatgtccacagagatttaatggatgagcacatgtagccaggagaaggcagaggggagagtattccagctgaggacacagcatgaggacggcacctggtaaccaagacgcttgtcatctctgagcctcaggaaagttggtaactgttccaacctgtcctcagctgtcttgtgggggcagtgaggagcactcctgtgcctgcacttcagccaacctgtttgaggtcatgagtgaggctgcggtcattatggggagatgcccagagggaaaagttcttaagcacatggggctgggccttcagccaaccacgcatggtgagcttctcactccactgctgaccctggcgatccagatttagtccagggagacagcaggtttgttcacatactttggtgcaatttgtctgatcagatttgttagccaccgggcaatgggatggagacgtttacgtggacggacaatgagagggcgttggaaccggaagctctgggtgcatggccctggaaagagaccaggccagcgaccatgaagctgagcaagggtttgcctggggctggctctgactagataataataacgagtgcttattgattgcgctacaatcaatcctaacagcttcacatatattaactcatgggaaaaactgaggcccagaaaggtcaagtaacttacctagcacaaagctacgtagcagtagagctgggatttgaaagtaagttgtctgatactattctacctctccatgagggtggaagctgatgatggcattaacctgtgcagcattgattgtgctccaggtcctactcaggccaggtattgttctgggttcctgagattcaccagtgaacaagaccagcaaaggccctgctttcatgggcttatgttctagtggagagacaggttaaaaaaaaaaaagatagttaaaaaataatttcagagagcaacaagtggtatggaaaaattaaaacagaaatgtgacagagagtaacaaggagaattggaatgaatttaagtggcttggaggtcgcaggaagagaatgaattgacaggacctaagcgtgggccatgcagaaagattgcatctcaaggactgtttccttgtctcggtagatgctgtgaggtcagcacgccagaagtcatcatccacccagtttttatttcttagagatggagcagccaccccaaaattaaggcagtcctagagtttaatgtttaataaataaaggagcattattttaaaaattttccctatttgtccagtgataccaggtttttagtttggctcttcattttgcatttaatattaaacgtgttactacttacacctgaaaagagatcccttaggaacaaagactcacagcgtttgcattacaaacttccctgtgctgattttgactgaggataaacatctttctggaatggactgtgaatggaaagggaaaatgtcacaatttgaatgcaattcaaagtaacatcagagaaaggtcagtgccttcgcatgagacctctcttttcaaagtaaacaagtggagcataaaagcactttgggaggtttcttttctttttttttgtttgagacagagtctggctctgttgcccaggctagagtgcagtggcgcaatcacggctcactgcaacctccacttcccaggttcaagcgattctcctgactcagcctcccaagcaactgagactacaggtgcccaccaccaagcccagctgttttttgtattttcagtagagactgggttttaccagattggccaggccggacctcaggtgatcggcacctgattctccagtggacacagctggggggtgtcctataattcaattctggagatggtgtcagatcctgcagcttgaagactcagtcccacggactgcccccacttcagatgccaattactagtcccaggtggtgaccttttgacaaatgggctataaattggagcttgagttcaactcctgacctctggtgatccgcccacttaggcctcccacagtgctgggattacaggcgtgagccaccgtgcccagccagcacttcaggagttttatgagaccagtgccgctggctcctagactgacctattcgattgtggagtgtcacccctggaccccacccacaagccctaagagcttaaaagtctacgggacaaggttggttctgacataactcacggttagcagctgggtcccttgaaggggagcaggaagtaaggaagtttcagtggccaagtgcggtgaccacctgcctgtgccaggccccagtgacggggtggaggggtcagtgcactgcaccctgggatgccaggtggacacgggttcctagtcatgctttcactctcccctgggcctgtcgcaggtgtgttctttccgagcctcccctccttccttttgccgtaactctggcgatggccaacagtgcggggagggcaggataactgcagccagggtacccagccaggaggagctggggacgctagggtagaacaggtctggtgtgggaacagaaaggacaaaggcagggagcagcagtagtcagccaaaccacgaagtggcagcaagtcctggccaggtggatggggcgggggctggcaggaatgccacggtgggtcaggtaatgtgtacaaatgcccaggcagggacacccatggggacttcctctgggagcaggtgaggggctggccagtagtggggaaagtgggctaggtggctaaggcacagcctaggcagcagtctgctgggtgaccttgggcaaaggacttaatctccttgggcctcagtttccttgtctgtcaaaaaggatggccctgtccttccccacatgcttgggcttatgatgtggatgaggtgatgagaatctcaagggcctgggctccaggcaggttgccaactcaatataatatgatgaagacccagttctcagactaagatgctgggcgtggcttgcatctggaaagttctaaggtcagaactaggcctcaaggtggggctgaaaaggcagcagaagctgtcgcagaggacctgagagtcaggctggcgcaggggtcccccaggggtgggtggagatggttctgcaaggtgcttaagtgagaagcaaaatgaatgttgagaaatgcctcatgacatagccccttcttggagagttagaaagcatcgaccgtattagtagttttgagaactcctgctgttaagacacctctttaatcccagtgattctcataccgacctttcccccttttccaaatacctgggaactatatacgctagaaacgtttgggtttcaaatctctcagaagtccttctttctctctttgggattggtcttagggtgggggctgtggcagaggattctccccagccacagggattgatgaaggaacatagcataggaacctggccgggcctcatgctattttatttttcttttttaagagaataaacttttgattttggaatagtcattaatttatggggaagttgtggagatagcccagagagttctctgtaccttcatccagctccccctaatgttaacgtctcacacaaccagagcgcatttgtcaaagctaagaaattaacactggcccagtatggttaactctccacagactttattcagagtgtgctttattcagtttttccactctgtcctttttctgttccaggaacaaatccaggatatcacattgcagttagcttgcttttctttttccttccgtattccttttaccctcagtctgtttggttgttgttgttttagcttcctcctctcgtacttcgtgtctgaggcctggagagcaaggtgagggggacggtgaggtgagcacaggaatcctctgcaccaggacagacaccgtgatgccttctatgaggtgagtggtggctgcagggagaagcccgcattgtggccagatggagagggagttcgggacaccatcaccagtcatgagcaggctgaggaggctacaggccaactggctgagagagcagactctgcatctggtgggtaactaaatgggctggtggagaaatccatgaagcttgaggggcctgccatgtctacagctgctttctgaggaaagtagccccaattgttcgccatctcaatcacaggtgcaggtggggtttgttagtgtcagtaccttagcatgttagcagaacccagccctgctacctgagacccagatggttccatcaggcgtcacaatgtgggtcaaggcaatgggccaggtgagggggcactcaggcaccagggtggcttggcaagactgctgctcagaggtgccccatggtgatggaaacaagccagtcaatcctagctctccctacatgaagggcaggctgtgtaagctccgggactatctgcagtaccaggaagagacactcctgggtctctctgaagcccactccatgcaccagtggagcagacaatttcgcacctacccaccatggatttatccccttctttgccagcacagccctgatttagttctggtctctaccctttgcccaacagccaaatgcttcaggaaggctggctttgaggggcaagtgccagttggtgtgcaaactcatcaaagagctctgatactgcctgccagtagttgctttaagcatggacatgtgtataattctggccaacaagccagatgtgaggggaagtcccctagtgtgtagggggcaggagagagggataggtgttctgagaaaggtttcctcactctcaacaagcgacacaaagatgaaatggctccttttcctgagtcttggcaatggtatgcccagatgtgacacctggaacgttggtagccatcttgtgactgagagagcagtgagatgagcagaagggaatgatgggaagaaccaaggtcctctccatgtcactgagtcacccaaaaaaaccaagcttggagcctgctgcctttggacttcttgttgtgtgtaagccagttgatgtaggcttttcttgtaacttgagatcatggaatcacccactaccagatctgtgacctgagggactgcaccccatgaggctgtcccagttctccctcttggtcctgtgaattcatgcctgagatctctggattagttccctgttaatctgccaataatttagtggtttaaaccaatgcaaatttattcttttaccattctggaggtcagaagtttaaaatcaaggtgttggcaaggccacgttccttctgaagtcttctggagaatcctgtttcttgtctattccagcttctagagccccccaccattcttttcccctcttgtaaggacccttgtgattccactgggctcacctagatcatctaggatcatcttcttatctcaagatccgtaacacaatcccatctgcaaagtcccctttaccgtgtaaggcagcatattcacaggttctagggattagggtatggatatctgagggagggaattattcagcctaacagcctccctcacccaaagtgatccatgtgtccctctcctggttctttggaggctggtggttcctgtggcttcctctccatggcaccacttgcatggaccccagcctgacagcccacctagtgtttcccaccaatcaactatggaggctctgcttgggcctagtgtctattcctcgtgggagaggagagcctggggaaagggggggagagagagagagagagagactgtggatacagaatgaactgtagctacttcaaagtggagagaaatagtggccttgtgttttctcaatagcagcgaagctgaaaaagatgtcagaggtctaccagatggtttcagtgaagttcagtgtgtccttatgtactcactgctttggggatcctcctcaacatcagagtccctgcaactctgactagatctgggtgcatctatcagggcatatgaggatcagagttggacttgaaaaccaataggccactgatctgtctctcctccattctggacattggctagatttgtgtgggtagaattcagagttgcagggtcagcttttgggagctttccagccacttttctcctttatgccacatgctgggcttcaggctgggccaaagaggcccatatatggaacctggatgcattctgcacaccacagaccgcatctctgtgtgaccttccgcgttctgcctttgcattggatgtgaagtagggtcaccttgactgtagaaggaggggttggggccaggctctaaagccctgcagctctccaacattacagcttgtgtatgggacattgaagagaaatttttggtgtcaaaaacaatgaggacagagcattcttggggctttcatcatcatccccaactccagaaagggttgtggtggagatagtggactgagttggctttgggtgaccatctcccacagcctggcctaggatgtgttgttctggcctctgaggcatcagagcacctcatgatggctccaacttgctcccaccccatcacccctgccatctgttcccatgggtgggaagacgtcctagctttggagcaggccagccccatcaggagaagccaatccgtgatgcaagagatgataaacagagcaacacaaatcttgtttggagagtaagccactccttagaaagcagagctaagacatccttttgttgtctagattctagggatgataacttctcactcttccccttgatgagtccttagagaactgtaaacttccaaagaatgctttgtttaatgggttgaaagaggaagaactgaaaggaggaaatgggggcctttgtcctctaaagagtaagcagtgtggatgatgacatcaacggccaatgtggacgtgtcaccagcactggcaccagcagccctgagttggcacaatctggcttcatgtgaattcttctgccacattgggagtccctcttgccctcgcttggcctcacttttcctagggagattacaaaacctatgtacttacctgaaggaagttgtgttacatccatgggataagacgccggactagagggctccttggaaaagatggcggatctgagaacccagtgctcacaggagtaggtgaagcagtctattgctgtgtagctcttgctgcctctgacctccaaagtcagcatgagtctcctcagcagaccacatgtgtaattagcatagggaggcttctgggaaggcaccaggcttctcagacatagccatacgtgaaggaaaagacccacaatctggaggcccaggggatggaggaggaggctcttggcattgggtttgggcatttgtcagggtcgtggttagaaatccctcctgggcttgtctgctcagcggttttgggtgtctgtgccaagggtggctggggggcccatcgaggagtccccagatctgcggggtctgattcatcctgtgtcagcccagggcgatgacagattggtccgatttggggcagagaattgcaaaccagtgttaacgagagacaagcctctcctagatggctttggggaacttctcagcatgtgctcctcctaagctctttgtctcctttcccatactcagcagcaaggcagcccacaggctccaagcagtccctggggaagcggggtggtggtgaggcagagatggttttctacggagccaggatacagtggggagcaggcacgcacatcctcatggggatgttccagttactagctagaaaggtggccaatttcttgagatctgaaaggtatcagggttcagagtgtgactactgggaggccattctgcccacactggccattggccagggctactgggtacttgatatagccaagagaagcagacattgggggtaagatggcataaaggaatcccctcgttagccaagaaaatgcaagatccttttatcagtcagggtttatagctgcaagcaaaagcaactgcccctggctggtgaagcagagacattttattaacaacagtgggcagctcatagtgtcccttgagccctggggcacgtggattggaagtcgcacagccaggtagagcaccctaacttctgccactgaacccatctgggaaagacatatttgctttgctacagggcccactgtcaacgccccaaccctgggtgctggctggaacagagcccctgtacctagaaactggatgttctgccaccaagatcatcactgcccatcaccagaacacaagttgtgcagggagacctgctgcttcttgtaagggacagagccacgccacttaccttgtctacctgccacaggggctggagaagccagtgtctggcacttttgatttctatagtgatgggtgggtctcactgtgggggcacaaacatagaaggcaatacaggtttttggtgactaaacagatgacagttgtcccctacaaggcattaggttataggaactgactacagggcatctgactctgctcctccttggaaatggccttcttttgatgctagtgtaccagcctcacctctgctgagggtggtggacacttaagctcagtcatctgttcctgaatatcagatgttctgtgtaaaaatgccaaccagtaaacaattcctgcatttaagttttattttttcagctttatcgaagtataattgtttagattatagattcaatataaaaaattgaatctatacaataaaattcagggtgtacaatgtgatgatttgatgtacatatacattgtgaaatgatagccacaatcaaatcagttaactcattcatcaccttagttactctgtgtgtgtgtgtgtgtgtgtgtgtgtgtgtgtgtgtggtgaaaacatttaaggtctactcagcaaatttcaagtaaagaattacagtattattaactatagagttaataatactggtgttttgtattattaactctatagttaataatacttgctgtgcattgggatctgatgttcctgttagtatagtttcctgttattataaatggaaaaggttataaggcacacatccaccaatcaacttcccaaatgtgattagatgtgttgaaacatctatataggtaataaactaccacattaggatgtaaaatactaggctgggcagcttagctcatgcctataattccagcactttgggaggttgaggcaggcaggtcacttgaggtcaggagttcgagaccagcctggccaacatggtgaaatcccatcactaccaaaaatacaaaaattagccaggcgtggtggtgcacgcctgtctcccagctacttgggaggctgaggcaggagaatcgcttgaacccaggagacagaggttgcagtgagccaagattgagccactgcactccagcctgggcgatagagtgagactctgtcaaaaaaaaaaaaaaaaaggggatgtaaaatacttaaaacatagcttaaaacactatagttgttaaggcctactttgtaagaagtgacaccgtgatgcctgtcagtgccaacaacttgggaaaacctcatcccctttgctgaggttcaccatgctttatacaaccttctacatgcagttctggcattctgttaagtgtaattgtaatgtttctcaagactttatagatatatttgtttaaaatgtagggtgttatgttttagggatataaatttacatttaccttagataaattctggccaaaaaatggcattgagagagatacgtatgttccctgaaatttggatattaaaaaccaagtggcatcctgcaatggggatgttaatcaggaagatgttttgtggggaaggtcttgatttgaagagtatctcccaaatgccaagggctttccacatattagcactaatgcccagagtaaccttaactccactttacaggtggaaataccagggtctttctcagggccccactagagctgggactcaaacccaggtttgtttgactccataatctttccaagataaatccagtttcttgttttctgagtatagctgaacaaagctgaagtattcaagagaaactttaccaaagtaagagaaatcgaaaaaataggagataataaaattactcaagagtatgaggcatagtttttttttaaccttacatttctattgcttacccatcccatttagcacattgtgttccataatctgtctaggatggtgggatgaaagggtgtgagcattgaaagcaaacaaatgtgagtgtgaaacctaaagctatcagtgattagctgtgtgttggccactggacccttcccgacctcaggcttctcagctttcagacacggatgataacgttttcaccagaagattgtggtgagggctttttttttttttttttctttcagggcgattgtgttggtggcatactggatatttctaacatgtataaagttaagtattttgattgactttctttctatgtatatgtacttctcttcaaatgccaagagctttttcttgctatcattgccttttgaaacaattcaattttcaagtctactgttgattgttatgttaaagattgagtcactgatattcaagatttaagtctgaaacagtcaaaatgaaccctcaaaaaaaaaaaaaaagaaaactgcttattggaaatcattactgtggaaatgaactttatttgccattatgaataatatccaatataagaatatgcttctggaattcagtactgcttttaagtaccaatgatacttatttttcaaaaatgtaatggcatgttattgctttgaaatgcttgctttcatgttatcttaaaatgcgctggtgaattctccatttttgacatccatttcacacgtaaaagacaaaaaaaaaaatctaggttggccttaatattgggatgataaaaggtaggtagcattaagaaaataaaacaatcttcatgttagagatgaacccattaaaacaatttaggaaatgaggggcaaaatggaagaaataatattccaaagaacatgagcataaaaatgaatgcatttcaatgtttaagaaggcttgatacaaaaagaatgtcactttttgatttaactgaaaacaaaagattgtggtgaggattaaatgacaatagtggacataaagtcatgtagatttgtggttcaagatgtagactgaagacacttgtttacttctccttccgcccaggatgccacagaaattacagacaagctgttaaaaaaataataaggcactcattctctctcctgctgccctgtgaagagatgccttctgccatgattgtaggtttcctgaggtctgcccagccatgcggaactgagtcaattaaacctcttttctttataaattaaataataacaacaataaatccataatttaccaggcatggtggcacatttctgtggtcccagccactcaggaagctaaggtgtgaggagtacttcagcctagaaatttgagacaaacctggtcaacagagcaagaccttgttttattaaaaaaaaaaaaaaaaaaaaaaagtcataactgctggaagaacatcagaccccagaattgaggaagttactgaaggatggattgaggatggtactggagtggtatagaaagtggactctgtttctcatttcctttcatcgccatatttcttgtgggttattcagatttgtacttcttcgccctgtgttgactctgggaaccactacaatctggctttttctaccatgattccattgaaaccgttcttatgaaagtgtctcatgacctcccccttgctaagtccagcatccggaggtcatatcactgtcagtatcttaggcaacctgttagcaatatttgtgatagttttccacttctcgaaaccttgtcttttcttcatttccatgacacctcagccctctggtttccttccacctcagtggtggctcctgctgtcttcttggctggctttgctctctctggctgatctctgaacatccctgttccctggtcctggcccctttttcatcatcttcaatattcttgatgagctcctccattctcacagctttcaacactatgtctcgatggctcctgcagttctgtctctagtctagttctctccttggagctctagacttgtatactcaactgcattaaaagcaaaacaacaacaaaacttttgagctggatgtagtggcccatgtctgtggtcccagctactcaggaggccaaggcaggaggactgattaagcccaggagttcaagaccagcctgggcaacatagtaaaacactgtctcagaaaacaaaaacaaaaacaacaacaaccttttttaaaatattttttttttcaaacttatacaaagcttacaaaaataaaaatagcacaaaaaacacctgcatacgctttacccagatttacccaaaattaacattcactccatttgccttatttttttcttactgtgtgttcctctatgtgtatgtatatctataacacacacatatataatatgtaatgttatgcatatgtgtgtgtgtgtatgtgtgtattttttttcctggaaccatttgaaggcatagccctttacttctaaacacttcagttttcttagggataaaaggttttctcttacctaaccacagtgcagttatcaacttccgaaaatttaacattgctaccatgctttatctttttttggttgaacttttaatttttttaattttaaatttttataattttaattttttatttccgtaggtgttcggggaacaggtggtgtttggttacatggatgcattcttcagcggtggtttctgagccatgctttatcttgtctaccattcacattgcaatttttgtcagttaacccaaaaatatcctttatggcttatttaaaaaactatagtacaggatctagactagagtcagatattgcatttaattgtgatgtctctttggcctctaatctggagcacttccacagcctttctttgtcatttatgacattgacatcttttaaaaaactgagcacaattttattgaatccttatagtccctgcccccaccccatgaggtcagaactattattattctcattgtacatgcagggaaactgaaacatacagagagtaagaaacttgcctgacatcacaattagtaaagttcagagctaggattcaaacctgtgctgttggaatctatacccatcaacttgactatcttagagctgcttactttcagtaccttcataacacaaaaatacccttactaatgtttttactgtatattacactgtacattaacatttttgaaaaatacagttccctctcatttaaaaaaaatttaaaataggacttcattttggttttgcctgatgttttctcaagattaggttcaggttgtttgtgccctgctggaataggacttggttaggtgtgtgcttctcaggccatcacagctggaggcacacagcatccgcccatgcctcattggcgatggtaattttgatcaccttgtcaaagtgctgtttgatttctcccctgtataatcactggttcttccctctctcttccttgtaaataacatatggtctgtggggagacactttaagaccagacaaatatcctgttcctcatcaaaatttacctctaaatttagcatctactgatgatttgtccctgacccaacctttactaggatggttggaacatggtgcttttccgactccaaccatcactcccccaacactgacctgtcaaccctctggattgtgctggaagtaagaccttccttttccctacccatgtactttctcatctattgattatcagtatgggctcatgactttctcctttaatggttagtaactttgtactgtacttattaggtgctgagattgcattttcgtcttctcttggctgtctcacggacaattcaaacctaacctgtccagagcagaactcttgatttcccaccccaaactaatctccctcctgaccttagtctttcccatcctgggaagtcatcatcatccacccagtggctcaagccagagacctgggtgtcatccctgagtcctccctttccctcagaccctcaactaatttgtaagcaagttctcttctggaattcaattttgttaaaaacgttaatgagctaaatggacagagctgaagattgaattagtgggctggaggagtgcttttcaaattttgttgcatattggaatcacctggggagattttaaagctcccagtgtctaggttgcatactatataaattaatcagactttctgggggtgggtccagacaacatcagtttttaaagctctctcaagtttgagtaaaagaggtttcccagaaggagaggcaaaaggaaaaataaaatatatagttgagggatctgtttgacagatttagaactttctatacccataggagatccaatatatatcctgacaccaacagaattttttcatgctatttgtaaaacagacccttgacttcctaaggaaaagagagtgtataagaatatttgaagtcaaagggaggctagtttccagttctcagatgtcagagtagaggttctgttgaaactttcttctcagtatgagcccccagacaacaaggagaataagaaacagaaatgtaaactcaatctttgattaaactaggaaacatctgaggcccagcaccacatttgaggaagggctgcccagtgaagagaaggtcaacaatgtggagtgaggatgctgaagatgctgtggctgcagcaatctgctccattcagcagagagtgcttctgcaaagtgagaggttcactgggtcccaaaccagcaagaacttacctgaaactgaggtaggagggaggcaggaccccgacccaggttgaagactggacaaagctgggaaaaggtgccaaaagcatgggtctttaagacacacccaccagtgccatgccagtttaccatcgccatggcgacacccagaaattaccaccccttgccactgtcaacacttggaacttaccacccattttctagctaattctgaatagcctgccccttaattagcatattatgaaagtgggtctaactgctgccctggctgctactctcagcacactgcctccctgctctgaaggagcactcatggagctgtaaccctgcttgccttgataaaactgccctataccaccgggtagctcttgaattcctccctgggtgaagccaagaacctaccctgcattgaaaccatgagaacagggtaccaggaccaagggcaataacttccctagacctatttcctctaggagaggctgtgctgaaagacagaatcttaggtaaactatctctgcaggagacattctgaggatgaggcagatggaagacagggactgaatgataagaacccctgtagttgccaacctcttttgagtggggagaaaacaacatatttcttgtttctgtcctttctactcccaacctctcaccttcccaccataccccctccaccccaacaagacacctgaccaaagatggcttcacagcagaattctatcaaaactttgaaggaagatatatgcagtgtccatagaaaaagaagaaaacacatccaattcaacaaaaacactgatgctaaaatatcataaaaggagcaaaaaaagagataaaattgtaattttacttattaatattggtgcaaagtttcaattattagctaatggggtccaacaatatgttggaaaaataaatcactatggtcaggaggactttatgccaacaatggaaggatatttcaatattagaaaatgatgagcatagattttcacgattaccttcatagttgctgataaggcatttggcaaaatctaatatacatatttgaccaaaaatgttttataaactaggaataggtaaataattttaaacatggtaaataaaagaaatatacgtatttcaaagttgccattatgctcaaagtaggagaaaatgagaaattttcttacagtcagaaataggaggaagtttctattgttttatgttattctggaagtatcaaatcatgcatgtagacaaaagaataaactgtaaagagagagagacatttataattattgttatatgattttatatctggaaaacccaagaaaataagctgaagagtaatttctaatgacaaaggaaattcataaagttggtgaatacaaaatcaatatgcaaaataacttgcctttctatatacgaatagtaaccagttataatggaagaaaatatcctgtttatgacacagtgacaaaatactcaagagtaaatgacaagacacacaagatctaaatgaagaggactttaaaatgctgaggtaaaccaaaaaaaaggcttggaaaacatgtaaatacatagtctatttctgtctagggatgattaaatatcatgaagatggcaattctccataagtgaatccataaatctaataaaaccctaataaaatatatcaataagaaatgtttgtgactaaaagtctacagaaaagtagacatgcaaacacagccaggagttttctgaaaaagatggagccacctgatggggctggggagtggggtggggccttagggaatagctctaccagaactgaaacccatctttaaagccacagcaattgaagcaatattgtactgggtatgaagaaacctacaaatcaatggatcagaatggagactccagaaatagacacaaacacatatacaaatatatgataagatagcattgcatattaatgaaggaaggtaggctgttaaaaataatgtttatactccagagagccatctgggaaagtgctatggactgaatgtttgcgtctgtcctccccaaattcacatgttgaaatcttaatcccccaatgtgcaattagaggtgagacccttgggaggtgattaggtcatgagggtagggccctcacagatggagttagtgtccttataagaagagacaggagagagtctgcttcctccccctctctccctttgctcttttctccctgtgagaatacagtaagaagatggtaatctgcaagccagaaagaggaccttttccagacatagaatctgcgggcaccttggtcttggcctgcccagactccagccccgtgagaaataaatggttattgtttaagccactcactctatggtattctgttacagcagcccaagctgatcaagacagaaaactggacccctgcttcacttcttatatgaacaaatggcaattggatccaagatttaactttataaaatgaaattaggaaagcataaaatttaagacaatttaaaaataactaagagaggtctttttaagtgttgcacaaaactcagaagccatagaaaagattaacaaatttaataatacaaataaaataattctgcatggcaatcagacaaaaatcccactataaacagagtcaaaagagaaatgatgttttgatggggaaacgatggggacaatatttgccacagaaattaagttatttaatataacaatgtgctctctcaagtcaataagaaaaagaaccaccatcaaagaaaaagagcaaagaacaagaaaaggaagtacgaatggttcttaaacatatgagaagatgactgacccactcataataaagtaaatgcaaatatggacaatgagatgccatttttcatctatctggtatcaaacccaaaagtttgatagcatgttgtgttggcggggatgtgcagggaagtatgtcaacatatctaagataagaatataaacagatggaacctctagcattgttatcagaattaaaaacacgtgtcagtgctctttgactatagtcacacgtctaaggatttattggacagatatgttcacatgtgtagaatgtatatgcatgcatacttcctgaaacattattttgaaaagtaaaatctcagaagcaagcttactgtctgcaatgggaggctggataaataacatggttttcatacagtggaatgtagaagaatgagacagttttatatatactgataggaaggatttacaaaatacatactgaatacttccataattgtatgctgatatatgcctaggatattcctggaaaaaaatggaagagatttcctctggggaggaaaactgtatagctggggaacagcagtgaaagaaagagggtgactttataccatgctttgtgaattttgtactctaggcatgtattacccatcttttaaaaaagaaatagccaaaagaatcagaagaggggcttttttctcaacctaataggatatattttaaagttatagaaatggaaattgtgacattgctatagaataggcaagtagattagtaggacagaataaactcaagaactagactgtgttagtctgtttgggctgctataacaaaataccatagcctgggtggcatataaataacagtttagaagaactgtttataagaattgtttctcacagttctagaggccaggaagtccaagactgaggcgtcagcaggttcagtgctggctgagggctcacattccctgattcatagatggtgccttctcactgtgtcctcacatggcagaagagaaaagggagctctctggagtcccttttataagggcacttattccattcttaagggctccactctcacggcctagtcacctcccaagcaccgtgccttctaataccatgacattggggattatgtttcaatgtatgaattctgggggacatcaacactcagaccatggaacagaccaatatacacatgggcatttggtgtgtgacaaaatggcactccagtatgtggggatagatgggtcagtaagcacagttggtctaattggttattcatagagaagaaaaaggtgttgaatccccaccttgcattatgcacgaatgtaaattcccacttgtttaaaggcctaaatgtccaaaacaaaaccacaaaatattttaaagaaacatagaagaaatatgtcgttttgactttggggtagggaagtccttaaaagacagaaaaagccctcccttcccaccccacaaaaagctgggtgaggtggcacctgaagtcctagctattctgaggctgaggcaggaggatctcttgaacccaggagtttgagtccatcctggacaacatggcaagaacccattcctaaaaaaaagaagaaggaaagaaggacgaaagaaaagaaaggatgaaaactcttcaaagtaatatatatatctcttaaatgtgtttgtgtgtgtgtgcgtgcgtacactgtgcatttatatttcaaactcataatagtggttcctttaggtaaggttgggcatggagagggattgggaatggtgggctttagctttacatgtaaagggctttaaaaattattatttaaggaatttatttttttattatactttaagttctagggtatgtgtgcacaatgtgtaggtttgttacatatgtatgcatgtgccatgttggtgtgctgcacccattaactcgtcatttacctaatgtaaaggaatttatttttactgttaattattgtcataatttgacactaatctttaaaaattttttttatagagatggggtctcactgtgttgaccaagctggtctggaactgttgccctcaactgatcctcccacttcagcctcccaaagtgctgggatgacaggcatgagccaccactcccagtctcttacctaaaaaataatagaaaaaatattcccaaactgaagaaagccaatacatctttagaataaaagagtctgttgagtgttgagcatgaacaatgaaaaaaaaaagattcaaatctaaatatatcctcttacaattttataatgacaatgacatgtagaaaaaatcttaaaagctctgagagagcagagactttcaattcatattgcaaatggtttctcccaaaagatgcagccaccggcaattttcaggagcctctggtcctaccgtgttcctcttgcccacctacgtttggctgggttctgtgggaatagaggccctttagccgatgtcccacctgcagaaagaattgctgaagccgcagtgagagggaggtcagctctgggtttggaaggtgataatcctccccagtctgctcctttggaatcttgtagtgaggtttctgtgtatccgggagcaggtaaaatgaaactactttgaacagaagtgagctgtgctgcccatcgtggggccctgaaccctcacaatagtgtttcttacttccctactccttcttgtagaccaaaacacctgatggttttgtaggattttccaaggtactttctttacctactctatcatcactgctgagagattttaaaatgtaagatgcaatcgaccacccgaagaatgtgtgagcctgtggcatagagctgggtcctctgtcttaaggctgcaatttcaggaatttcttaatgtatcttttatgtgttgtgatgatgaaagactctagtggaactccctgtttacacaaaatgtgacacttacaagtttccaagaaaacgccctgcctgtctggcaaaacggagctaccagaagacttggaatcaggcgaggatgcttctgatatgcacgttatccacaccccacgggacagagctctcttgccaatggttggcggaacacaggaaaggcttgttctggaagatccttctatctcaaacccatacaaacactctcagccctgctcaggctggagctcaggatgctcttgttgcagcttcagggagggggctcaatttcctttggagaagatgtctaaatcctcagaatgcagtggcccaatgctataaacaacatcaaacgtgaaagagcaaactagatataactgatggaggatgaatattattccgatatttattcttctggcaacggagtgtgaggggctcatctcactacactctcgtattactggaactacaagacataaaaaatgacattccgctttttttcgacacaaagtcttgctctatcacccaggctgcagtgcagtggcgtgatctcggctcactgcaacctccgcctcctgggttcaagcaattctcctgcctcagcctcccgagtagctgggattacaggtgcccatcaccacactaggctaatttttgtattcttaggagagacgggtttcaccatgttggcccggctggtctctaactcctgacctcatgatctgcctgtttcggtctcctcatgtgctgggattacaggtgtgagccaccgtgcctgactgatatcctacttttaagtgccattggttgagtgcctgagaagaaaacattttttccttatgattgttcctttttgttttgtgtttgtttcacagtctggctatgaggaaatgattgttcctttataaatcatgaattttctgtcatctgtgaattttcttttcttttttttaattttattattattatagtttaagttttagggtacatgtgcacaacgtgcaggtttgttacatatgtatacatgtgccatgttggtgtgctgcacccattaactcgtcatttacattaggtatatctcctaatgctatccctcccccctccccccaccccacaacaggccccggtgtgtgatgttacccttcctgtgtccatgtgttctcattgttcagttcccacctatgagtgagaacatgcagtgtttggttttttgtccttgcgatagtttgctgagaatgatggtttccagtttcatccatgtccctacaaaggacatgaactcatcattttttatggctgcatagtattccatggtgtatatgtgccacattttcttaatccagtgtatcgttgttggacatttgggttggttccaagtctttgctattgtgaatagtgctgcaataaacatacgtgtgcatgtgtctttatagcagcatgatttataatcctttggatatatacccagtaatgggatggctgggtcaaatggtatttctagttctagatccctgaggaatcgccacactgacttccacaatggttgaactagtttacagtcccaccaacagtgtaaaagcgttcctatttctccacatcctctctagcacctgttgtttcctgactttttaatgatcgcccttctaactggtgtgagatgatatctcattgcggttttgatttgcatttctctgatgatcagtgatgatgagcattttttcatgtgttttttggctgcataaatgtcttcttctgagaagtgtctgttcatatcctttgcccactttttgatggggttgtttgtttttttcttgtaaatttgtttgagttcatcgtagattctggatattagccctttgtcagatgagtagactgcaaaaattttctcccattctgtaggttgcctgttcactctgatggtagtttcttttgctgtgcagaagctctttagtttagttagatcccatttgtcaattttggcttttgttgccattgcttttggtgttttagacatgaagtccttgcccatgcctatgtcctgaatggtattgcctaggttttattctaaggtttttatggttttaggtctaacatttaagtctttaatccatcttgaattaatttttgtataaggtgtaaggaagggatccagtttcagctttctacatctatggctagccagttttcccaccaccatttattaaatagggaatcctttccccatttcttgtttttgtcaggtttgtcaaagatcagatagttgtagatatgcggcattatttctgagggctctgttctgttccattggtctatatctctgttttggtaccagtactatgctgttttggttactgtagccttgtagtatagtttgaagtcaggtagcgtgatgcctccagctttgttctttcggcttaggattgacttggcgatgcaggctcttttttggttccatagggactttgaagtagttttttccaattccgtgaagaaagtcattggtagcttgatggggatggcattgaatctataaattaccttgggtagtatggccattttcacgatattgattcttcctacccatgagcatggaatgttcttccatttgtttgtatccttttttatttcattgagcagtggtttgtagttctccttgaagaggtccttcacatcccttgtaaggtggattcctaggtattttattctctttgaagcaattgtgaatgggagttcactcatgatttggctctctgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgctctggccggaacttccaacactatgttgaataggagtggtgagagagggcatccctgttttgtgccagttttcaaagggaatgcttccagtttttgcccattcagtatgatattggctgtaggtttgtcatagatagctcttattattttgagatacgtcccatcaatacctaatttattgagagtttttagcatgaagggttgttgaattttgtcaaaggccttttctgcatctattgagataatcatgtggcttttgtctttggttctgtttatatgctggattacatttattgatttgcgtatgttgaaccagccttgcatcccagggatgaagctcacttgatcatggtggataagctttttgatgtgctgctggattcagtttgccagtattttattgaggatttttgcattgatgttcctcaaggatattggtctaaaattctctgtttttgttgtgtctctgccaggctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttggtgggtaagctattgattattgcctcaatttcagagcctgttattggtctattcagagattcaacttcttcctggtttagtcttgggaggatgtatgtgtcaaggaatttatccatttcttctagattttctagtttatttgcgtagaggtgtttatagtattctctgatggtagtttgtatttctgtgggatcggtggtgtatcccctttatcatttttttattgcatttatttgattcttctctcttttcttcattagtcttgctagaggtctatcaattttgttgatcttttcaaaaaaccagctcctggattcattaattttttgaaaggttttttgtgtctctatttccttcagttctgctctgatcttagttatttcttaccttctgctagcttttgaatgtgtttgctcttggttttctagttcttttaattgtgatgttagggtgtcaattttagatctttcctgctttctcttgtgagcatttagtgctataaatttccctctacacactgctttgaatgtgtcccagagattctggtatgttgtgtctttgttctcattggtttcaaagaacatctttatttctgccttcatttctttatgtacccagtaatcattcagaagcaggttgttcagtttccatgtagttgggtggttttgagtgagtttgttaatcctgagttctagtttgattgcactgtggtctgagagacagtttgttataatttctgttcttttacatttgctgaggagtgctttacttccaactatgtggtcaatttgggaataggtgaggcgtggtgctgaaaagaatgtatattctgttgatttggggtggagagttctgtagatgtctattaggtctgcttggtgcagagctgagttcaattcctgggtatccttgttaactttctgtctcgttgatctgtctaatgttgagagtggggtgttaaagtctcccattattattgtgtgggagtctaagtctctttgtaggtctctaaggacttgttttatgaatctgggtgctcctgtattgggtgcatatatatttaggatagttagctcttgttgaattgatccctttaccattatgtaatggccttctttgtctcttttgatcattgttggtttaaagtctgttttatcagagactaggattgcaacccctgcctttttctgttttccatttgcttggtagatcttcctccatccctttattttgagcctatgtgtgtctctgcacatgagatgggtttcctgaatacagcacactgataggtcttgactctttatccaatttgccagtctgtgtcttttaattggagcatttagcccatttacattcaaagttaatatcgttatgtgtgaatttgatcctgtcattatgatgtcagctggctattttgctcgttagttgatgcagtttcttcctagccttaaaggtctttacaatttggcatgtttttgcagtggctggtacccattgttcctttccatgtttagtgcttccttcaggagctcttttagggcaggcctggtggcgacaaaatctctcagcatttgcttgtctgtaaagtattttatttctccttcacttactaagcttagcctggctggatatgaaattctgggttgaaaattcttttctttaagaatgttgaatattggcccccactctcctctggcttgtagagtttctgctgaaagatccactgttagtctgatgggcttccctttgtgggtaacccgacctttctctctggctgcccttaacattttttccttcatttcaactttggtgaatctgacaattatgtgtcttggagttgctcttctcgaggagtacctttgtggcattctctgtatttcctgaatttgaatgttggcctgccttgctagattggggaagttctcctggatgatatcctgcagagtattttctaatttggttccattctccccgtcactttcaggtacaccaatcagacgtagatttggtcttttcacatagtcccatatttcttggaggctttgttcgtttctttttattcttttttctctaaacttctcttcttgcttcatttcatgcatttcatcttccatcactgataccctttcttccagttgatcgcatcggctactgaggcttctgcattcatcacatagttctcgtgccttggttttcagttccatcaggtcctttaaggacttctctgcattggttattctagttatccatttgtctaattttttttcaaagtttttaacttctttgccattggttcgaatctcctcctgtagctcggagtagtttgatcatctgaagccttcttctctcaactcgtcaaagctattctctgtccagctctgatccgttgctggtgaggagctgcattcctttggaggaggagaggtgctctgatttttagagtttccagtttttctgctctgttttttccccatctttgtggttttatctacctttggtctttgatgatggtgacgtacagatgggtttttggcgtggatgtccttcctgtttgttagttttccttctaacagacaggaccctcagctgcaggtctgttggagtttgctagaggtccactccagaccctgtttgcctgggtatccggagcagtggctgcagaacaacggatattggtgaactgcaaatgctgctgcctgattgttcctctggaagttttgtctcagaggagtacccggccatgtgaggtgtcagtctgctcctactagggggtgcctcccagttaggctactcgggggtcagggacccacttgaggaggcagtctgcccgttctcagatctgaagctgcatgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgcactccaccctgttcgagcttcccagctgctttgtttacctaatcaagtctgggcaacggcgggcgcccctcccccagccttgctgccaccttgcagtttgatctcagactgccgtgctagcaatgagcgaggctccgtgggcgtaggaccctctgagccatgtgcgggatataatctcctcgtgtgccgttttttaagcccattgggaaagcgcagtattagggtgggagtgacccgattttctaggtgccatctgtcacccctttctttgactaggagagggaattccctgacccctttcacttccagggtgaggcgatgcctcaccctgctttggctcacgcacggtgcgctgcacccactgtctggcacaccccagtaagatggcctggtacctcagttggaaatgcagaaatcacccgtcttctgcatcgctcacgctgggagccgtagactcgagctgttcctattcggccatcttgcacacatgttctcatctgtgaattttctgtccatgtcctttgtcatacacctattgggacatcaatggattttgctgttgttggtcacttggcatgagtgcattcaatacaagtacacttggcctgtcatatatatggaaaataattttcctaacttgcctgagttaaaatttggttgttgctgtattttgtcttgcagaaacctccagttcttaagtgatcatgaaacctgttgctatttccttttaaacatatttcccctattccttttgtagggccattccagaggaaagagcttcttgcagtagactctttctgaaaatgactgacttctctgcaagtcaggcaacaataatgatatagttcctaacagtaagtgtcaatgcacttcatctgatttgatgaaatttgggggcaaggacacagtggcataccaagggtaggtggtgggaacagcctaccctgcatgcaggcaataaaggagtgccttgtgtgtagcatcattaaaaacagtaataaaactgactacacgttggtcagctttttattatcactatatgctggttattctaagcaatgtccgtgatgaagtacttactccttccccccaaaccatttattagtctaagtcctaaacagttgctgctattagtgttgtcttttagtgatatatgtccaggcttaaagagtgcacattttattacttatgttttaataagtatgtttaattgccttctacatggaagttaatttggaacacctccaattacacaggatataagcagagtcagttgcaggctggttccaagagtcagtttgcaagggtgacaattcagaattgttggcgctcacttctggggcagttggttccttgtactccggatctacgccgtattcctgtgttgaatgagtagggtggaaatgaatgaggctagctcggtgaactggattcacttcagttctgtctgtctgggtgcgagccagtctctaaagctttggagttcactcttttggaagtgtttcttcgtgcatgcccccacttaaaaaaaaacacattagggtaatgattaatccatgactttttaatttttgtattgtaatatttattttgcttttattaaaaagtttttacaggcaaaattatatatacaaagttcaatcctgctactaatttctctggccattagtattcatttcatttcattatgaccgaagatgatttcattgtatgtggggatgttgaaggtaatctgcttgaaactaatacaacagttgtgccacagcaggtgtgtttcccagtcttcaccacagggccttgtcacatgcaagctggaagagcaggtggcaggtatggttgtgaagaagggatggccagcaggactggctggtttctcatcattcgacttccattcaatgcaggtcaactctcctggggttgtcctgagcaatgcctccagatccgtgttgacggtgcctacttggccttgggggacaacccactgaatacacaagagtgtcttctgcaagcagccctgctgcccctccttgtcggatgtgttctttcctgctgctggtaggcaggtggggctggctcccctcccctggtccaccagcgagatgcgtcactgtggtctctctccatggtggccggtgacaggctgggaaaaggcttcctccagctgctctcggcctggcagatgcaggagatgcggtgccccttgagcctcgtggtgttgttgtctttgttacagtctctgaggactcgctgggccacaggcaaagagagagcaaccatctttttctgtcccacaaaactgctgacatggttttgacactgtctggagtcataacgtcaggctcacttggcgtaagcacctcaacttgaagagcaagtgggaaggagggcatcaggtgcctgtgtttagtgttggttcagttctgagttctgccagtgattttgagaggtgaagccagctggacttcttgggtccagtggggacttggagaacttttccgtctagttagaggattgtaaatgcaccaatcagcactctgtaaaaacacaccaatcagcgctctgtgtctagctaaaggattgtaaatgcaccaatcagcactctgtaaaaacgcaccaatcagtgctctgtgtctagctagaggattgtaaatgcaccaatcagcattctgtaaaaatggaccaatcagcactctgtagaatggaccaatcagcactctgtaaaatggaccaatcagcaggacatgggaggggccaaataagggaataaaagctggccacctgagccagcagcagcaacccactggggtcctctttcatggtgtggaagctttgttctttcacacgtcataataaatcttgcagctgctcactctttgggtctgcactacctttatgagctgtaacactcatcatgagggtctgcagcttcattcctgaagtcagcaagaatcatgaacccaccagaaagtacaaactctggacaagccacctttaagagctgtaacactcactgcaagggtccgcggcttcattcctgaagtcagcgagaccacgaacccaccagaaggaaccaactctggacacaatttcaggagggtcggcctgaggttgttaaccctgccacagttccatgccaccgggaggagcctcaggagctgtccagttccagaaagagactgcttttttggagctgatcgcaaagatgcttggagtcaagggaactgattttgttatttagagatgggatcttgctttattggtcagactggagtgcagtggttatttgcaggcacaaacatagtgcactacaacctggaactcctaggctcaaacaatcctcttgccttatccttctgaatacctgggattccaggcacgcaccatcgcacacagtttattatattttgacatcttaaaaaaccctttctggctggggagacactggctctttggagctagtcaatccttagagacagcaagagggcatgcctttgatatgcaaactacccaacccagggcatacctcatccatctggcccgcataccccaggaggctatgttcctctgcctaatcaccccagggccaggtgccaggcagctggagaccgccctgacagcccaaaacccttcaaaattatctactctagcccatcttaagctgctcaccccaccctggctatcccaaggagactccaacaaaggccgtggtccaagctcatcctgcacccctgcgttctgcctcctgaccaacactggtgcttcccctgtggtcctgcttggtatgtggtgaccccctttctggagcctgtgagtgtaatggacttcattgtcctgcgcctctcttgcatctcctcttgtggctgtacctgacctgaccattgcttgaaaggacagagcagggaggctgaaaacatcttcgctgtttgcctcgggctcatacctgttccccttgggtgtccttttctctttctccagccccaggttgatgagtgacccattcatgatttgtgtcctgtgctgggcaacttgatcctcccgcttcctgggaaggtgatggtggttatgtcaccatagtggagatgtggcagcaaacagattctcacaaatgtgaatcattcttggcataactttgatgtcacataataataataatgataaaaagtcccctttcccaccagaggtgagatataaaaagcaaaacttgagtgaggatggaataacctatcctgccatggtatagtttttgcttaagcaaagttctgttgaatgaagacttgtttgcttcttggttcttaactgggtctcagactatgcatgtatgcatgagagacggagagaactagacacacacacacacacacacacacacacacacacacacacacacctgtccacacagatggcatcaccattaaagtcaggcaataggacccttgcctgggttccctttttgagaaaggtgctccgtctctcctttgactgtgccctaaaccacattatgaggaagctgaagggccaaggagatgcactcataggaaaccatgcttgccctgctaggccacattctgggcattggggtcctgaaacactgtgctcgggggggccctgagcctgcttccagagcttgcatgggcttctctcctgggcttgtcctgaagggaactcctcattgttggtgtgtgcaccctagatccagtggggccaagggcagctgctgcggcagaaggggatgggagaggaacatgcgagagaagcagcaggctggcaaggtgaggagggctgaaggctcatacctacatctgcaacctcccctgggccacatgtactggtatgccagggatacagggcagtgtgcccctgcctgcctcgccacatgactttcttagagcagttgttcaacaggagccctgattctgaggatattttcccactagactctctcattattgagtactttcctgcccaggggcccatcctcccagcacttggattccaatgtggtttgtgggaatgattcatgtggcgcctaataatggagaaagccgtggtttatggtttagttttgtctgtcaggtaaaggtggagatagtgacacacaggaaaaagttctcaccaaagtctccaaaggacactgggccaaggcccctctctgcatctcatcttcacatggaggagggggtggccctgcaagccatggggaccaagcagtgcctcgtgctcttcccaggtgagtgtcaggagggctggggatcagtggccgcagcagcaacccccatgctccctttctggtcccttcacacgtccatcttttttcagctgttgaccatgattgatgtgttggactatgtttttttggttgtgcccctggatggttggttttttgagatgtggggtcagtctcttaatctcacttgtctaacaagaagatccaaacaaagaccttctccttctgggttcaaatgggacgtctattcaatgcacactctgcccctctgacatgcagtttccctcccacgtggggagctccagcccgaatcactgaccccacttcctctgaccacacgctccctgactgccagtgttccctgcctctgttcgccaggctccacactccaggctggaggccttggcttccccctcggctccctgcaccattgagccagtggcagcaagtagcttcatcagctttattggtggaggatccaggggaaggctgtttaactcccaggccaagctctttcctcctctcctcttaggcaaagatctggggcactagctggccacacatgggtgatgctgcctaagtcacttcttgaagcactgggttagactggtccttcctgtctacctggaccttaggactcttccccagcaggatggggttagagggcccagcgtgaccgaagcattgggagggcaggaacaagttagtggtgtttgcctctccctaaggcctggcttacacttggagaggaccagcctttgaccctgcacagcaggctggggttctgcaaacagccccgaccccaagatggatgttcagtgtgtatctgcccccaaactcccacaggcctcagaaaaccgagggctgcctctgggggagcaggctttgggcattcctggggctgtccctccgctctgccacttaacaaccgtgtggctgtggttgagtgactcagctctctctgtaaagcagggatggaatgagtcctttgaatcagcatggggaagatccagtgagcttctatatgcccagcgcatcacaaggtcttgggaattagtggttagtactgttgttgctgccattcatccatccctcttgcaattgttagtttactttctgtcttccccagaagctcctctctccatatctgtgccgtccgcttctctgaccccagaacccagtgtcaatacatatggctggatagatggttgaataaatgaatgaatgaatgaatgaatttattgttatggagattaaatgagacgccacaaaagctccaggaacagaatgactttttatctggagaaggcaaggggacaggccacaggcagcccgcattgaggcaggcccagggagacacatgaggcctgggttgcagcatcacagcacagcgcgggagagcccagtgctgctgtggtgaaggtgtccaggtgggtcacctttgctggtggctctttacttccgacttctgtgtgtactcaccttcccagacccttggcctccctgggagagctgccctcctggacctgagcagtgggtgacagccgcacctgtccacagggaaaatgttgtcgattttctgtcagtgtgaactctcacatttacatttttgccaagctgaaaataacagtaacataaacacgcctccatggccctgtcctctctgaagggagaggagaaaaaagtgcagcccactccagaaaacaatgttccctctgttagcagacacgggcttctgtttaagtccccagggcccccacggctgcagtggaatgagctgggcccggcctgctgggtgtaccggctgcctgggcagcccctcccgaggccagccttgtttacgaccgtgggagagggggccgctcccagcccagctaggcacccgtgaggcactgaccagccagccctgtgggaacccagggccctgaatgcctcccctgtgcagaagggtcagtgctttccaaccctctgccctgtgcactgtggtcaagggcacatcatgtccccaagcacagagtgtgctcagggtcctattcttcacaacagccttcctttcactgcctgctcagcaagcagaaaaggttaacatttccatcttccgtcctaaggagatgcctgctgggacttggtctcaggcatgagtcttttcttcctccttcctgggaggggttggaactaagcctcaaagcagagtagctgacaacgtggcgtgggagaggcttggatgtgtcgctggagagaaacattcttgccacccccaccctaaagaggctgcggggacaggcagcccagccctcctggcctattttcgggctggagagaggttcagtctcaggcacagttttgggaggcagatcagcctccctgttccggcctcccactcccatggagctctctgctgcctcttccaaggggccgcagatacccgttccttgctctatttcttcaccagccctacctgttctcagtccattacctcatggccctgctctctgcttactaaagtgacaattcgtctataaggaagcccttgcactgtagctgaggattcgcgaggctgcaccctcagcaggcactgtggccacacagcactggcctgagatctgagttcctggagcctcggccctgaggcccatggtgagtatctctgtagctactcagccagcctgccttggcctggtgatcaataacctgggacctttcccccagcaccagcatctgtgagctcaaggaagacatctgaacttcttgatagcagggcagggccaaaccatctactgaaatcatcagcaaaagtgaggggaatgcaggactggtcgctccagaaacttctaactttttagctagatgtaaatcatcgcacagcttttgctgcaatgtggacattgtgaagggtgttttgcctcttttaggggtgcaataaaaaaggaaaaataatggaatgagaaaaaaatccaaaaaatggataaaaatctttggtcaagtcctgtaaaactatgatcttagttctcagagtctatgggaaacacatcacagtgggtcgacttatttctgtctccaaccctagagaccatctcgtgtaaaaaaaaaaaattttgtaaaacaagaagagttagtcttattattcagtataccacaattacttgcttagttttcattttgttgagctgcttctggtttaaatataatatatatatttgaagtcttaatagccattgtgatcacaaaactgctggcaagttttatcaaaacccttaagacaggcaaacgtgaggctcttaaagagaaaatcctcagtcgccccctcatttctaatttatctagcacagtcagtaaacatgtctttcagagggaactgaagacaattagaaataaatcaagatacaaatgaattcaatacttactgttgtatagatcagcagctgtcaaccaaagggtagctttgcctcccaggggccatttggcaatgtctgcagacatttttgattgtcgcagcttggagaagaaaggctgccgctagcattcggcggtacagactaggaagtctacaatgctcagaatggcctcccacaacaaagaattgtctggcttgaaattccatagtgtcaaggttagaaatgctggtatagaaactatgagagacacaaaacggcataaaggcataattactgcgttttaggaatttgcaagctaacttgttttcaaaatgctacataatgaaaacagactttaatttctcgtatttatttcccttgctctggtccctgtttgagatgtatgggaaagccaggagtcccgcgatgcttctgagtgaggcattctgggtagcgccaagaagggcagtacagggacattggtgcatgggccacgggcagatggcccttgctgggctcagctgttcactggaatgtgcactattcttggggtgacagtgaatgactaagccattttaccttcagggggtctgcagctctgaggccacccaaggacaccaaaaccaggccaggaagctctagtggggaaggtgatgagagggggggcgtcggtgcacagagcggcaccgtggctgcgtccaagtccagtcgggttttggaatcttgtcctgcgtgtctgtttgtgattctctcactctcctctggcttctggacctaccatgttctatggagcatccaaaactggggagctgacacctcagggccagccctgcactctcatttctggcgtataccacagtgggccttacttgggaggcattcggggcagggcccagcacagacgagattctcagaatgtgtggacgatggcactgtagttgaagaggggagtcctcgcttctagagctccacgcctgaatatttacaatgaaatgatgtgatagccgggatttacttcagagtaacctggagtgcagagacagaggctaggcgatgggaaacgagaatggccatgagccttggggatggcccatgggggtctgatctacatctgtctctgctttcgcatgcatttgaaattgttcataaaaatatctgttaaaccatacttgtccctccaaggccaaggcatggtataggggccaaggtgagtgaagaggccccggttctcttttggagagaattacttggtttggaatgagagtttttaatatctccctgttgatctggaagagtggggctcctgtcacgggtgggtaggggacccagtgccagtggttaggggaggctggaggctggctgggtccatcaggatgtgctggtgaggacgcggctcgggccatcccctcagagctgccctgaagcaggaggccttgcaggggtttgaggaggccgagtctgcactcaagaggttgcaagaaccaagctgccctgatgccggggatgggccccaggctgaaagcctgagcacaagccaggcctgaagggcactgagcggccagagctgacggcacttctgaggggctgaatcagagtcagtcccaggagagggaagaggatgaaaggaatcaggagggcttgtttgtgctttaagcctgtccacaagaaccaggagatgggctcctgggatttcacaattcgaggtccgtctggtgcctcctgcatcctctgcacttgcacattgtgtgacatatgaaagtcggaagtgacctgaagacacgtgcaccacaagggatgctgtggagacgccctacagggactctgatgtggggggcatttccgatttctggggcctggcttttagatgaaggcagcagaaagttacctaaagacagcaatggagaggtctttagtgatccactgctgtgtaataaaccaccccgaacttaatggcttgtaacagcaagcatatattccctgccatgtttccgcaggttgactaggctcagctgggcagttcttggctggtctcacttggggtctcttgggaggttgcaggcagaatgcgcctgggctggagtcctctggtcgctctcccagggtcccagaacagctgcctgtctacgtggtctcaaggccttcgctccctatatggcctttctatgcagtgtctccatgcagactttctggtgaagggagctgggggcttctcacatggaggctcggggctcctcaaagtgcagaaccagaagccttcttaacacttagccagaagctggcccagtgtcacttcttcctccttcctttggttgagctgttgtggccagctcaggtccagggtagggaagtaaattcttgatgggagaatgacaaggaattgtggccatcattaatccaccatagggacccagtctggagcctgcacagaagtggggaagctgcggccgtgttaggtgatgccgtcttgtagacgcgggagatgccagaaccgctatccctggctccttctctgtgtcctcgctgacttgaacaagcaatgggtcattgtaacatcttcagatgcctcttggcttcatgtcatcagctataaagtggcatcacagtgatatctctctggggccagccctgggtccacctgccaaccacctccctgtgcacagttcttggaagtcattcattcacctgaccagacgctgaagccagacccgtccccacccactgaggccacctccgtaaggtcaggttgtggccatgtgctgggtcatttcactcccttctgggctcacaggaaggaaggaggtctttgcaggggcaaatggagcaccacctcatgtctgctgcacctgctcacatcctctagctcctcctcccagcaaacctgcctcaagggcacacagagtcctggtggagtcaagactcgagtccaggtcctcatacagcaatgccttgtcttccctgcaggctcccaggggcaggcaggtgggagatgggtgcacagggagtgccatcgtccccacacccagactcctcagggattctctttcctcagttacaaagagtgctggctctgctagccaggacagatgttagcaattttcaaggagcaaacatttctcatttcatcttaccttaatcaagttacttgggccctatccacaaaagtgtctgaggaacagatgactgaagaagggtgacagctgctgctggcctggtgggggcctctgtgcagtgaatggctggctggctgctggatgtggcgtggcttgctgatgggcatgaatgtggggagcgggagcctgcctctcagcttcctgcatctggaattgaaattggacctgtttgcaggtcagtgtgccctgggggaactgccattctctcactctcctctgggtcctggctaccactccagcctgtcccagtgcccatggctgggaaaggaacacccaggacatcgctggctcagcccacactctgtcacctctctgccacattctacacaccgtgggcccttttgggagactttctgggcaaggctttaccagattgcatttaaaaataatctttcaaatatgcttcaccttcaaagccaggctagagatggagaggcataaagcgtgaccaggaggattcaatgttttcttggagagtctgatttgatttcagtgctgagtaggaggagaatgtcctgcagcccctctctgtttcaccttaatttgtaaggacaggggtgtttcttcccccccacagtgcctagacctttgctaagcacagttggaatcagcaaacatcaagaagcactgaagatgcacttgctgatcgaaggtaattgctctcgaccttggccgaatactaggaaactttaaaaatcatggatgcctggctcccacccccacattctggcaattggcctggagtaggacccgacagaaactcccctgtgattctactgtgcaggcgaggtgaggcctcctgccccgatgcctgctcctccgctcctaccagccctgctggattgagcctgactttgcctcagctcgggtgtgctcacaggggtgtccagccagctgcctcttgtcaccaccatgacctggacaagccctgctgcttcccagtacattcggacaacgggaccggaggaaagaggatctcagttggagagtccaaggtgcctcaaatcaaaagataaaacttgcagatggctgccaatggctcgggaagacaccgctaaagtcatgtcatgccataactgggactgcatctgtgagggaggagcatgaccttggaggcagaaggtcaaggtcaaggctcacccattctactccatgtgcttggcttccccatctccataaatggcagcttcatgttttcagtattgcaagccagtggacttatggtcatctttgattcctctttctctcacatttcacatctaatccatcagcaaatcttgttggctccacattccaaatatatccggactctgacggctgctcaccacctctgctagcatcttgtcaggtctgaattaccgcaaccacctcctaactggtccctctgagtccatccctggcccgtcacagtctattctcatcgtggcacccagagcagtcctttcaaaatgcaattcggagtatgtcacccttctgttcagaaccttcactggattctaaacttacatcgtgggacatcccaaatttttactgtaatctctaagactggccaggtctggtgcctgctgtctcctgggctcattttctgctgctctcctcctcatttatgccaatctggccaccccagcctccttgctgttctctaagattcccacggtcccactgcaaggcctttgcacttgctgttccctctgagtagaacacccttcttgatatttgcacagctcactgccttccttccttcaggtttgtcttcagttattatcttatcagagaggcctccctgtgtaccttacttaaaatagtgtcccctaaccgaattctaacgctttttttttttttttaattttttttggaggcaaggtctcactctgttgcccaggctggagtgcagtagcctgatcacagctcactgcagccctgacctcctgggctcaagcaatccttccacctcagcctcccaagtagctgggactacaggcatgcaccaccacacttgcctaatttttgtatttttttgtagagtcggggtctcactgtcttacctgggctggtctcaatctcctgggctcaagtgatcctctcaactcagcctcccaaagtgctgagattacaggtatgagccacctttttcctttcattctcagaatctgtcaccacccacatattatacatttacttgtttacttgcaggctctttcccctagaatgtgtgttccctaagagcaagttcactgtggtgcctccagcacccaggatagtgtctgaaacacagcaagtgctcagcaaatatttgctgaatgcatgagtacatgtatgaggaaaagcagttgcaaagaagattccagggtgggtcttttgggaggtcatgtgaaccagaccttaaaagactgagggtgagcatgtaggggtggagcgagaggcttttccagaaaaggggataaacagctgtcaagttggtcaggagctcaggccagcggtgggagtgtgggtgtgagtggagcatctggatggagctgtgcgcgcccagctcatgaacccccctcagagctactgaggctgagctgatgtgcttgggagccctgtgcagccaggagaaggcactgcatgggcgtcca

SEQ ID NO: 96 - DNA, 10280 bp, Homo sapiens
agaattcaggagagttcatgagtagagagagttttaattccagttcaatagtgatgtccaaaaactaaaccaagaattcattttccttcttttttttttccagacaggatctcagtctgttgctcaggctggagtgcagtggcatgaatgtgactcactgcagcctagacctcctgggctcaagcgattcttctacctgggcttccctcccctaaatgtttgagtatgaaataagtaagcaatttcttattcttaacagtatttagcctgtacaactccttgatggaagaagttccacttttaccatcaacattaaagtggcagagtaaagggttgcctatttgtttctcagaatctgaaataaaactagaagatttcaagcagaaaagcaatgaaggcgtgcaatgctaagttccactcactattaaaacagtgaaattgtcaggtgaggaaacggagagctgccatcaagacactgtgcaaagtcagtcttcacaattgaaagaaagctaagactaggtttatgagatgagagtttccaaaattctaacctcaacagttaaatgcaaactgaaagcaaaccttctaataagtgtggtttcaccttaagtaggagtgaactgcacagattttaaaaataaaagaatataaaagaaaaaatcagaacagagagcacttaccactatgcagaatgttaagaatgaaacaatgtgcggtagccccaaaatcattgtatgatgaagtattaaaaaaggaaaacatacaaagaaacaaaaagctagtagtaaaaaaggaaatataaaaacatccagaagtaaaatgaatataaagaataatcagaaagtaaatatataaaaaggtaaacacacaaattagctgtagtcacactaaaaattgatgtggaggctgaagttactagtaatataaaaacatgactataaaaactgtctatatagataaaactggtaattcctatgtgttttgagtaagagagggaggcctcactattcagtatatactaagcaatactatattctaggaattagggatgtaaaaaatagttcctgaccttcagaattctagtggggaaggcagacaataaacaaaaatataatgtaatggtagtattatagcgtgacgaaatgcagggtaaggtgacagagtgacaagaaaggctatttagatataacctgggacgacctctttcatgcggcttttgaacagaaagagactcgaataaaatgaagaaaaagccacaggacctggagaaaagagcattctggactgagggagaagcatgcttggcgtgttcagggaacaatgaggcccaggtggctggaggggcatgagctaggaagagtggtaagagatgaggaatccatcttcgaagggccctgtaggccacagtaaatacctacgacttttttccagtgtgacaagaatctcttaaaaagctctgagtagcggagatacctggtctaacttacattgcaaaaggctcatccagaccgccaggtgaggcacaaagtttaaggaagttggaagaccctgttacaaggctactgcggtattccaggaaagagaatggcggcttggacccaggtggcagcaagaggaggtgaatttagagtgagagaaaacaatatgctgatctgattgtatgtcaggtgtgagggagagttgggagcctccagtaatttgtcgatttcagtttaggcactggtttctgtggagcttctgctctaagctgtggttctctgtattcgcagtctgtctcaccaatttgggggacagcaatttgccctgtgacctcgcttctctgacagatccaagaggagttgttgatttttcagtttgttcagtttttccttgttgctaggacaggtggtgacttccaagctcctcatgcgctggatcacaaagtaaaagtctaccgctttttgtaattttcttcataaaacttttaaatatcttttattagatttcttgcaagatactccgtaattttttttttttaagagatggagtctcactctgtcactcaggctggactgctgtggtgtaatcacagctcactgctgcctcaaactcctgggctcaagagatcttctcttctcagcctcctgagtagctagtactacaggtctgtgcctccacacctgattaatttttttatttttatagagataaggtcttgctatgttgcccatgctggtctcaaactgctggccttaagcaatcctcccaaagccctgagcttacagtcatgagccaccatggctggcctgtaatttcttcatgttataaatgacatctttaaaattatattttccaactctttatgtctgaactaaagaacgttcaacaatggaatcaccttgctgactctcacattaattctaataatgtttgtaaatgatcttggcttttcctatgcaaacaatcatataatctgtgaatgactgcatagaaggatgtgcagtaggctgaataatggccctcccaaatatgtccacatgctaatcctcaaaatctatgaatatgttaccttaggcaacaaaacagtattggtagatgtgacaaaattaaggacttggagatgtggagattttcctggattatccaggtgggcctaatgtaattgaaagggtccttataagagggaggaaaaagggtcagagtcagagaaggcaatgtgacaacggaagcagaggctggaatgatgtgctttgaagatggaagcagaggccacaagctaaggaggaaacattctcccctaccgcctcagaaggaacaaagccctgcagacaccttgcttttagcaccgtaagactagtttaggacttctgacctccagaactataagataataaatttgtgtttaagccaaaaagagttcaactttaaaaaccccataattagtataattctgtttcagaatatcttaaatacaaaacttaacgtaagagaatggataaaatgacttatgaaagattgactcgaaatgcactaaatcatataactaagcaaagccaggtagacggttgacagctctctgacttcccctacttcccaggaatcctcgaaagcaagatcagttagagaaaaatgacagacagcagtcaatggacacctctttcagcccctgtattctaattatttcttacctcatccctttcttacattttgtatggacttgggtaactcctggcctaaaaatactctagttttagtactcctattctgggaagtgtgttataaattatttgcctacaaatagtttattggctacaacagcacagcagcacttgaaacagaaatggggctaagatatactttaaaagtcaaattcatattcctagcattataaatgcatactctaaaaggctaaaatgctatactccatcttcaaaaataacttagagactaagaaaatgtttgcggtgctatctctgcaaattttcctaacttctttatccaacactttaaaataccgtgttcctggcttcgaataactgtcgcctaatcaaagcccaacaatccttgatctgcattcttcgggctagtgcagggtggggaagaggagctttcattacaatggcaacggctaccggctcaggtgcaaaagagaaggagcaatgcaagagggacggctgaaggtcaccggctcgcggacacaggactaggggagacctggggaaggctcagggtggcacggcctcgcggccgtgggaggcaggctggcggaggacagggcggggcggccgctcacccacctggttggtgacctgaaacggaagcagaaacacaatttagagaaacatctttcttgctccagagcctcgctgcccactctccttccaggttggaactcacatcggacttagcatccagcggcggctcgctggacgcctccatgggcagcgtctgggacttgcggcccggactcgagagaacgcccccagaccagcgcttccgcttccacgtcctgcccctagcggcctggcgcatggggcggacgtagcaggggaagctgaaaaaagcatctttatgtgactcatattttttcttaattcaacatatatcttaggagacattgagctaaaagaaaattattttatggaaaaaggccaaagatttgggagatactttgagaagagaagcgctaattaaatttaggatgccgcttcccccatctaacagtgacacgtgggctcttccagactggagcggggcggggcacagcatcccgctgcgcggctcctcaatcccaaccaaattcggaaggcgctgggcgaccgcacccccggcacatgggagtttgtcctgcaagggaaggctgtgggaaccacagttataggatgagctgcttcgctggcctagctgtgggcggggcatgctttccattatccctgctgttcctcttgaatcccagccctcagtctggctgcggaataccttcccatcttgtcttcccacctctttcctattgacctcaaatccatcctacaggaagtatccacagtgatgttttttccccgccaactttgtattttgaaaaatttatttttttcagaaaaattgcaaaaaataattcaatgaacacctgtatacccttcatctagattcaccaactgttcgcattgtacatatttgctttatctcggcttgtattaaggatgatacttcactcctaaatgcttgagcatgttgtctcctaagaactagggcattcttctaaataaccacaattcaactatcacattcaggaaatttaatattgataaaatactattctctaataaataagtcaaattaaaatttccccacttgtttaaacaatattctttaaagttattccctaccccatccacaactagaatctaatcaagggccgccttgaatttggtgatcatgtctctttagtctcctctaatctagaactgcaccggtaaacggtcagcaggactgtgttcctcaatgaaggttccggggtggtggggtttgggtgggggacaggggtgggatctgctttcagcctcaattcaggttgttggcagagctcagttctgtgcagtttccttgctggcttttagatggggactcccagctcctagaggccatctgcattccttggcttgtggctccttcctccaccttcaaagccaggaagggcaggtcaagtcctcctcacactttaaatctctctgatctccctttctgtatgatctctcctgttcctgttccttcttttgccacatctctctgactctagcctgaaaaaattctctgtttctaggggcctaaaaaattattagatcaaatataaccaaacaattaactttttttttttttgagacagagtctcaaaaaaagacactcactctgtcacccagactggagtgcagtggtgcaatctaagctcattgcaacctctgcctcccaggttcaaacaattctcctgcctcagcctttttgagtagctgagattgcagacatgcatcaccatgcctggctaattttcatatttttagtagagatggggtctctccatattgggcaggttgatctggaactcctgtcctcacgtaatccacccacctcgggccttggcctcccaaagtgctgggattacagacgtgagccactgtgcctggcctctttctatcttaaggtacataaattttaattatatttataaagtcccttcagatcagtacctaaattagtgtttcaatgagtaatcaggatggaaatctttggaggagggcatttttagaataatgcttaccttaaataccctcatagggttgttggagaattacattagttaatgcatgttaagcacctaaaaatgtccctggcatgtagcactcggaaactaggccaaaaaaccaaaaaacaaacaaaaaaaccccccactgactcaaggttattggacgtgattaaatgtactaattagcttgggaggatagtccctgaatgaatcagacgatttcttctctaaggaagtcagatgaaaacacagaacactgctgtgcatccagctggtcagtgtgtcggttctttttgcaaggaaatctttttttttttttttttttgagacagagtctcactctgttgcccaggctggagtgcagtggcgtgatctcacctcactgcaacctccaactcccgggttcaagcgcttctactgactcagcctcccaagtagctgggattacaggcgcatgccaccatgcccagctatttttttgtattttagtagagatggggtttcaacgtgttgcccaggctggtctcgaactcctgagctcaggcaatctgcccgcctcagcctcccaaagtgctgggattacaggtgtgagtcaccatgcccagccccaggaaatctttttcttcagttcttgttgtcatcatggtgagggggtggtaaatacacacacacacacacacccacacacacacacacacacacacacacagacacacaccccttaactttgtaaaaatgcttcaaaaaggtgaaaagatgtgtattttaaaaggtattttttgttatttctttgtatttttcatgcatttctttaaaaactgtttattattgttctaattcaacatgagtgcacttcaaaaacctatcgatctgatttggggagagtaaaatgtcattagagtttagggcaatctctgccaattgttactccagcaacacgtgataaactgtttatgtttcagacctccatcttacaagagatcacttacacaaacttcgcagttggaaaatacagatgttatcaatagagtcaaaaaatgctaatattaaaaatgcatgagtataattttgttttatttttacataatgacatataagtagaacatatgtcagaaaatatttttggagctcttacagtaagcctagtactatcacatgcataggaagaaatccatagaactatggcataaactctgatctcatgagcattatggtgtaatgtaaaaaacgaaattggtactcatgaagcaggcaatgcttcaatttaagtatttattttaagacttttttgtgccaagagatatgcagttgtccctcagtgtacttaggagattggttccaggaccaattaagggagatgacaatgtaccaaaatctgcatatactcaagtcctacatacagtctgtcctgctgaacttgagtataggaaaattctgcctccctatttgtcggtttagcatcctgggagtatagcagctttgatctgtggttggttttaaaaaaaatctcaccagcacagttcaaacccatgttgttcaagggtcaactgaaattctaacttgagctagcctaagcaaagtagcagaaattattgtctcacagaggcagcctttgaaatgtagtggtagcagcttcagggtcaacagaattgtgagatgtgaatagcaaaagtgccccatctccacttctcagttgtggtatggccttctgcttgactgctggcttcggtctcttcagcttctccatacattgttggagagtagtgtgtatatatagacatatgaccaccaacatctctgggttcacagccttatgactcatgatccaaggagaaagaggaagctgcccgttcatctcaattctcagagaaggactctagttgatctgcttggaccaatacgggtctggagtgatgtgttactatttttgcccatgttgcctgctgtgttcataaggcgtagagttgtgtgattggtagagtcactggaagtaaaaggggtgaaaagccatgctctagagaagatggaggtgagaatgaggcaacaaagcttgggtgcaaatatactagggaaacaaaataaatgtgcactcaacatatttactatactgtattacaatacactatcctgtgtagtcaatggatatggtatgcagaataatggccccccaaatatgttactttctaatccccagaatttatgaatatgttatggtgcatgtttaaataacagacagaggctctctaaaagaaaatatttatttgcgcatagggcattgcagcagaaatacatatgccatagtaaactatgtgcatattcaaggaggtaaaggaagacaaaggtttttaatggaaaaatgaggatgattacataattgttttgtgataattttccttgcctacaagtattaataacaagggtgatgccagtcattagctggacaggcagttgctgggcagatgaccttgcaaaagtattttttgtgtaagggtgcaatggcctttgtgcaaggttgtggtattggcagagtcttttgtgatggtttttgttatctggcatttatgcatgaaagctgtctcatggccttccccagctctatttgtcaaggtttctttttctttctttccttttttttttttttttgatacagagtttcactcttgttgcccaggctggagtgcaatggtgcgttctcagcttactgcaacttctgcctcctgagcttaagtgattctcctgccttagcctctcaagtagctgggattacaggcatgcgccaccatgcccagctaattttgtatttttagtagagacagggtttcaccatgttggtcagtctggtctcgaactcctgacctcaggtgatccacctaccttagcctcccaaagtactgggattacaggcgtgagtgactgcacccagcccttttttttctttttaacacaagtgactccattatgattcttacaattttcacaattacataaaaagggggaattaaggttgctaattagctgactttaaaaggaggacagtttcttggattcctcagatgagtccagtgtattcacagggtccttaaagatgaaaggtagaggcagaggagttagagtcagagacagagagggagtgttagagtgatagattccatgtgagagactcagccagcctttgctgattttgaagacagatggaggccaagagccaaagaaggaaggctgcttctagaagctagaatgggcacattagcaaagacatggaatcaacctagatgcccatcagtggtgtacctggataaagaaaatgtacatatacaccatggtatactacacagccataaaagagaacaaaatcatgtcctttgcagcaacatggatggggctgaaggccattatcctaagcacattaatgcagaaacagaaaaacaaatacatgttctcacttataagtgggagctaaacactgagtatacatgaacataaagaaaggaacacacactggggcctacttgagggtagagagtgggaggaaggcgaggattgaaaaatgacctatctggtactatgctcattacctgggtgttgaaataatctgtatgctgagcccccctgacacacaatttacccatgtaacaaacctatacatgtatccccttaacctaatataagttggaaagaaaaaaaacagctggaataggaaagaaaatggactctcccttatatctcccaaatagtttccagaaggaacacagccctgtcaacattgtgattttagcccagtgagccccatttcagacttttgaacttcagaccataagatacaaatttgtgttgttttaagccactaaatgtatggtaatttgttatagcagcagtaggaatttgacagagtagagcataacaatgagtgctgcgatcttgacagtcacctaggcctgaatctaaagccctcttctaccactcagctgtgtgatatcattcaagttggcttttctgagcatcagctttcttagctgtaaaaatagagctatcaatatttgtcccacaaggtttttattaagggataaatgagatcttgtatgtaaagcatgtaacaaaggttctgaacatagtaagtgctgataaatcctagatgctattgtcatcagcacgatattcaatactccaaagaagcctataggttatgtagatcatacattatctctattttaaaggtgagaaaactgaagttcaggaatggtaagcaacagcacctagctaataagtaaaacttaaagcagtctggtattaatttacaatttgcaatctaatttcagagagctctggagagattcctgactcccagtgtatctgctgaaatgctcctcagctactttctgctaattgactgttttatttgtactccaggttattcaagaagatgagtgattctgtgtgtgttgtggtggtggtgggtgggggggaggtggggtaatcatcaagcagcatcagtaagatgcagaac

SEQ ID NO: 97 - DNA, 3283 bp, Homo sapiens
tttttaatactctgacccagtagataattagcactgtattgcagagagcaaataaatagcgtatgttacaaaggtctcaaatgtaaatgcctatggggcaacctagtcacgtaagagagatgtgagcttgacataaaataacaaatgacaattcaaactcagcctctatgccagggtgacaacaaggaatgctggacactgaaatcagaactattctcttagttgtagcagatggctgccatatggaaatgcagccattgtcgctgaatctgccatttacttaaggaaaacaatatctccatttttatggaaatattcttaatttttaaaaataatggttgctaattcaaataaaggaaaaaaaacaatggatgctaaagaaaacctttggtcacatgaagtctacatgccacagcttgaaacatcttgtgggtcgggttggggggacctgtgaattagagttggaatcagaagacctaactttgacttctatctgatcaattctattgctgtcttacctggacccggtcatttagcttgtcactgacttggcctcctattctggaaagttaaaaaggtagttaaattctaaagtctttaagttgctttaagatatatggatctagattttgaccaatagccagcctgtgggtgatcaaagctagcaggcttatgagagagcatgagttgagcgggtaagaaaggtttttctgttcccaaacacctgtctactagtacatcagtgtctgaggaggagtggaaaatgggacttagtgggtgggtttggaggatcaaccatcacagagcacttgagtactgagatgcaggcagctaaagaggaggataagattcttgccttttaggagtggaaagactgcctgagaagaaagagggtgctgataatttatcaataaacagaagccaaatatctggctcaagaaaacctcaacagattatacaattatatgtaatgactcataagtggattagctggtaagaaaagtcttacttctcagtgttctgcttggtgtttctttacctgactggatgatagcataagaagctaatgacctacagctaacgagcttttgtaacataaatgtaagacacccaggtttaaattcaaattttgacttttttctatagctcttaggcacatttaaaaaaatcctgtagatgcagattcatatcaaccatgatactaggatcaaaaataagaataactattattactactattaactctttagcttgggtaaaagtcatacagataattaaacaatatcttactacttcatcctctcatttacccagtgaaagttttccatgttttataacttcaagttgttgtttcagatatgtttgttgagtttgtgcatccattttgcagtgttttccttttttattagactgtaagaattgcttcttttcaaactgcgtccaagtccatggataaagaagctggtacacagtgggtattgttattatactgaaggaaattagaagtcaagacaaatttatggaaacattataagtgaaacttttgataaagggttaaaagatcctttggtcttattaagatatgacaacaaagagactattactagctcctttcagtctccaacaagggaggcaaacatgtttgaaaaactatggcaagattttgttctatgacgaaagaaattgaagaaaattccagttacctgtctcagttataagtgagggttatatatccttcttttgtgaccactgtcactaaaaattcttcccctgcctttgaaaatctcagcacataattcacctcagcagaggcataggttttgatggccctttggtttctcccattgccaggaacccaagtgcaagtcttagaaggtcttgaaaacataggaaacattttcctcaggcttgaaaatccatttgcccaattttacacttctcttcaggttaaaaacaaatctctgtgttgttaggggtaaagaatatctccttagttctttggtcaatattactttaatgcaggttatttaacatatggcttgtgcttccacttctgtccaaaatagattaataggggccttggctcactgcctggagttttcaggctattgcacaggacgggaaacctcgtcagagcctgacagtcttgcagagttgaggaagaagagattagagtttacagaggccaaaatggccagcatttgtggagcagactaccagagaggcaggagtttcacagtcagaaggaaatctgaagagagaatccccttaagcctttgggtcaataatgatttgcaaaagcatgagaggtaactaccaaaagtggggctgggtgttggggggacacttaaaagtaataaaacaattcccacagggctaggaatagttgttgtttccaccagctagagtaaaaatcttgtaatacatgtgttactgggctactggatagaattgtcagaaggttatcatcttaagaatttggccctagaccagaggtccccaacatttttggcaccagggaccggttttgtggaagacaaattttctgcaggacggagggtagagggagggatggtttcaggatgaaactgttccacctcagatcgtcaggcattagttagattagattctcataaggagtacacaacctagatccctcgcatgtacagttcacaatagagttctctctcctatgagaatcaaattctgctgctgatctaacatgaggtggagagctcagtggataatgcttgcttgtctgctgctcacctcctgctatgcagcctggtaccagtccagggcctgggggtttgggggacccataccctagacaaaagctatttgtacctgctttaataaaacttaagtgcaagccttgaaacatcacttgattttgggtaacttaactgaatgccagaacaaaggttaacatcatagagggcataaaaatccagcaatgaacaatgtccagcatacaattataaatacagaaaagcaaagaaacagaaaaatattatgtatattcaagagatagatgatagttggatataaacagatgtagagctgaaaaagatgattgaactaagacaagaatgccgaaacagtgattataattattcctcacatgtttgagagagtagaggaaaacatgctcatgactaggagagaaattgaagatgtatatattttttaaaagagctgagaagaattttattaagcatataaattggtaaattgaaaatcaagcctaaaagagaaaaatctagctacactgtatgtcaga

SEQ ID NO: 98 - DNA, 32 bp, Homo sapiens
tttttaatactctgacccagtagataattagc

SEQ ID NO: 99 - DNA, 23803 bp, Homo sapiens
cctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtcacagaatgtgtcgcttcgtcttctttgatgtgttttctgtgtgcttgttagctttacagtttctttgggctgttttagatttgaaaattctgtctgtctttgatactgaagataacatgtttcctttaaagtctagagtttgagaaaatttgaagatttttttttaaaagacaaggaaagaacactggaagtcttaggaacaaaagctgaagtaacaggtcacgctggtaggcacagcccccaggtcctcacccatgcctggaggaatgacctgcattctggaaggcgctcaggacaccgttttgtgggatcaagtaagcgaaactttcttgaagatatctgtggggtcccttttaggagctgtcataagacaaaaggaaattgctcgtgtgtgtccctgtgtggcggtggtgcaaacgagggtgtcttccggaagggtggccgggaggaccaagcggggtctcctgtccatggtccgtgtacctggctcaggtgtgtctacagctccgctgcatgtcatttcagccagccagaggtcaggtagccacacgcagtgcccagcccactggcttattgtaggagctcaaaagaagtcaggatctacactttcaaggactttagtcatttcaggttaaaacaagtaggcgttcaaaaacccatttctgttgatttgcattgtgacaagaacgtgcgatgcataagacacctaatgtgaattgttcatcttactggtggagtaggtaggcatttgtacttgatacctcaccagtaattaaaaactaggatgtacctgagccatgtataccgttttttaactgtacactttttaaaggtatactgggccatgtatacttcattttcttgcagaactatttatatttttcccataagcaggtattattttcctaattaaaaactagcatgtaccagagtttttaattgttaaaataatacctgttgatacggaaaatagaaacagtataccaggatacaaagtaaaaagcatgtattctgcctcccagcgccctgaccctgttccccagaagtagctcctgttctgcgtttaggttcttctgttcattcttctgagcaaatgccagtgtgtggtgtctgtgttttaacttttttcccagcaagtgagattgcattaagtatattctttcctaagttgcctctttgaaccttatctttccatatgggtatatgtagtttgaaccattcatcatttttgaccactgcataaatattcccctgattgagtgccctgcagtttgtcacctatgagtggatatttgggagggggcagtcgctattgcagaaatgctctactgaatatccttatgtatacagctgtgcaactgtgcacatacagctaaatgattaacttctggaaacgtttgtgcatttttaactttgatagaatttgccatatttttacaaggtgttttggaaatgacagccttggcaattgtacagttctagtttctcaaagaaggaatggggccatgatggcatgggaagcatgctcttcgttgtgatgctttcccatggaagccgttgactccgaaacatgctcttcgttgtgatgctttcccatggaagccattgattccaaaacatgctcttcattgtgatgctttcccacggaagccattgattccaaaacatgctcttcattgtgatgctttcccatggaagctgttgactctgaaacatgctcttcattgtgatgctttcccatggaagcagtggactctgaaacatgctcttcattgtgatgctttcccatggaagccattgattccaaaacatggtcttcattgtgatgctttcccatggaagccattgattccaaaacatgctcttcattgtgatgctttcccatggaagccattgattccaaaacatgctcttcattgtgatgctttcccatggaagccgttgactctgaaacatgctcttcattgtgatgctttcccatggaagccattgattccgaaacatgctcttcattgtgatgctttcccatggaagccattgattccgaaacatgctcttcattgcgatgctttcccatggaagccgttgactccgaaacatgctcttcattgtgatgctttcccatggaagccgttgactccgaaacatgctcttcattgtgatgctttcccatggaagccgttgactccgaaacatgctcttcattgtgatgctttctcatggaagccgttgactccgaaacatgctcttcattgtgataccttctcatggaagccgttgactctgaaacatgctcttcattgcgatgctttcccatggaagctgttgactccgaaacatgctcttcattgtgatgctttctcatggaagccattgactccaaaacatgctcttcattgtgatgctttctcatggaagccgttgactccgaaacatgctcttcattgtgatgccttctcatggaagccgttgactctgaaacatgctcttcattgcaatgctttcccatggaagccattgactccgaaacatgctcttcattgtgatgctttttcatggaagccgttgactccgaaacatgctctccattgctgacgccttcccttggaagccgctgcccccacacgagcatggctttgaaagtggggaagattggggtgggtggttctttcctgtgccaggctccttgctcatctttctaaggcatatcaaactcgcccttgtctagggtcatgacttcctgcctaacctggccccttccactccacgctgctctaaaacgtggcaagtgggcagggccttcctgctaactcctgggtgcttttagaaaatgtcagttcctgtgccccccacccccaccccccacctaaggagctgatttctgagggtgggatccaggagtctgcctttttgacgcaccccagtgctgttagtgcctgtagtaacaatgtactgatgcccatttaggtgggctgctcagttgaggtcttctgcatttctgtgcatgatggttacttagtgtctgggcagccaaaggagaagggcgtgtgaccagcctgtgtgcaggaataagcccggcacccccagcactgccacatcctagttattctggaggccacaccttctttgccatatcactaagagcagttgctgcctgtcgtaattggagagggtcatccattctaaaacatgttcaggttttacagctgttaaagtgctttgagaatcgggggagttgagatgaactatggcattgggggtcagtcctgtctccagctctccacagtggctacatggggtctcacaagtgcaaccccacttcctcctccttggccctcagaggatgttggactgcttacaaaaaggtgcaacctgctgcgagggaactgcctccacctctcaccacacttaaaaacctgtcaccatctgtcccgctgctctgtcttgtttcggtggaagaattcgcccgagcccccagccccatggcttccttgcaggcctgggagcctgtgtctcttctcctgccttcctgaaagccagacccttctcttggccgctatgtctgttgtgtttgtttcttatggaaaatgtcaagcttgtatagaagtaggataatgagtgatgattgctctctgagatttatgaacattccaggccctgtgactgctggtctgttctagaatgaaggaaaatggctgtgcagtcccaggagaaaaatgctatgatcatatgattatattaatacatttagttacagttcagtatccatttgtggagatgaaaccaattgcagaccaggaataaaagggaatttcttcagtctgattgagaacagttaccaaaaaacctatcaatatacatataagaaggctagtaacgctcaccggctattccccaggcatgctggtggagcaaggcaaggaaaagggggaggggaacagaggttgtaaagaaacaactacaattgccacgacttcccaactatactgttgtttatgtagaaaatacaaaagtatccgcaattaaatagaattaataatgctgccagatacaagatgtagcaattttctctaaatcaggaacaaatggaaaatataaaaatcttttcagtagcaaagatgtcaaataggaataaaatgaaaaatatgtaagaccttcatgtagaaaactacaaaacactgttgaaagaatttagggaaggtctaaattaacagagcgatgtgttgatggttaaaggactgcatggaaaggcatcagttctccttgttgattgttggaggactgcatggaaaggcgtcagttctccgtgttgatggttaaaggactgcgtggaaaggcctcagttctccatgttgatggttggaggactgcatggaaaggcattagttctctgtgttgatggttaaaggactgcatggaaaggcatcagttctccgtgttgatggttagaggactgcatggaaaggtgtcagttctccgtgttgatggttaaaggactgcatggaaagacatcagttctccgtgtggatggttagaggactgcatggaaaggtgtcagttctccgtgttgatggttggaggactgcatggaaaggcatcagttctcctctgtgtttatggttagagtgtagaaaggcatcagttctctgtgttgatggttagaggactgcatggaaaggtgtcagttctcctctgtgttgatggttggaagactgcatggaaaggcgtcagttctccgtgttaatggttagaggactgcatggaaaggcgtcagttctccatgttaatggttagaggactgcatggaaaggtgtcagtcctccgtgttgatggttagaggactccatggaaaggcgtcagttctcctctgtgtttatggttagaggactgtgtagaaaggcatcagttctcctctgtgttgatggttggaagactgcatggaaaggtgtcagtcctccatgttgatggtgagaggactgcatgggaaggcgtcagttctccgtgttgatggaagactgcatggaaaggcatcagtcctcctctgtgttgatggttagaggactgcgtggaaaggcgtcagtcctccatcttgatagttagagaactgcatggaaaggcgtcagtcctccatgttgatggttggaggactgcatggaaaggcgtcagttctccgtgttgatggttagtggactgcatggaaaggcgtcagttttcctccgtgttgatggttagaggactgtgtggaaaggcatcagttctctgtgttgatggttagaggactgcatggaaagacatcagttctcctccgtgttgatggttagaggactgcatggaaagacatcagttctcctccatgttgatggttagaggactgcatggaaaggcatcagttctcctccgtgttgatggttagaggactgcgtggaaaggcatcagttcccctccgtgttgatggttagaggactgcatggaaaggtgtcagttctccgtgttgatggttaaaggactgcatggaaaggcatcatttttctgtgttgatggttaaaggactgcatggaaaggcatgagtcctccgtgttgatggttagaggattgcatggaaaggcatcagttctccacgttgatggttagaggactgcatggaaagatgtcagtcctccatgttgatggttagaagactgcatggaaaggcgtcagttctccgcgttgatggttagatgactgcatggaaaggcgtcagtcctccgtgttgatggttagaggacttcatggaaaggcatcagttcaattaattgcttggtggactccgtgccagccattcaattcctgtgagttttttaccgcttttctggatcttgaaaaacaatttatgtagaagtgcaaagtgccaagaacagctgagagcctcgtgcaaacgcagagcaaggcgggaagacatgccgtgcaggatgacgaggtttaggcagccaacccaggggtggtgcccagggagggaccgctggagattacaccaggggtcttgcggcagagcagtggggaaaggacaacgttttcagtcagtagttccttttagccagcagtttttccacgggggtgaatgtgaaccttgactcctccctcacactgtgcccattaatcttaggtggatgttaaatgtaaatgtgcaggcgaggccgagcgtggtggctcatgcctgtaatcccaacacttcaggaagctgaggcaggcggatcgcttgagcttgggttaaagaccccatctctactaaaaatacatgcaaaaaatgccaggcatggtcatgcgtgcctgtggcctcagctgcttgggaggctgaggtgagaggattgcttgagccctaggggcagaggttgcagtgcgctgagatcgcaccactgcactccagcctgggcaacagagccagaccctgtctcaaaaacaaaaatgtgcaggggaagcgagaaccctttagaaaataatgtaggagaacatcttcatgacctgagagttaggaaagactttttaacaggacacacaaagctccgatcacaaaaaaagattaataactttgactaaaatgaatgtaaccaatgataaactgcttaaaccacagagaagatgcagccgtgccatcttctcagtggctgagtaagagcaccgcacaccaagggccacacccagcctatgtagcaaatcaataagaaaaagacaattgagacaaggtaaaagatttgaaagacatttcacaaagaatataaaatggccggtcaacataaaaggtctttgatctcatttataattggtgaaatgcaagttaaaggtaaaaattacactattaaaataccactaaaatgatgaatactgtcaagtattttcgaaggtgtggatgctgttggttgcagagtgacttggtataagcactttagaaaagagccgggcatcatctgccgcagatactccgctcccacatgcattcgtttgctagtgctgctgctgtgaccgactgcgtgcctcacctagcatcccgagtgtgtctctgtctctgtgggtcaagagtccaggcatggcagagctgcaggtcctgcttgggtcctcccaggctgacattaaggtctcagagggaccaggttctctgagctcggggccttttccaggcactcacacaggtggctggcagcattcgctccttgtggtggagggatggaggcccattttcttgctgcccattggccagaggttgcttttgctccttggctgctagtcattctctctggttcctgccccctggcccctcacacattccaaacccagcaggagaatctctgacttcagccaggacagagctccgaatttcatgccataatcacaggagccaggatcacaccgactttgccttacgatgcagcctgatcctgggggtgaccccgccctattcacagatcccaggggtgactgcgtcctagtcacgaatcctggtggtgaccgcatcctattcactggtcttgggggtgaccccatcctattcacagatcccggggtgaccctgtcctagtcatggaccccgggggcaaccacatcctagtcacgcgtcccaggggtgactcagtcctagttacggatcccaggggcaaccccatcctattcacgaaccccaagggtgaccctgccctattcacagatcctggggacaaccccatcctactcactggtcttgagggcaaccctgtcctagtcatggatcccaggggtgaccgtgtcctgttcacagatcctgggggtgaccatcctgatcctgcctggacctcacagggtcgggggcagacaccgggggcaggaatcctgtggcgtctttgaattctgcccaccataccatgtagtgtcactcctaggagtatgccccacagaaatgacccagatagtttgaatggataagtggtgaaaatgcacatgtcaaaccaaagctctgctcctcaacgtgggtgatgctctgaacgtaacattaaatgaaagaggccaggtgtagaaatacactaaattattcagtttatgtaaagtgttaaaaaaagttgaaccatagcatatagggatgcaagcttaggtggcaaaagtgtaaagaaaagaatgtgattcccctaaacaccaggcctgttttgaccaggtggaaaatgcccttgggatggagttttctgacttggagaggtaagggaacatggcagactcggggctcatgggccttccctgtgtcacggggggacctcccaccccaaagggctgccacagttaggatcctttaagcttttcaagaaggcgggcgcatctccggtgccgttctctgagtgaggaacacgttgacagaagtgggttgtccagatatgatcaaggcaggggtcgaaatggacctcctgatgggaagtccctctgggaggagtgtcagctcccaggcaagggctcgctttgcccctccatggcactgacctgctcagggcctcagccaccgtgagtgctgactcatgggaactttgattctgggaatgaggctgtcaaggcgcaagagcgttgcttttgtttatggatttggagagagtgctgggctctgaaactgtgtacatgagagcctcctggagcatccatggccccagaggagccacacgcatccgtggaagggtggagaggacactggggccccagaggagccacacgcgtccatggaagggtggagaggacactggggccccagaggagccacacgcatccatggaagggtggagaggacactggggcccctctggctgagacagcagaacaagaaatggggagaacaatctcagatttggttttttggttgttttttgagatggagtcttgctctgcactccaggctggagtgcaatggtgtgatctcggctcactgcaacctccgcctcccgggttcaagcaattctcttgcctcaacctcctgagtagctgggactacaggcactcgccaccaggcctggctaatttttgtatttttagtagaggcggggtttcaccatgttggccaggctggtcttgaactcctgacctcaggtgatccacctgcctcggcctcccaaagtgctgaaattacaggtgtgagacaccgcgcctggcccaaactcagatttgaatttaattttatttctttgggcctcggcttgcaaaagcagggagatttaacttgcagacattaattttcccaaaagttcatcaagaaagagttcgtattaggatatgtggtgtctgcgtgttgatgacactgcatcatcagaacgtctgagtctgcctgagttgtcacgtccttgtggttagagagggccccacatacatgccaagtatcctgtatttgcccctaagaatgaaaaggggttactcttgttccctggtgtgtctcatgagttttgttgaatactggacacttcacatcaactctggattccagagggcagttattggagttttgtttgttaaataacatgtctggacaaaatctgtgatgtctgctccctgtcagtgtggggcacagatgtcggcactcaatttttgctgggggcagaggggggattgttttaattctgagttttggtgggttttgctctttgcctgcaagattgagctggagactgggctgaggcttggctggagctgctgctccctacacagcatggcctccactctgctagggctctgtgggtgggctgggagcacatgcacctcttcctccagctctctgagtgtgccctctgggcatgtcccagcagcacctggccagggaggcaggcttgggccctccagtgcacccgcctgcggcctcccccagcccctcctccctggccccgccctgctgagtcctgcagggcccccgtgcttcactagccccgcttttggacaccccgcagggaagcacccccagtggagagctgggctccactgtgtttccacccctcagagtcctcggctgtgctgtcttctcttcagtgcctagaagcaagaaccatgctccttccctgggtggccccagcaaagccccgcagactgcatggcctaaactgcagaaatgtgtcgtctcctggcctggagcccagggcccaagctcagggtgtcagcagggatggctccctccgaggctgtgcaggagaatccgcccaggcctctcctccagctccttggttcgctgccgtctttgaggttccttggcctgtagacgcctcagccctctgcactctgtgaggctggcccaaatcgcccccttcataaggacaccagtcacatgggattaggggtccgccatctgacctcaccttaatgcagcacatctgcaagaccctctttctagacaaggccatgctgaggtataggggtcaaagttccagcatatttttgttgggggcagacataaccaataacaccagcctcatacatttgctcaattttacaggtgagttctcctggaagaagaacctgatgccagccatctgtcaaggaagacaggaagtaacagtgcaggctcagtaagtatctgttggatgaataaaggaaattagggatgacatcctacaacctgaggaaggtgtggggcatgcacacgcctcccgccacccacaccaccctctgctgcctcgtggagcccccgctgtctgccctgaggctgtcccatgcgcagctcctcagatgcttcctggaaggagttctgtgcactgtgggctgtgccgttgctgcaagacggtggcatttcctggcacttctgagttagaaagtgccagttatttccaatgttttccagacattgctggaattccatgaccaaagggcaagggccagggagtgtaacgctgggcccgggtgtcaaaaagtgctgtccacagtggctgagaacagagtgaaaccagtgctgccgcacacacagaatccttcaaggaccctcgcttttcccttttccaaataccggatgcacattgtctgggctctggctgggctgaaattgatgctgttttaatttctttcttactgtatgagtctgtttcacactgctataaagatactacctgagactgggtaatttacaaaggaaagaggtttaattgactcacggttccacatggctgaggaggcctcaggaaacttacaatcatggcagaaggggaaggggaggcaaggcaccttcacaaggtggtgagaaggtaaggaagtgccacactttaaaaccatcagctgtatcatgagaactcactatcatgagaacagcctgggggaaaccacccccacggtccaatcaccccccaccacgtccctctcttgacatgtggggattacaattcgagatgagatttgggtggggacacagagccaacccagatcacttatttagatgcaatatttaattaacgtattttattcgtaaagaaaggtggctggcatctagtagctgggaggaggcctgtgggtggtgatgctgccgtgtaacattctccgccaacagcttcacggagtgaggaatcatcccgggagccgtccactctgaggccgtaggggtgagggtctgcctgtgaagttggtggcctgctgtcaccccatgctgtggcgaaggatttgggtgtaaatggaatcagctgtcttgtgtggttggcagcagcatgtagggaatgcaggaaagccaggcctgagatggcgttgccctctggtgccctggtgctcagggtgggggccacaggctctggtgtgtccccaggcccacctccagtctacagtgtgacagacctggcgtgctcctccggccttcgtgttgttttatttggggttgctttctaatgggaatactggacaggtgttgaagatttggaagtatctttgctcggtttattgtcccagcgaagtcatcaacacgggcgtgtttgcttcctgcggctgctttcacacagcagcaccgacatggcgccaacagcagagctttcttctcgctggctctgcggccacaatctgaagtcaggacgtgggccgagggttctggggagggccctcctgcccctcccaccccagggctgctggcagtcctccgtgttccggggctcgcaggcgccttgctccttcttcacctctgttgctgcacagccgtccgtcccctccccgggcctctgcgcctgcacttgacaccctcccggtgtctctctcttctcatcttaataggacaccggtcctattggacagggccacgcttacaacctcagctcgattacatcggcaaagaccctatttccaaataagccctcatccttaggtcctaggggttaggacttcaacatctcttttttgaggaaacacagttcagcctgtggtgatggggaaactggactcacacccctgtctaggagccccccgaatcccctgctctcagcctggctgagctgctctgctgggagtcaggtctgagtgctttgctcaagttgttagccaagtccgttacagggttaatagcttcatagttaggggtcctcagaggtaacgggtccccgtggcacttgtcctatttccaaagaaccccacggcagctccacacattcccatgggaagactgcacagtctacccctgcaaacatcttgctcttagctaaaattgtgtctgtcagtgtagtcactggttatcacgtgggaacgggactcaggacccatatagacagagctgagtccatgctggctgctccgtcctgtggcctgctgggtttcactcttccacggcgtggcctctccctagaagcccttggtgaacacccctctccctgtgagtctggggcagtccctgccgcccccagccagtggctcccgcagcttcccggtgctggctcagtcctggcaatgaccacactgcaggctcatctgtctccactccttccccggaagctcattgatgacgtggttctccagccgactgctgcccaggttggtgcctgctgtaggtgacagttcccaggagagagaagcagtgtctctgcctgggagcctgcacgcaatgctggtgggaacgtgaaatggtgcagccactttgtaaaatagcctggcaggtcctcagagggtgaaacagaattcctgtatgtcatagcccatctggactgtaacaaaaatgccacagcctgggtggcttataaacagcggacactttttgctcacacttctgggggctggaagttctagatggaggtgtggcagatttgctgtcctccgaagtccccttcctggctcatatccggcgccttctcactgggtcctcatgtggaagaagaggcgagggagctctctgaggcctctttaatgggggcacgattcccattcgtgaggcttcaccctcacgacctcctcaccttccaaggcctcgcctcctaatcccatcatcttgagggttgggattttgacttgtgcattttgggaggacacaaacattgggttcttcccagcgtgtgacccggcaattccactcctagggatataccaaggataagtgaaaatctacgtccacacagaaacttacattgagtgttcccaacagcattattcataaaagccaaaatgttggcccaacccagtgcccatccacagacgaatgactaagcgaaatgtggcatgtccctgcagtgggatattattcagtcgtgagaaggaatgaagctctgacacgtgctacatagcaggtgaaccttctgcaacatgaaaaattcagacacatcaacccaaattgcgtgtatgtgtatgcttcctgggcgtgtcccctagatgcctcctctgtccacctgatgcccacagcaccagcctccagccccccagcagcgtcctcggctcaccattgactttttcttctcttgctctccacatccaagccgtccgccactcttattaattgattagttgattgacacagtgtctccctctgttgccctggctggggtgcagtggtgcaatcacagctcaccgcaaccttgacctcccagtctcaagcgatcctcccgccttgccctaccaagattctgggattacaggtgcgcaccattatgcaaggcccactccttcaactcaaaccatgaaaagtagcagccccctccggcagttgcctgccttcttcctcatgagtatcccgtccttcctgctcacaaacctcccgacagccgtttccagcacagcagagtgatgctgtgaaaatgattccatttctcgcacaaaatctgctagtaactccctactttgctcagaataaaggccaccatcctcaccatgacccatgtggtttcatgccctgccctcctgcggcatctcggctccttgtgtctctcaagtcgccacaccagcctccccccaggacctctgcatgctccctcgtcagccccagacacaccttcctccctggaggccgcctgcccaccctgtggcaaggggcaacccctgccctgatccagcctggcccacgccctgagtttgccttctccccacggcccgggcctggtccgaggcagctacgtcactctgtcctctccccaggagggaagggatttggttttgttctctgctgcacccagtgctggctggcagagaggggtgtcccaggaaggaccgggacacaaaggaagggagggacaggactcaagcacctgtgcccacaggcttggtgggcaaggggcgggggtatcctgcagggaaggtgggactcagcccatggtgtccccagcagcgtcttgcccctggaactccctccctacatctgttcatctgagtggccttcgtcctcaatgcagccagtgtcaaggtggacacgcacacggctccgaagtcctgtgtgacgcccacgtgacctcatgaggctgtgtgatgtcacagcgggcggggtggtgtgtgcccagcctggtcccacagtccatagtgagcggcagacagaggggtggccagtttgttgttttacctaaaaggtgttttccacgtggagtgggactgagaggcacaggtggctgaggggacccgcctgggatgtgaggcgcaggtgagtcgatgaacgccccctcctggtgtgagccgcccgctccccaaacgacgtccccagggccccgcccgtgctgacctctcctgttttccaggtgtgctcggccccttcatctgtcagctgcagcaatggaatacgtgctggaagtgaagaactctccgcggcacctcctgaagcaattcacaggtatggagggaaggcgccaggggggcgggtggggtgggggagcagttgggggggggcacagggaggagctgtttgagcccctggcgcggacagggggtcctggtcccagacctggctaggagggcaaggcagcaaaatgtgtgttcaggaaataacctgggaaaacgctgtgaagacttcatttttgaaaattttattacaaaatacacccgaacctgaggttttctagatgaagaaatacatttaactatttccagggctttaacaggtcaaaggcattttgtccatgaggcgctgaagatccacttcaactacttcataacttttattgcaggagtgacttttttaattaaggaaaaatatttatcagcaatgaagaagttccaccttccctttccccacccgggcaactgacccggaggcagacactcaccactgggactggaaggaaccaccggtgtgggatgtggcttctcccacaggtgccgttaatgtgcatagatgggggatgacagtgacttatggtcaggaaaaggaagattctggaagtttgcacctcccccgggaggcaggagatgccaccttccatggctcaggtttacctgctacttgaatgtttttttctcaatggatcttgtgttcatgcaatgcttttataaaacaacaacaacaaaaacaaaaaaaaacccaagaaaatcggatgggcgtggtggcctgtaatcccagcactttgagaagccaaggcaggtgggccacctgaggtcaggagttccagaccagcctggccaacatggcgaaaccccatctctactaaaaatacaaaaattagccgagcgtggtggcgggttgcctgtaatcccagctacttggaaggctgaggcaggagaatcacttgaacccgggaggcagagattgcagtgagctgagattgtgccactccactccagcctgggcgacaaagcgagactccgcctcaaaaacaaacaaaccaagaaaatggaagaaaaagaaaacaaattagattgttttgggttgttacctttgttgggaaggtaggctagggagcacctctcaggctggccaagatgctggcagccactgagcacctgcccacagcagcacctggccctgcagctctcgcagcgggacagggcggcccaggtgccaggaatgtgtggcatctgccagactgcgaggccttccaaggccaccaggccaccagactttgtcacaccaggggggcagctatctctttggacaggaagaggggtgtccacaagaggggtctttgcagttccctatccagatgcacccagggtggagtgggaggcctgcgcctggggccccgagggaacgggccgctcttgtggacggctggggtggcccctctcatattctggcaagatggcctgtagccagggcaagcacgggggagaaagcgctccctcttccaggcccttgggggccaccctcctggtttctgcttcagggctgtaagcagtgcagctgttgtgtgtacaagctgctgctgctgggcctggccaccccgtctgtgaggggctgtcaggggctgctggaggctggtgccacttctcagggtgcatgggactggtgggggtcatctcaggtgtgccaggtcacccaaggcactgcccaagctgaccctgggctggagtcatctcaccttgccatggccatgcccaggacccagctcctggtgtctgcaggcgacactcctgtgtgctccccacacagcctgtcctcgtgaactgaagaacgcatgcaggggcgtcagcattgtctttatcattctttgcacactgtggcgtggctgttttgcaactgtttctattcctttaggggtgtagggaggctgtgaaatgacaaggtcagggtcttcctggcttggagttggctcaggtgtcagcaccaccggtggcctcagcgggcaggtggggagctggaacctttagccacagtggctggccctggccctgcagctcaggccctctctgccacccacccctgggtctgaacccaagaagcagcctagaggaattcctcctgtccttctctgcgcaactttgcagatgtggaagagactctgtggccgggtgcagtgcagactctggcctccaagcccacccactctgcagcctcttcccatgtgggtgcagagccctgcacgcctccccttccacgcagccctgctgggcttccccatgtccacactcactcatccgggacaggaggcagctgggcctccagacagccccctagcaggtgatggcctgaggctggctcccagggcaccatgttcacatggccctggatggcgggtgacctgggggtgaaagagcggaaatgaggatgggaggatgacaggtggcccctggggaagaggcgtgtgtggggccactcagccctggctggaggctctgccttactgcggggatacagcctcggctgctgcctgtcagctgctgcctaaagattaatgtcaattctctccctaaataaaatagtttctgcaaaagtgcttttaaactgtgacacactttccacaccggtgtgagttcttctctgagtggcttgtatgaaagagtggggactcgaagccactgcttcttctccacaggctcgggggtctgtggacatatttggactctctgtgtccgaatccccgggatctgtggtcctgcacaccccagatccccatccgtggttcacacgtgctccaggcaggaaggccacacacatgagcctctgcacacacagggatccgtggccctgcacgccccagatccccatccgtggttcacacgcgctccaggcaggaaggccacacacacgagcctctgcacacaccatgccagctccctgaacctgctgtgatccctgcccagcttcctcctcctcctccttctcacctctccttccgtgttctgatgctcaaactccgggagaactggtgtcttctgtccaaagataacttgacatgcagcttcaagctcagtgtcaagaaaatgggtctccaggttcagagatttttatgttgtttatgacatctgctgtgaagacacattcagccggattccaggtggtgtcacagctcacagacagaaaggggtgtgcagtctgggcccgctgaaggtcctgggggtgctggtggcaatcgtgaccgcaggcacgtctctggagttcccacacatttcctgtcaccactgtactcagaatcttgtcttctcttcccgcctggaccatctttggaaacctgtctgtggttgggtcttgctgtccgtggccacgctgccaggaaccctcagctgggacattctagtgggccgccgggcagtgtggcttggaggtgtcccctggaggccagcctgatgcctgcctttctaggggagcagctcccagcagggaagctgagcctcagaagtgctggaagcctccacggtgctgtgaggtcatggctgctgagtctgccagctgcttctccaggaggcgaccatggtctgtcccctgctaattgactgcttcatcgggaaacgaggtggcagagggacttggatggggagtcacactgaggacccggcgctgccctgagagagtctctgggcttgactcctcccctaggaagaattcctgcaagtgtgcgtttcacagagagagggcaagggaggtggatggagcacaggaaggagaaacgccagggaatcgtcagccacacttaaaatggtgacgcctccccacctggatcatcagccacgtttaaaacgatgatgcctcactgcctgggtcggaaagccctggcctcagatctgcacctctctaggcaccatgcccctcctgaacctttcctctcctgctgcagaagcagcaaaatgcagagtgaagagactttccatggccttggagaaaaataacggaacgtttaccaccgtgctggcgtgggcgtgttagaagcctcaggaggtggctggcgggaagtgggatgagcgagggaatgaatggcagccccactgtccctggggagcggtggcttccctgggcttgctatccacgcagacggggtgacgggacagattcatgggatgagctttgaaacctcactccacgggcccccatctcacctggcacccctcagccagggtggcttctcccaggaagcactcggctcattttagattgattggtttaaccccagtctcgtttcagtagatcaggaagaacgtggttgccccgccatcctgaggcagcgcctccccgttcccctagcctggcccagccgatggctcctctccctcttcccagccacgctgtcatgactctgggagagcacagggagagagccaggcagtgagccctgcgctccagccgtcctggctgtggtgtggggggtgtggagggcctactggagataccactgctggtgccagtggccgggagtccagtacctgtgcagtgggcgagctgccagtgatgtttctagagggagcagggagctgcatcagccctgccgatcccccaccatgtgggaagcccacctcggcccccttggcagctgtgacctggtgcctgcccagaaagcctcagcttactccaacctcaaagcctgttaggggttgtggaggagggtggagggccgggctaggaatggaaatgcgtgagagacttttcagggtctactggatttttaaaatgcatggcgacattgtggaggtgcgtgcaggaaaataacggtgggtgtggagggaaaatgggacaccggaggaggcgcgggaggactgccgggattcgacggctgggcggtcagatgcgatggggactgaacttttaaaatgagaaagaatgtatgaacgtttgtgtagtgatattgaagagaacaaatcactttatgaataaaaataatgcttcgttcagtggcatatttcctgcccagtctgtttgctgaaattaaacatccgctgtcacctggagcaagtcttcagaaacctttgttctcctggctctgtgagcagatgcctctgtgctgctggggcttctcctcccgtgtctggggacggtggggagggcgcctggcactgtggagacagcaggaccctgaagccagaggtctctgtggatcccggctccgctgcgtccaagctggtgggatcttgggtttcgtctggatcttcccagatggggtggaagagcgttcgggcatcacgagctgggtgctggctggtgtctgctggggtggaggagactgcgggcagtgtgagcctgtctggtggggtggagactgcgggcaacgcgagcctggcgctggtgggtgtctggtggggtggaagagactgcgggcagtgtgagcctgtctggtggggtggagactgcgggcaacgcgagcctggggctggtgggtgtctggtggggtggaggagaccgcgggcagcgtgaggctgtctggtggggtggaggagacggtgggcagcgtgagcctggcgctggtgggtgtctggtggggtggaagagactgcgggcagtgcgagcctgtctggtggggtggaggagaccacgggcagcgcgaggctgtctggtggggtggagactgcgggcaacgcgagcctggtgctggcgggtgtctggtcgggtggaagagactgcgggcagtgcgagcctgtctggtggggtggaggagaccacgggcagtgcgagcctgtctggtggggtggagactgcgggcaacgtgagcctggcgctggcgggtgtctggtggggtggaggagactgcgggcagtgcgatcctggcgctggcgggtgtttgctgtgcagctgctgtcatcacctgcgtcagaaagtggaggcagtggcggactctgtgggtagtgtttgtgaagttctggcgctgtgtccaccctggaattgcactccaggaaaaaggccgtggtgcctggatgccctgggagcaaagccctcctagtcacccactgtagacacatgggctgctgcatagaacgtgggggaccatctggccagccacagcccgagaccagtcacccaccccaggcccctctgagcctggctgtgcagtacctgcctgctgctatggggcctcttccggcctcccccgacctctccctacatggtaggtcagctcaaatcacacacagccaccccatgcaactgagggaggagagggtggcagcagccggtgacttcagcctgccctgtgcactctgccttggcaggtgcggcatcgcctcggcagggctcccgtgtccatgatgcttctgacagaggatgagggctgcagccgcagcatttgcaaacctggaatgggggtgtcttgagaaggggaacctgaaagactaaatcaaccctaaggaacacaaatggggctcctcaagggtcaagaaggccgggcagctcccctcccggcccctgtcccagtggaacaacttacagaggggccagggaagacccccagtggcttgggtgcagccttggcctggggcatggagcctggctttgtgggactgcagtccacccagcaaaggtctctgcgggcaccctgggccctcacctgcaggaacccccttcatcatccagcccagtccctcggtggcccatggccgatcaaggcagccacatccctcggggctgaacatgtgtgaggctgctgaactcctctggaaagggtcgtctgccaggagctctccccgccctgcttcctttacctcccacggcgcgccgcacactcattgtcttccctttttctccctttgggtcaaaactggcattaaactttctgtccttttgattcaagttttaaaattctgaaataatcctcaggccatgctgctaattctaactcctgtatgcttaagtgtgaaataattacacgttccctcccgaactcccaagcagccattgtgtgagccccgcgcttctgtgggctctgtcgtgcgccgtgcctggcgctgctgcgcggaaatgtattatctcctaatcgttaga

SEQ ID NO: 100 - DNA, 34352 bp, Homo sapiens
agtcttctcacccatttaggagttttcagtaataacgcacacacttttagtgaagatgttggagtgaagatatgcttctgtctgaattggaaaatgtgttcacttttttgactgagctgaatttatgctgtgctctttggataaataaccttgtttgatttattcaagtgacattgtgtcaggtcttgctatcaatctgcacctagtattgacatttgtaaatgtaatggccattcagtttctagataaccataacatttacttgacaactctgtattgcgcttacgctcattcatttttttttctgcatttgctttgaactttgtccttttgataatcagatgtattaagcctcatatagaaatgccaggatgtgtgtgtgtgtgtgtgtgtgcatatacatctgcaaacatatgtgtacatatatacatgtatgcaaaatccaaaattgacaacttataaactgtcatctgcccatgcaaacttgaagaagctgagcttttcagcttttcaatatcccagacagggcacctatcaagtgtatctttctaggctgctgaacaagaagagatgaacacatgagaaggatatgtttatttacttactcaacaaacgttctaggggttagggatatggagaagaacaagacaatgtttctgccttcatggtatttacattaaattaggggagtgcgacaaccaataaacagaaatgtttttaaaaacctaaggtaataataagtgttaagaaaaaaataaagaggatagaaggtaatagaggaaggaaaggcaaattaaaactacaatgagataccacttcacactcactaaaatgactataataaataagacacacattaacaaatgttggtaaggacgcagaaaaacaagaatctttttaaattgtggaatttccactttctggtggaaatgtaaaatagtgtagccagttggaaaacagtttgtcagtttctcagaaggcaaagcacaaaactaccatatgacccatcatttctacttgtagctgtttacctaagagaattaagatcataaccacacaaacacacacaaatgtccacagcaacttttaaaataataaggactggaaacatcccaaatgcccatcaactggtaaatggattgtttaaaaaatgtatatctaggctgggtgtggtggcttgtgcctgttatcccagcactttgggaggctggggcgggtggatgacttgaggccaggagtacaagaccagcctggccaacatagcaaaaccctgtctctactaaaaataaaaaattagccaggcatggtggcatgcacctgtaatcccagctactctggggccgaagcatgagaatcacttgaaccagggagatggaggctgcagtgagctgagatcatgccactgcactccagcctgggcaatagaacgagactcctgtcttaaaaaaaaaaagagagaaagaaaaaatgtaaatctatacaatggtatactattcattaataaaaaagaacaaactactgacacatgctatgtcatgggtgaacctcaaaaacatgctaaataaaataatccagatacaaatctgtattatgtgattctatttatatgaaatatccagaaaaatttctagagacagaaagtagattaatggttttctggggcttagtgttgagatggggattaatataatgggcatagagatcttatttaagggataaaaatgttccaaaactgatctacgtgattgttgcaacactaaataaaatgataacaatcattgaattttgcacttgaaacgagtgagttttatgatacgtgaaatacagctcactaaggctgttctgtttgtttgtttggttggttggttggtttttttttgagatggaattttgctttcgttgcccaggccggagtgcaatggcgctatctctgctcaccgcaacctccgcctcctgggtttgagcggttctcctgcctcagcctcccaagtagctgggattacaagcatgcaccaccatgcctggctaattttgtagttttagtagagacagggtttctccgtgttggtcaggctggtgttcaactcccgaccttaggtgatacacccccttggcctcccaaagtgctgggattacaggcgtgagccactgcgcccagccaaggcagttttttttaaaaaaaaagtgataaaagggtgagtgatttcaaataggttggttcagggaaggcctctccaaggagctgtcagttgagcagagacctgagtaaatgagggcgtgaatgatgcagtgattagagatgagtgtgcaagcaaacatacaagttcttagggaacttaacaatttagcagtaacagaaggccagtgctattagagtagactgaacaaggggaatggtgatggtagataaggctggagatgaaggcaggtgttgtaggtcatgataagtttaggttttattttgagcatgaaagaaggtcactgaaatgatttttaaccaatttacttttttttaaaaaaaaaaaaaaaaaaacctcactggctgctttgtagaaaatcagtagtattaagcaaaaatagggtgattggttaggagacctcagaggtagattagggtaaaaggtggtttaggctggaaccagtggtggtaatggaggtgctaacgatacaggaactagaagaaattattaggtagatgatgagggcaagagtccttagcaaggtttccctttttaactaaaagcagcccccgagtcatttcttttctaacaaagagtggcctgaaaaatcgagctgcagacagagataagcaagctggaagtttgcacaggtgaatgccggccgctgtgccaacagaaaagggctgcctgagggccaggcatgttcaacatggaggctccatcttcccttttcttagtcaccacgtgcacagtaaagaaccaggcaatatggcaatggccaagtaaaaaacccatccgcataataaaagattagggtggggcagccagcttctttgagtgctatgcaaatggcatacctggtccaaccaatctttcgagccctgtgtaaatcagacaccgcctcctcaagcttatctataaaacttcctgcatttcactgtggaagtggcaatccattttccccaggacccctctctgcacagagagctcttctctttctttcgcctattaaacctccgcttttaaccttacttcttgtgtgtccacatccttgatttccttggcatgaggcagcaaacctcaggtattaccttagatgaatgatgctgcttcagtaagaagaggttggattctggagatatttgaaggtagagcagataggacttacctatatttacatagatataaggaaatatatatatatagagagagatatatatatagaaatatatatatttctatatatctacatatagaaaaaaatatatatttctatatatctatatatatatttctatatatctatatataaaaaatatatatttctatatatctatatatatagaataagacttaccttatttctatagatatatagaaaataaaatatgagtaaaaaataggaatttagaaaggttcctaagttttcagcttgacctgctgggtgaatggagttgccatctaccaagacaccgctaacagaggagcagttttggcatggtaatcaaaagtttcttttaaggctgtcacgtttgaaaagctagacctccagatggacatgtggattacacagttgggtatatgagtttggagtccaagggaagaggtttaagctagataaatacatttggaagtcattagcacataggtggtgtttaaaccaaattatctggacgatatcacttggggacagaagtcaggagaaggagaaggatctagcaaatgtgtttgaggagacattaatgaggtagaaggaaaaccaagaagtaggatgccttggagggcaagtgaagaaagcgttttaacacaagagactgatcgaggtcactgctcaccttgacgagcagtctcagcggggtaacaaagatgatatctttattagagcggacaccagaaagaatgagaggtgaggaaatagaggcagcaagtgcaaaccatgaaattttgctataaagggaagtggtagctgggggaaaggatgtgggttcaggagaaggttttttcctttttttttaaatgatgggaggcattttgaactggaaagaagccaactgggacttgggtgtgatctgaagaagagaagatggcctgtaccatagtctgagagttaaatggcacctttattgattattgatataataccctatggcttgcttatagtacagttacacctgtgttgtgtgatagggagccttgccagtggaagcaaattggtctaagatagaagcttggttttgacttgatagctgcccataagagggcagcagagcagagctaggaaattaaaaacaacaacaacaataataacaacaacaaagaaaaactctgcaaggtgatccctgcagggtaaagactttttagcaaactctttaaagatattaaagaaagttcagcccttcctccccagagcctcagtgctagattcttgcttagagaccccaaaggctccagacttgggaatacaactggtaacatggcagactatgagccctgcaggggagggagcaactgtaaagctgattgagtgtaaaagaatggctagtacagaaggaagatgtagctgttatatcgaagcattaaaaacaaacaaacaacaaactaggccaggtgggggccgggcacagtggctcacgcctgtaatcccagcactttgggaggctgaggtgggaggatcacttgaggccaggagtttgagaccgacctgagcaacatagcaagaccctgtttctaaaaaaaaaaaaaaaaaaaaaaaaaaatttacaagctgattgtgatggcacacacctgtagtctcagctacttgggagtctgaggcaggaggatcacttgagcccaggaactccaggttacagtgagcaatgatcatgccactgctctccagcttgggtgataaagcgagaccctatccctctctaaaaaacaagacaaaacaataacaataaaacaaattagtctggaccattgtcattatgaacagactattttttcaaagtaatcactgcaatttactatcattccataaaagccattgatgctgaattccaatgtgtgtggctaaattttaccaaaaaaacctagtatagaaggacttaatttatgctgggaggaagggagacactcatgctgagattggacctttaatgtgaatattcacagcaggtaatatgtacatagtgctttatagtttacaaaatattttacattttttggtcctttttagttgtgataattactgagacccttgagcaagtatcattgatatttttctcattttcatttttctgatttaaaaaggcttagagaaaggttatctgacttttccaataccacacagcaaaggaatagctaagctattccttcaggctcagaacttttgtcaccatagcattagatctacataaagagatggggatggagaatgtgtaaaaaggcatcacgtttaggttgaatgaaaagccagagagtagttaagtttggtggtaaacagaagatgaaaggaggtagtgaagaactgtcttctattaatattattattatgatttttttaagagatagaatcttgatctgttacccaggctctgtggaatgcactagtatgatcatagctctctgcatccttgaactccaaggctcaagcaatcctcttgcctcaaactcctgagtagctgggactacaggcacatatcaccacacccagctgattaaaaaaaattttttttgtagaaacaaagtcttgctatgttgcccaggctggtctcgaattcctggcctcaagtgatcctagcacctcggcctcctaaagtattgggattacaggcatgagccaacgtacctggccttatattatttttaaacttatttatatagaagaatcaaatttactctgtgcaactttggagagttgactaggacaggagagcccactcaatattagaaaaagagctctacaaaaaagacattgttacgttacattcctgaaatgttgaaataggggctagaggaatatttgacaaagctgtagagagaaatagttgaccttatgacctctaaaattcttttcaagatattttatctgcaaaaacctgaatagcaacaactatagttccacaacactctagttctacagaaggagggtgggatgttacactgtgctttcatgtttcaataattatatatctatccatgcatgtccacttctgcttgatgccactgaagtgggacctgaggagctggggtgctagggcagaaagagtaaggtctgtgcccgatcctagacaaaagtggaagcaattcactgcttcatccatcacggaagggcaactctttagcttagcaaactgagaaattttcaggctcaacaccagcaggaattcaatttgcagcaagatagacctcaggggattgaggcaatgattcagagaggatgggtggggtagggttacacaggaactttagagaaagaatcgtttgtgggtggaagccttgggcagaggtgcactcagtagagaagaaagccatttgttccagaacagcagtttgaaaggggtgtgttttgtgtgggcaatggtgtatgaggaaagggtttgtggggaagaagcgtgtggggctactaacaggcacagaaacacttgttgagaaatgttgttcatagggggattgctttgctggggcccaggagcaggtggtttggtgcagtgaaagaggccagaggggcagaaagaagggtcctagctgtggccttaaacacacacatacacacacacacacacacacacaccaaaaagcaaggaagaaccccttatcctctcagccaagataagcaagcgctgttaccagctaggtgtgcttactatggattttatacattttagagaaaatttctaatgcccatttgtcctgaactttttacttggaatatcgttaagtttacggaaaagtagaaaggatcatgtaatgaacactagtgtacctctcacctaaaccatcaatagtcaataatctgctacatacatttgttttctcctgagccatttgaaagtaaattgctgcagacaatttgcctatcagtccatttttgaatatattggcacgcatctctaagaataaggacattctcttacataatagcattgccattatgaagatcttacctatgaagatccacattaattcataagatctgcatgtgtgttacttatcagtacgtcttataatggattctgaatgctttcccttttcttatttctctagctgtcatctttgaaggtaaaacctcgactgcatatctggccagccaggccaggccaaagtacctgtatactgggtgaggggataagaaagactctctcaaagagcacaggaacctggaagcctgtcagaggtcacctctcacggaagcccaggacgcttccttcctgctgagctaatcttaactgctgacctccacgcattgctcagggctccctccctcccttcttccctatttccttccttccctttcctctcctttcctgtctctttcaccaaaccttaacggacaactcttctgtgctaacttctgtgccagtgtattagtccgttttcatgttgctgataaagacatatcagagactgggaagaaaaggtggtttaatttgacttacagttccacatggctggggaggtctcacaatcatggcagagggtgaaaggcacttcttacttggaggaggcaagagggaatgaggaagatgcaaaagtggaaacccctgataaaaccatcagatctcgtgagacttattcactaccacgaccaaaccatatcagccagtatctgccatcccaagtgaacttagtctgtgaactcaaaatagtgctggccaggcatggtggctcacgtctgtaatcccagcgctttgggcggccaaggcggggggatcatgaggtcaggagatcgagaccatcctggctgacatggcgaaaccctgtctccactaaaatacaaaaaaattagcagggcatggtggcacatgcctgtagtcccagctactaaggaggttgaggcagaagaatggaagaatggcttgaacccaagaggcagaggttgcagtgagccgagatcgcgccactgccctccatcctggcaacagagtgagactctgtctcaaaaaaaaaaaaaaaagttcagaaaaggcagagtttcttctggcgagtcattcctttctttggctctgtgacccgccctttaggagcatcgtgcagatggactggcttgtccacctggtggccctatcagggtatatgggcttggcatggaaaaagcctctgctccttggatcactaatattaccttgatcatcatcattacctgaccagagtactagacacagtttcatgaagagaaagcaaaccctttcatcctgaaattttaacttagttgctcctcccatggggtgattcttggtgcaggggagatatctatttgcaaattgaggggcatttgtgtctaccttcttgacttaggtggtttctgttttgtttctcgttatggttgttggctgtcctttcaagattatttctacgcgtcaaaaagtctgtgagctaattttaacatgtcaggcatcttactggaaaccacacatttactccgaataaagctacaacatgctaactaaaactaagtttgtttgaactattcaaaccattgtggtcatctcattcttactaaaaaccttttctggtaagtttcatttatttatttatttttattagtacaaatgggaaaataaagtggtgattcataggtataaatattatatggcaaaatttcttcaacacttgaaattattagtaccacctgagaattacatcaggtcaaatcagcatttggtaaatagtagtcaccatttgtagaattaaaccatccaaacttctaatctatcacctagggctaaggactcacacacttcagctctggggaccaaaatgctggcttcaggaagcataatgattttagcctcgatacagtgatggcataatcaatcaagttgtatcctgcctcttttctctcacctaaatttgatttgtgtgattatttattgcagacagttttgcaagctgactttaatcctatcttggaatgaggtggagtataaaagaatacaaatcaacaaacatgctaatgtattttaagaaggagataggagagtttggaaattggaaagggaaattctaaattttgagaattgctttctactaaaccatcattgtccaggagtaacacactagctcacttcttaatttcaagtcagaaacattttcccaagcttatcctggcccgaaggaactgtgacgctgctgaccactgatgctcaccaagcaatcatctctttgaggtttggtctcccacttgagtcagggagagaatgtatggggcaggtttattttcactgcacatatttttcaatgtagatcttgttcatagttttaactggggattggttggtgtgagtaactcgcatgaaactgaaaaatgcgctggacacagtggttcatgcctgtaatcccagcactttgggaggctgaggcaggcagatcacctgaggtcaggagttcaagatgaccctggccaaaatggtgaaaccccatgtctactaaaaatacaaaaattagccaggtgtggtggcgggtgcctgtaatcccagctacttgggaggctgaggcaggagaagcttgaactcgggaggtggtggttgcagtgagccgagatcacgccactgcactccagcctgggcgacaagagtgagactccatctcaaaaaaaaagaaactgaaaaactcagataagatcaagtttgcacctgtaagttgtggataggatccaatgtatcttggataattgtgcagcctccacctcctgaaaccctttctgggtgtccatctggtttttttggacatggtcccccagatacatttgctaagttacaactatatcttaacaaatatttatagggacctatgggggctgggaataataaaaagggtctaataggttgggcaaccccatctctacatctctacaaaaaattaaaacattagctggatatggtggtgcccacctgtactcccagctacctgggaaggaatttttaaaattttatttaaaaaaaggaaagaaaaaagaacccatgatgatcaaaagattagaagctaccagtttagctggtacatcttcttcagactttagtggttttgtcatttggattgaacgcagttcccactgaaacttatttggccactatctgaagttgaaatatcacacagtgacaattgtttgaaaatttcagctccccttctcctgcctcctcttcatctctaagtattttcactcccatctactcatggcagtatctggccactgcccattctcagaccagaaagggatcaggaaaaggccagtgtgtggggtgaggctgacttccaacagttgagctagtacagagccactgagcatttccctccctagggctcactcttcctcaaaactgctagtgtcttgcagatcctctctcaaaacaaaagaggaagtcagaggtggagcagggagtggtttgaactactggttttactggaaaaggattcctgttccaaacctcaagagcaagttcttcgatcttgagcaggaaagaattaaggacagggcgcagagtacagtatagttaaaacagttcattagaaactactctattacagagtagggcatcctcagagagcaagaggaggaatgcccctactttaaatgtaatgcttgcttatacaggatattaaggttaagaatagtttactttgggagtccgaggtgggtggatcacgaggtcaggagatcaagaccatcctggctaacacggtgaaaccccatctccactaaaaatacaaaaaattagccgggcatggtggtgggcacctgtagtcccagctactcgggaggctaaggcaggagaatggcatgaatccgggtggcggagcttgcagtgaaccgagattgcgccactgcacttcagtctgggcaacagagccagactccatctcaaaaaaaaaaaaaaaaaaaaaaaaaagaatagtttactttattataaaggcttgtgatcaagttgtgacaggctattagtattgttattctccggtgtaactattgatttcagcaataatttatgagtgtagtattatctttaaagtgaaacccatgtttatttttatgtgtttatttgcttacaccttcaccaccacaagaaaccctcccacccacctttttttttaagacagaatttcactcttgtcgcccaggctggagtgcagtggtgcgatcttggctcactgtagcctccacctccttgactcgatcctctttgatcctctggattctctcacctcagtctccatgcccagctaatttttatttttatttttttatagagataggattctaccatgttgcctgtcacgtgtgtccgtgtgaagagaccaccaacgggctttgtgtgagcaataaagctttttaattacctgggtgcaggcggactgagtccaaaaaaggagtcagcaaagggagatggggtggggctgttttataggatttgggtaggtagtggaaaattacagtcaaaggggattgttctctggcgggcaggggtgggggtcacaaggtgctcagtaggggagcttctgagccaggagaaggaatttcacaaggtaatgtcatcagttaaggaaggaatcgactgttttcacttcttttgtgattcttcagttgcttcaggccatccggatacttacacgtgcaagcttgggctcagacgcctgacattgcccatggctggtttgaactcctgagatcaagcaatctaactgccttggcctcctgaagtgctgggattacaggtgtgagccaccatgccatccaagaaacccatttttaaactaagaatgcctttttccatcaactcatttcctcaaccataaacattttgtgattaacagtgcccaatttcctgggaaagtaacccagcaggtttggcttcatctggcctttattcaagatgagtcactctgattgggacacctcgaatactggtgcaaatacccaaaatgaaacaaaactgcctgaacttactcattacccccttccttacaaagccagcagacttcctttttgtaatttccttccccttcaagtttcctttcctttcctgttctttcttttttttcattcctttttcctttcctttctcctttcctctttcctgtcctttcccctttcctttctttttcttttcttcttttcttttctttcctttctcccttcccttccttcccctccgctcccctccccgcttctcccttttccctcccttcccctccctttcccttgccctttcctcccctcctcttccttcctctccctgctctcccctcccttcctttcccttccttttcctttcctttacctttcccttccttttcctttcctttcttctcctttccattatggaaatttttaaacatgcactgaaattagaaagaagcatatgatttaatccccaagtgcccattacatgcagcttcaacagtaatcaacattttgctcatcttgtttcatctcttctccttattttgttatttttacttatttgtttattgctgcagtattttaaagttaattgtgagtttatttttaatggagtctctgtctccccatggtacaacttgaggctgggcagaggaaaccaagcttgatgagttcagtgcctctgcctgcctccctggctctccattgccgcctcacagttggaatcaggtgcgaaagctatttcacaacctgatatttattcttctcataaatgttgttgactaccttcattgttccacacactttgcttggcactgaggacaagaagagagatggcataggaagctctcagctcagtgtgctggaagataagtaaaagggcaatcctgacggtttggcctgattatttccacaggtggaagagttttatttaccatataggccttcttaagtttgcttcgtaaatctagagccatatactattcacaaggccacagaatgaacttctttctagaagtttccttaagaaatctcagactgacttttaaaagcctctattatttgctgttgtgaggttagaaaaaccaagctcaagaatctctttccactagatttttacccacagtacctatacatttggatgaatttctttcttctcaagtttctcatattttcttgaagtttcttacctgccaagaaggtaaggaaccaagaactaggaagtgaccttcctcacctcctgcaagactgggactctgtaagccagatcccaggtgggtttttctgagaggattttgtaggcattggctcatcaaagctgattaaaggagcaccattctcaaaagtgacattctggcccacaccttggttgtgtaactgtttttctgttatatcctggcaaaaaagagaaaagattcttgctgaacctattcagataactatactgttataaaaagtaagaaaggaggtaagagtttctgaattcttagttggagtatgtgggtcagtaagaatcagatatcatttaaaaatgtttatttttgataaatattttaattttcaaaagctcctaacttatgaattagagagattttaagaagaaaggaaaaaaccttgtttatatgttcagaatagaacattaaaacaacatcaacattaaagcagaactttaaaacaatattccaaacaaataactacaacgtttctttataagttcattcagctttacataattaattcttattctgttgaaacttgagttaactgtcatgaagaggttttttttttaaataaaaaaactaaaatgagttttggaaatctggagtcagtctacaggtttgatataaaaaaaattttttttttttttgagatggagactggctttgtcacctaggcttgactgcagtggtgcgatctctattctctgcaacctccacctcccaagttcaagtgattctcctgcctcagcctcccaagtagctgggattacaggccccccgccaccactcccggctaattttttttgtatttttagtatagacagggctttgtcatgttggccaggctgatctcaaactcctgatctcaggtgatccacccgccttggcctcccagagtgctgggattacaggcgtgagccactgcacccagcctgatctaaaaattgtctaaatgatgttacatcaaaagcctatatccaagtatatgctttgaagtattaatagtttgaaatatctggtacaatcgtttttcatgaggctttgagactgtccttctttattgaagacacaaattgtggcctgtaatttatagcagagtctttaggcaaacattagagtagagcaaaaactatctgtaggtgacagagctttaaaatgactgtggttagtttattaccaataattttcaaatgtgaaaggttatgcaggctcatgataagaataatgcaacttacaggccgggcgcggtggctcacgcctgtaatcccagcactttgggaagccgaggcgggcggatcacgaggtcaggagatcaagaccatcctggctaacatggtgaaaccctgtctctactaaaaatacaaaaaaattagccgggcatggtagcgggtgcctgtagtcccagttactcgggaggctgaggcaggagaatggggtgaacccagggggcggagcctgcagtgagccgagatcgcaccactgcaatccagcctgggcgacagcgagactccgtctcaaaaaaaaaaaaaaaaaaaaaaaaaaagcaacttacaaagaaatttggttatttcttcaacatatacaaccagataataaagtcatctccaataatttttagatgaaatatctctaaagataatgattaagcctatttcaaagaagagagtgaatattacttacactgataaaaatgtttgaattttttttttcttttgagacattctgttgcccaggccggagtacagcagtgtgatatcggctcactgcagcctcaacactctgggctcaggtgatcttcccacctcagcctccaaagtagctgggactacaggcacgcaccaccacacccagctagtttttgtatttttagtagaaacagggcctttccatgttgcctaggctggtctcaaactcctgtgctcaagtgatccacctgcctcagcttcccaaagtgctgggattacaggctgaatgagccactgcacccggcctgagcatgatttttatcgaggatgacacccagaatatcagagagctggcatcttttctagcagaggtataggctgtaaaaaaacaaagaacttcttggcaggagtgattcataaattagatgtgattttggggagctccttttgtagactgttggttctggaagtttctgttgcaccagagtggttgtggtttgtttaacggttcatatgttattagcaaaactcttccaagattgcagaagctgcccaaatcactcagttagaaagaacaagacataatgtggtaactcccccagagatcaatccatggactgaacccatggctatgcagggcctgaacaggtagaaatctagatcagagaactacaatgattagagagggggaacaaggatcataagaataaagtagcaggcagactaagaagggttgggttctatagattgtgagcaggtttgtgtagttcattttacaaatgtgaattgtgattcttaataataactaaaaatacctatcttatatattcaagattgttttcggaatcactggtaaccaattgttctctaggtccatgaggaaatgatttcacctggaacacattatcagggtctaggcagatgctaaaaaagaaaaaacaatgggtggaagtcagcagatcggggcctcattcctgttctgccactcgccacctatgtggcctcaggcgagtcacttaacagcttgaggcctcagttttattgtaaaaccaaagaagtaatttgagaccttcttacttggtggggaagttgtgaggatcacatgaggttacttatgtgaaaatgaactaaaatgtagcaccatctgtttaggtccccagaaagcccaaacagcacttttatatgaatgagaagaaaggctcttcctcctggtgaagtcaactcagcgctagtttgtacagtttgtttacagagtataggttaggttttcatttctatttaccccctttgctggctacccttaagcaaaccataatcttcagaaatgtttctgtaagaagaattatactacataatatcataagaaagccttttctaggaagatgtttaataggctaggtccctctgtgtttggtgggtagactgacgctatgatctgcacacaattgagcactctgggatcctgatggaagaccgtgcttagatattgggtcatctcaaataacatggcagtttctgaaaaagtgccccctctcccaccacagactttgtttatctggtgggcatgtgaacgacaaaaaccgtaggaaaaaagataatggcttctttgggacccacaagaaaagcattgttcagtattccttcccttctgctgttcccatgtctcgcatcccaagagagacctcatacctggaaagcctccatcccacagctgagctggattcttatatccagtcaactggagcagctgcaattgcagaattaaggaaaaactcatgtgtgcacagtgtagcgagacactaaccattactgattgtttcaaaccgctggttctcaaccacgtcaccagatccaacctttcatagcaaacatgttgtttcccttttactatcctgaagtgtaattcatagataacataacacatttacacacataaacctaggtgatctattctcagtcttagcactcaaactattgctctaacaaatattttctttcactcctgcattacgcttttcctctctactgtgtctttactatcaacaaacaagctattatttcccccatcttaaaaacaaacaaaacaaagttaaaaaagaatctctggacactgtcatccagtctcatgtctttagatacataaccatatgcctttatgtctctttatgtctcaaatttatatttccagactagactcttcagaactccagattgctgtatccactatgtccaactaccacttgacatttcagcttgcaggtttttttcttttcttttcttttctttttgagatggagtggagttttgcttttcttgcccaggctggagtgcaatggtacggtctcggctcactgcaacctccatctcccgggttcaagcgattctcctgtctcagcctccaagtagctgggattacaggtgccctccaccaagccagctaatttttgtatttttagtagagacggggtttcaccatgttggccaggcaggtcttgaactcctgatctcaggtgatctgcctgccttggcctcccaaagtgttgggattacaggcctgagccaccatgcccggccaacttgtagtttctatagacatgttaaacttaacgtcaacatggggttgagttgggtggaggaagattgcaaagatacacaccaacgtgtaaataacagtaggatgagggtcttgtgtgtgtatttgtgtgtttctatatactattacataaaacttctataatgagcattaacattttgaaaaactttttattttgaaataattatagattcacagaaagttgcaaagatggtacagagagtccccatgtacctgtcaacagttttccccagtggttatatctcacttaaagagtacaatatcaaaaccaggaaataaacattagtgtggtgtgtgtgtgtgtgtgtgtgtgtgtgtgtgtagttacaagtcattttattgtgtgtttattcctgtaaccaccactgcaatcaagatacagaactattccatcaccacaaggatctccctggtgatacctctttgtagtcacgcgtatatccctatccccatgatccttgaccctgcaactatgaatctgttctccatgttatgtaaatggaatcatacagtacatggctgcttgatgatacatttttttcatttagcataatgcccttgagatgtatctaatttattgtgtgtatcaatagttcattcctttttactgctgagtcatattccatggtacatgtaccatggtttgcttaatgcatcacccattgaagaacatttggatggtttccaggttttgaatattatgaagaaaactgctattttatttctgtacaggtttttatgtgaacatatgttttcatttctctgggttaaatgccaaggagtgcaattgctgggttgtatggtaagcatacacagttagacagaaggaataagttacagtgttcaatagcacagcaggatgaccatagttatcaataatttattgtatatttcaaaatgattagaagatttggaatgttctcaacacaaagacatgataaatgcttgaggtaatggatatcccaattactctgacttgattatcgaacattgtatgaatgtatcaaaaccccacaaatatgtacaactattatgtatcagtaaaaaaaggaatctgacaaactgttttacagagtggccataacatttatattttcaccattaatgtatgcgtgtacccagtttctctgcctccttgccggcagttggtatttgcgctatttattcttttagccattctgatggatgtgcagtgacatcttgtcactccagatctctgaagttctgtctgcaattctgtcctctctggtactgtgctctgtgaactccagttgccttggcttccttggacccccagttttatctcctcagctcaggaagactggcggactctgcctgggtctccctctctgtgccacagcctgaaaactctttctaggaaataagctgggagaattgtagggttcagttttaacatcaatcttttctacccctatctctttacacctatctatctgtctgtctatctatctacctatcatttatccaccatctatttatttatcataaatttttcttaactacaagccaagggttttagtatcagaactgctattagttatctgtagcatttgggacattaacttacttgagccacttctttgttggtgaaatgagggtcatcttatatcagccttctcataattccttctgagagattccaggatactggttgactcttctagaagatacagtgagcagtgttggtagctacggtccttagtatgtgctatttctaaacaggaaaatgatattgattgggtgggtaatgagcatgtgttggtaattgctatgtaagagcaataacaacaacaactaatacatttagccttttacatgcagtgtcttatataatatttacaacagccctgtaaagtaagtgctactattatccaaatttattcattttttatttaaaaaatttttttagtattataaaccactttatgtccaagaacgattcaaatttagaagacgagaaaactgtagcctagaaaaagaaataaaaatgaaaattaaaaacctgtccagtctaaaggttatacttacacagacttaggttctttctttgtatttaattaaaggttaatttcaaatgatctctagtagtaacaaaactctttagttataaagaagcaggtgatgcatggttgttgaatacattacccctgctgaccttagactgctgctgggctcagcagataattcttgattttctcttcacattgcaaatagacctcaccagaataaatgggcagaatagacaccaaagagggatagcgcaagcaaatgtgagggtgaaatgcagtcagtgccttgcaaaaggaagtgctcaatactggtagtcggtgtcattgctcttactgcaaattataaacaccagcactgcaaaagtcagcccagtagactttgtaaatcacagaagtggctcctagaccaccatttgaaaaattctgcctgaaggactaaggaaaacatcttcttttatttttattttatttttttataccacagtttaggaaaacatcttcttaaaagatcgtgtttatgtctacagatgatttttatagtgccttaacagtctccagagtggttttaaaaatattatctcagaatgtcaatttcagctaaagaagtgaaccttaggatcaacattgtaaccctcctggttttattcacccagagtatagggactgataatgataatgctgctttggatagtctcctatctagggctaaatgatcagatttgcaaaatccagatattcttatgggaatgtggttattggctaggggaatggaaagagggagtagagagtggaaaactggataaagttataggtaaagatatgtgaaaactcatgattgtctcaaatactctaaatcttgtcataatacacttgtaaagtaataatcatgttggagagatggccaaataaaggccaaagatcttgacactgcagaaattataggagaggattaaaggaagtacatgtggcagatataagaaaagactaaacttgagattcatgcacaaggtcaggctgcataaaccacaggatagcgggtgtaactcaggagcagaacaattgatccatgaaacaaaactgtctgcagtttcccaggctggagagatttcccgtcttggatgtctggatctgtctcagtgcccagatagcctcacttcaaagtgtttgtgggaacagaaagaattggctgagtgtgtttgttcagtgctaggcggaggaagtgaaacggggagtgggtttaggaagtaagtgtgtgtttaagagcacgtggaccaccagaagataaccatttttcttcagactagcagccagggcactgctcacgaagaaggaaaccctgggagggaagaacttggggaacgagaggacacaagaatctctgcagctgcttatgcatgtacgtaagtcacagaggtgttgggtgcctcaaggaacaacatggaagtcctctctcttttttaaaataaataattttttaataaattttcgagcactttgggaggccgaggcgggcgggtcacgaggtcgggagatcgagaccattctggctaacacggtgaaaccccgtctctactaaaaaatacaaaaaattagccgggcgcggtggcgggcgcctgtagtcccagctacttgggaggctgaggcaggagaatggcgtgaacctgggaggcggagcttgcagtgagccgagatcgcgccaccgcactccagcctgggcgacagagagagactccgtctcaaaaaaaaaaaaaaaaaaaggaatctgtcattacaaccttctctcacaaagaactccaggcgcagacagcatcaccacagcattctaccaaccatttacagggaaagtaatgcacgtccacaaaactcttccagaaagacaagggagcactcaccagctcctgaggccaacgtagcctcagtccctaacccagcaaggacagcagcggagaggagctcacaggccagcccccgccacacgtacacaccactgcgaggctccaaagctcaagcagcgtgtatccagcgaatacaacaagaataatgaaaaagcgttatctgatcaattgctagaggagcagaagtaactctggcaaacctcactgaatgtgaatcctgaaagtgccttgatctgcggttctacaagttatggtgctggaggtctcagccaatgctgtagggtaggacaaagaaagagctccagtgccagacaagaaaaagtaaaactctgattgattcacccatgaaacagtgtctgtgtttagaaaccccaaaagaatatatagacaaatcataaggatgaaaaagtgagtttgctccctctccctctccctctccctctccctctccctctccctctccctctccctctccctctccctccacggtctccttccacggtctccctctgatgccgagccaaagctggacggtactgctgccatctcggctcactgcaacctccctgcctgattctcctgcctcagcctgccgagggcctgcgattgcaggcgcgcgccaccacgcctgactggttttcgtacttttttggtggagacggggtttcactgtgttggccgggctggtctccagctcctaaccgcgagtgatccgccagccttggcctcccaaggtgccgggattgcagacggagtctggttcactcagtgctcaatggtgcccaggctggagtgcagtggcgtgatctcagctcgctacaacctccatctcccagccgcctgccttggcctcccaaagtgccgagattgcagcctctgcctggccgccaccccgtctgggaagtgaggagcgtctctgcctggccgcccatcgtctgggatacgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctgggccgcaaccctgtctgggaggtgaggagcgtctctgcccggccgccccgtctgagaagtgaggaaaccctctgcctggcaaccgccccgtctgagaagtgaggagcccctccgtccggcagccaccccgtctgggaagtgaggagcgtctccgcccggcagccaccccgtccgggagggaggtgggggggggtcagccccccgcccggccagccgccccgtccgggaggtgaggggctcctctgcccggccgcccctactgggaagtgaggagcccatctgcccggccagccgccccgtccgggagggaggtggggggggtcagccccccgcccggccagccgcccagtccgggaggtgaggggcgcctctgcccggccgcccctactgggaagtgaggagcccctctgcccggccagccgtcccgtccgggaggggggagggggggtcagccccctgcccggccagccgccccgtccgggagggaggtggtgggggtcagccccccgcccggccagccgccctatccaggaggtgaggggcgcctctgcccggccgcccctactgggaagtgaggagcccctctgcccggccagccgcccagtccgggagggaggtggggggatcagccccccgcctggccagccgcccagtccaggagggaggtggggggtcagccccccgcccggccagccgccccgtccgggagggaggtgggggggtcagccccccgcccggccagccgccccgtccgggagggaggtggggggggtcagccccccgcccggccagccgccccgtccgggagggaggtggggggatcagccccccgcctggccagccgccccgtccgggaggtgaggggcgcctctgcccggccgcccctactgggaagtgaggagcccctctgcctggccagccgccccgtccgggaggggggagggggggtcagccccccgcccggccagccgccccgtccgggagggaggtggtgggggtcagccccccgcccggccagccgccctgtccgggaggtgaggggcgcctctgcccggccgcccctactgggaagtgaggagcccctctgcccggccaggaccccgtctgggaggtgtgcccagcggctcattggggatgggccatgatgacaatggcggttttgtggaatagaaaggcgggaagggtggggaaaaaattgagaaatcggatggttgccgggtctgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgttaagagtcatcaccactccctaatcttaagtacccagggacacaaacactgcggaaggctgcagggtcctctgcctaggaaaaccagagacctttgttcacttgtttatctgctgaccttccctccactattgtcctatgaccctgccaaatccccctctgcgagaaacacccaagaatgatcaattaaaaaaataaataaataaataaataaaattttcaactttacaaacaaatgtgataataattcatggaactcatgaatattctttatccaggtacattatttttttaaacttcccttatttatttatttatttatttatttatttatttatttagagatagattctcactccggttgcccaggctggggtgtagcagttggatcatggctcactgcagcctcaacttcctgggctccaaccatcctcccacctcagcctgcctggtagctggaactgaagacacacgccaccaagccaggctaattttttcatattttttgtagagatggggtttcaccatgttgcccaggctggtctcaaactccgggactcaagtgatccacctgcctcggtctcccaaagcactggaattgcaggcatgagccactgcgcccaggccccctatttattttttatcattttctctctctctctgtaaacacacacatgtatacatatccatatatctatattccgaagcatttgagagtatattgcatatgttgtgctcttttcctgcttaatatttcagtgtgcatctcctaagaagaaggatattttcttaaacaatcagggtacagttttacattcagtatatcaaatacatatatacagtgattctccctacccaaagtttcagttacccatggtcaacgacggtctgaaactattaaatggcaaattccagaaataaacaattcataatttaatgttgcatgctgttctgagtaatgtgatgaaatctctcaccgtctcactccatcctgcctgggatgtgaaccatccctttgtccagcgtgtccatgttgtagacaccacccacccattagctacttagtggccaatatcagatgcaccgtcacagtatctcagcgcctgtgttcacataacccttattttacctagtaatagccgcaaagtgcaagaatgatgatgctggcaattcagacacgtcaaaaagaacccgtaaagtgctccgtttgagtgaaaaggtgaaagtgtctcaacttaataaggaaaggggggaaaaacatgctgcaattggtaaaatctacagtaagaaagaatcttttatctgcaaattttgaacagtatattgttataattattctattttattagttgttgttaatatatattactaatttataaattaaacttatgtagatatgtatgtataggaagagaacagtacatatagggccttagacattcactggggtcttggaacatattccctgtggataagggggactgccataatactcttatctactacagagatcatacttttatcaattgcctcaataatgttcttcatagcaattttttttttttctggcagggaatgtgtctctttgttaaggggatgagactggcctagcaagacaaagatgcatgctcagctctccttaggatcttctttttttgagacagaatctcactccgtcacacaggctgtagtgcagtggcaccatcttggccttctcacgggttcaagcaattctcgtgtctcagcttccccagtggctgggactactggtgcgtggcaccatgccggctaatttttgtatttttagtagagatggggtttcaccatgttggccaggctgatcttgaactcctacctcaggtgatccacctgccttggcctcccaaagtgctgggattataggcagaagccaccaagcctggcctccttagaatctttatgagtaggggaacccccagcaggtcaattgtttgattttctttggtttcattcttattccatttcttccctgagagtataaacctaatcagcaagactactcagatgttaagagatctttaatagtagaaggaatctggcttaacaagatgtagctttagcaggggcctgagatgtaaagttggacatcttccctccagcctcagcttaggagtaagaatggactgtggtactttttctattcctttttatcttttgtggggaaggtgggtaacaagaagagtaatagatatttgaataagcaaaagcaaatttgggttaaaaataaagagatggtcttctgtggtaaatctagtcctatattgacaataaggctttctacaagaatttccctaaaggagagtgtgacactgtacacgcttgtcttctcaatcattctctggttatttggcacaaatttctgtttaagaatcaattgatgtcaggggcatggtggctcacacttgtaatcccagcactttggccaaagtgggatgattaattgaccgcaggagtttgagaccagcctgggcaacatagcgagactcgtctcaaaaaaaaaaaaaaaaagagctgggcatggtagtgtgtgcctgtgatcccagctacttgggaggctgaagcagaaggatcacttgaccctgggagattgaggcttcagtgagctatgatggtgccactgtactccaatctgggtgacagagcaagatcctgtctcaaaaggaaaaaaaaaaaaaaaagaatcaattgatgtcaactttcctcactgatttcccatatgtaaattacctcagaactgcttcccttggtcatctccctactcttcaagagaagaaacatgaggaaacttccacattttattacacagcaacagggaatgtggtagggaggaacaagagaaatgggaatggaaagagaaatcgctgccttgaagagggtagagtaatgtgcagaagacacaggagaccccagatacaatgctgtagggcttagtgagattacagtctctactagagccaattttgatctcaaagtcacgttcttccatttcccgcttcctctccaggcaaaatgaagctgaatctggtgcagatctttttcatgttgctgatgctgctgctgggcctggggatgggcctggggttgggacttcatatggctacagcagtcttggaggagagtgatcaaccgctcaatgaattttggtccagtgactcacaggacaaagctgaggccactgaggagggagacggcacccaaaccacagaaacgctggtgcttagcaacaaagaagtggtgcaacctggctggccagaagatcccatcctcggtgaagatgaggttgggggtaacaagatgctcagagcctcagctctctttcagagcaacaaagactatcttaggcttgaccagacagatagagaatgcaatgatatgatggcacacaagatgaaggagcccagtcagagttgcatagcccagtatgcattcatccatgaggatctaaacacagtcaaagctgtctgtaacagtcctgtcattgcctgtgagctcaaggggggaaaatgtcacaaaagctcccgaccttttgatttgacattgtgcgagctgtcccaaccagaccaggtcactcctaactgcaattacctaacttctgttataaaaaagcacattattataacctgtaatgacatgaagcgccagttaccaactggacaatgaagcaactcatcatcttttttctcttcaccttctcctgttcctcttccttttttacttcttctttctcatatagttctcctgatcttaggtatcatgcagatggaattcttccttgccctatgggtcacccaacttgcattttgttcctaggattagagatggtaggataaggtgatgatgcctagtttctctaagctctctgcctctcctttcccttaccctggaaaggagtaagtgaagagctgctgtagtccgtactgtagtcctggccatccatttgtttcctgctctgctctgagtttgtctctggatgtggactggaagagtttagtgtatcctttacccatgttcttccctgctgcccaccctgagcctctacaacaatcacataagactcttgggttttgcacaactgcacttctctattgcggatgaagttaaagtgattctatctgtaatggcttctggaggaccatgtggaacaggcttccttttccgagcttggaaaaatttagggcctaggtatgggggtctgctggggaggtggtgtggtgctgtagagcaagatagaagatgggctggagcaagaatagaactcttttttcttgacccttcactgcccttttctctttcttcccaccttttactagcagcctccttgcttggcttcttgttttcatctcttacctttgcttttgtcctttgcttctttttctccttactttctctgttctccttttcctcttctttttctttttgggcccgctcttctctttatctggatccttttagagattcagtcagccgatactgatcacttatgctatgttggtcctatagtcagtcatgcaagcagatgttcgtcctatagtcagagtctggcacagggagttagaggggggtgggtcaagagaatgagaaaaagagagaggaaaagagagaaagagaaagagagagtgagaaatcttttttgaattatgtccagaagcagaatagtgctcatatgaggtgcccagtagatgtgggatgaatgggatgggagacagtctttttctcatttagcatcgtttccgctttattgctctaaagaacaagaaagttagtgaaagaataatttcagcagagaaggtatcaaacttaatcaaggagaagagaagctgtgtggctggatacacagaagatgcaagtggctgccctcagcctatttcctctaaattcaaatgagaaatagtgtagttagtcatgcatagggagaagaggaatctgagaacatagctgtaaggattcaccgtgtgactgaattttgagatttccttcccctagagtttttctctgcttcacattcctagactattatagacccaagtcagggacatacataaatgggagactgaagggaagaacggtttgctttactctgacctggcttgcattttcctgttctttctgtctttattctctttatccttcctgttttcacagacaggcaaccactttagtatcctcctagacgtccctgattcaatatatcccttatacctctgactcacttccagcaataacctcttaggaacagtgttgtctcccagggaattctaataatagtggacaggaggtatgtctccatctgtgggctggcctgatgttttagaggtggtaatgaagtggtgaaaggtgatgacccagccaaggcagattcctatgcttcctgagggcgaatccctctccggggaaagagacaaaagattatctaaggtaagggggaaaaaatgagaaataggatgggaagaggggaaagaagaataggtgtcagagaaaatcggccacgttagcaatctgtctggtaggtaaaccaaggatttaggaatgaaatgtgaaagatctccattgtatggagtgaattattaagagaatggaattagccagggattaaagcctatattctctagtattcagatgtggctccatcctcttcagcttccgtccagcttctctccctaagcgttccggcactgtttgatgggcatactcatctcctccgggtcttcactttgggcaaatctcagtgggtcatgtttttcttttgttttgttttgttttgtttttgttttttttgtttaatctgaccacgtagactatcgcaggaaagcaatttacaaaatactccacaggcgcctagtggctcaagcaggaaaatatagcttccatggctgataacagggtgacaaggcattgtggggacctcacctcccaggggcagaaaattaactcactgtagctcaaattctgcctcattcacaagactttcaccgagtcttctaattccaatgtagcttcctctctacacttccaggatctgtgttgagcccatatgacagatcccagtcccttatctacagtacccaaatctctgaagctctgaaaatggaaagtttttttcaaagtggccccaaaactcatttagatatgacacctgactagattgacaatgtgaggctatttatcttgtttatttatgctatgtgaccattacatatttcactgtggaaatatcactgtgttttgttatgagtaggtccttctaagagtgtgttagtcatatatgatataaacatacacacattaacatacaatagtgctttttaaaatctgaaaatgttggccaaaatgcattggccccaaaagtttcaagtaagaaattgtgggatctatatatactatttaattagccttaattaatttgagtatactggatatgatcctagttaggccactagcacctttgtggaaggatctgtattataagtttcttctatattcttcattgacacatttattaatcaatgactatctacctatgggccaagggatgtctcctctactgtttggaagacactcaaatattgtcttcaaaacactctgtacaagtttttggccaggtgtggtggcttatgcctgtaatcctaacactttgggaggctgaggtgggaagaacactagagcccaggagttcaagaccagcctgggcaacgtagggagacctcatctctacaaaaaatagaaaaattagccaggcgtggtggcacatgcctgtaatcctagctatttgggttaggctaaggtgtgaggattgcatgagccccagagattaaggatgtagtgagctatgattgcaccactgcactccagcctaggtgacagagtgagaccctgtctcaaaaaaaaattttttttaagttgttctgagctttgctgcttattaacattactgtccaggaatggtggctcacgcctgtaatcccagtactttgggaggctgaggcaggtggatcacctgaggtcaagagttcaagactagcctggccaacatggcaaaaccccatctctaccaaaaatacaaaaattagcccggcatggtggtgcaagcctatagtcccaactacttgggaagctgagaaaggagaatcacttgaacctgggaggtggaggttgcagtgagccaagatcatgccattacactccagcctgggcgacagagcaagactctgtctcaaaacaagcaaacaaacaaacaacaacaacaaaacattaccttggggagtttaaaaattttttaattaaaaaaaagttacagggccctcttctagcaatattggtttaattagtctgagttggagcctagacatcaggtggggtccagcatcttggagcctaccagttttcctgtgaattaatgtttcaaaactgttaataaagatgttgaactgctcaggttattaactaatatgatgtggtgtgatgtaggagaaaagaaccaattcttgggataaacgtgagaatatctcagctctgccattcaaaaaaaaagcagctgtgactatgggaattgccctcagctctcagaatctgaggtttcttatcagtaaaatgagaaaatgatcatacctactttatagggtggcagtgaggattagatgagattgaacagcccatggtagggttcaatgaatggcagctgcatttggtggtgatgctgcagggctcactgcccacggagaacacataatattttgacggagtccttctggaagcagcactatgacacgaagtgcaataccatcagcacaggtttgagtttcaggtgtgttggcagtatgtggacatgtgggatcttataggatttttaaaatttcattccttggatggccacaaaatttatattctagggccagtagagtccttagacttgagcgagcagggccactgccctcaagggtccctttggagtgccttccatacaggaagttaccccactacagtatctgggactggctgaggccagcagtgccatgtgggtagggtgctctgagcttagactaggactggtgtgggcccgggtcccatttctcccctttggagcactgtctccccactgccatgtgtggggtcaactaggtgctgcaaaagagttctgggacttggtcaggcgtggtggcttatgcctgtaatcccaacactttgggaggccgaggcaggtggatcacctgaggtcagaagttcgagaccaggctggctaacatggtgaaaccctatctctactaaaaatacaaaaaaaaaaaaaaaaaaaaaaaaagctgggcatggtggcaggcacatgtaatcccagctacttgggaggctgaggcaggagatttgcttggacctgggagagggaggttacagtgagcagagattacaggcatgagccaccgctcctagccccaatggggcatttcctgtcaatgttctctcttgcctccaactggtgggtgataacatgctttcttgggttggtcttaatctgtgcaagatgaaggataatcactccttgcatgaacaggatgcttttttcactctgcccacgggtctcttgctagtagcaatgtgtggaaggtaggaatgtggttagttgtaaaagaggtcacgttctaggaatgcagtaattacggcttaaagagttcaagagaaaatatgattggaagatatgttttatgtttatactacaaaactccaaatggcaaattctacatggcctgaaaattaattatcattctcattttctggcatattctggataagacttgcatttgtgatcatcaccaacaacataaagtaataaagtaacctttgagagagtcattggaagttggtatttaggccataaactggataattccctgtcatgagtaacactataactgacattaaatggcattaggaaactacagaggcaagaagatacaaattgtttcaatttaaataggtttcgaagagctgtagcagtgtgatacccttttttcttgtggttggagacatgaaatattcaagaatggtgcatttgacagtaaggagtgtgaagaaatgattcctagatctaacaggaagagatgatatctggacagtccgaagaatctccatatacattgatgggacaataaagaaatatatagtatctctttcttttctcattattctaaaacttcattgacaaatcatgatacttcacttgggctcataaattttgtaatatatttaaacatgaaactgtttatatagatagggccctcttcctcacccttaccccccaaaaaatttagccagggccacacacagtagaggcagctctggttgtggctgtatccaaggtaatgtctcatgtgttatgtccttattaggctctcgacaagaagtcatctcctcgccttcctcaagtgctcagtctaccaagcagggtagcctcagttggttcttttcaagcctctctttcccatgaaatgaagttacgttatccagcagagattcattgctggtggggtcaaaaggaactccagggcacagagtttctgtcattttcagcaatgctttgatttagcgtggaatttgttgatgttcctgcctccatttcctgtatcctacgcagagacctgcctttctctcctcttcacatttttgcaatgggctccagtttgttttcagaaagtgattcacatcccagagacgtcacttccaggagcagctgggctgattctttataagaattatgattcagaaacccagttaagtttggatttaggggaaaggtaaggggaagaggaaaatggtaatattaaggccaagcaacagaggcaatgagggaaatgtgagtctcatgttgagacataatagtccattacctatggaaataggatttcaggaggtactgggatgccccagtgtttgaaaatgtcagctctccagcactagcatgaggttagtgtttggaattatatccttataaacttattgcatatccctatacacaagtatata

SEQ ID NO: 101 - DNA, 55029 bp, Homo sapiens
tcgattacagagatcataacagataattttctttaatgttgacttatactttattcctgcttcatataaaacatcttctctcaaaggtcataaatatcaaagtagatcatttgtactacttctgctggcaaatgaaggtagttggaaatgtacgcaggaaatctacacaagggacaatcagaaaaaccttatgagcatgttctgaatgcaatttttatggctgggagcagtggctcatacttgtaatcccatcactttggaaggccgaggtgggcgcattacctgaggtcaggagtttgagaccagcctggccaacatggtgaaaccccgtctctactaaaaatacaaaaattaggcgggcattgtgtcgagcgcctgtaatcccagctactcaggaggctgaggcaggagaatcacttgaacttgggaggcggaggtggaggttgcagtgagatcacgccactgcagtccagcctgggtgacaagagcaagactccgtctcaaaaaaaaacaaaaaacaaaaaactccacaattttaaaggatgaatatggttgcaaattgggcaggttatggtctgcttaagacacttcaataagtctgatatgtcataagcacagatgtcttcaggagccaggcaggtgtcatcactgaacagataggataaaagtcaggagggagagtggagtcagagaacagccctgagctagagccccttccacagacgcagctgttactcagctctaattgatacaacaccaatggtgcaccaaccaccatcatgtgatttttaaagataagacagtaatgaaaacttttagtgaactattccaatgtcaaactttatcttccaaaccaaacatcataaatagcactgtgtatgctgaaaagaagcactgtttagccaagtacctgccctggggctgcagtctatgtcttttgcctcatactatagacacttaagtgcaaatgtttctagccagtgtggctgtcagcatcacagaggggatactctacgtatcattcacctttacattctcatcacctacaaaaatgatctccacacaatatacatgaaaaaataaacttgcctcatgataaagctgctaatgaatgtcggccagaacaggacttcaaggcagagcaatattagctgcgcattgagtcctcaccaggtcaccattgtgtccacatttacctaaggaccccagtgataaaattattgcatttctaaatgacaggaaaattggacggtagtaaaaattaggcagattaactgttggaaggtatattatatcatttaagggtctactttccattttctaatctcaaagctagaccagatttaacatctgttagtacccaggccttacctttgcaattcacttctcacctctgtacaatttccccacatcatcccctgtgcccagaatgctcatctcttctctaaatcccctgaaaatcccctgcttatcctttaggacctgctgaaataaacttttttttgaagttttccttatttctcaagccaagtgatttccttcaccagcagtgtccctatgacaccatgttcacacaaatgctattacctctatcacactgtaatacaattatatgtctacaagtactttcctgtgtttctctgagggccaagaataaatgtatgctttgtgtatcaaactgtacacttgacctctatactttcaggaatacagtgctctgtccttaaatgttcatttgtaaatacagaaccatattcttgttaatatcacaaaatgaaacttaccaggaagatgaatgacaaccccagaacacactgttttgtagaaaataccataggctgaaaagatcacaggaataccgagtgctaggttggaatctttcatgacaccaaatgttcattcatcctctgccagattttacaactgtcctcggtgtgtttttaggttatgtaactttacacaaagtggaatcaataatcagggcaagacttaagagaaagtggatccaatgcaagaggagtaaagaaaaaaattcctcaattgtatggagcagattgttttaattatctacagaatcttgtgccccaagaaattaatagctcaagtttccagcaagagtggtggatgagatggagagcatttatgtgagagagaaccaaggatattactaaaaatggaagggaagctgggtttctcctgggcaaacagccctctgtggctctatttctcctaactactatgcctgccttcgtgtcatttagtcatttaggggcctgccagaggacagttataaaatctgtggtcattctgccggcagcgtatagttttcacccagagtccagatcccaccggcaaaactctgtctaacacaggatgacttggaattagagtccgtatagcagaaagagcagcagggctgtccttgggtatccgttgctcagccaagtcatcaaataaaaaggatgattgcacaagtggaccatgtgtcaatctgtgggtttctgcatggccagacccaccaagggaagctttatttaaacagttccaagtaggggagaccagctgcccctgaaccccagaacaaccagctggatcagttctcacaggagccacagctcagagactgggtaagtcaacaatccccagagctgggacaggaggggcagcgacagggcagcacctgagggagaggtgagctgaagttagtgcttaggagatgtggcacactttggggacaggaagaaaaggaaatgcgaccccagagtggcagcagaggggcctgtgggttgagacactatagagtgtgtcataaccgagaccggatcggggagtagttacttctcttcttttcttacaggaaacatggttccaaaactgttcacttcccaaatttgtctgcttcttctgttggggcttatgggtgtggagggctcactccatgccagacccccacagtttacgagggctcagtggtttgccatccagcacatcagtctgaacccccctcgatgcaccattgcaatgcgggcaattaacaattatcgatggcgttgcaaaaaccaaaatacttttcttcgtacaacttttgctaatgtagttaatgtttgtggtaaccaaagtatacgctgccctcataacagaactctcaacaattgtcatcggagtagattccgggtgcctttactccactgtgacctcataaatccaggtgcacagaatatttcaaactgcacgtatgcagacagaccaggaaggaggttctatgtagttgcatgtgacaacagagatccacgggattctccacggtatcctgtggttccagttcacctggataccaccatctaagctcctgtatcagcagtcctcatcatcactcatctgccaagctcctcaatcatagccaagatcccatccctccatgtactctgggtatcagcaactgtcctcatcagtctccataccccttcagctttcctgagctgaagtcccttgtgaaccctgcaataaactgctttgcaaattcatctggaagtgtctgtgtgtcttcctcggccgctctgctgtcatttagtgacaatctgctctagagatttgggtttatcatgaatctctccccctcaatatctgaccaaattccttaattcccccatcatccttcatgtgatacctgattccaggcctgccttaaaaaaaaatccaattgagtcaacttagcattggtctccctagccttaatatctcctctaagcaattttccatccactgactcctcccccaacaccaacctataacttgtgtatagatctccacttgttttagttgtattccagaattgagcccaatttgatattgaggtcccatttgatgctttatggtccgactatggtttttattgacatgatttctatcccaagaaaaaaagagctgcagtgaatcagctgaaaatgcacgtgcttcattatgatttatgaatgataaattttgatagaattgaacgttatgatagaaaatagaaaagaagaaagtagaaaaagtcaagaatgctataaataaggtgaaaccaagataaagaaaagtttagcctcagggatatttcttttaaatgggcacatcaagtctccagctattagcaatcgtaatagaggtggaaccagggtttgagtcaaatgtgcaataagataaattgttccgacagcagtaaggacagattgtaatgctgactggaggagaggtggacatctttcccaaaagttccatgtcctggagatggggagccgctggtcacgtgggaaggagaagggggaggaggaggaggaggaagtgggagcactcatgaaggtgagttggctcctgcccattctgccctccatagatgttcccaatggcgagtcaaaggttcattcaacacctgtcaggaagggcacagcctcgagaattcaggatttgtagacccagagagagaagaaatggatgatgagagccgctgccctggactccaacacagggcttcactcaggaatccatgagaaacaggggagaaaaaggggaagccccttcctgcaagttgtggacaggtgcagcattcaagtgattgttccaggaacagagtgggtctttttgaatggcccgactcagaatgcaagagaggtacgatgccatcagatctgcaccttggtccttcagtctgagatttctgacttctatatttctcctcctcttccagaccctgagaaacagcaatttccattcctcagatgactccatgtcagtaatggtgctttaattggcatcagacagcagctgtattgaagtctctcctctggagaagctattgagatcttgcttctccaaggtcgggctgtgaacttaaaagtttgcacagagacactgagtttgggaaatctcagtgctcaacagaatccactgactctaggtaaaacagggcatgtcaggaagtgagtgcagtcttcccataacctcagagtagcagaaggagaaggtgggactctgaaagctggagccacgtttcctgtgaagaaagatggagtggaccttccttgcttcaggtaccagatcacaggtctcttctcagtcggggatgcctcatctctaaaaccacaggatagagggatcagtccccacctgcccccacaccctctccaccttgtgacttcatcctctctcgtcattcattccttcgttcattcattcatccagcagtcatctactgagcagataccttgctccaggcacagtttgagggagtgatgatgcaacacaaaccaagacaggtccctgctcttttgaggccacattatacaaggataaaaataaacatacaaaattgttctaagcatacaaaattttgctaagtgtcaggaggaaaaatacacagcatagtacacagaaaattacacagagcagcacaatatagaggttctgtatgtgccacaaaagtgacagggcagagtgtcaccaggaaagacttatctcagagaatgaaatctgaacaggaggaaaagcagccagtcatgcagacaccagatggagaatcatcccagcaaagagaaagagagttcaaaagtcctgacaaataccaaggctgtaagaagacttttcgttctgtgtttacgataagttgattaaaacatctgaaggagaatgactaccattattcgcatctttgtatgtatttattccttaatgtaataaaacattttcagttttaaaaaatggtcctgaatggatagaggtttggcgtgttagaagcacaaaagttgtttggtcaggacaagatcatcatagccatgagtgttaatgataggagttaatgaggttcagacccttcatgcctgtgaagatggaagaataaagtaagttcctcatggggcacaaatcgagcatgttacatgcaagaataacattgcctaaagatctgtccagctgctgtgcaaaacacaactatttgggagacaagagtggaagcaaggccccaatgaaggaccacaagttgagggagagggaaacaagagtcttccaatctcagtgaatctcaccatcatcctctcatggtgcagccccatgctattcccctccctgttgccatggcctctctccagcccctccatgccttccacatcatcttcctgccatccccatgctgatgactgggctgaggtcagaggcagctcccctctcccaggacgtgagacgattcaaacaagaccaaggaggattctgtgcttgaccatcaggaaaccctggctggactcactgccccttctgcagtagacatccaagattttctgattgccctggacccaaggccagcaccacagagactaccattagagaagttaagtggtcacatccgcatgttccaaagacgtgatccttggagtccacttcttttccttgaacctcccatgtctgattttataaaattctcttaatatcaaatcttcaggaagtcttgcaggagtaaatgccgttaattgttctgtaagccggcagggagggtctccaggaattgtaagaatttaatcaacttgagcaatcagcctgttttacaagcttgctggtgggaaccagctcctggcataacccagcaacttacagacaaactggcatgaacattcctcattatcatgctaaagtctccacccaaggaggaggctcattaccataacatgtgaactatgtgctggcagaatcactcactgtgtatgggcaactgggactcctcctctacaagtgatgatacaccctctgccctctccatcaccacatagaatgttcttctcactttccatcaggaagacactgctttggagaatactcccagtgggcttcttacttgaaccaagtaacaaaacttatttatcaaaatgtacattctcatagagagtctttgttactcaccagggaaacaagccctggttttttcagctaccagctctaacatattctgtaaagtccagcacagaaggaaggttaattcacaatgctattgctttcattttatttcactttttaataattgggtacatatcagggcagatgtctttaggtgggggttgaatggaaggtcaaggagacaaatcatcaaccttggaaagatattcttgcagagattatgactacacttgggattcatgaatatgagaccccaccagcaaagtagcctgcaatgttcaaggatatccaagtagatcaagcattttaatgagaaaacgataggctttgtctttcaagatgtccatgaattgactttccaaaagggaaagaaggacccattttcagggcagaagagagaagaggagaggggtttaggctaaacattgtaatcaattttgcctgataatgactttttgtttcttggttcatttttatttatttatttatttatttatttatttatttatttattttcccaggctggagtgcagaggtgcaatttcggctcactgcagcctctgtctcccaggttcaagcgattctcctgcctcagcctcccgagtagctgggactacaggcatgcactgccatgcccagctaatttttgtattattagtagagacggggtttcaccatgttggccaggctggtctcaaactcctgacctcaggtgatctgccctactcggcctcccaaattacgaggattacagacctgagctgtcgcacccagcctcttagttcatttttagagatgaggtctccctatgtggcccaggatggatttgaagttgtggactcaagcaatgtttttgccttagccagcccagtagttgggtctataaatacacaccactgagcccagatgatactctcattttatgagctgtgtttccactctgattacataaggaagtgaggcaattagtagggataggagcatagaaattctgtctacattcctatttcaaattacctatgaaaaacagacttgtttctaaactaaaactggattttggttaataaatgtttttctttattaaaatgcattagacttatgacagagttgtcacttttgtctcacgtctgatctacaatgatttcaaaagaagatcaattgactacttcaaaattctcattgtttcaaagatattatggatgtaaaactgggtgatctgagataatttagcatatagggccagccaggttacccaaatgaatatctgggaaactgagtacattacatgcttatcacacatctccactgatttagaaaatatgactgtattagtcagagtcatcaagagaaacattgcagatgtaggtagaaagagacagacagaaatatagatacagaaggatttatcatgagaaattggctcaggcaattatggagtcggtgaagtcccacaatctgctttctgcaagctggcagacccagaaaagccagtggtataattcggttcaagtcctaacgcctgaaaaacaagggagccgatgacatagatgtcaacccaagtgtgggaacgatgacacaagatgtcctagcttaggaagtgaggcaagaaaaatgatgaattcctcctttctccacttttcattctattctggcccttaacagattggatgatccccatccagactagcaatgcaaactactttacttaatcaaccaattcagctgctagtcttatagaaacaccctctcagacacacccagaaatcattaattatttaattaattattaatctgggcacccacaggcccaggcaacttgaaatataaaattcaccatcatgatgacctatggtttccaaggtgcaccagtagatgttaccaaaatggcaccaccagccagaacccacatacattcaccaggtcagtgcacttctcaattcgccggagattcattttcttctgtgacatcacgttcacctggagtggagccaagaaccaggccacagctaataatgagaaagaaaggattctttatttgcttttttacaaatgagagaaaaatttgccaaaatcctttggtaataagtagttatctcaaagacaaagagactcaaaatgaaaatgaaaaaagtcagttacccttcccactgcccatgttcttcctccacatataaaaataggtattaagttcaccctttctggtattaaggactagagtctaacccaataactctgaatctgagtgtgcagatgttaccagatttttcattacagaaaatgacagagacgttcttccactacagtagctattttgtggtgacaacttttactttcccaggattcctcggttaagtgacacacacgggcaactggaagtatttactgttttcacccacagcttccacacttcacagatgtgcaggagcttcagtacagcagttcctaggaacatggataggacatgcgtgacttgttaaccacaatgcaatagcaaatatatggggttcggtgttggtctttcattcggaatatacagttcagaattgtttaaaatagtacatttagaaacaaataatatatcctgctgaactggttaaattggattgtatatctttacaatggaattttatgcagcattcttttaaaattatactttaatttctagggtacatgtgcacaacgtgcaggtttgttacatatgcatacatgcgccatattggtgtgctgcactcattaactcgacatttacattaggtatatctcctaatgctatccctcccctctcccgccagcccacgacaggcccccggtggtgatgttccccttcctgtgttcaagtgttcttattgttcaattcccacctatgagtgagaacatgcggtgtttggttttttgtccttgggatagtttgctgagaatgatggtttccagtttcatccatgtccctacaaaggacatgaactcatccttttttatggctgttatacagcatttttttaatgcaaaaaagtacggttgatcccttgctactggcatggaatattaccaaaatatattgttaatgagaaagaggaatgctgtaggccactgtagtaatctgctcaggctgctataacaaaataccacaaatgagtagccgaaacaacagaaatttctttctcccagtcgaggaaacatcagctcttctcctccatactcacactcacacttccggccaccaaatacgggagggtgctttcttacaggaactgattccagctgcgtatcctacaattcaattcgattgtgacactaactggagtgaatgcagaccccacaggttaagggctccgtcccacaagactatcagtatcaagaagcagatcattatctgtgcttttgaccaatgaactatagtttggaggatcccgtgacttcctcctcagtttgatcatttgctagaatggctcacagagcccagggaaacactttacttaggtttacacatctatcataaaggtatactaaatgtacacacagggagataatggggcaaggcttggaagggtcctaagtgcagaatcttctgtccctgtggagttggggtgtgccaccctcccagcacagggatatgttcttgtgtactgtattgatctgttgtaacactgctataaagaactacctagggctgggcatggtgctcatgcctgtaatcccggcacattgggaggctgaggtggacaattcataaggttagaagttcaagcccagccttgccaacatggtgaaaccctgtctctattaaaaatacaaaattagctgggagtggtggcacacacctgtaatcccagttacttgggggtgctgaggcaggagaatcacttgaacccaggaggcagaggttgcagtgagccaagatcatgtcattgcactccagcctgggcaaaaagagcataactccatctcaaagaaaaaatagaaaactacttgagacgaaataatttatgaagaaagaagtttaattgactcacagttctgcaggctgcacaggaagcatggctggggggcctcaggaaacttataatcatggcagaagggtgatgggaaagcaagcacaccttcacatagcagcaggagagagtgaagggggaagagctatacacttttaaacaatgagatctcatgagaactcactcactataacaagaaattgtatagtagggggaaatctgcccccatgatgcaattacctcccaccagttccctcccccaacattagtaattacaatttgacatgagatttgggtggggacacagagccaaaccatatcattcaccaaatccggaaacttaccaaagtctctctctctccttttggggtttatggaggtgtcattacgttggcatgactgatgaaattattcgccactgctgatcaatttaaccttcaatcccctttccagggggttagctagggtgggaatggatgttctaaccctctaatcacttgctagagtctgctggcaaccagcccccatcctaatgctacgcaggtgccactcgtctcattaacgtacttcatgaggcacttattcagaaattagacacttattcagaaattttaagagttttaggggctctgagtcaggaaacaggcaggaacattaaatatatgctttatatttttttagagatgggatttcactcggtcacccaggccagagtgcagtggtgccatcataggtcactttagcccccacctcctgggttcaagccatccttccgcctcagtcttccaagtagctgggattataggctgcagccaccatgcccagcagttgcatttctcattataaatcacaatatcacaatcacagctctggacactgggaagttcaagatgaaggttctggcaggttcaatttgcagtgaggtctcccttcctggcttgctgacagttgttcccccaccactgtgtcctcacataggcaaggaaggagtaagctctctggtgtgtctcttgtttttttgtttgtttgttttttgttttttgttttgttttgtagagatggcatcttgctatattgctgtattaggctgctctttcattgcaatgaaaaaattcctgagattgggtaacttataaagaaaagaagtttaattggctcatggctctgtacgatgctcaggaagtatagccctggtatcagcttctaggaaggcctcaggaagcttataatcgtcgcagaagatgaagcagcaacaggcacttcatatggggaaagcaagagcaagagagagttggaagtcgtagggggaggtatcacaacttttaaatgaccagtctcagaagaactcactcattttctccaggacagcaccaaggatttggtgctaaaccattcatgagaagtttgcccctgtattagttctttctcacattgttacaaagaaacacctgaaaccgggtaatttataaagaaaagaggttaaattagctctcagttctgcagaatttacagaaagcatagcagtttttgcttctggggaggcttcaggaagcttccaatcatggtggaaggcacagggggaacaggggtctgacatggcaggtgctggggcaagagagcaagggggaatgtaccacaatttgaacaaccagatctcacgagaactcactcactatcaggagaacagcaccaagggaatggcgctgattcacgagaaatccagccccaagatccaatcacttcccaccaagcctgcctccaacactgggaattatattccaatatcacatatggatggggcaaatatccaaactgtcccagttgcccacaatgatcttgagctcttggcctcaagtgatcttcctgcctcaggtgcccaaagtgctgggataacaagtgagagtcaccaacccagctggtggtgtctctttttataaggatactaatcctcttgaatcaaggctccacctttatgacatcatttaacattaagtttatccttataggccctccctccaaatacagtgacactgggggttaggacttcaatatatgaatttttaagggacataattcagtccacagtaaacactatatatagcatattactgtctgacagggaaaaaagaggaattaacacagaaatctatgaaaatgagaaaaagccttatacgtattattcatatatgcttagactcagcatatgcattatagaaagggtactaaaaaactgaataattattcttcctagaatacaaatctagcttccataaagaaaggtaaatgaagacatccttttcactagataccatttttaattattgaatttacattttcaccatatgaatgtatatgcattctatatatgcacttacatatgtatgcacgtacttatgtgcatatatctatatatgtagagatgtatacatttgttaaccacagactccctactactagaacattcaaacaaaggagatgtaatcaagtaaaactaaaagaaccataacaaggcagcactggatgacctggaaggctgagggtcactcagctcgccacccctcaccccccagctgggaatcagagagtgatggagctatccctcactccacctcctgctctcttccttctgcagtccagccacctggtcacagagtgaggctctaaactggcccgtattacatgtgtctgtccctccccttctcactttggaggaagagtgtgactatcccaagtcagcacgtagagtgagacagagcgtgagacctgctagctgaggaaccgtaagaaccttgtgctttgaaagccgatctgctttgtgatattgaaatcctccgagtccattctctcattattacaggaaaggtgtgtaaaatatccaggtcatgtcactacaggacaaaagctctggatgttcagccataatcaaagctcttgagatccagcaatttccttgaacaatttttctaccacacacacttctcaaaatatagtgcatacccatatttaggattgtggtagagggccattacatgatcttgactgtatcaataaaagtctcagggcaaaactctgggggattcatgcagatggcctaccatttggatgtggaatctgagcaaatcatcctaacattctgctacccatctccaaaaatgggcttcaataaaatggctatctcagacactttgcaatctatgagtctgcaatgaagaatgaatgtgtgtgtgtgtgtgtgtgtgtgtgtgtgtgtgtgtgtgtgttttaaagaggcatatatgtggtttacttggtttatgtatatgagttacttgattacttataagggagtattctgaataatggattaattgaataaatgaaatataattacaccatgtacaaaactttacatagttttttctgcttgatcattattcctgtaagtctccatagtaatatctaattgtatttttagtgaagaagctattttggtctgaccttcaaaactgtctttgcatttgggtaggacaaaagactagcaaaaaaaagcctgagggattatcttaagtattcttaggatttagtgttcttcagactatctgggttagctgacttgtgaaaaaactaatagttcactcctcagtatttctggaacaggaaggatttttcctcatgcccccaactgcctctagccaaataaaaaagcaagaggacaaaattctttaaatattaaaaggaagttatgggtaagcagtgacatatagagacatatagagacatatagatgagcacgtagttcatcaattttgtctccctgggatattcataattaatccctaatgactaatagccaatcttctataataataaactatataatcaaatattatacacaaattcattcataatgttctctgccagcatgtaagtggcacacctaaaaaacttcaaacattaagtattttccatttggatcacatgggggaagttttgcactatggattcgtgagctccattccagatatactcacacagaatgtctgcacatggagctcaggattctgcatttccaatcacatcctcaagtagttttccaacaacctatctccagcccaactttgagatccatttgttaccaaacattgacttcagaagccttcatgtgcatcggaagtaatcttggcgtagggaaattccgaagcacaggaggcagcgataccatttgcattattcctgagatgattctagctacatacacctattatccagcatttatgtcttgatttgaggcttctattcagttgaccctattgatatccaagtgtacacaactgacctgtcaggctatagcaacactcttcacttatatgtagggagaatttgtacagggcttaactgaagctcatcatggggtatgaattgacttggtctcattgctgtaacccttgggttcagaagacactgagcaaatgcttaaaaaactcttttgggttaatacatgaagagatattaactcctcagatagccaaagaatcaaggggaaggggtaaaagaggatggccatatagaagtatccattgatttcacccccacacataccagcagaaacaccacatttaacaactatctacacacaaaaaaggacctacataggaaataaaaatcaggtcaaccatcattgtacctgattttaacttcgtatcactgaaaaaggcactgaagagatgaggaaagacaattttgaatcactgaggccaccactcccccatgtcccagtagctgccactggagctgagacagaaactcagtgcatgggggagggagagtgcagcaattgtgaaaatctgcattgaactcagtgctgccctgtcagagcccacccacagagggagcattcagaccaaccttagccagaggggaatcaatcgcctatccaagcagtcagtatgtgagtttgggaaagccttgccaaagcaggctaaagtgctctggggtcctaaatgcatttgaaactcaatctaggccacaagaactacaactacaaggcaagtcccagtgctgtgctgggctcagagccagtggacttggacaccactagtgtgacacttgtcagggcagctaagggagtgcttgcacaaccactcctccaaccccaggcagcacagctcacagcagtgaaagtgactgcttccttctgcttgaggaaaggagaggaaagagtaactaggacattgtcttacatcgtaaatgtcagttcagccacaataggatagggcaccagtcagagtcatgaagccaccattccaggcactcgctcctgaaggacatttctagacacaccctgcaccagaagaaaacccactgcctagaaggaaaggacccagtcctgccaggattcatcacctgctgactgaagaaccctcaggccctaaataaccagcagcaatacctagtagtacactccatgggccttgggtgagactctgagatatgctggcttcaggagagacccaccatattcacagctgtggtagtcatgaagagagaatccttctgcttgagaaaagcagagggaaaataaaggggactctgtcttgcagcttagacagcagcttagctacagcggggtagagcaccaagccagctcttggagtccccagttccagatcttggcttttggttggcatttctggacatgccctgggtcagaggggagcctactgccctgaagggtgagtcccaggccaggcagcattcaccacaagctggctaaagaactctggggccttatgggaacactggcatcatcctgtcagtattccccttgagcctgcggtggaggtagctgcagggagaggctcctctgcctgtggaagagtaagggaagagtggaaggactccagctcagccacagtaaaacagaacaccatgtaaacctcccaggttgtttacttcagtccctggctctcagacagtacctctggacatgcctgggcctagaggaactcatcaccctgaagggaaggacacaagcctggctggtattgccacctgctctagggccttgtagagctctagggccttgagtgaggccctcacttccaagaaagaaataaactcttttccactgcagctaaactgtaaagctcataacacaagtagatcctctgtgcatattcacttcctttccttcttacgcaaggtgctacagtgtgaatctgaatgtggcaagttcaacactaaagtcctggagtgcaggaaagttatggtagactcagaaatctgttcttcaacatttagactgtatttatgatggctgaattttctgtctagtcacctatggtcctctacctgggcgacagagtgaggctccgtctcaaaaaaaaaaaatagtttagcatgccaaagtaccatcctttggagtatagtgtgctgagccccaacaaaagccatgagattagatatgatcatgaagagagtgcatgagtccatagaaaagaaagaatagctaacccctaggaacctccaccatcaagatgctggagagaaaggggaagaattaatgaagcagactgagaacatgagtccagggacttagaagaaatgatcaggaaagggtggggtgttgtaactcagcacacatccttgacaagactgtctgccttgagggcaccaggcctgatctcaccagacttttcattctgtttctgtcacaagaagatcattctcaggtcagcttcatcaaggagcagggagaaatcaactctgtcaaatgctgctgagcatggaaagttaacactgtcaggggagaaatgtcttactccaagtgcaaaccttccctcatgaccactgctgatggggtggaagagtctgggcaattcattgaagaggtatccaaatttctgggtctaaggaaagacaatcttaccaggaggtgaacaggaagagggtccacatgtgagtcacgttttcatctcagtggagggaataaggcaaaggagagtagggtttctgtgtctcaatgcccggagatattgttctccttttaaccatatcccagacctcagtacttctcacatttgtctccatctctctttgctcctgtaaggacccatctgagcaactcacttcaccacatcatccttcattcatctccatatcactctcttttcttttctttttcttttcttttcttttcttttcttttttttttttttttttttttttttttttttttgagactgagtcttgtcttctcacccaggctggagtgcactgacgtgatctcggctcactgcaacctccacttcccagattcaagcgattctcatgtctcagtctcctgagtagctgggattatagttgccccacatcatgcccagctaatttttgtagagacagggtttcaatatgttggccaggctggtctcgaactcttgacttcgagtgatccacctatctcggcctcccaaagtgctgagattacaggcgtgagccaccatgcctggccgcaaaaagatattttctaacattcagttctatcaatttgtttagtgtgcttaacagatgactctaccattactcttcctcagctggaaagtgaggggtgtggtataaatgtctttaggagtgccttacagctcagactatttagaaatctgatactctggagcataggtatgggtgtatgcctgtgtgtgtgtttgtgtgtgtgagtgtgtgtgtgtgtgtgtgtgtgtgtgtgtaggaaaagatgtaaaggaaatttggttgacatctgtgcatcatctgtctatgtaaatctgattttcctaaatcattattaatttaggcagaaaaaagcataattctctgaaacaaaattattatatacaattacatcattatttttaaactatgcaaaaaaacatgcctataatcgattttattgtagagaagatgtgaggtcttgttatttagaactgttatttaatggagcaagataaaacactagcacaaagactatgtgataatttcaagcccctgagagctagattagaggactaattttgtgttcagtttcatgtagagctataaattaaacaattctaccttgaaaaatattttcacagaagaataaaggatccaaggacagtaggaaaaaaatgaagctcaaggtgaatgatttggctaaattcatcaaattctgtacaaaaaagagactaaatcatgcaggaactatatttttatcatgaaaatgctctaattatttgctaagacagttcctcaaatttagcaccaaattgatggaaaatataatttttatgataatctatttccctttgttctgacttcacaagtaaatgcaagatgttaaaaggtgatttattctatctcagattgggaagggtccctgagaaacagcggtcctatcaaaatgacttgtccacctaagcagcacttggtcaaaaagagataaaaccctgagttctatttcttatgccttcactttgaggagtaaggaaaagaaacaagcatactgtcttattgtaaataccacagagaggatagtgcagtaatggatactacattaacaccttgatgcataagactgatcatccttatcaagatttctttttctttttgcaatgttttatgctacatattttgttatttcatacacacacacacacaaattaccacattaaatttctcctacaaaccaatgtatgtgttgttgttttttacagattataaaacagaggcatagagaggacgaataaccgtgcaacttttttttatttgtttgttttttttaagagacagagtgttgctctgtctcccaggctggagggcaggggaatgatatcagctcactgcagcctctgactcctgggttcaagagatcctcctacctcagcctcctgagtagctgggattacaggtgcaagtcaccatgcctgactaatttttgtgtttttggtagagatggggtttcatcatgttgggcaggctggtttcgaggtactcgcctgaagtgatccctctgtctaggcctcccaaagtgctgggattacaggcttgagccaccacgcttggccctggactactgttatagtaagagtgtcaaatagaaaaagtcagagctggtatctggacaagactatacaaaatctacacctgacatcactgtgacacaaaacttatataataactgcatttacagagacactaacctatataataattcatttcctataagccctgaaatctcagcaaatgcatctatgtgctcaaaatgcaatgaggatgaagagaggttgattaatgagtataaatataagaagtgatataagaaataagacctggggtttgatagaacaggaggatggctatagttaatgataatctactgtacacttcaaaatagcttgaagaccaaaattcgaatgtttctaaagtaaagaaaagtcaaatatttaaggtaatggatatcccaatttccctgatataatctttacacattatatgactgtattaaattatcacatgtaccctgaaaatatgtacctctcttatgtatcaataaaaagaaataaggccaggggcagtggctcatgcctggctgaggtgtgcggatcatcagaggtcaggagttcaagaccagcctggtcaacatggtgaaaccctgtctttactaaaaatacaaaaattagctgggcatggtgacgtgcacctgtaatcccagctactcgggaggctgaggaaggagaattgcttgagcctgggaggtggaggttgcagtgagctgagatctcaccactgcactccagcctgggtgagactccatctcaaagaaaaaaagaaggaaagaaataagaaagaaagaaagaaagaaagaaagaaagaaagaaagaaagaaagaaagaaagaagggagggatggagggagggagggtagggtaggggaggggaggggtgtggagaggagaggagaagagaagagaagagaaatattctaaaaacatgcagtggtacatgaacgcaactttccaatttattcggaaacacactttatttcatctcttctaagacacacctctccataattccatctgagctctatttccatttcttccctttccagagagggagaggactttatagttgaggagaaagaagaaagccttagttctttcctctttcatgccagaaacttgatcaaagatgtcagatctacttattcaatggctttcagaggagacatgcaggaggccccacgcaagaaggaaggcctagggccacctttctgaggttcaagagaccaggaagagctcagtacaccaaatatctttagaacttaggtaagttaaatattacttcatttgctacaatttaattaacctgcaccatattattatggaaatcttgtgttacttttaaaggcaaaaatctcaattacttttgcaccaacctaataaatagtgtgcattgtctttcccatagataaccactgctgcattagggaaatctgtgtgcaggaaggtattgatggtgtggtacctccctgtcagcaggttaagagcaaatattgcaagggtaccctggggctgaagaaattgcaagcattgaacactatatttttgcacataaatgctatgcaaaaaagacattgatcaatgcagtgtactcaacagtggtttttaccataaatgcagaattctttgtctgggacaatattttaaaatgttcatcagtttcccaaaaaaagacttaatactgggacataattccaactattcctctcagtggaagtgtggatcaggtctgaaaatgtgtcattaaattaggctgcaagacaacttatactaataaaataaagagcccaggtgtgttaaagacaaaatcgtgggggccgaataggaacagctccggtctgcagctcccagcgtaagcgacacagaagatgggcgatttctgcattaccatctgaggtaccgggttcatctcactagggagtgccagacagtggggacaggacagtgggtgcagtgcccagtgcgcaagccgaagcaaggcgatgcattgcctcactagggaagtgcaaggggtcagggagttccctttcctggtcaaggaaaggggtgacagacggcacctggaaaatcgggtcactcccacccaaatactgtgcttttccgaagggcttaggaaatggcgcaccaggagattatatcctgcacacggctcggagggtcctacgtgcccacagagtctcgatgattgctagcacagcagtctgagatcaaactgcaaggcagcagcgaggctggggcactggcgcccgccattgcccaggcttgcttaggtaaacaaagcagccaggaagctcgaactgggtggagcccaccacaggtcaaggaggcctgcctgcctctgtaggctccacctctgggggcaaggcacagacaaacaaaaagacagcggtaacctctgcagacttaaatgtccccgtctgacagctttgaagagagcagtggttctcccagcacacagctggagatctgagaacgggcagactgcctcctcaagtgggtccctgactcctgacccctgagcagcctaactgggaggcaccccccagtaggggcagactgacacctcacatggccgggtactcctctgagacaaaacttccagaggaatgatcatacagcagcattcgcggttcatgaaaatctgctgttctgcagacaccactgctgatacccaggaaaacagggtctggaggggacctctagcaaactccaacagacctgcagctgagggtcctgtctgttagaaggaaaactaacaaacagaaaggacatccacaccaaaaacccatctgtacgtcaccattatcaaagaccaaaagtagataaaacgaaaaagatggggaaaaaacagagcagaaaaactggaaactctaaaaagcagagcgcctctcctcctccaaaggaatgcagttcctcaccagcaatggaacaaagctggacggagaatgacattgacgagttgagagaagaagtcttcagatgatcaaactactccgagctacaggaggaaatacaaaccaaaggcaaagaagttgaaaactttgaaaaaaatttagatgaatgtatagctagaataaccaatacagagaagtgcttaaaggagctgatggagctgaaagccaaggctcgagaactacgtgaagaatgcagaagcctcaggagccgaagcaatcaactggaagaaagggtatcagtgatggaagatgaaatgaatgaaatgaagtgagaagggaagtttagagaaaaaagaataaaaagaaatgaacaaagcctccaagaaatatgggactatgtgaaaagaccaaatctacgtctgattggtgtatctgaaagtgacggggagaatgcaaccaagttggaaaacactctgcaggatattatccaggagaacttccccaatctagcaaggcaggccaacattcagattcaggaaatacagagaacaccacaaagatactgctcgagaagagcaactccaagacacataattgtcagattcaccaaagttgaaatgaaggaaaaaatgttaagggcagctagagagaaaggtcgggttacccacaaagggaagcccatcagactaacagcggatctctcagcagaaactctacaagccagaagagagtgggggccaatattcaacattcttaaagaaaaaaattttcaacccagaatttcatatccagccaaactaaacttcataagtgaaggagaaataaaatactttacggacaagtaaatgctgagagattttgtcaccaccagacctgccctaaatgagctcctgaaggaagcactaaacatggaaaggcacaaccggtaccagccactgcaaaatcatgccaaaatgtaaagaccatcgagactaggaagaaactacatcaactaatgagcaaaattaccagctaacatcataatgacaggatcaaattcacacataacaatattaactttaaatgtcaatggactaaatgctccaattaaaagatgcagactggcaaattggataaagagtcaagacccatcagtgtgctgtattcaggaaacccatctcatgtgcacacacacacataagctcaaaataaaaggatggaggaagatctaccaagccaacggaaaacaaaaaaaggaaggggttgcaatcctagtctctgataaaacagactttaaaccaacaaagatcaaaagagacaaagaaggccattacataatgggaaaaggatcaattcaacaagaagagctaactatcctaaatatatatgcacccaatacaggagcacccagattcataaagcaagtcctgagtgacctacaaagagacttagactcccacacaataataatgggagactttaacacaccactgtcaacactagacagatcaacgagacagaaagttaacaatgatacccaggaattgaactcagctctgcaccaagtggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactgtctctcagaccacagtgcaatcaaactagaactcaggattcagaaattcactcaaaactgctcaactacatggaaactgaacaacctgctcctgaatgactactgggtacataacgaaatgaaggcagaaataaagatgttctttgaaaccaatgagaacaaagacacaacacaccagaatctctgggacacattcaaagcagtgtgtagagggaaattgatagcactaaatgcccacaagaaaaagcaggaaagatccaaaattgacaccctaacatcacaattaaaagaactagaaaagcaagagcaaacacattcaaaagctagcagaaggcaagaaataactaaaatcagcagaattgaaggaaattctgacagaaaaaacccttcaaaaaattaatgaatccaggagctggttttttgaaaggatcaacaaaatagatagaccactagcaagactaataaagaaaaaaaaaagagaatcaaatagacgcaataaaaaatgataaaggggatatcaccaccaatcccacagaaatacaaactaccatcagagaatactacaaacacctctacgcaaataaactagaaaatctagaagaaatggataaattcctcgacacatacactctcccaagactaaaccaggaaaaagttgaatctctgaatagaccaataacaggttctgaaattgtggcaataatcaatagcttaccaaccaaaaagagtccaggaccagatggattcacagccgaattctaccagaggtacaaggaggaactggtacaattccttctgaaactattccaatcaacagaaaaagagggaatcctccctaactcattttatgaggccagcatcatcctgataccaaagccaggcagagacacaaccaaaaaagagaattttagaccaatatccttgatgaacattgatgcaaaaatcctcaataaaatactggcaaactgaatccagcagcacatcaaaaagcttatccaccatgatcaagtgggcttcatccctgggatgcaaggctggttcaatatacacaaatcaataaatgtaatccagcatataaacagaaccaaagacaaaaaccacatgattatctcaatagatgcagaaaaggcctttgacaaaattcaacaacacttcatgctaaaaattctcaataaattaggtattgatgggacgtatctcaaaataataagagctatctatgacaaacccacagccaatatcatactgaatgggcaaagactggaagcattccctttgaacactggcacaagacagggatgccctctctcaccactcctattcaacatattgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacttaggaatccaacttacaagggacgtgaaggacctcttcaaggagaactacaaactgctgctcaatgaaacaaaagaggatacaaagaaatggaagaacattccatgctcatgggtaggaagaatcaatatcgtgaaaatggccatactgcccaaggtaatttatacattcaatgccatcctcatcaagctgccaatgactttcttcacagaattggaaaaaaatactttaaagttcatatggaaccaaaaaagagcccgcatcgccaagtcaatcctaagccaaaggaacaaagctggaggcatcatgctacttgacttcaaactatactacaaggctacagtaacaaaaacagcatggtactggtaccaaaagagagatatagatcaatggaacagaacagagccctcagaaataacaccgcatatctacaactatctgatctttgacaaacctgagaaaaacaagcaacggggaaaggattccctatttaataaatggtgttgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggtcttcatgtctaaaacaccaaaagcaatggcaacaaaagccaaaattgacaaatgggatctaattaaactcaagagcttctgcacagcaaaagaaactaccatcagagtcaacaggcaacctacaaaatgggagaaaattttcgcaacctactcatctgacaaagggctaatatccagaatctacaatgaactcagacaaatttgcaagagagaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccacttagaatggcaatcattaaaaagtcaggaaacaacaggtgctggagaggatgtggagaaataggaacacttttacactgttggtgggactgttaactagttcaacccttgtggaagtcagggtggcgattcctcagggatctagaactagaaataccatttgacccagccatcccattactgggtatatacccaaaggactataaatcatgctgctataaagacacatgcacatgtatgtttattgtggcactattcacaataacaaagacttggaaccaacccaaatatccaacaatgatagactggattaagaaaacgtggcacatatacaccatggaatactatgcagccataaaaaatgatgagttcatgtcctttgtaggaacatggatgaaattggaaatcatcattctcagtaaactatcgcaaggacaaaaaaccaaacaccgcatgttctcactcatagatggaactgaacaatgagaacacatggacacaggaaggggaacatcacactctggggactgttgtggggtggggggatgggggagggatagcattaggagatatacctaatgctaaatgacgagttaatgggtgcagcacaccagcatggcacatgtatacataagtaactaacctgcacattgtgcacatgtaccctaaaacttaaagtataataataattttttaaaaaaagacaaacgatcatgctgaagttacagagaattttgtttaatgttggcttacactttatttctgcttcatataaaacatcttctcccaaaggtcataaatatcaaagtagatcatgtgtactagttctgcagataaatgaaggtagttagaaatgtacacaggaaatctatacaagggagaatcagaaaaatcttatgagcatgttctgaatacaattttagtgatcaggagcagtgtctcacacctgtaatcccatcactttgggaggccaagtggggcagatcacctgaggtcaggagtttgagaccagcctcgccaacatagtgaaaccacatctctactaacaatctgaaaattagccggatgttgtggcagatgcctgtaatcccagctactcaggatgctgaggcaggagaatcacttgaactcgggaggcagaggtggcagtgagccgagatcgtgccactgtactccagcctgggccacaagagcaagactccatatcaaagacaaacaaacaaataaaaaaaactcgcacaattttaaaggatgaatatggttgcaaattgggcaggttatggtctgagttatttcttaagacactgcaacaagtctgacgcgtcataatcacagatttctccagaagccaggaaggtgtcattactgaacagacaggatgtaagtcaggaggcagagatggagtcagagaacagccctgagctagagccccttccacagaggcagctttacccagctctaattgataccacacagcaacggagacacagtgcaccaaccaacatcatgtgatttttaaagataagacagtaatgaaaacttttagtgaactattccaatgtcaaactttatcttccaaaccaaacattataaataacactgtatatgctgaaaagaagcactgtttagccgagtacctgccctggggctgcagtctatgtcttttgcctcacactatagacacttgagtgcaagtctttctacccagtgtgcctgtcagcatcacagaggggatactctacgtatcattcacctttacattctcatcacctgcaaaaatgatctccacacaatatacatgaaaaaagaatttgcttcatgataaagctgctaatgaatgtcggccagaagaggacttcaaggcagagtactgttagctgtgcattgaatcctcacctgatgaccattgtgtccacatttacctaaggactccagtgataaaattattgcatttgtaaatgacaggaaaattggatggtatatgatatcatttaaaggtctgatttccatttactaatctagaagctagaccagagatttaacatctttttgtacctaggtcttacccctgcaattcactttccacctctgtacaattttcccacatcatcccctgtgcccagaatgctcatctcttccctaaagtccctgaaaaccacctgctttgcctttaggaccctgctgaaatgaaactttttttttttgaagtcttccttgtccctcaagcgaagtgatttccttcaccctcggcgtccccatgaaaccatgttcacacaaatgctattatctctatcatactgtaatacaattatgtgactacaattactttcctgtatatctctgaggtccaagaataagtctatgcttggtgtatgaaattgtacagttgacttctatactttcaggaatacagtgctctgtccttaaatgttcatttgtaaatacagaaccattttcttgttgatatcacaagatgaaacctaccaggaagatgaatgacaaccccagaacacactgttttgtagaaaataccataggctgaaaagatcacaggaataccgagtgctaggttggaatctttcatgacaccaaatgttcattcattctctgccagattttacaactgtcctcggtgtgtttttaggttgtgtaactttacacaaagtggaagcaataatcagggcaagacttaagagaaagtggatccaatgcaagaggagtaaagaaaaaaatccctcaaatgtatggagcagattgttttaattatctacagaatcttgtgccccaagaaattaatagctcaagtttccagcaagagtggtggatgagatggagagcatttatgtgagagagaaccaaggatattactaaaaatggaagggaagctgggttcctcctgggaaaacagatctctgtggctctatttgttctaactactatgcctgccttcatgtactttggtcatttaggggcctgccagaggacagttataaaatctgtggtcattctgccggcagcatatagttttcatccagagtccagatcccaccggcaaaactctgtctaacacaggatgacttggaattagagtccgtatagcagaaagagcagcagggctgtccttgggtatccgttgctcagccaagtcatcaaataaaaaggatgattgcgcaagtggaccatgtgtcaatctgtgggtttctgcatggccaagagccagaccctccctcctggctctgctggcccaacccaccaagggatgctttatttaaatagttccaagtaggggagaccagctgcccctgaaccccagaacaaccagctggatcaattctcataggagccacagcgcggagactgtgtaagtcaacaatccccagagttgggacaggaggggcagcgacagggcagcaactgagggagaagggagctgacgttagtgcttaggagatgtggcacactttggggacaggaaggaacaggaaatgggacccaagagtggcagcagattggcctgtggggtgagacactatggtgtgtgtcacaaccgagacagaatcggggagtagttacttctcttcttttctcacaggaaacatggttccaaaactgttcacttcccaaatttgtctgcttcttctgttggggcttctggctgtggagggctcactccatgtcaaacctccacagtttacctgggctcaggggtttgacgtccatcagtaggaaccagctccaatgcaccaatgcaatgcgggtaattaacaattatcaacggcgatggaaaaaccaaaatacttttcttcttgcaacttttgctaatgtagttaatgtttgtggtaacccaactataacctgccctcataacagaactctcaacaattgtcatcatagtggagtccaggtgcctttaatgtactgtaacctcacaactccaagtccacagaatatttcaaactgcaggtatgcgcagacaccagcaaacatgttctatatagttgcatgtgacaacagggatcaacgacgggaccctccacagtatccagtggttccagttcacctggataccatcatctaagctcctgtatcagcactcctcgtcatcactcatctgccaagctcctcaatcatagccaagatcccatccctccatgtactctgggtgtcagcatctgtcctcttcagtctctataccccttccacttgcctgagctgaagtgccttgtgaagcctgcaataaactgctttgcaaattcatctggaagtgtctgtgtgtcttcgtcggccactctgctgtcattgagtgacaatctactctagatatttttccttcctccaacccgagacttgtgggaaatggagagatttgaggataagagactctttctgtcatgaagcagcacagacttatccctctccctgctttaggctgagaagccgaggtctcaactgatacctaccaactgttgaagactcttcccttgaccaaatttagtcatctcccctggcctcttcacaagtaggtcattctgttgggtttcctagtccttccttgtagagtcaggtttgtatttatatttacatttatatttatatttatatttatatttattcattttttgagagagagtctcgctctatcacccaggctggagtgcagtggcacaatctcggctcattgcaaactgtgcctcccaggttcaagcgattctcctgcctcagcttcctcagtagctggggttacagtcatgcaccaccatgcctggccaatttttgcaatgttagtagagatggggtttcaccatgttggccaggctagtcttgaactcctgacctcaggcaatccgcctgcctcagcctcccaaagtgctaggattataggcgtgagccaccagtgcccaacctagggtcaggtttaacagaagtcttcctaacctggtttatcattaatattcaccctcaatatctgaccaaattccttaattcccccatcatcctccttgtgatacctgattcctggcctgccttcaaaaaaaaagaaaatccagttgagtcgacttagcattggtctccctagcctcgatggttcttctaggtaattttgcatccagtgacccctccccccacaccaacttataacttcagtatacctctccacttgttttagctgtattccagaattttgctcaatttggtgctgaggtcccatttgacactttatggtctaagtctggtttttattgacatgatttctatcctaagagatatagaggctgcagggaataaggtgaaaatgtacatgtttgattatgatttatgaatgataaattttgatagaattgaacattgagatagaaaacacacaaaaaaagaaagtagaaaaagccaagaatgctataaatatggtgaaaccaagataaaaagtttagcctcagacctatttcctttaaatgggcacatcaaatctccagctattagcaatcgtactagaggtggatccacggtttgagtcaaatatggaatgagataaattgttcagacagcaatatggacagattgtaataaatattgcctgaaggagaggtgcgcatcattcccaaaacttccatgtcctggagatagggagtagctggtcacctgggaaggggaaggggaacgagggagactggggagtgggatcactcatgaaggtgaattggctcctgcccgttctgccctccacagttgtccccaaaggtgagtcaaagggttcattcaacacctgtcaggtagggcacagcctcaagaattagggatttgtagacccagagagagaagaaatggataatgagagcccttgccctggactccattacagggcttcactcaggaatccatgagaaacaggaaggggaagccctttcttgcaagctgtggacaggtgcagcattcaagtgattgtgccggggacagagtgggtctttttgaatggcctgactcttggccatacaacagagatacaatgccatcagatctgcaccttggtccttcagtctgagagttctgacttctatatttctgctcctcttccagaccctcagaaatagcaatttccattcctcagatgactccatgtcagtaatagtagctctcattggcatcagacagcagcagtattgaagtctctcctctggagaagctattgagatcttgcttctccaagggtgtggcagggctgtgaactttaaagtttgcacagggacacagatttcacgaaatcctggtgctcaatagaatccactgactctaggtaaaatagggcatattaggaagtgagtgcagtcttcccacaacctccaagtagcagaaggagaaggtgggactctgaaagctggagccacgtttcctgtgaagagagatggaatggaccttcctcacttcaggtaccagatcacaggtgtcttctcagtcagggatgccccgtctctaaaaccataggatagagggatcagtccccacctgcccccatgccctctccaccttgtgacttcatctcctctcctgtcattcatccttcactcattcattcatccagcagacatctactgagtagataccttgctccaggcacagtttgagggagtgatgacgcaacgcaaaccaagacaggtcactgctcttttggggccacattatacaaggataaaaataaacatacaaaattgttctaagcatacaaaattttgctaagtgtcaggaggaaaaatacacagcctagtaagcagaaaactacacagagcgacacaatatagaggttctgtatgtgcctcagaagtgacagagcaaagtgtgaccaggaaagacccatttcagagaatgaaatctaaacaggaggaaaagcagccagtcatacagacaccagatggaaaatcatcccagcaaagagaaggagacttcaaaattcctcacaaatatcaaggctataagtagacttcagttcagtgcttacaataagttaattaaaacatctgcaagaaaatgactacaactatttgcatctttgtatgtatttattccttaatgtaataaaacattttcatttttaaaaaatggtcctgaatgaatagaggtttggcatgttagaagcacaaaagttgtttggtcaggacaagatcatcatagccatgagtattaatgataggagttaatgaggttcagacccttcatgcttgtgaagatagaagaataaagtaagttcctcatggggcacaaattgagcatgttacatgcaagaataacgttgcctaaagatctgtccagcctctgtgcagaacacaactatttaggagacaagagtggaagcaaggtcccagtgaaggaccacaggttgaggcagagggaaacaagagtcttccaatctcagtgaatctcaccatcatcctctcatgctgcagccccatgctattcccctccctgttgccatggcctctctccagcccctccatgccttccacatcatcttcctgccatccccatgctgatgactgggctgaggtcagaggcagctcccctctcccaggacgtgagacgattcaaacaagaccaaggaggattctgtgcttgaccatcaggaaaccctggctggactcactgccccttctgcagtagacatccaagattttctgattgccctggacccaaggccagcaccacagagactaccattagagaagttaagtagtcacgtcagcatgttccaaagacgtgatccttggattccacttcttttccttgaacctcccatgtctgattttataaaattctcttcatatcaaatcttcaggaagtcttgcaggagtaaatgcagttaattgttctataagcaggcagggagggtctccagggattataagaatttaaccaacttgagcaatcagcctgttttacaagcttgctggtgggaaccagctcctggcataacccagcaacttacagacaaattaggatgaacattcctcattaccatgctaaagtctccacccaaggaggagctatagcctcattaccatgacatgtgaactatgtgctggcagaatcactcactgtgtatgggcaactgggactcctcctctacaagtgatgatacaccctctgccctctccatcaccacatagaatgttcttctcactttccatcaggaagacactgctttggagaatactcccagtggccttcttacttgaaccaagtaacaaaacttttatttatcaaaatgtacgttctcatagagagtctttgttactcaccagggaaacaagccctagttttttcagctaccagctctaacacattctgtaaagtccagcacagaaggaaggttaattcacaatgctattgctttcactttttaataattgggaacatatcagggcagatgtctttatgtagggttaaatggaaggtcaaggaggcaaatcatcaaccttggggagacacacttgcagagattatgactacacttgggattcaagaatatgagaccccaccagcagagtagcctgcaatgttcaaggatatccaagtagatcaagtattttaatgaaaaaacaacaggctttgtctttcaagatgtccatgaattgactttccagaagagaaggaagaagacctcattgtcagggcagaagagagaagaggagagggatctaggctaaatattgtaatcgattttgcctgatattgactttttgtttgtttcttagttcattttattttattttattttatttttttgccaagactggagtgcagtggtgcagttttggctcactgcagcctctgcctcccaggttcaagcgattctcctgcctcaacctccagagcaatttttgtattactagtagagacagggtttcgccatgttggccaggttggtctacaaactcctgacctcaggtgatccgcccacctcagcctcccaaagggctagtattatagacatgagccatcgcgcccagcctcttagttcatttttagagatgaagtctccctatgttgctcaggctggacttgaagttctagactaaagcaatgctctcgccttagtcttgccagttgttgagactataaatacacaccactgagcacagctgatactcacattttatgagctgtttccactccaattacataagggagtgaggcaattagtaaggataggagcatagaaactctgtctacatctctatttcaaattacctctgaaaaacagccttgtttttaaactaaaacttgattttggttaataaatgtttgtcttaaaatgcacttagaattatgacagagttgtcacttttgtctcagttctgacctatagtgatttcaaaagaagatcagtagactacttcaaaattctcattattcaaagttattttggatgtaaaattggctgatgtgagataatttagaatatagggccagccaggttacccaaatgaatatctgggaaactgagcacattacatgcttatcacacatccccactgagttagaaaatatgactgtattagtcaggatcatcaagagaaacataaaagatttaggtagacacagatagatagaaatatagatacagaaggatttatcatgagaaactcgctcacgcaattatggagtctgtgaagttccataatctgccctctgcaagctggcagacccaggaaagctggtgggataatttggttcgagtcccgatgcccaaaaaccatggaagctgatgatgtaaatgtcaacccaactacaggaagatgacataagatgtcctagcttaagaagtgaggcaagaaaaagtgatgaattccgcctttctctacttttcaatctattctggccgtcaacagattggatgagccccatccacactggaaatgcaacctactttacttaatcaaccaattcaactgctagtcttacagaaataccctcagagacacagccagaaataatgttaatctgggcacccacaggcccaggcaacttgaaatataaaactcaacatcatgatgacctatggtttcccaggtgcaccagaagatgttaccaaaatggcaccatcagccagaacccacatacattcaccaggtcagtgcatctctcagttcaccagagattcattttctttgtgacatcacgttcacctggagtgcagccaagaatcaggccacagctaataatgagaaaggaaggattcttcatttgcctttttacaaatgacagaaaaatttgccaaaatcctttggtaataagtagttatctcaaagacaaagagactcaaaatgaaaatgaaaaaaagtcagttacccttcccactgcccatgttcttcctccacatataaaaataggtattaagttcaccctttctggtgttaaagattttagtctaacccaatacctgtgaatctcagtgcacagatattaccagatttttcattacacagaaaatgacagagacattctcccactacagttgctattttgtggtgacaacttttactttcccacgattctttcgttaagtgacacacacgtgcaactggaaggatttactgttttcacccacagctcccacacttcacagctatgcaggagcttcagtacagcagatcctagcaccctggatagtacaagcgtgacttcttaaccacaatgcaatagcaaatatatggggttcagtgtcggtctttcattcagaatatactgttcagaattgtttaaaatagtaaatttagaaacaaataatatatcctgcagaactggttaaaataggattgtatatctttacaagggaattttatgcagtattttttaatgcaaaaaaagtacggttaatctcttcctactggcatggaatattaccgaaatatattgttaatgagaaagaagaatggtgtaggccactgtaagaatctacccaggctgctataacaaaataccacaaatgagtattccaaaacaacagaaatttctttctcccagttgaggaaacatcagctcttctcctccatactcacactcacacttctggccaccaaatgtgggagggtgctttcttgcagcaaccgattccagctgggtatcctaaaattcaattggattgtgacactaactggagtgaatgcagaccccacaggttaagggcttggtcccacaagactgtcagtctcaagtagcagatcattatctgtgcttttgaccaatgaactatagtttggaggatcccgtgacttcctcctcagtttgatcatttgctagaatggctcacagagcccagggaaacactttacttaggtttatacatctatcattaaggatatactaaaggtacagacagggagataatggggcaaggcttggaagggtcctaagtgcaggatcttctatccctgtggaattggggtgtgccaccctcccagcacagggatatgttcttgtgtactgtattcatttgttctcacactgctataaagaactacctgacgctgggtacggtggctcatgcctgtaatcccagcacttcgggagaccaacgtgggcagatcctaaggtcaggagtttgagcccagccttgccaacatggtgaaaccctgactctactaaaaatacaaaattagctgggtgtggtggcacaggcctgtaatcccagttacttaggaggctgagggaggagaatcacttgaagccgggaggcggagtttgcagtgagcctataacatgccatttctctccagcctgggcaaaaagagtgaaactccatctcaaaataaaacaaaacaaaacaaaacaaaaaaaactacctgagactggataattgatgaagaaagaagtttaattgactcgcagttctgcagtctgcacaggaagcatggctgaggggagctcaggaaacttacaatcatcgcagagggtgaagggaaagcaagcacatcttcacatagcagcaggaaagagtgaagggggaagtgctatacacttttaaataaccggatctcgtaagaacttactcactatcacgagaacagcaagggggaaatccgcccccatgatccaattacctcccaccaggtacctcccccaacattagtaattacaatttgacatgagatttgggtggggacacagagccaaaccatatcattcaccaaatccagaaacttaccaaagtctctctctctcctcttggggtttatggaggtgtcactacgttggcatgactgatgaaattattcgccactgctgatcaactcaaccttcaatcccccttccagggggttagctggggtagcaatggatgttttaaccctctaatcacttgctcagctctgctagcaaccagacccctcctgagactacacaggtgccactcgtctcattaatgtacttcattagacacttattcagaaattttaagagttttaggggctctgagtcaggaaacaggcaggaacattaaatatatgctatatatttttttagagatgggatttcactcggtcacccaggccggagtgcagtggtgccatcatagctcactgtacccccacctccggggttcaaggcatccttctgcctcagtcttccaagtagctgggaatataggctgtagccaccatgcccagaagttgcatttctcattataaatcacaatatcacaatcacagctctggacactgggaagttcaagatgaaggatctggcaggttcagtttgcagtgaggtctcccttcctggcttgctgacagttgttcccccaccactgtgtcctcagatagtggaggaagaagtaagctctctggtgtgtctcttgtttttttgtttgtttgttttttgttttttgttttgttttgtagagatggcatcttgctatattgctgtattaggctgttctttcattgctatgaaataattcctgagattgggtaacttataaagaaaagaagtttaattggctcatggttctgtacgatgctcaggaagtatagccctggtatcagcttctaggaaggcctcaggaagcttataatcgtggcagaagatgaagcgggaacaggcacttcacatggggaaagcaagagcaagagagagttggaagtcgtagggggaggtatcacaacttttaaatgaccagtctcagaagaactcactcattttctccaggacagcaccaaggatttggtgctaaaccattcatgagaagtttgcccctgtattagttctttctcacattgttacaaagaaacacctgaaaccgggtaatttataaagaaaggaggttaatctagctctcagttctgcaggctttacagaaagcatagcagttcctgcttctggggaggcctcaggaagcttccaatcatggtggaaggcacagggggaacaggggtctgacatggcaggtgctggggcaagagggcaagggggaatgtaccacaatttgaacaaccagatctcacgagaactcactcactatcaggagaacagcaccaagggaatggcgctgattcacgagaaatccagccccaagatccaatcacttcccaccaagcctgcctccaacactggggattatattccaatatcacatatggatggggcaaatatccaaactgtcccagttgcccacaatgatcttgagctcttggcctcaagcgatcttcctgcctcaggtgcccaaagtgctgggataacaagtgagagtcaccaacccagctggtggtgtctctttttataaggatactaatcctcttgaatcaaggctccacctttatgatgtcatttaacattaagtttatccttataggctctccctccaaatacagtgagactgggggttaggactacaatatatgaatttttaagggacataattcagtccacagcaaacactattattttagtttttaaatagagcatgttactgaggggggacatagaggaattatacgaagaaatctgtataaatgaggaaaagtgagtatgcttatatgtactaccacatatatgcttagattcagtatatatattatagaaagagtactaaaaaactgaataattattcttcctggaatacaaacctagcctcgataaacaaaggtaaatgaagacatctttttcactagatacccttttttaataattgagtttacattttcaccatatgaatgtatatgcattctacatatgcatatgcacttatgtgcatatatctatattcgtaaagatgcatatatttgttaaccacagactccctactattacaacattcaaacaaaggagaagcaatcaagtaaaactaaaagaaccataataaggcagcactggatgacctggaaggctgagggtccctgagcccaacacccatcaccctacagctgggaatcagacagtgatggagctatccctcactccatctcctgctctcttccttctccagtccagccacctggtcacagagtgaggctctaaactggcccgtattacatgtgtctgtccctccccttctcacctcggaggaagagtgtgactatcccaagtcagcaggtagagtaagacagagcgtgagacctgctagctgaggagctctaagaaccttgtgctttgaaagccgatctgctttgtggtattgaaatcctctgagtccattacctctttattacaggaaaggtgtgtgaaagacccaggacgtgtcactacaggacaaaagatctggatgttcaaccacaatcaaagctcttgagatccagcaatttccttgaacaatttttctaccacacacacttctcaaaatatagtgcatacccatatttaggattgtggtagagggccattacatgatcttgactgtatcaataaaagtctcagggcaaatctctgggggattcagtgcagatggcctgccagttggatgtggaatctgagcaaattatccttatattctgctactcatctccaaataacaggcttgcatcaaacggccatctatctcagacactttgcaatctatgagtctgcaataaagaatgaatgtgtctgtgtgtgtgtgtgtgtgtgtgtgtgtgtgtgtgtgtgtgttttaaagaggcatatatgtggttcacttggtttatgtatgtgagttacttgattgcttatatgggaatattctgaatacttgattaattgaataaacgaaatataattacatcatgtacaaaacttttcatagtttcatctgcttgatcattattcctgtaagactccatagtaatatctaattgtatttttagtgaggaagctattttggcctgaccttcaaaactgtctttgcatttggtaggacaaaagactagcaaaaaaaagcctgaggggttattttaagtattcttatgaattagtgttcctcagactgtctgggttagctgacttgtgaaaaaactaaagggacaggatactcagtaagtatgaatgtaacagttcactcctcagtatttctggaacaggaaggatttttcctcatgcccccaactgcctctagccaaacagaaaagcaagaggacaaaattctttaaatcttaaaaggaagctatgggtaagcagtgacatatagaaactagcacataggtcatcaattttgtatcactgggatactcataatcaatccctaatgactaatgaccaattttcgataataataaactatataatcaaatattatacacaaattcattgatagtgttttctgccagcctgtaagtgccacacctgaaaaaacttcaaactttagtgtagtttccatttggatcacctgggggaagttttgcactatggatccgtgggctccattccggatatactcatacagaacgtctgcacatggagctcaggattctgcattttcaagcatttcctcaagtggttctgaaacaacctgtctccagcccaactttgagatccattttttaccaaactctggcttcagaagccttcatgtacatcggaagtaatctcagtgtggggaaattccaaagcacaggaagcgatgataccatttgcattattacccagatgattctagctacatacacctattatccagcatttatgtcttgatatgaggcttctattcagttgaccctattgatatccaagtgtacacaactgacctgtcaggctatagcaacacttcacttatatgtagggagaatttgtgcagggcttagctgaagctcatcatggggtatgaattgacttggtcttattgctataacccttgggttcagaagacactgaacaaatgcttaagaaactgttttaggttaatgaatggggatatatttaactcctcagatagccaaagaatcaagaagaagggattgagctggatggcccaatagaagtgtccattgattgcacccccacacataccagcagaaacaccacatttaacaacaactatctacacacaaaaaagcacctacataggaaatgaaaatcaagtcaacaatcatagtacctattttaacttcatatcactgaaagaggcactgaagaggttaggaaagacaattttgaatcactgaggccaccactcccccatctcccaacagccaccacatggagctgagacagaatctgagtgcatgggggagggagagtttagcaattgtggaaatctgcattgaactcagtgctgccctgtcacagcccatccacagaaggagcatttagaccaccttagccaaaggggaattgcctatcccagcggtcagacactgagtttgggaaagctttgccacagtaggctaaagtgctctggggtcctaaatatatttgaaactcaatctaggccacaagaactacaactacaaggcaagtcccagtgctgtgctgagctcagagccagtggacctagacaccactagtgtgacacttgtcagggcagctaagggagtgcttgcacaaccgctcccccaaccccaggcagcacagctcacagcaatgaaagtgactccttccttctgcttgaggaaaggagaggaaagagtaactaggactttgtcttacatcgtaaagatcagctcagccacaataggatagggcaccagtcagagtcatgaagccaccatttcaggcactcgctcctgaaggacatttctagacacaccctgcaccagaagaaaacccactgcctagaaggaaaggacctagtccttccaggattcatcacctgctgactgaagaaccctcaggccctaaataaccagcagcaatacccagtagcacactccatgggccttaggtgagactctgagatatgctggcttcaggtgagacccaccatacttacagctggggcagtcatgaagggacaattcttctgcttgagaaaagcagagggaaaagtaaaggggactctgtcttgcagcttagatagcagctcagctacagcggggtagagcaccaagccggctcttggatccccaattccagatcttggctcttggctggcatttctggacctgccctgggtcagaggggaatccacttccctgaagggtgagtcccaggccaggcagcattcaccacaagctgactgcagagctccggggccttaagggaacattggcagtagcctggcagtattcctcttgagcctgtgttggaggtagcagtggggagaggctcctctgcccatggaaaggtgaaggaagactggaaggactccatctcatggcttgagtgcaagctcagccacagtaaaacagaacaccacgtaaacttcccaggttttttactttggtccctggctctcagacagaacctctggacatgcctgggcctagaggacctcatgaccctgaagggaaggacacagcctggctggtattgccacctgctctaggaccttgtagagctttagggcctgaggcccttacttccaagaaaggaataactcttttctagtgagctgaactgtaaagctcataacacaagtaggtcctcagtgcatattcacttcctttccttcttacctgaggtgctgcagtgtgaatctgaaggtggcaggttcaacactaaagtgacggactgcaagaaagttatggtagactcagaaatctgttcttcaacatttagactgtatttatgctggctggattttctgtttattcacctattattctctacccctgtcagcaaccaagaaactcgcagcccatctcacgctgtcttaaagggaaccaagaagttttggactcttggcctgcaggaagcatgcagcgcggcgccccctgccggccaatacaacggccacgggaactggcagaccactgaggctctgggcggggcggagttgccccttctcctcccacttctctagcagcggcttcttctggtgacaccccgggagccacagggatttggttccctaaaggaagcggtttcccaccagggtatcgtccctaataccctccgaaggagtccattgaggagaaaggaacagaacgtctggcagaatgcagaaggaccctatgatccaggacatgtagcgccagccatcaggaggttttatgagagcagctggtgggaagatcagtcccaggagaaggggtttgtctagcagcttggttggagcaagccttttccagagaattatttccgtaattcaggctccctcccaaccctccactgccaccttatcctccaccaaaagccctgacactgtggcagggataggggacgtggggttggtggggaacaggctgtaagaaagacgcgggagcctatatgtgtctgggaaaaatgaggggtccacgtgcaagggaagaagcatttacaaagaagactttgacagtgctgcaaagatttgaaggcgcagggtgcaagtcattcaggtgccggtgtcaggaggaacctagccatccaggtgaacagatgcccccttcttgcagcccactcgcatgggcctggtggactccttcttatttttggtagtggcagtgaagaggtcgggtccctgcgctggcaaagcagtcagtgacattgacatcatgagtactgttgcggcagctgcacatggaggggctgttggtacagggcagtggtggagttctgcagaaatctgctatggtggtcagattctatgaatgaatgtgtggatctgctcgcatttacccctatagatcagccaactgcgcctcatcatcacatcacagtatcggtggtgtcctctagggacccacgacctggggttgtctatatgtcgtgttaagaagggcagggctggagtgaagacagttaggtccaaaaggaggaagaggaggagggtccatatcagattcatgtttcttgtgaaagcatttcaaagaagagcagagtcaaaagagcaagccatggtcccttgtcctgttcctaagaagtcttggcccaacacttagtgttcgcagttctcccctcctgccatttctacacttattcttcgtgtactcatggcaacaagtgttctcacatccttcttccacctccttgtcaataacggagatggctaccaccctctcaaccctttatgggattatcctatgtacaaggttatttccaaaccccaaagtgattcttgctccttacctaagcagaccagttaaactaaaaactttcatctctgaggtgtttgcatctatcagttcaactgccactcacccatagccttgagatgaggcaggcatgattgccaacccctttttagagtgacttaactcagaagggaattgacagattcatatgacctgcatcttagaaaatattttcacttccttaaatacaaatgtctgtttaaacgctgtttttaaaaatgagagcatttcaattttaagggagtagagtttatgtttcccccacatatttctctgcctcaaaataaagattcccaactcttccatgtatagagcctatcttccagaaatgttctaattcttggtgctcagggattctgggtgactgtgtgtgagccttctgtctctagctctaatatctgactctttttttaaatacctgggagttccaggaaagggttttctgcagagcagatgacatccacagagatggatatttttctctcagaggttgatactcctagtagaaatggaatccccgttgcctctctccttcctctaatcttgtagaaatttcattgtggatattttcttcccagaggttagggtgcaggccgtatggaaaactctcaggcctgtcaatgattttaaacagattcccaggtaatgctaattttatgcttactatttcacacctgaaatattcaccagcatcacacagagtgcctatgacatcactgcaaatatgcagaaacttggggtttagtgtctatcataagcttgctactggagcttggcaaatcaccttatccttctactcctcatcactaaagtgaagattatagacaaaagatctctttcagctctgacattctgtatttttctatacattactgtgtgtttgggttcatgtgtgattttgtatatatgcatattggtttatacatgttcaggttaggagaaatacttagtttgcaaattgagtttccatttcagaattgttaatttaattaagtgtagtttttccttaaagcagttattagcaaggtcaaaaaaattgaatcactattatgtaaagattacagcataatctgtttttgtctccaccattaaagttatacgggttttttggtgtttgtttatttgtttttgagactgagtctggctctgtcactcaggctgaaatccagtggcgcaatcttgactcactggaacctccgcctcccaggttcaagcagttctctgcctcagcctcccgagtagctgggattacaggcatgggccaccatgcctagctaatttttgtatttttagtagagtaggggtttcaccatctttcccaggctggtcttgaactcctgacctcatgatccaccagcctcggcttcccaaagtgctaggattacaagcatgagccaccgtgcccagccatattcatttatttatatttatttttatgtatttatttattttgagatggactttcactcttgttgcccaggctggagtgcaataatgctatctcggctcaccaccacctccgcctcccgggttcaagggattctcctgccgcaccctcccaagtagctgggattacaggcgtgtgccaccacgcccagctaattttgtatttttagtagagacagggtttctccatgttgctcaggctggtctcgaactcctgacctcaggtgatccgtccgcctcagcctcccaaagtgccgggattacaggcgtgagccactgagcccagctgaaattatatatgtttttattgaaggagaagctacttggaactccagtctgtatttcagtaaggcaagggaagaaattagtacgtacgtttctcagaactccaaaatcagctaaatttagggacctgttaatgaaggcaataggaggagttgcgtatacagtctatcaacaaggtgtgatgcagtagatttcatagtttttctgtcttaataggtctcctgagcagaaaggcctcaaaagccttttatataattaagcaaaactgactaatccatggcaagaagctgagttgagatctaatacctagattttaacatccttgacttctatctgctttataattggccaagttgccaagaaaagagaaatgaattcttttttttttttttttgcttttgagatggagtcttcctctgttgcccaggctggagtgcagtggcgtgatctcggctcgctgcaacctccgcctcttgggttcaagcaattctcctgcttcagcctcccaagtagctgggattacaggaaccccccaccatgcctggctaatttttgtatttttagtagagacagggttacactatgttggccaggagggtctcgatctcttgacctcgtgatctgcccacctcagcctctcaaagtgctgggattacaggcatgatccactgcacccagccagaaatgaactctttttgaacttcatgctcagttattcttgtttaattcacacaaccattctgacaggtatttattattatgaccacttctgtggatttcataatttcttgtgtttatagcctcacgtaacaggccatgtgtttataatatccagtctgctggtgatatggtttggatctgtgtctccacaaaatctcatgtcaaattatcgtccccagtgttggaggtggtacctggtgggacatgattgcatcgttggggtggatttctcatgaatggtttagcaccatcctcttggtgctgttcttgtgatagtgagttagttatgagatttgattgttcaaaagtgtgcagcacctcctccctctctctcttgcttctgctcccaccacgtgagacacctcgctccccctttgccttccactatgattggaagtttcctgaggcctcactagaagcagaaaccactatgcttcctgtacagcctgcagaacagtgagccaattaaacctcttttctttataaattacccagtctcagatatttcttaatagcaatgcaagaatggactaatacagctgttatgctctgtttgtccgagtactatgaaaaaagtcttattactcataagcagtagagctgtaatgcaaaacgatgtcctgtatcttaactttttgaagagaatatgtcgcagacagcaggataaggcaagatgcagaaatttattctgcaaaaaaaagtgtccttattctgaagagacagatgccttcatagtgtgagagactaacctagtcctccaaagataaccaggaagaaaaaaaccacactacctaaagtaataagtagttgtgattagtggcagttatggaagaatgtatagctcagccaacaaatatttaccacatgaggagatttagtttaaggcaaatacatttgcttaactgacaatgtattctaataaattgaacacagtaggatgtttttacggaaagatgaaaacttgccacgaaagcagaaatgagactatatagagcagtttcacaggatttgcccaacactgtctggaggagagagaccctgtatctgacagcctttagctttctggtcattgtggcatgggctagttcataaagctcttctggggcattgatgaaacatccctcaagaccacttgcttctctttactctgattaaataatcttcatacagcattttgataactggtctatcctcaccagtactactgtgtattactagcacagaagacaaaatattgaaatagagagtcttcagaagtaaactatgaacaatggcgatttagtaaatctcataatgctggcgtttctaactggtgaggaaataatgaattgttcaatcaatagcacttagaatattggtgatccatttaaaaaaataagactatatccctctctgataacacagagtttttttgttctgttttgttttgttttgttttgctttcttttttgagactgactctcactctattgcctaggctggagtgcagtggcttgatcttggctcattgtaacctctgcctcctgggttcaagagattctcatgcctcagtcttccgagtagctgagactacaggcatgagccaccatgactggctaatttgcatttttggtaaggatacgttttcaccatgtttgtcaggctggtctcgaactccttacctcaggtgatccatcccactcggtctaccaaagtgctgggatttacaggcatgagccaccgtgcctggccatcatagaattttaaaattggaaaagaggaaacaaaactgtcactatttacagatataatagtgtacattgaaaaatctaaaaacaatgtgtcgggactcagaaacaatacttcaaactgtggtgctttggaatgaggagcactctgggctttttctgttgcttgtttttaaattttttaacaatatttgtgtgggtacaaatttggtgtatatatttatggagtacatgagctattttgatacaggcatccagggcctaatcacatcagggtaaatggggtatccatcccctcaagcatttatcctttatgttacaaagaagccaatcatactcttttagttattttaaaacgtacaataaaattattattgatgaatgtcaccctatatttgtgctatcaaatactaaatcttattcattctttttttttcttttttttattttaattttttttgagacagagtcttcctctgtcacccaggctggagtgtagtgccgtgatctcggctaactgcaacctctgactcctgggttcaagtgattctcctgcctcagtctctcaagtaactgggattacaggcatgtaccaccatgcccagctaatttttgtatttttagtaggaacgatgtttagccatgttggccaggctggtctccaacacctgacctcaggtggtctgcccgcttcaacctcccaaagtgctgggattacaggtgtaagccaccacgcccggcctaatcattctatttttttactcattaaccattcacttccctctcaccctccaatgctaaggtctttgaactaaagaaaatgaaagggtgttagaatcagcctcagaaccacggactttcttaacttctcctgttttgcccccaagtgcaggatgaaactcttcctctctgaagttaccttatccgaagctcctccagaaagaatccagtggtctttggtcagctccctgagactttcttaaccagggaagattaaactcatggcagaaggtaagactgagggatgtcaccacacctaagcagactttgtcagaagctgttgtctattctttgtcataatccaaagagtttccaaagagaataattcacaaactatggtcaattctttgggcccattcaactctcctaaaaacaatttcctactcctcaaaattgcctacattcccccatctctctctctcctgtgaagaagggtatatagattctgaacctcgctgggttactgggtagtcactctctcgtcattcccccatgaatacaataaacttgcctttttctccagtgaatctaccgtcggttaatttcagcaaactcaaaccttaaagggaaagggaaattcccctttgcccctaacatgcaaattaattatttagattaataattgctagatataaaattggcatatggtttatttatttttatatttcagcacaggggagggaaaaatgacttccttccacccttttaggttttttgtggctgggctacaagttaaattacataagacggattaacacaagaaaaactgtattaaagtatgtgtgtatacataggagtcccacaaaaatataagactcaaagaaaggccagatgaataaagcttatatagcatcttaagctacagaaagaaacagaggcttggggcttctggagggtggtggtgcaagttaccggagcgtgagaggaggaaacatatagtaaatacatggtaaataaaggttgccttgttatgcagataagagtctctcaggggataaaaattgccttggagcagctctcttcctgatcaaaaacacctttaccagtgaaaatttattgtatacatctgaatttcttttacaaaagggcagcttttcagagctaactcctgtgcaggcagtttttctaaataaatagttaataatcaatatgctagagaggaatattttggagtggtgcattctgagccctaaccccagcaacaggcagaaactgaaatgttaaaatgatacaatttgcaatactattaaaaatattaagttcataaggagaaaaattgggaaaagataaagaactttatggacaaaagtacaaaactttattgtgagacattaaggtaaatagaaaggtatagcatgtttatagattgtaagactcactaatttagatacatcaatttttctgcaaatcgacctatagattggtaattgcctgatgggttgttcctgcctgctgcacagacaaaatcagttcactgagaccacggagacagagtttttactcaaatcactctcccagcagtcttggagactaggggttttttggttttttcctttttcgttttttgtttttttttttttttgagagaaagtctcactctctcaccaggctggagtgtagtggcatgatcttggctccctgcaacctccccctcccgggttcaagtgattcccctgcctcagcctctgaagtagctgggactacaggcacgcaccaacacacctggctatttttaggtattttagtagagacggggtttcatcatgttgaccaggctgatctaaaactcctgactttgtgatccacccgcctcggcctcccacagtgctggaattataggtgtgagccaccacgcccggccaggaagttagggtttttcaaggatagtttggtgagcaggtggctagagaatgggtgctgctgactggctggggatgaattcatagggatgtgaaaaacaatcctcgtgggctgagtctgcctctgggtggaaccacaggactggttgagttatgagccctggttccataggttgccggaatgcaaaagtctgaaaaaaaatctcaaaagaccaacctcaggttccacagtagtgatgttacctataggagcaattggagaagtgacaaatcttgtgacctctggccatgtgacccttgagcagtaagggattatagaaaatacattttataagaattcaggcacatctcataatcctaactttgcagactttcattagttttacaaagttttgggaagtgctactatcatcctcactttaaatttgaactataacttccacccgaagtagcttggcctatgcccaggaatgaccaaggacagcttggaggttaaaagcaagacagagtcaactatgtcagatttctcttactgtcataatctttgcaagggcagtttcagatttagaacaattccaatcaaattctcaaccaagtctttgtttacttattttgggaacttactgattctagaggatatatagatgtataagaatagcaaagacacctccaaaaaaacaaactaaaaaacaagctgagagagtttgttctaccagaatatatataaaatggaaaacaatatcttgttacataaaagcctagtattgctcgttgacgggcagccttgttccatgtgttattcagagacacagattacttccatcttctgattctgtcatctcctcatccatttcatatagctggcaaacagaatagaaggtggagaagcacactttcttaactgccttggccatttttcactggcatcaccttcaggtagggaactatagttcctacctgagctgtcgcttctcagcatcaactctacaccatgcaagggtgagcataagcctgagggcagctagttactacagctacagcaatgtaaatggtgttgccagtttcatctttgtcacagatgagataagaacagatgcaatacagttgaaatatgaaagtagagagaaatctaacacagagtttcccaaaaatgagttagatgagacccaggaacttgtacaaactctcatcagtgattgacaccagtgtcaacaaacttgcaaggagaaaaaatggtcagtcccaaaactggacctaaaacactttatcttcttattagaaaacagcagcagcattaataatactatactgcaatatcatatttagacttatgggccagagaagtgggatgtg

SEQ ID NO: 102 - DNA, 59320 bp, Homo sapiens
agaattgaacgttatgatagaaaatagaaaagaagaaagtagaaaaagtcaagaatgctataaataaggtgaaaccaagataaagaaaagtttagcctcagggatatttcttttaaatgggcacatcaagtctccagctattagcaatcgtaatagaggtggaaccagggtttgagtcaaatgtgcaataagataaattgttccgacagcagtaaggacagattgtaatgctgactggaggagaggtggacatctttcccaaaagttccatgtcctggagatggggagccgctggtcacgtgggaaggagaagggggaggaggaggaggaggaagtgggagcactcatgaaggtgagttggctcctgcccattctgccctccatagatgttcccaatggcgagtcaaaggttcattcaacacctgtcaggaagggcacagcctcgagaattcaggatttgtagacccagagagagaagaaatggatgatgagagccgctgccctggactccaacacagggcttcactcaggaatccatgagaaacaggggagaaaaaggggaagccccttcctgcaagttgtggacaggtgcagcattcaagtgattgttccaggaacagagtgggtctttttgaatggcccgactcagaatgcaagagaggtacgatgccatcagatctgcaccttggtccttcagtctgagatttctgacttctatatttctcctcctcttccagaccctgagaaacagcaatttccattcctcagatgactccatgtcagtaatggtgctttaattggcatcagacagcagctgtattgaagtctctcctctggagaagctattgagatcttgcttctccaaggtcgggctgtgaacttaaaagtttgcacagagacactgagtttgggaaatctcagtgctcaacagaatccactgactctaggtaaaacagggcatgtcaggaagtgagtgcagtcttcccataacctcagagtagcagaaggagaaggtgggactctgaaagctggagccacgtttcctgtgaagaaagatggagtggaccttccttgcttcaggtaccagatcacaggtctcttctcagtcggggatgcctcatctctaaaaccacaggatagagggatcagtccccacctgcccccacaccctctccaccttgtgacttcatcctctctcgtcattcattccttcgttcattcattcatccagcagtcatctactgagcagataccttgctccaggcacagtttgagggagtgatgatgcaacacaaaccaagacaggtccctgctcttttgaggccacattatacaaggataaaaataaacatacaaaattgttctaagcatacaaaattttgctaagtgtcaggaggaaaaatacacagcatagtacacagaaaattacacagagcagcacaatatagaggttctgtatgtgccacaaaagtgacagggcagagtgtcaccaggaaagacttatctcagagaatgaaatctgaacaggaggaaaagcagccagtcatgcagacaccagatggagaatcatcccagcaaagagaaagagagttcaaaagtcctgacaaataccaaggctgtaagaagacttttcgttctgtgtttacgataagttgattaaaacatctgaaggagaatgactaccattattcgcatctttgtatgtatttattccttaatgtaataaaacattttcagttttaaaaaatggtcctgaatggatagaggtttggcgtgttagaagcacaaaagttgtttggtcaggacaagatcatcatagccatgagtgttaatgataggagttaatgaggttcagacccttcatgcctgtgaagatggaagaataaagtaagttcctcatggggcacaaatcgagcatgttacatgcaagaataacattgcctaaagatctgtccagctgctgtgcaaaacacaactatttgggagacaagagtggaagcaaggccccaatgaaggaccacaagttgagggagagggaaacaagagtcttccaatctcagtgaatctcaccatcatcctctcatggtgcagccccatgctattcccctccctgttgccatggcctctctccagcccctccatgccttccacatcatcttcctgccatccccatgctgatgactgggctgaggtcagaggcagctcccctctcccaggacgtgagacgattcaaacaagaccaaggaggattctgtgcttgaccatcaggaaaccctggctggactcactgccccttctgcagtagacatccaagattttctgattgccctggacccaaggccagcaccacagagactaccattagagaagttaagtggtcacatccgcatgttccaaagacgtgatccttggagtccacttcttttccttgaacctcccatgtctgattttataaaattctcttaatatcaaatcttcaggaagtcttgcaggagtaaatgccgttaattgttctgtaagccggcagggagggtctccaggaattgtaagaatttaatcaacttgagcaatcagcctgttttacaagcttgctggtgggaaccagctcctggcataacccagcaacttacagacaaactggcatgaacattcctcattatcatgctaaagtctccacccaaggaggaggctcattaccataacatgtgaactatgtgctggcagaatcactcactgtgtatgggcaactgggactcctcctctacaagtgatgatacaccctctgccctctccatcaccacatagaatgttcttctcactttccatcaggaagacactgctttggagaatactcccagtgggcttcttacttgaaccaagtaacaaaacttatttatcaaaatgtacattctcatagagagtctttgttactcaccagggaaacaagccctggttttttcagctaccagctctaacatattctgtaaagtccagcacagaaggaaggttaattcacaatgctattgctttcattttatttcactttttaataattgggtacatatcagggcagatgtctttaggtgggggttgaatggaaggtcaaggagacaaatcatcaaccttggaaagatattcttgcagagattatgactacacttgggattcatgaatatgagaccccaccagcaaagtagcctgcaatgttcaaggatatccaagtagatcaagcattttaatgagaaaacgataggctttgtctttcaagatgtccatgaattgactttccaaaagggaaagaaggacccattttcagggcagaagagagaagaggagaggggtttaggctaaacattgtaatcaattttgcctgataatgactttttgtttcttggttcatttttatttatttatttatttatttatttatttatttatttattttcccaggctggagtgcagaggtgcaatttcggctcactgcagcctctgtctcccaggttcaagcgattctcctgcctcagcctcccgagtagctgggactacaggcatgcactgccatgcccagctaatttttgtattattagtagagacggggtttcaccatgttggccaggctggtctcaaactcctgacctcaggtgatctgccctactcggcctcccaaattacgaggattacagacctgagctgtcgcacccagcctcttagttcatttttagagatgaggtctccctatgtggcccaggatggatttgaagttgtggactcaagcaatgtttttgccttagccagcccagtagttgggtctataaatacacaccactgagcccagatgatactctcattttatgagctgtgtttccactctgattacataaggaagtgaggcaattagtagggataggagcatagaaattctgtctacattcctatttcaaattacctatgaaaaacagacttgtttctaaactaaaactggattttggttaataaatgtttttctttattaaaatgcattagacttatgacagagttgtcacttttgtctcacgtctgatctacaatgatttcaaaagaagatcaattgactacttcaaaattctcattgtttcaaagatattatggatgtaaaactgggtgatctgagataatttagcatatagggccagccaggttacccaaatgaatatctgggaaactgagtacattacatgcttatcacacatctccactgatttagaaaatatgactgtattagtcagagtcatcaagagaaacattgcagatgtaggtagaaagagacagacagaaatatagatacagaaggatttatcatgagaaattggctcaggcaattatggagtcggtgaagtcccacaatctgctttctgcaagctggcagacccagaaaagccagtggtataattcggttcaagtcctaacgcctgaaaaacaagggagccgatgacatagatgtcaacccaagtgtgggaacgatgacacaagatgtcctagcttaggaagtgaggcaagaaaaatgatgaattcctcctttctccacttttcattctattctggcccttaacagattggatgatccccatccagactagcaatgcaaactactttacttaatcaaccaattcagctgctagtcttatagaaacaccctctcagacacacccagaaatcattaattatttaattaattattaatctgggcacccacaggcccaggcaacttgaaatataaaattcaccatcatgatgacctatggtttccaaggtgcaccagtagatgttaccaaaatggcaccaccagccagaacccacatacattcaccaggtcagtgcacttctcaattcgccggagattcattttcttctgtgacatcacgttcacctggagtggagccaagaaccaggccacagctaataatgagaaagaaaggattctttatttgcttttttacaaatgagagaaaaatttgccaaaatcctttggtaataagtagttatctcaaagacaaagagactcaaaatgaaaatgaaaaaagtcagttacccttcccactgcccatgttcttcctccacatataaaaataggtattaagttcaccctttctggtattaaggactagagtctaacccaataactctgaatctgagtgtgcagatgttaccagatttttcattacagaaaatgacagagacgttcttccactacagtagctattttgtggtgacaacttttactttcccaggattcctcggttaagtgacacacacgggcaactggaagtatttactgttttcacccacagcttccacacttcacagatgtgcaggagcttcagtacagcagttcctaggaacatggataggacatgcgtgacttgttaaccacaatgcaatagcaaatatatggggttcggtgttggtctttcattcggaatatacagttcagaattgtttaaaatagtacatttagaaacaaataatatatcctgctgaactggttaaattggattgtatatctttacaatggaattttatgcagcattcttttaaaattatactttaatttctagggtacatgtgcacaacgtgcaggtttgttacatatgcatacatgcgccatattggtgtgctgcactcattaactcgacatttacattaggtatatctcctaatgctatccctcccctctcccgccagcccacgacaggcccccggtggtgatgttccccttcctgtgttcaagtgttcttattgttcaattcccacctatgagtgagaacatgcggtgtttggttttttgtccttgggatagtttgctgagaatgatggtttccagtttcatccatgtccctacaaaggacatgaactcatccttttttatggctgttatacagcatttttttaatgcaaaaaagtacggttgatcccttgctactggcatggaatattaccaaaatatattgttaatgagaaagaggaatgctgtaggccactgtagtaatctgctcaggctgctataacaaaataccacaaatgagtagccgaaacaacagaaatttctttctcccagtcgaggaaacatcagctcttctcctccatactcacactcacacttccggccaccaaatacgggagggtgctttcttacaggaactgattccagctgcgtatcctacaattcaattcgattgtgacactaactggagtgaatgcagaccccacaggttaagggctccgtcccacaagactatcagtatcaagaagcagatcattatctgtgcttttgaccaatgaactatagtttggaggatcccgtgacttcctcctcagtttgatcatttgctagaatggctcacagagcccagggaaacactttacttaggtttacacatctatcataaaggtatactaaatgtacacacagggagataatggggcaaggcttggaagggtcctaagtgcagaatcttctgtccctgtggagttggggtgtgccaccctcccagcacagggatatgttcttgtgtactgtattgatctgttgtaacactgctataaagaactacctagggctgggcatggtgctcatgcctgtaatcccggcacattgggaggctgaggtggacaattcataaggttagaagttcaagcccagccttgccaacatggtgaaaccctgtctctattaaaaatacaaaattagctgggagtggtggcacacacctgtaatcccagttacttgggggtgctgaggcaggagaatcacttgaacccaggaggcagaggttgcagtgagccaagatcatgtcattgcactccagcctgggcaaaaagagcataactccatctcaaagaaaaaatagaaaactacttgagacgaaataatttatgaagaaagaagtttaattgactcacagttctgcaggctgcacaggaagcatggctggggggcctcaggaaacttataatcatggcagaagggtgatgggaaagcaagcacaccttcacatagcagcaggagagagtgaagggggaagagctatacacttttaaacaatgagatctcatgagaactcactcactataacaagaaattgtatagtagggggaaatctgcccccatgatgcaattacctcccaccagttccctcccccaacattagtaattacaatttgacatgagatttgggtggggacacagagccaaaccatatcattcaccaaatccggaaacttaccaaagtctctctctctccttttggggtttatggaggtgtcattacgttggcatgactgatgaaattattcgccactgctgatcaatttaaccttcaatcccctttccagggggttagctagggtgggaatggatgttctaaccctctaatcacttgctagagtctgctggcaaccagcccccatcctaatgctacgcaggtgccactcgtctcattaacgtacttcatgaggcacttattcagaaattagacacttattcagaaattttaagagttttaggggctctgagtcaggaaacaggcaggaacattaaatatatgctttatatttttttagagatgggatttcactcggtcacccaggccagagtgcagtggtgccatcataggtcactttagcccccacctcctgggttcaagccatccttccgcctcagtcttccaagtagctgggattataggctgcagccaccatgcccagcagttgcatttctcattataaatcacaatatcacaatcacagctctggacactgggaagttcaagatgaaggttctggcaggttcaatttgcagtgaggtctcccttcctggcttgctgacagttgttcccccaccactgtgtcctcacataggcaaggaaggagtaagctctctggtgtgtctcttgtttttttgtttgtttgttttttgttttttgttttgttttgtagagatggcatcttgctatattgctgtattaggctgctctttcattgcaatgaaaaaattcctgagattgggtaacttataaagaaaagaagtttaattggctcatggctctgtacgatgctcaggaagtatagccctggtatcagcttctaggaaggcctcaggaagcttataatcgtcgcagaagatgaagcagcaacaggcacttcatatggggaaagcaagagcaagagagagttggaagtcgtagggggaggtatcacaacttttaaatgaccagtctcagaagaactcactcattttctccaggacagcaccaaggatttggtgctaaaccattcatgagaagtttgcccctgtattagttctttctcacattgttacaaagaaacacctgaaaccgggtaatttataaagaaaagaggttaaattagctctcagttctgcagaatttacagaaagcatagcagtttttgcttctggggaggcttcaggaagcttccaatcatggtggaaggcacagggggaacaggggtctgacatggcaggtgctggggcaagagagcaagggggaatgtaccacaatttgaacaaccagatctcacgagaactcactcactatcaggagaacagcaccaagggaatggcgctgattcacgagaaatccagccccaagatccaatcacttcccaccaagcctgcctccaacactgggaattatattccaatatcacatatggatggggcaaatatccaaactgtcccagttgcccacaatgatcttgagctcttggcctcaagtgatcttcctgcctcaggtgcccaaagtgctgggataacaagtgagagtcaccaacccagctggtggtgtctctttttataaggatactaatcctcttgaatcaaggctccacctttatgacatcatttaacattaagtttatccttataggccctccctccaaatacagtgacactgggggttaggacttcaatatatgaatttttaagggacataattcagtccacagtaaacactatatatagcatattactgtctgacagggaaaaaagaggaattaacacagaaatctatgaaaatgagaaaaagccttatacgtattattcatatatgcttagactcagcatatgcattatagaaagggtactaaaaaactgaataattattcttcctagaatacaaatctagcttccataaagaaaggtaaatgaagacatccttttcactagataccatttttaattattgaatttacattttcaccatatgaatgtatatgcattctatatatgcacttacatatgtatgcacgtacttatgtgcatatatctatatatgtagagatgtatacatttgttaaccacagactccctactactagaacattcaaacaaaggagatgtaatcaagtaaaactaaaagaaccataacaaggcagcactggatgacctggaaggctgagggtcactcagctcgccacccctcaccccccagctgggaatcagagagtgatggagctatccctcactccacctcctgctctcttccttctgcagtccagccacctggtcacagagtgaggctctaaactggcccgtattacatgtgtctgtccctccccttctcactttggaggaagagtgtgactatcccaagtcagcacgtagagtgagacagagcgtgagacctgctagctgaggaaccgtaagaaccttgtgctttgaaagccgatctgctttgtgatattgaaatcctccgagtccattctctcattattacaggaaaggtgtgtaaaatatccaggtcatgtcactacaggacaaaagctctggatgttcagccataatcaaagctcttgagatccagcaatttccttgaacaatttttctaccacacacacttctcaaaatatagtgcatacccatatttaggattgtggtagagggccattacatgatcttgactgtatcaataaaagtctcagggcaaaactctgggggattcatgcagatggcctaccatttggatgtggaatctgagcaaatcatcctaacattctgctacccatctccaaaaatgggcttcaataaaatggctatctcagacactttgcaatctatgagtctgcaatgaagaatgaatgtgtgtgtgtgtgtgtgtgtgtgtgtgtgtgtgtgtgtgtgttttaaagaggcatatatgtggtttacttggtttatgtatatgagttacttgattacttataagggagtattctgaataatggattaattgaataaatgaaatataattacaccatgtacaaaactttacatagttttttctgcttgatcattattcctgtaagtctccatagtaatatctaattgtatttttagtgaagaagctattttggtctgaccttcaaaactgtctttgcatttgggtaggacaaaagactagcaaaaaaaagcctgagggattatcttaagtattcttaggatttagtgttcttcagactatctgggttagctgacttgtgaaaaaactaatagttcactcctcagtatttctggaacaggaaggatttttcctcatgcccccaactgcctctagccaaataaaaaagcaagaggacaaaattctttaaatattaaaaggaagttatgggtaagcagtgacatatagagacatatagagacatatagatgagcacgtagttcatcaattttgtctccctgggatattcataattaatccctaatgactaatagccaatcttctataataataaactatataatcaaatattatacacaaattcattcataatgttctctgccagcatgtaagtggcacacctaaaaaacttcaaacattaagtattttccatttggatcacatgggggaagttttgcactatggattcgtgagctccattccagatatactcacacagaatgtctgcacatggagctcaggattctgcatttccaatcacatcctcaagtagttttccaacaacctatctccagcccaactttgagatccatttgttaccaaacattgacttcagaagccttcatgtgcatcggaagtaatcttggcgtagggaaattccgaagcacaggaggcagcgataccatttgcattattcctgagatgattctagctacatacacctattatccagcatttatgtcttgatttgaggcttctattcagttgaccctattgatatccaagtgtacacaactgacctgtcaggctatagcaacactcttcacttatatgtagggagaatttgtacagggcttaactgaagctcatcatggggtatgaattgacttggtctcattgctgtaacccttgggttcagaagacactgagcaaatgcttaaaaaactcttttgggttaatacatgaagagatattaactcctcagatagccaaagaatcaaggggaaggggtaaaagaggatggccatatagaagtatccattgatttcacccccacacataccagcagaaacaccacatttaacaactatctacacacaaaaaaggacctacataggaaataaaaatcaggtcaaccatcattgtacctgattttaacttcgtatcactgaaaaaggcactgaagagatgaggaaagacaattttgaatcactgaggccaccactcccccatgtcccagtagctgccactggagctgagacagaaactcagtgcatgggggagggagagtgcagcaattgtgaaaatctgcattgaactcagtgctgccctgtcagagcccacccacagagggagcattcagaccaaccttagccagaggggaatcaatcgcctatccaagcagtcagtatgtgagtttgggaaagccttgccaaagcaggctaaagtgctctggggtcctaaatgcatttgaaactcaatctaggccacaagaactacaactacaaggcaagtcccagtgctgtgctgggctcagagccagtggacttggacaccactagtgtgacacttgtcagggcagctaagggagtgcttgcacaaccactcctccaaccccaggcagcacagctcacagcagtgaaagtgactgcttccttctgcttgaggaaaggagaggaaagagtaactaggacattgtcttacatcgtaaatgtcagttcagccacaataggatagggcaccagtcagagtcatgaagccaccattccaggcactcgctcctgaaggacatttctagacacaccctgcaccagaagaaaacccactgcctagaaggaaaggacccagtcctgccaggattcatcacctgctgactgaagaaccctcaggccctaaataaccagcagcaatacctagtagtacactccatgggccttgggtgagactctgagatatgctggcttcaggagagacccaccatattcacagctgtggtagtcatgaagagagaatccttctgcttgagaaaagcagagggaaaataaaggggactctgtcttgcagcttagacagcagcttagctacagcggggtagagcaccaagccagctcttggagtccccagttccagatcttggcttttggttggcatttctggacatgccctgggtcagaggggagcctactgccctgaagggtgagtcccaggccaggcagcattcaccacaagctggctaaagaactctggggccttatgggaacactggcatcatcctgtcagtattccccttgagcctgcggtggaggtagctgcagggagaggctcctctgcctgtggaagagtaagggaagagtggaaggactccagctcagccacagtaaaacagaacaccatgtaaacctcccaggttgtttacttcagtccctggctctcagacagtacctctggacatgcctgggcctagaggaactcatcaccctgaagggaaggacacaagcctggctggtattgccacctgctctagggccttgtagagctctagggccttgagtgaggccctcacttccaagaaagaaataaactcttttccactgcagctaaactgtaaagctcataacacaagtagatcctctgtgcatattcacttcctttccttcttacgcaaggtgctacagtgtgaatctgaatgtggcaagttcaacactaaagtcctggagtgcaggaaagttatggtagactcagaaatctgttcttcaacatttagactgtatttatgatggctgaattttctgtctagtcacctatggtcctctacctgggcgacagagtgaggctccgtctcaaaaaaaaaaaatagtttagcatgccaaagtaccatcctttggagtatagtgtgctgagccccaacaaaagccatgagattagatatgatcatgaagagagtgcatgagtccatagaaaagaaagaatagctaacccctaggaacctccaccatcaagatgctggagagaaaggggaagaattaatgaagcagactgagaacatgagtccagggacttagaagaaatgatcaggaaagggtggggtgttgtaactcagcacacatccttgacaagactgtctgccttgagggcaccaggcctgatctcaccagacttttcattctgtttctgtcacaagaagatcattctcaggtcagcttcatcaaggagcagggagaaatcaactctgtcaaatgctgctgagcatggaaagttaacactgtcaggggagaaatgtcttactccaagtgcaaaccttccctcatgaccactgctgatggggtggaagagtctgggcaattcattgaagaggtatccaaatttctgggtctaaggaaagacaatcttaccaggaggtgaacaggaagagggtccacatgtgagtcacgttttcatctcagtggagggaataaggcaaaggagagtagggtttctgtgtctcaatgcccggagatattgttctccttttaaccatatcccagacctcagtacttctcacatttgtctccatctctctttgctcctgtaaggacccatctgagcaactcacttcaccacatcatccttcattcatctccatatcactctcttttcttttctttttcttttcttttcttttcttttcttttttttttttttttttttttttttttttttttgagactgagtcttgtcttctcacccaggctggagtgcactgacgtgatctcggctcactgcaacctccacttcccagattcaagcgattctcatgtctcagtctcctgagtagctgggattatagttgccccacatcatgcccagctaatttttgtagagacagggtttcaatatgttggccaggctggtctcgaactcttgacttcgagtgatccacctatctcggcctcccaaagtgctgagattacaggcgtgagccaccatgcctggccgcaaaaagatattttctaacattcagttctatcaatttgtttagtgtgcttaacagatgactctaccattactcttcctcagctggaaagtgaggggtgtggtataaatgtctttaggagtgccttacagctcagactatttagaaatctgatactctggagcataggtatgggtgtatgcctgtgtgtgtgtttgtgtgtgtgagtgtgtgtgtgtgtgtgtgtgtgtgtgtgtaggaaaagatgtaaaggaaatttggttgacatctgtgcatcatctgtctatgtaaatctgattttcctaaatcattattaatttaggcagaaaaaagcataattctctgaaacaaaattattatatacaattacatcattatttttaaactatgcaaaaaaacatgcctataatcgattttattgtagagaagatgtgaggtcttgttatttagaactgttatttaatggagcaagataaaacactagcacaaagactatgtgataatttcaagcccctgagagctagattagaggactaattttgtgttcagtttcatgtagagctataaattaaacaattctaccttgaaaaatattttcacagaagaataaaggatccaaggacagtaggaaaaaaatgaagctcaaggtgaatgatttggctaaattcatcaaattctgtacaaaaaagagactaaatcatgcaggaactatatttttatcatgaaaatgctctaattatttgctaagacagttcctcaaatttagcaccaaattgatggaaaatataatttttatgataatctatttccctttgttctgacttcacaagtaaatgcaagatgttaaaaggtgatttattctatctcagattgggaagggtccctgagaaacagcggtcctatcaaaatgacttgtccacctaagcagcacttggtcaaaaagagataaaaccctgagttctatttcttatgccttcactttgaggagtaaggaaaagaaacaagcatactgtcttattgtaaataccacagagaggatagtgcagtaatggatactacattaacaccttgatgcataagactgatcatccttatcaagatttctttttctttttgcaatgttttatgctacatattttgttatttcatacacacacacacacaaattaccacattaaatttctcctacaaaccaatgtatgtgttgttgttttttacagattataaaacagaggcatagagaggacgaataaccgtgcaacttttttttatttgtttgttttttttaagagacagagtgttgctctgtctcccaggctggagggcaggggaatgatatcagctcactgcagcctctgactcctgggttcaagagatcctcctacctcagcctcctgagtagctgggattacaggtgcaagtcaccatgcctgactaatttttgtgtttttggtagagatggggtttcatcatgttgggcaggctggtttcgaggtactcgcctgaagtgatccctctgtctaggcctcccaaagtgctgggattacaggcttgagccaccacgcttggccctggactactgttatagtaagagtgtcaaatagaaaaagtcagagctggtatctggacaagactatacaaaatctacacctgacatcactgtgacacaaaacttatataataactgcatttacagagacactaacctatataataattcatttcctataagccctgaaatctcagcaaatgcatctatgtgctcaaaatgcaatgaggatgaagagaggttgattaatgagtataaatataagaagtgatataagaaataagacctggggtttgatagaacaggaggatggctatagttaatgataatctactgtacacttcaaaatagcttgaagaccaaaattcgaatgtttctaaagtaaagaaaagtcaaatatttaaggtaatggatatcccaatttccctgatataatctttacacattatatgactgtattaaattatcacatgtaccctgaaaatatgtacctctcttatgtatcaataaaaagaaataaggccaggggcagtggctcatgcctggctgaggtgtgcggatcatcagaggtcaggagttcaagaccagcctggtcaacatggtgaaaccctgtctttactaaaaatacaaaaattagctgggcatggtgacgtgcacctgtaatcccagctactcgggaggctgaggaaggagaattgcttgagcctgggaggtggaggttgcagtgagctgagatctcaccactgcactccagcctgggtgagactccatctcaaagaaaaaaagaaggaaagaaataagaaagaaagaaagaaagaaagaaagaaagaaagaaagaaagaaagaaagaaagaagggagggatggagggagggagggtagggtaggggaggggaggggtgtggagaggagaggagaagagaagagaagagaaatattctaaaaacatgcagtggtacatgaacgcaactttccaatttattcggaaacacactttatttcatctcttctaagacacacctctccataattccatctgagctctatttccatttcttccctttccagagagggagaggactttatagttgaggagaaagaagaaagccttagttctttcctctttcatgccagaaacttgatcaaagatgtcagatctacttattcaatggctttcagaggagacatgcaggaggccccacgcaagaaggaaggcctagggccacctttctgaggttcaagagaccaggaagagctcagtacaccaaatatctttagaacttaggtaagttaaatattacttcatttgctacaatttaattaacctgcaccatattattatggaaatcttgtgttacttttaaaggcaaaaatctcaattacttttgcaccaacctaataaatagtgtgcattgtctttcccatagataaccactgctgcattagggaaatctgtgtgcaggaaggtattgatggtgtggtacctccctgtcagcaggttaagagcaaatattgcaagggtaccctggggctgaagaaattgcaagcattgaacactatatttttgcacataaatgctatgcaaaaaagacattgatcaatgcagtgtactcaacagtggtttttaccataaatgcagaattctttgtctgggacaatattttaaaatgttcatcagtttcccaaaaaaagacttaatactgggacataattccaactattcctctcagtggaagtgtggatcaggtctgaaaatgtgtcattaaattaggctgcaagacaacttatactaataaaataaagagcccaggtgtgttaaagacaaaatcgtgggggccgaataggaacagctccggtctgcagctcccagcgtaagcgacacagaagatgggcgatttctgcattaccatctgaggtaccgggttcatctcactagggagtgccagacagtggggacaggacagtgggtgcagtgcccagtgcgcaagccgaagcaaggcgatgcattgcctcactagggaagtgcaaggggtcagggagttccctttcctggtcaaggaaaggggtgacagacggcacctggaaaatcgggtcactcccacccaaatactgtgcttttccgaagggcttaggaaatggcgcaccaggagattatatcctgcacacggctcggagggtcctacgtgcccacagagtctcgatgattgctagcacagcagtctgagatcaaactgcaaggcagcagcgaggctggggcactggcgcccgccattgcccaggcttgcttaggtaaacaaagcagccaggaagctcgaactgggtggagcccaccacaggtcaaggaggcctgcctgcctctgtaggctccacctctgggggcaaggcacagacaaacaaaaagacagcggtaacctctgcagacttaaatgtccccgtctgacagctttgaagagagcagtggttctcccagcacacagctggagatctgagaacgggcagactgcctcctcaagtgggtccctgactcctgacccctgagcagcctaactgggaggcaccccccagtaggggcagactgacacctcacatggccgggtactcctctgagacaaaacttccagaggaatgatcatacagcagcattcgcggttcatgaaaatctgctgttctgcagacaccactgctgatacccaggaaaacagggtctggaggggacctctagcaaactccaacagacctgcagctgagggtcctgtctgttagaaggaaaactaacaaacagaaaggacatccacaccaaaaacccatctgtacgtcaccattatcaaagaccaaaagtagataaaacgaaaaagatggggaaaaaacagagcagaaaaactggaaactctaaaaagcagagcgcctctcctcctccaaaggaatgcagttcctcaccagcaatggaacaaagctggacggagaatgacattgacgagttgagagaagaagtcttcagatgatcaaactactccgagctacaggaggaaatacaaaccaaaggcaaagaagttgaaaactttgaaaaaaatttagatgaatgtatagctagaataaccaatacagagaagtgcttaaaggagctgatggagctgaaagccaaggctcgagaactacgtgaagaatgcagaagcctcaggagccgaagcaatcaactggaagaaagggtatcagtgatggaagatgaaatgaatgaaatgaagtgagaagggaagtttagagaaaaaagaataaaaagaaatgaacaaagcctccaagaaatatgggactatgtgaaaagaccaaatctacgtctgattggtgtatctgaaagtgacggggagaatgcaaccaagttggaaaacactctgcaggatattatccaggagaacttccccaatctagcaaggcaggccaacattcagattcaggaaatacagagaacaccacaaagatactgctcgagaagagcaactccaagacacataattgtcagattcaccaaagttgaaatgaaggaaaaaatgttaagggcagctagagagaaaggtcgggttacccacaaagggaagcccatcagactaacagcggatctctcagcagaaactctacaagccagaagagagtgggggccaatattcaacattcttaaagaaaaaaattttcaacccagaatttcatatccagccaaactaaacttcataagtgaaggagaaataaaatactttacggacaagtaaatgctgagagattttgtcaccaccagacctgccctaaatgagctcctgaaggaagcactaaacatggaaaggcacaaccggtaccagccactgcaaaatcatgccaaaatgtaaagaccatcgagactaggaagaaactacatcaactaatgagcaaaattaccagctaacatcataatgacaggatcaaattcacacataacaatattaactttaaatgtcaatggactaaatgctccaattaaaagatgcagactggcaaattggataaagagtcaagacccatcagtgtgctgtattcaggaaacccatctcatgtgcacacacacacataagctcaaaataaaaggatggaggaagatctaccaagccaacggaaaacaaaaaaaggaaggggttgcaatcctagtctctgataaaacagactttaaaccaacaaagatcaaaagagacaaagaaggccattacataatgggaaaaggatcaattcaacaagaagagctaactatcctaaatatatatgcacccaatacaggagcacccagattcataaagcaagtcctgagtgacctacaaagagacttagactcccacacaataataatgggagactttaacacaccactgtcaacactagacagatcaacgagacagaaagttaacaatgatacccaggaattgaactcagctctgcaccaagtggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactgtctctcagaccacagtgcaatcaaactagaactcaggattcagaaattcactcaaaactgctcaactacatggaaactgaacaacctgctcctgaatgactactgggtacataacgaaatgaaggcagaaataaagatgttctttgaaaccaatgagaacaaagacacaacacaccagaatctctgggacacattcaaagcagtgtgtagagggaaattgatagcactaaatgcccacaagaaaaagcaggaaagatccaaaattgacaccctaacatcacaattaaaagaactagaaaagcaagagcaaacacattcaaaagctagcagaaggcaagaaataactaaaatcagcagaattgaaggaaattctgacagaaaaaacccttcaaaaaattaatgaatccaggagctggttttttgaaaggatcaacaaaatagatagaccactagcaagactaataaagaaaaaaaaaagagaatcaaatagacgcaataaaaaatgataaaggggatatcaccaccaatcccacagaaatacaaactaccatcagagaatactacaaacacctctacgcaaataaactagaaaatctagaagaaatggataaattcctcgacacatacactctcccaagactaaaccaggaaaaagttgaatctctgaatagaccaataacaggttctgaaattgtggcaataatcaatagcttaccaaccaaaaagagtccaggaccagatggattcacagccgaattctaccagaggtacaaggaggaactggtacaattccttctgaaactattccaatcaacagaaaaagagggaatcctccctaactcattttatgaggccagcatcatcctgataccaaagccaggcagagacacaaccaaaaaagagaattttagaccaatatccttgatgaacattgatgcaaaaatcctcaataaaatactggcaaactgaatccagcagcacatcaaaaagcttatccaccatgatcaagtgggcttcatccctgggatgcaaggctggttcaatatacacaaatcaataaatgtaatccagcatataaacagaaccaaagacaaaaaccacatgattatctcaatagatgcagaaaaggcctttgacaaaattcaacaacacttcatgctaaaaattctcaataaattaggtattgatgggacgtatctcaaaataataagagctatctatgacaaacccacagccaatatcatactgaatgggcaaagactggaagcattccctttgaacactggcacaagacagggatgccctctctcaccactcctattcaacatattgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacttaggaatccaacttacaagggacgtgaaggacctcttcaaggagaactacaaactgctgctcaatgaaacaaaagaggatacaaagaaatggaagaacattccatgctcatgggtaggaagaatcaatatcgtgaaaatggccatactgcccaaggtaatttatacattcaatgccatcctcatcaagctgccaatgactttcttcacagaattggaaaaaaatactttaaagttcatatggaaccaaaaaagagcccgcatcgccaagtcaatcctaagccaaaggaacaaagctggaggcatcatgctacttgacttcaaactatactacaaggctacagtaacaaaaacagcatggtactggtaccaaaagagagatatagatcaatggaacagaacagagccctcagaaataacaccgcatatctacaactatctgatctttgacaaacctgagaaaaacaagcaacggggaaaggattccctatttaataaatggtgttgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggtcttcatgtctaaaacaccaaaagcaatggcaacaaaagccaaaattgacaaatgggatctaattaaactcaagagcttctgcacagcaaaagaaactaccatcagagtcaacaggcaacctacaaaatgggagaaaattttcgcaacctactcatctgacaaagggctaatatccagaatctacaatgaactcagacaaatttgcaagagagaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccacttagaatggcaatcattaaaaagtcaggaaacaacaggtgctggagaggatgtggagaaataggaacacttttacactgttggtgggactgttaactagttcaacccttgtggaagtcagggtggcgattcctcagggatctagaactagaaataccatttgacccagccatcccattactgggtatatacccaaaggactataaatcatgctgctataaagacacatgcacatgtatgtttattgtggcactattcacaataacaaagacttggaaccaacccaaatatccaacaatgatagactggattaagaaaacgtggcacatatacaccatggaatactatgcagccataaaaaatgatgagttcatgtcctttgtaggaacatggatgaaattggaaatcatcattctcagtaaactatcgcaaggacaaaaaaccaaacaccgcatgttctcactcatagatggaactgaacaatgagaacacatggacacaggaaggggaacatcacactctggggactgttgtggggtggggggatgggggagggatagcattaggagatatacctaatgctaaatgacgagttaatgggtgcagcacaccagcatggcacatgtatacataagtaactaacctgcacattgtgcacatgtaccctaaaacttaaagtataataataattttttaaaaaaagacaaacgatcatgctgaagttacagagaattttgtttaatgttggcttacactttatttctgcttcatataaaacatcttctcccaaaggtcataaatatcaaagtagatcatgtgtactagttctgcagataaatgaaggtagttagaaatgtacacaggaaatctatacaagggagaatcagaaaaatcttatgagcatgttctgaatacaattttagtgatcaggagcagtgtctcacacctgtaatcccatcactttgggaggccaagtggggcagatcacctgaggtcaggagtttgagaccagcctcgccaacatagtgaaaccacatctctactaacaatctgaaaattagccggatgttgtggcagatgcctgtaatcccagctactcaggatgctgaggcaggagaatcacttgaactcgggaggcagaggtggcagtgagccgagatcgtgccactgtactccagcctgggccacaagagcaagactccatatcaaagacaaacaaacaaataaaaaaaactcgcacaattttaaaggatgaatatggttgcaaattgggcaggttatggtctgagttatttcttaagacactgcaacaagtctgacgcgtcataatcacagatttctccagaagccaggaaggtgtcattactgaacagacaggatgtaagtcaggaggcagagatggagtcagagaacagccctgagctagagccccttccacagaggcagctttacccagctctaattgataccacacagcaacggagacacagtgcaccaaccaacatcatgtgatttttaaagataagacagtaatgaaaacttttagtgaactattccaatgtcaaactttatcttccaaaccaaacattataaataacactgtatatgctgaaaagaagcactgtttagccgagtacctgccctggggctgcagtctatgtcttttgcctcacactatagacacttgagtgcaagtctttctacccagtgtgcctgtcagcatcacagaggggatactctacgtatcattcacctttacattctcatcacctgcaaaaatgatctccacacaatatacatgaaaaaagaatttgcttcatgataaagctgctaatgaatgtcggccagaagaggacttcaaggcagagtactgttagctgtgcattgaatcctcacctgatgaccattgtgtccacatttacctaaggactccagtgataaaattattgcatttgtaaatgacaggaaaattggatggtatatgatatcatttaaaggtctgatttccatttactaatctagaagctagaccagagatttaacatctttttgtacctaggtcttacccctgcaattcactttccacctctgtacaattttcccacatcatcccctgtgcccagaatgctcatctcttccctaaagtccctgaaaaccacctgctttgcctttaggaccctgctgaaatgaaactttttttttttgaagtcttccttgtccctcaagcgaagtgatttccttcaccctcggcgtccccatgaaaccatgttcacacaaatgctattatctctatcatactgtaatacaattatgtgactacaattactttcctgtatatctctgaggtccaagaataagtctatgcttggtgtatgaaattgtacagttgacttctatactttcaggaatacagtgctctgtccttaaatgttcatttgtaaatacagaaccattttcttgttgatatcacaagatgaaacctaccaggaagatgaatgacaaccccagaacacactgttttgtagaaaataccataggctgaaaagatcacaggaataccgagtgctaggttggaatctttcatgacaccaaatgttcattcattctctgccagattttacaactgtcctcggtgtgtttttaggttgtgtaactttacacaaagtggaagcaataatcagggcaagacttaagagaaagtggatccaatgcaagaggagtaaagaaaaaaatccctcaaatgtatggagcagattgttttaattatctacagaatcttgtgccccaagaaattaatagctcaagtttccagcaagagtggtggatgagatggagagcatttatgtgagagagaaccaaggatattactaaaaatggaagggaagctgggttcctcctgggaaaacagatctctgtggctctatttgttctaactactatgcctgccttcatgtactttggtcatttaggggcctgccagaggacagttataaaatctgtggtcattctgccggcagcatatagttttcatccagagtccagatcccaccggcaaaactctgtctaacacaggatgacttggaattagagtccgtatagcagaaagagcagcagggctgtccttgggtatccgttgctcagccaagtcatcaaataaaaaggatgattgcgcaagtggaccatgtgtcaatctgtgggtttctgcatggccaagagccagaccctccctcctggctctgctggcccaacccaccaagggatgctttatttaaatagttccaagtaggggagaccagctgcccctgaaccccagaacaaccagctggatcaattctcataggagccacagcgcggagactgtgtaagtcaacaatccccagagttgggacaggaggggcagcgacagggcagcaactgagggagaagggagctgacgttagtgcttaggagatgtggcacactttggggacaggaaggaacaggaaatgggacccaagagtggcagcagattggcctgtggggtgagacactatggtgtgtgtcacaaccgagacagaatcggggagtagttacttctcttcttttctcacaggaaacatggttccaaaactgttcacttcccaaatttgtctgcttcttctgttggggcttctggctgtggagggctcactccatgtcaaacctccacagtttacctgggctcaggggtttgacgtccatcagtaggaaccagctccaatgcaccaatgcaatgcgggtaattaacaattatcaacggcgatggaaaaaccaaaatacttttcttcttgcaacttttgctaatgtagttaatgtttgtggtaacccaactataacctgccctcataacagaactctcaacaattgtcatcatagtggagtccaggtgcctttaatgtactgtaacctcacaactccaagtccacagaatatttcaaactgcaggtatgcgcagacaccagcaaacatgttctatatagttgcatgtgacaacagggatcaacgacgggaccctccacagtatccagtggttccagttcacctggataccatcatctaagctcctgtatcagcactcctcgtcatcactcatctgccaagctcctcaatcatagccaagatcccatccctccatgtactctgggtgtcagcatctgtcctcttcagtctctataccccttccacttgcctgagctgaagtgccttgtgaagcctgcaataaactgctttgcaaattcatctggaagtgtctgtgtgtcttcgtcggccactctgctgtcattgagtgacaatctactctagatatttttccttcctccaacccgagacttgtgggaaatggagagatttgaggataagagactctttctgtcatgaagcagcacagacttatccctctccctgctttaggctgagaagccgaggtctcaactgatacctaccaactgttgaagactcttcccttgaccaaatttagtcatctcccctggcctcttcacaagtaggtcattctgttgggtttcctagtccttccttgtagagtcaggtttgtatttatatttacatttatatttatatttatatttatatttattcattttttgagagagagtctcgctctatcacccaggctggagtgcagtggcacaatctcggctcattgcaaactgtgcctcccaggttcaagcgattctcctgcctcagcttcctcagtagctggggttacagtcatgcaccaccatgcctggccaatttttgcaatgttagtagagatggggtttcaccatgttggccaggctagtcttgaactcctgacctcaggcaatccgcctgcctcagcctcccaaagtgctaggattataggcgtgagccaccagtgcccaacctagggtcaggtttaacagaagtcttcctaacctggtttatcattaatattcaccctcaatatctgaccaaattccttaattcccccatcatcctccttgtgatacctgattcctggcctgccttcaaaaaaaaagaaaatccagttgagtcgacttagcattggtctccctagcctcgatggttcttctaggtaattttgcatccagtgacccctccccccacaccaacttataacttcagtatacctctccacttgttttagctgtattccagaattttgctcaatttggtgctgaggtcccatttgacactttatggtctaagtctggtttttattgacatgatttctatcctaagagatatagaggctgcagggaataaggtgaaaatgtacatgtttgattatgatttatgaatgataaattttgatagaattgaacattgagatagaaaacacacaaaaaaagaaagtagaaaaagccaagaatgctataaatatggtgaaaccaagataaaaagtttagcctcagacctatttcctttaaatgggcacatcaaatctccagctattagcaatcgtactagaggtggatccacggtttgagtcaaatatggaatgagataaattgttcagacagcaatatggacagattgtaataaatattgcctgaaggagaggtgcgcatcattcccaaaacttccatgtcctggagatagggagtagctggtcacctgggaaggggaaggggaacgagggagactggggagtgggatcactcatgaaggtgaattggctcctgcccgttctgccctccacagttgtccccaaaggtgagtcaaagggttcattcaacacctgtcaggtagggcacagcctcaagaattagggatttgtagacccagagagagaagaaatggataatgagagcccttgccctggactccattacagggcttcactcaggaatccatgagaaacaggaaggggaagccctttcttgcaagctgtggacaggtgcagcattcaagtgattgtgccggggacagagtgggtctttttgaatggcctgactcttggccatacaacagagatacaatgccatcagatctgcaccttggtccttcagtctgagagttctgacttctatatttctgctcctcttccagaccctcagaaatagcaatttccattcctcagatgactccatgtcagtaatagtagctctcattggcatcagacagcagcagtattgaagtctctcctctggagaagctattgagatcttgcttctccaagggtgtggcagggctgtgaactttaaagtttgcacagggacacagatttcacgaaatcctggtgctcaatagaatccactgactctaggtaaaatagggcatattaggaagtgagtgcagtcttcccacaacctccaagtagcagaaggagaaggtgggactctgaaagctggagccacgtttcctgtgaagagagatggaatggaccttcctcacttcaggtaccagatcacaggtgtcttctcagtcagggatgccccgtctctaaaaccataggatagagggatcagtccccacctgcccccatgccctctccaccttgtgacttcatctcctctcctgtcattcatccttcactcattcattcatccagcagacatctactgagtagataccttgctccaggcacagtttgagggagtgatgacgcaacgcaaaccaagacaggtcactgctcttttggggccacattatacaaggataaaaataaacatacaaaattgttctaagcatacaaaattttgctaagtgtcaggaggaaaaatacacagcctagtaagcagaaaactacacagagcgacacaatatagaggttctgtatgtgcctcagaagtgacagagcaaagtgtgaccaggaaagacccatttcagagaatgaaatctaaacaggaggaaaagcagccagtcatacagacaccagatggaaaatcatcccagcaaagagaaggagacttcaaaattcctcacaaatatcaaggctataagtagacttcagttcagtgcttacaataagttaattaaaacatctgcaagaaaatgactacaactatttgcatctttgtatgtatttattccttaatgtaataaaacattttcatttttaaaaaatggtcctgaatgaatagaggtttggcatgttagaagcacaaaagttgtttggtcaggacaagatcatcatagccatgagtattaatgataggagttaatgaggttcagacccttcatgcttgtgaagatagaagaataaagtaagttcctcatggggcacaaattgagcatgttacatgcaagaataacgttgcctaaagatctgtccagcctctgtgcagaacacaactatttaggagacaagagtggaagcaaggtcccagtgaaggaccacaggttgaggcagagggaaacaagagtcttccaatctcagtgaatctcaccatcatcctctcatgctgcagccccatgctattcccctccctgttgccatggcctctctccagcccctccatgccttccacatcatcttcctgccatccccatgctgatgactgggctgaggtcagaggcagctcccctctcccaggacgtgagacgattcaaacaagaccaaggaggattctgtgcttgaccatcaggaaaccctggctggactcactgccccttctgcagtagacatccaagattttctgattgccctggacccaaggccagcaccacagagactaccattagagaagttaagtagtcacgtcagcatgttccaaagacgtgatccttggattccacttcttttccttgaacctcccatgtctgattttataaaattctcttcatatcaaatcttcaggaagtcttgcaggagtaaatgcagttaattgttctataagcaggcagggagggtctccagggattataagaatttaaccaacttgagcaatcagcctgttttacaagcttgctggtgggaaccagctcctggcataacccagcaacttacagacaaattaggatgaacattcctcattaccatgctaaagtctccacccaaggaggagctatagcctcattaccatgacatgtgaactatgtgctggcagaatcactcactgtgtatgggcaactgggactcctcctctacaagtgatgatacaccctctgccctctccatcaccacatagaatgttcttctcactttccatcaggaagacactgctttggagaatactcccagtggccttcttacttgaaccaagtaacaaaacttttatttatcaaaatgtacgttctcatagagagtctttgttactcaccagggaaacaagccctagttttttcagctaccagctctaacacattctgtaaagtccagcacagaaggaaggttaattcacaatgctattgctttcactttttaataattgggaacatatcagggcagatgtctttatgtagggttaaatggaaggtcaaggaggcaaatcatcaaccttggggagacacacttgcagagattatgactacacttgggattcaagaatatgagaccccaccagcagagtagcctgcaatgttcaaggatatccaagtagatcaagtattttaatgaaaaaacaacaggctttgtctttcaagatgtccatgaattgactttccagaagagaaggaagaagacctcattgtcagggcagaagagagaagaggagagggatctaggctaaatattgtaatcgattttgcctgatattgactttttgtttgtttcttagttcattttattttattttattttatttttttgccaagactggagtgcagtggtgcagttttggctcactgcagcctctgcctcccaggttcaagcgattctcctgcctcaacctccagagcaatttttgtattactagtagagacagggtttcgccatgttggccaggttggtctacaaactcctgacctcaggtgatccgcccacctcagcctcccaaagggctagtattatagacatgagccatcgcgcccagcctcttagttcatttttagagatgaagtctccctatgttgctcaggctggacttgaagttctagactaaagcaatgctctcgccttagtcttgccagttgttgagactataaatacacaccactgagcacagctgatactcacattttatgagctgtttccactccaattacataagggagtgaggcaattagtaaggataggagcatagaaactctgtctacatctctatttcaaattacctctgaaaaacagccttgtttttaaactaaaacttgattttggttaataaatgtttgtcttaaaatgcacttagaattatgacagagttgtcacttttgtctcagttctgacctatagtgatttcaaaagaagatcagtagactacttcaaaattctcattattcaaagttattttggatgtaaaattggctgatgtgagataatttagaatatagggccagccaggttacccaaatgaatatctgggaaactgagcacattacatgcttatcacacatccccactgagttagaaaatatgactgtattagtcaggatcatcaagagaaacataaaagatttaggtagacacagatagatagaaatatagatacagaaggatttatcatgagaaactcgctcacgcaattatggagtctgtgaagttccataatctgccctctgcaagctggcagacccaggaaagctggtgggataatttggttcgagtcccgatgcccaaaaaccatggaagctgatgatgtaaatgtcaacccaactacaggaagatgacataagatgtcctagcttaagaagtgaggcaagaaaaagtgatgaattccgcctttctctacttttcaatctattctggccgtcaacagattggatgagccccatccacactggaaatgcaacctactttacttaatcaaccaattcaactgctagtcttacagaaataccctcagagacacagccagaaataatgttaatctgggcacccacaggcccaggcaacttgaaatataaaactcaacatcatgatgacctatggtttcccaggtgcaccagaagatgttaccaaaatggcaccatcagccagaacccacatacattcaccaggtcagtgcatctctcagttcaccagagattcattttctttgtgacatcacgttcacctggagtgcagccaagaatcaggccacagctaataatgagaaaggaaggattcttcatttgcctttttacaaatgacagaaaaatttgccaaaatcctttggtaataagtagttatctcaaagacaaagagactcaaaatgaaaatgaaaaaaagtcagttacccttcccactgcccatgttcttcctccacatataaaaataggtattaagttcaccctttctggtgttaaagattttagtctaacccaatacctgtgaatctcagtgcacagatattaccagatttttcattacacagaaaatgacagagacattctcccactacagttgctattttgtggtgacaacttttactttcccacgattctttcgttaagtgacacacacgtgcaactggaaggatttactgttttcacccacagctcccacacttcacagctatgcaggagcttcagtacagcagatcctagcaccctggatagtacaagcgtgacttcttaaccacaatgcaatagcaaatatatggggttcagtgtcggtctttcattcagaatatactgttcagaattgtttaaaatagtaaatttagaaacaaataatatatcctgcagaactggttaaaataggattgtatatctttacaagggaattttatgcagtattttttaatgcaaaaaaagtacggttaatctcttcctactggcatggaatattaccgaaatatattgttaatgagaaagaagaatggtgtaggccactgtaagaatctacccaggctgctataacaaaataccacaaatgagtattccaaaacaacagaaatttctttctcccagttgaggaaacatcagctcttctcctccatactcacactcacacttctggccaccaaatgtgggagggtgctttcttgcagcaaccgattccagctgggtatcctaaaattcaattggattgtgacactaactggagtgaatgcagaccccacaggttaagggcttggtcccacaagactgtcagtctcaagtagcagatcattatctgtgcttttgaccaatgaactatagtttggaggatcccgtgacttcctcctcagtttgatcatttgctagaatggctcacagagcccagggaaacactttacttaggtttatacatctatcattaaggatatactaaaggtacagacagggagataatggggcaaggcttggaagggtcctaagtgcaggatcttctatccctgtggaattggggtgtgccaccctcccagcacagggatatgttcttgtgtactgtattcatttgttctcacactgctataaagaactacctgacgctgggtacggtggctcatgcctgtaatcccagcacttcgggagaccaacgtgggcagatcctaaggtcaggagtttgagcccagccttgccaacatggtgaaaccctgactctactaaaaatacaaaattagctgggtgtggtggcacaggcctgtaatcccagttacttaggaggctgagggaggagaatcacttgaagccgggaggcggagtttgcagtgagcctataacatgccatttctctccagcctgggcaaaaagagtgaaactccatctcaaaataaaacaaaacaaaacaaaacaaaaaaaactacctgagactggataattgatgaagaaagaagtttaattgactcgcagttctgcagtctgcacaggaagcatggctgaggggagctcaggaaacttacaatcatcgcagagggtgaagggaaagcaagcacatcttcacatagcagcaggaaagagtgaagggggaagtgctatacacttttaaataaccggatctcgtaagaacttactcactatcacgagaacagcaagggggaaatccgcccccatgatccaattacctcccaccaggtacctcccccaacattagtaattacaatttgacatgagatttgggtggggacacagagccaaaccatatcattcaccaaatccagaaacttaccaaagtctctctctctcctcttggggtttatggaggtgtcactacgttggcatgactgatgaaattattcgccactgctgatcaactcaaccttcaatcccccttccagggggttagctggggtagcaatggatgttttaaccctctaatcacttgctcagctctgctagcaaccagacccctcctgagactacacaggtgccactcgtctcattaatgtacttcattagacacttattcagaaattttaagagttttaggggctctgagtcaggaaacaggcaggaacattaaatatatgctatatatttttttagagatgggatttcactcggtcacccaggccggagtgcagtggtgccatcatagctcactgtacccccacctccggggttcaaggcatccttctgcctcagtcttccaagtagctgggaatataggctgtagccaccatgcccagaagttgcatttctcattataaatcacaatatcacaatcacagctctggacactgggaagttcaagatgaaggatctggcaggttcagtttgcagtgaggtctcccttcctggcttgctgacagttgttcccccaccactgtgtcctcagatagtggaggaagaagtaagctctctggtgtgtctcttgtttttttgtttgtttgttttttgttttttgttttgttttgtagagatggcatcttgctatattgctgtattaggctgttctttcattgctatgaaataattcctgagattgggtaacttataaagaaaagaagtttaattggctcatggttctgtacgatgctcaggaagtatagccctggtatcagcttctaggaaggcctcaggaagcttataatcgtggcagaagatgaagcgggaacaggcacttcacatggggaaagcaagagcaagagagagttggaagtcgtagggggaggtatcacaacttttaaatgaccagtctcagaagaactcactcattttctccaggacagcaccaaggatttggtgctaaaccattcatgagaagtttgcccctgtattagttctttctcacattgttacaaagaaacacctgaaaccgggtaatttataaagaaaggaggttaatctagctctcagttctgcaggctttacagaaagcatagcagttcctgcttctggggaggcctcaggaagcttccaatcatggtggaaggcacagggggaacaggggtctgacatggcaggtgctggggcaagagggcaagggggaatgtaccacaatttgaacaaccagatctcacgagaactcactcactatcaggagaacagcaccaagggaatggcgctgattcacgagaaatccagccccaagatccaatcacttcccaccaagcctgcctccaacactggggattatattccaatatcacatatggatggggcaaatatccaaactgtcccagttgcccacaatgatcttgagctcttggcctcaagcgatcttcctgcctcaggtgcccaaagtgctgggataacaagtgagagtcaccaacccagctggtggtgtctctttttataaggatactaatcctcttgaatcaaggctccacctttatgatgtcatttaacattaagtttatccttataggctctccctccaaatacagtgagactgggggttaggactacaatatatgaatttttaagggacataattcagtccacagcaaacactattattttagtttttaaatagagcatgttactgaggggggacatagaggaattatacgaagaaatctgtataaatgaggaaaagtgagtatgcttatatgtactaccacatatatgcttagattcagtatatatattatagaaagagtactaaaaaactgaataattattcttcctggaatacaaacctagcctcgataaacaaaggtaaatgaagacatctttttcactagatacccttttttaataattgagtttacattttcaccatatgaatgtatatgcattctacatatgcatatgcacttatgtgcatatatctatattcgtaaagatgcatatatttgttaaccacagactccctactattacaacattcaaacaaaggagaagcaatcaagtaaaactaaaagaaccataataaggcagcactggatgacctggaaggctgagggtccctgagcccaacacccatcaccctacagctgggaatcagacagtgatggagctatccctcactccatctcctgctctcttccttctccagtccagccacctggtcacagagtgaggctctaaactggcccgtattacatgtgtctgtccctccccttctcacctcggaggaagagtgtgactatcccaagtcagcaggtagagtaagacagagcgtgagacctgctagctgaggagctctaagaaccttgtgctttgaaagccgatctgctttgtggtattgaaatcctctgagtccattacctctttattacaggaaaggtgtgtgaaagacccaggacgtgtcactacaggacaaaagatctggatgttcaaccacaatcaaagctcttgagatccagcaatttccttgaacaatttttctaccacacacacttctcaaaatatagtgcatacccatatttaggattgtggtagagggccattacatgatcttgactgtatcaataaaagtctcagggcaaatctctgggggattcagtgcagatggcctgccagttggatgtggaatctgagcaaattatccttatattctgctactcatctccaaataacaggcttgcatcaaacggccatctatctcagacactttgcaatctatgagtctgcaataaagaatgaatgtgtctgtgtgtgtgtgtgtgtgtgtgtgtgtgtgtgtgtgtgtgttttaaagaggcatatatgtggttcacttggtttatgtatgtgagttacttgattgcttatatgggaatattctgaatacttgattaattgaataaacgaaatataattacatcatgtacaaaacttttcatagtttcatctgcttgatcattattcctgtaagactccatagtaatatctaattgtatttttagtgaggaagctattttggcctgaccttcaaaactgtctttgcatttggtaggacaaaagactagcaaaaaaaagcctgaggggttattttaagtattcttatgaattagtgttcctcagactgtctgggttagctgacttgtgaaaaaactaaagggacaggatactcagtaagtatgaatgtaacagttcactcctcagtatttctggaacaggaaggatttttcctcatgcccccaactgcctctagccaaacagaaaagcaagaggacaaaattctttaaatcttaaaaggaagctatgggtaagcagtgacatatagaaactagcacataggtcatcaattttgtatcactgggatactcataatcaatccctaatgactaatgaccaattttcgataataataaactatataatcaaatattatacacaaattcattgatagtgttttctgccagcctgtaagtgccacacctgaaaaaacttcaaactttagtgtagtttccatttggatcacctgggggaagttttgcactatggatccgtgggctccattccggatatactcatacagaacgtctgcacatggagctcaggattctgcattttcaagcatttcctcaagtggttctgaaacaacctgtctccagcccaactttgagatccattttttaccaaactctggcttcagaagccttcatgtacatcggaagtaatctcagtgtggggaaattccaaagcacaggaagcgatgataccatttgcattattacccagatgattctagctacatacacctattatccagcatttatgtcttgatatgaggcttctattcagttgaccctattgatatccaagtgtacacaactgacctgtcaggctatagcaacacttcacttatatgtagggagaatttgtgcagggcttagctgaagctcatcatggggtatgaattgacttggtcttattgctataacccttgggttcagaagacactgaacaaatgcttaagaaactgttttaggttaatgaatggggatatatttaactcctcagatagccaaagaatcaagaagaagggattgagctggatggcccaatagaagtgtccattgattgcacccccacacataccagcagaaacaccacatttaacaacaactatctacacacaaaaaagcacctacataggaaatgaaaatcaagtcaacaatcatagtacctattttaacttcatatcactgaaagaggcactgaagaggttaggaaagacaattttgaatcactgaggccaccactcccccatctcccaacagccaccacatggagctgagacagaatctgagtgcatgggggagggagagtttagcaattgtggaaatctgcattgaactcagtgctgccctgtcacagcccatccacagaaggagcatttagaccaccttagccaaaggggaattgcctatcccagcggtcagacactgagtttgggaaagctttgccacagtaggctaaagtgctctggggtcctaaatatatttgaaactcaatctaggccacaagaactacaactacaaggcaagtcccagtgctgtgctgagctcagagccagtggacctagacaccactagtgtgacacttgtcagggcagctaagggagtgcttgcacaaccgctcccccaaccccaggcagcacagctcacagcaatgaaagtgactccttccttctgcttgaggaaaggagaggaaagagtaactaggactttgtcttacatcgtaaagatcagctcagccacaataggatagggcaccagtcagagtcatgaagccaccatttcaggcactcgctcctgaaggacatttctagacacaccctgcaccagaagaaaacccactgcctagaaggaaaggacctagtccttccaggattcatcacctgctgactgaagaaccctcaggccctaaataaccagcagcaatacccagtagcacactccatgggccttaggtgagactctgagatatgctggcttcaggtgagacccaccatacttacagctggggcagtcatgaagggacaattcttctgcttgagaaaagcagagggaaaagtaaaggggactctgtcttgcagcttagatagcagctcagctacagcggggtagagcaccaagccggctcttggatccccaattccagatcttggctcttggctggcatttctggacctgccctgggtcagaggggaatccacttccctgaagggtgagtcccaggccaggcagcattcaccacaagctgactgcagagctccggggccttaagggaacattggcagtagcctggcagtattcctcttgagcctgtgttggaggtagcagtggggagaggctcctctgcccatggaaaggtgaaggaagactggaaggactccatctcatggcttgagtgcaagctcagccacagtaaaacagaacaccacgtaaacttcccaggttttttactttggtccctggctctcagacagaacctctggacatgcctgggcctagaggacctcatgaccctgaagggaaggacacagcctggctggtattgccacctgctctaggaccttgtagagctttagggcctgaggcccttacttccaagaaaggaataactcttttctagtgagctgaactgtaaagctcataacacaagtaggtcctcagtgcatattcacttcctttccttcttacctgaggtgctgcagtgtgaatctgaaggtggcaggttcaacactaaagtgacggactgcaagaaagttatggtagactcagaaatctgttcttcaacatttagactgtatttatgctggctggattttctgtttattcacctattattctctacccctgtcagcaaccaagaaactcgcagcccatctcacgctgtcttaaagggaaccaagaagttttggactcttggcctgcaggaagcatgcagcgcggcgccccctgccggccaatacaacggccacgggaactggcagaccactgaggctctgggcggggcggagttgccccttctcctcccacttctctagcagcggcttcttctggtgacaccccgggagccacagggatttggttccctaaaggaagcggtttcccaccagggtatcgtccctaataccctccgaaggagtccattgaggagaaaggaacagaacgtctggcagaatgcagaaggaccctatgatccaggacatgtagcgccagccatcaggaggttttatgagagcagctggtgggaagatcagtcccaggagaaggggtttgtctagcagcttggttggagcaagccttttccagagaattatttccgtaattcaggctccctcccaaccctccactgccaccttatcctccaccaaaagccctgacactgtggcagggataggggacgtggggttggtggggaacaggctgtaagaaagacgcgggagcctatatgtgtctgggaaaaatgaggggtccacgtgcaagggaagaagcatttacaaagaagactttgacagtgctgcaaagatttgaaggcgcagggtgcaagtcattcaggtgccggtgtcaggaggaacctagccatccaggtgaacagatgcccccttcttgcagcccactcgcatgggcctggtggactccttcttatttttggtagtggcagtgaagaggtcgggtccctgcgctggcaaagcagtcagtgacattgacatcatgagtactgttgcggcagctgcacatggaggggctgttggtacagggcagtggtggagttctgcagaaatctgctatggtggtcagattctatgaatgaatgtgtggatctgctcgcatttacccctatagatcagccaactgcgcctcatcatcacatcacagtatcggtggtgtcctctagggacccacgacctggggttgtctatatgtcgtgttaagaagggcagggctggagtgaagacagttaggtccaaaaggaggaagaggaggagggtccatatcagattcatgtttcttgtgaaagcatttcaaagaagagcagagtcaaaagagcaagccatggtcccttgtcctgttcctaagaagtcttggcccaacacttagtgttcgcagttctcccctcctgccatttctacacttattcttcgtgtactcatggcaacaagtgttctcacatccttcttccacctccttgtcaataacggagatggctaccaccctctcaaccctttatgggattatcctatgtacaaggttatttccaaaccccaaagtgattcttgctccttacctaagcagaccagttaaactaaaaactttcatctctgaggtgtttgcatctatcagttcaactgccactcacccatagccttgagatgaggcaggcatgattgccaacccctttttagagtgacttaactcagaagggaattgacagattcatatgacctgcatcttagaaaatattttcacttccttaaatacaaatgtctgtttaaacgctgtttttaaaaatgagagcatttcaattttaagggagtagagtttatgtttcccccacatatttctctgcctcaaaataaagattcccaactcttccatgtatagagcctatcttccagaaatgttctaattcttggtgctcagggattctgggtgactgtgtgtgagccttctgtctctagctctaatatctgactctttttttaaatacctgggagttccaggaaagggttttctgcagagcagatgacatccacagagatggatatttttctctcagaggttgatactcctagtagaaatggaatccccgttgcctctctccttcctctaatcttgtagaaatttcattgtggatattttcttcccagaggttagggtgcaggccgtatggaaaactctcaggcctgtcaatgattttaaacagattcccaggtaatgctaattttatgcttactatttcacacctgaaatattcaccagcatcacacagagtgcctatgacatcactgcaaatatgcagaaacttggggtttagtgtctatcataagcttgctactggagcttggcaaatcaccttatccttctactcctcatcactaaagtgaagattatagacaaaagatctctttcagctctgacattctgtatttttctatacattactgtgtgtttgggttcatgtgtgattttgtatatatgcatattggtttatacatgttcaggttaggagaaatacttagtttgcaaattgagtttccatttcagaattgttaatttaattaagtgtagtttttccttaaagcagttattagcaaggtcaaaaaaattgaatcactattatgtaaagattacagcataatctgtttttgtctccaccattaaagttatacgggttttttggtgtttgtttatttgtttttgagactgagtctggctctgtcactcaggctgaaatccagtggcgcaatcttgactcactggaacctccgcctcccaggttcaagcagttctctgcctcagcctcccgagtagctgggattacaggcatgggccaccatgcctagctaatttttgtatttttagtagagtaggggtttcaccatctttcccaggctggtcttgaactcctgacctcatgatccaccagcctcggcttcccaaagtgctaggattacaagcatgagccaccgtgcccagccatattcatttatttatatttatttttatgtatttatttattttgagatggactttcactcttgttgcccaggctggagtgcaataatgctatctcggctcaccaccacctccgcctcccgggttcaagggattctcctgccgcaccctcccaagtagctgggattacaggcgtgtgccaccacgcccagctaattttgtatttttagtagagacagggtttctccatgttgctcaggctggtctcgaactcctgacctcaggtgatccgtccgcctcagcctcccaaagtgccgggattacaggcgtgagccactgagcccagctgaaattatatatgtttttattgaaggagaagctacttggaactccagtctgtatttcagtaaggcaagggaagaaattagtacgtacgtttctcagaactccaaaatcagctaaatttagggacctgttaatgaaggcaataggaggagttgcgtatacagtctatcaacaaggtgtgatgcagtagatttcatagtttttctgtcttaataggtctcctgagcagaaaggcctcaaaagccttttatataattaagcaaaactgactaatccatggcaagaagctgagttgagatctaatacctagattttaacatccttgacttctatctgctttataattggccaagttgccaagaaaagagaaatgaattcttttttttttttttttgcttttgagatggagtcttcctctgttgcccaggctggagtgcagtggcgtgatctcggctcgctgcaacctccgcctcttgggttcaagcaattctcctgcttcagcctcccaagtagctgggattacaggaaccccccaccatgcctggctaatttttgtatttttagtagagacagggttacactatgttggccaggagggtctcgatctcttgacctcgtgatctgcccacctcagcctctcaaagtgctgggattacaggcatgatccactgcacccagccagaaatgaactctttttgaacttcatgctcagttattcttgtttaattcacacaaccattctgacaggtatttattattatgaccacttctgtggatttcataatttcttgtgtttatagcctcacgtaacaggccatgtgtttataatatccagtctgctggtgatatggtttggatctgtgtctccacaaaatctcatgtcaaattatcgtccccagtgttggaggtggtacctggtgggacatgattgcatcgttggggtggatttctcatgaatggtttagcaccatcctcttggtgctgttcttgtgatagtgagttagttatgagatttgattgttcaaaagtgtgcagcacctcctccctctctctcttgcttctgctcccaccacgtgagacacctcgctccccctttgccttccactatgattggaagtttcctgaggcctcactagaagcagaaaccactatgcttcctgtacagcctgcagaacagtgagccaattaaacctcttttctttataaattacccagtctcagatatttcttaatagcaatgcaagaatggactaatacagctgttatgctctgtttgtccgagtactatgaaaaaagtcttattactcataagcagtagagctgtaatgcaaaacgatgtcctgtatcttaactttttgaagagaatatgtcgcagacagcaggataaggcaagatgcagaaatttattctgcaaaaaaaagtgtccttattctgaagagacagatgccttcatagtgtgagagactaacctagtcctccaaagataaccaggaagaaaaaaaccacactacctaaagtaataagtagttgtgattagtggcagttatggaagaatgtatagctcagccaacaaatatttaccacatgaggagatttagtttaaggcaaatacatttgcttaactgacaatgtattctaataaattgaacacagtaggatgtttttacggaaagatgaaaacttgccacgaaagcagaaatgagactatatagagcagtttcacaggatttgcccaacactgtctggaggagagagaccctgtatctgacagcctttagctttctggtcattgtggcatgggctagttcataaagctcttctggggcattgatgaaacatccctcaagaccacttgcttctctttactctgattaaataatcttcatacagcattttgataactggtctatcctcaccagtactactgtgtattactagcacagaagacaaaatattgaaatagagagtcttcagaagtaaactatgaacaatggcgatttagtaaatctcataatgctggcgtttctaactggtgaggaaataatgaattgttcaatcaatagcacttagaatattggtgatccatttaaaaaaataagactatatccctctctgataacacagagtttttttgttctgttttgttttgttttgttttgctttcttttttgagactgactctcactctattgcctaggctggagtgcagtggcttgatcttggctcattgtaacctctgcctcctgggttcaagagattctcatgcctcagtcttccgagtagctgagactacaggcatgagccaccatgactggctaatttgcatttttggtaaggatacgttttcaccatgtttgtcaggctggtctcgaactccttacctcaggtgatccatcccactcggtctaccaaagtgctgggatttacaggcatgagccaccgtgcctggccatcatagaattttaaaattggaaaagaggaaacaaaactgtcactatttacagatataatagtgtacattgaaaaatctaaaaacaatgtgtcgggactcagaaacaatacttcaaactgtggtgctttggaatgaggagcactctgggctttttctgttgcttgtttttaaattttttaacaatatttgtgtgggtacaaatttggtgtatatatttatggagtacatgagctattttgatacaggcatccagggcctaatcacatcagggtaaatggggtatccatcccctcaagcatttatcctttatgttacaaagaagccaatcatactcttttagttattttaaaacgtacaataaaattattattgatgaatgtcaccctatatttgtgctatcaaatactaaatcttattcattctttttttttcttttttttattttaattttttttgagacagagtcttcctctgtcacccaggctggagtgtagtgccgtgatctcggctaactgcaacctctgactcctgggttcaagtgattctcctgcctcagtctctcaagtaactgggattacaggcatgtaccaccatgcccagctaatttttgtatttttagtaggaacgatgtttagccatgttggccaggctggtctccaacacctgacctcaggtggtctgcccgcttcaacctcccaaagtgctgggattacaggtgtaagccaccacgcccggcctaatcattctatttttttactcattaaccattcacttccctctcaccctccaatgctaaggtctttgaactaaagaaaatgaaagggtgttagaatcagcctcagaaccacggactttcttaacttctcctgttttgcccccaagtgcaggatgaaactcttcctctctgaagttaccttatccgaagctcctccagaaagaatccagtggtctttggtcagctccctgagactttcttaaccagggaagattaaactcatggcagaaggtaagactgagggatgtcaccacacctaagcagactttgtcagaagctgttgtctattctttgtcataatccaaagagtttccaaagagaataattcacaaactatggtcaattctttgggcccattcaactctcctaaaaacaatttcctactcctcaaaattgcctacattcccccatctctctctctcctgtgaagaagggtatatagattctgaacctcgctgggttactgggtagtcactctctcgtcattcccccatgaatacaataaacttgcctttttctccagtgaatctaccgtcggttaatttcagcaaactcaaaccttaaagggaaagggaaattcccctttgcccctaacatgcaaattaattatttagattaataattgctagatataaaattggcatatggtttatttatttttatatttcagcacaggggagggaaaaatgacttccttccacccttttaggttttttgtggctgggctacaagttaaattacataagacggattaacacaagaaaaactgtattaaagtatgtgtgtatacataggagtcccacaaaaatataagactcaaagaaaggccagatgaataaagcttatatagcatcttaagctacagaaagaaacagaggcttggggcttctggagggtggtggtgcaagttaccggagcgtgagaggaggaaacatatagtaaatacatggtaaataaaggttgccttgttatgcagataagagtctctcaggggataaaaattgccttggagcagctctcttcctgatcaaaaacacctttaccagtgaaaatttattgtatacatctgaatttcttttacaaaagggcagcttttcagagctaactcctgtgcaggcagtttttctaaataaatagttaataatcaatatgctagagaggaatattttggagtggtgcattctgagccctaaccccagcaacaggcagaaactgaaatgttaaaatgatacaatttgcaatactattaaaaatattaagttcataaggagaaaaattgggaaaagataaagaactttatggacaaaagtacaaaactttattgtgagacattaaggtaaatagaaaggtatagcatgtttatagattgtaagactcactaatttagatacatcaatttttctgcaaatcgacctatagattggtaattgcctgatgggttgttcctgcctgctgcacagacaaaatcagttcactgagaccacggagacagagtttttactcaaatcactctcccagcagtcttggagactaggggttttttggttttttcctttttcgttttttgtttttttttttttttgagagaaagtctcactctctcaccaggctggagtgtagtggcatgatcttggctccctgcaacctccccctcccgggttcaagtgattcccctgcctcagcctctgaagtagctgggactacaggcacgcaccaacacacctggctatttttaggtattttagtagagacggggtttcatcatgttgaccaggctgatctaaaactcctgactttgtgatccacccgcctcggcctcccacagtgctggaattataggtgtgagccaccacgcccggccaggaagttagggtttttcaaggatagtttggtgagcaggtggctagagaatgggtgctgctgactggctggggatgaattcatagggatgtgaaaaacaatcctcgtgggctgagtctgcctctgggtggaaccacaggactggttgagttatgagccctggttccataggttgccggaatgcaaaagtctgaaaaaaaatctcaaaagaccaacctcaggttccacagtagtgatgttacctataggagcaattggagaagtgacaaatcttgtgacctctggccatgtgacccttgagcagtaagggattatagaaaatacattttataagaattcaggcacatctcataatcctaactttgcagactttcattagttttacaaagttttgggaagtgctactatcatcctcactttaaatttgaactataacttccacccgaagtagcttggcctatgcccaggaatgaccaaggacagcttggaggttaaaagcaagacagagtcaactatgtcagatttctcttactgtcataatctttgcaagggcagtttcagatttagaacaattccaatcaaattctcaaccaagtctttgtttacttattttgggaacttactgattctagaggatatatagatgtataagaatagcaaagacacctccaaaaaaacaaactaaaaaacaagctgagagagtttgttctaccagaatatatataaaatggaaaacaatatcttgttacataaaagcctagtattgctcgttgacgggcagccttgttccatgtgttattcagagacacagattacttccatcttctgattctgtcatctcctcatccatttcatatagctggcaaacagaatagaaggtggagaagcacactttcttaactgccttggccatttttcactggcatcaccttcaggtagggaactatagttcctacctgagctgtcgcttctcagcatcaactctacaccatgcaagggtgagcataagcctgagggcagctagttactacagctacagcaatgtaaatggtgttgccagtttcatctttgtcacagatgagataagaacagatgcaatacagttgaaatatgaaagtagagagaaatctaacacagagtttcccaaaaatgagttagatgagacccaggaacttgtacaaactctcatcagtgattgacaccagtgtcaacaaacttgcaaggagaaaaaatggtcagtcccaaaactggacctaaaacactttatcttcttattagaaaacagcagcagcattaataatactatactgcaatatcatatttagacttatgggccagagaagtgggatgtggaaattagcaatgagtcctagaaggactatgataattggatattggctgctcaagagatgctgagtaaccaaaagaagagctaacatgcgggacagcctaaaaatatcatgtgagcacacatttaaggaagtctaccctgtgccacaacggtgctgggagatggacacaaagataaccaagacatagcccctttctctcaggaactgtcagtccagtggttctggtaccagagggggaggacccccccttagcaggtgcaaaggtgggtaaagtgatgatggagctgtggcccactagaggatgttgcaagtacagacatcgggatggggaatactggttgtgtggagatgagctagtctttttgaaaatcatattcctgttttatttgaaaaaccaatcctccaccttgctcccgtctgtggcttggatggactggctccaccccagctccagtaatgagctactcagtgtgtgtgtctcattagatgagatgggcacttgtcccagtcagagacctttgctaggaatattgggggatgaaggcaggacttcatcttgagagaatggaagatgtggagttgctgctgtcatcttacagatatacaaggaacatctgcctgatagtgggactatgatagaggagaaagaaacaggaaaatatagagaaaccatgtactgttttcatcatctaagttctgataagctgctcattaagccataacagtgtgttatggcttaggatagtttaactgtacattcaggttcttaggccctcagaagagatcaagttctcgggggtaaggggtttcagttgtgctaagtggccgaaagaagattctagagaattttgtcttagaaatccatgagtgtcatttattcatttccatactggtagcctttaatttaatataatttttatttatttattattattattatttgtagagacaaggtcttgctatattacccagaccattcttgaactcctgggctcaagtgatcctcccaacttggtcgcccaaagtgctgggtttacagcatgagccaccatacctagccatgggtaacattttaaaataaagtagtcaaaatagatctccttgagaaaattattattattattattattattattattattattattatttgagatggagtctagctctgttgccaggctggagtgcagtggcgcgatctcggctcaccacaacctctgcctcccaggtacaagtgattctcctgcttcagcctccggagtagctgggattacaggcatgcaccaccatgcctggctaattttgtatttttagtacaacaggggttccaccatgttggccggatgatctccatctcctgacctcatgatgtgcccaccttgctctcccaaagtgctaggattacaggcgtgagccaccgcacccagccgagaaaattatttttaagcaaagacttagagagagagaggaagttagctatgcacattgtgggtgcggtgtggttagggtggccctgagatagggatatgcctggtgtgtttacggaacagctaagaggccagggaactagaggaaattgagtgggaaggggaagagtaggagattagttttgaaaagcaaatggtttgggaatatggatcatgtaagagcacatgagattttataaggatttcattttactcagggtgaaatgaagaagcactaaaagattttgagtagagtttcatgatctgacttatgttttaaaaggaccctctagctgcttgggctatcagtggtggaagcaggaaggccaatgagaatgcttttccagtaattctagcgaaaggtgatggtggctcagaatggtggtagcagtgaaggccatgagaagtggccagattctgtgtgtgatttgaaggcagaaaaagacttccctgacaggttggatgtgggatataagagaaaagaaggttattcaacaattagagaaaatggacttaccttctcttgagatgaggaatactgagggaggaacaacttcgggggaagagtaggaaaagatgatcagtgtttcctggggacatgctaggtttgatatacttattagacatttaagaagaaatgtcacatagaaagttgctgtacaagtatagggttcaggagagagaggtgtactgaagatttgggcattgttagaaaattaatgatattaaaagtgtagaggtagaaaaagtatgatatctctcctctcccctcataagggtctgacactcctatagcaaaagacaggttaacaagagaaaaacataacaaatttacttaaagttttatgtgactcagaaaccttcagaatgaagacccaaagacccaggcaaaactgtctagatttatgctcaggttcagtgaaggatggacagccatgtagcaatgtaattggacaaaaagggtatgagttgatagtaataggctgagggaggaacccagcacggcctgtctgtttagatttttcttggactctctgtataggaattctccctcccagctatacagcaagaccccctctggaatcagtcttatgacctactatcagacaaggtaggtcaggtaatttctttatggccagctcctacacagaatggcagagggaagactagagtaatatttctagattttatgggtgatttggggagaggggagcaagagactggaagacaggagaaggtcagagagaccttggttctggaggctacttcacggaaagttaagcctgttggggagaaatgtcttactccaagtgcaaagcttccctcatgaccactgttgatggggtggaagagtctggggaattcattgaagagatatccacattactggatctagagaaagaaaatcttgtcctggaggtgaacaggaagagggtccacatctgtgtcacgttttcatctcagtggagggaataaggagaaggagagtagggcattggtgtctcaatgcccggagatattgttctcctcttaagcataccccagacctcagtacttctcgcatttgtctccatctctcttcgctcctctaaggacccatctgagctattcactttaccacatcctccttccctcttacacattcatctccgtatcactctcttttcttttctttctttttttttttttttttttgacatggagtctcgtcctcttgcccaggctagagtgcactggcgtgatcttgggtcactgcaacctccaccttccgggttcaggcgattctcctgcctcagcctcccgagtagctgggattacaggcatctgccatcatgctcagctaatttttgtatttttagtagagatgggatttcaccatgctgaccaggctagtatcaaactcctgacctcaactgatccactcaccttggcctcccaaagtgctgggattacaggggtgagccaccatgcccagcccctctctcttttcttccttcccatttcactactctggccctgcaggttttcttggaagtttagagagattacagacacactcatcacattttttacagctttaattgaggtataatttacaaataaaacttgtatatatttaagttttacaacttcatgttttgatatacaaaagcactgtgagataatcatcacaatcaagctaattgacatatctgtcatctcacatagttaccattttcttttctttttcttttttttcgtggtgagaacacttgtggtctatccttttagtaaatttcaaatgtgcaatacaaaattgctaactctattcatcttgctaaacactgcatctcctgacccatctcagttttgaattgtactaatagaatacacatagtactaatataattctcaaagcaaaaatatattttctttttttttctttttctttcttttttttttttttatgagactgagtgtctctttatcacccaggctggagtccaagggcgcgatctcggctcactgcaacctccacctcccgagttcaagcaattctcgtgcctcagcctctcgagtagctgggattacaggcacccactaccatgcccggctaatttttgtattattactagggaagggtttcaatatgttggccaggctggtctcaaactcttgacctcaagtgaacacctacctcggcctctgaaagtgctgagattacaggcatgagccactgcgcccagccacaaaaagatattttctaatactcagttctatcattaatttttttagtgtgcttaacagatcactctaccattactcttcctcagctggaaagtgaggggttggtataaatgtctttaggagttccttccagctcagactatttagaaatccgatactctggagcataggtatgtgtgtatgcatgtgtatgtgtgtgtgtgtgtgtgtgtgtgtgtgcgtgcatgtgtgtgtgtaggaaaaaatgtaaaggaaatttggttgatatttttgtattgttggtctatgtatatctgattttcctaaatcattatgaatttaggcagaaacaggcataattatctgaaataaaattattatatacagattacatcattatttttaaactatgaaaaaaaaccacgcttgtaatctatcttattgtagagaagatatgaggtcctgtcatttagaactgtcatttaatggagcaagagaaaacattagcgcaaacactatgggatgagctcaagcccctgagatctagattagaggactggttaatagcctgggagataacactcagtcaacaaacaataatgtagtcattcctcttcttggctatctcccttcccttcacctacctgtagtctaataggtgatcgggggcccaaaactcattacatccaagaggaagctttgtttggcaggtgctatctagccaagaaaatctcagcatcactgaacatttacatacattgtaatttttccctaagcattggaaaaaagaaagaacccaacaccacatgggggtcgccatttcattcaaggcatttttattaaggctcaaaacaggactgtcttgtaggtaaccctcgcttctactgttttagagacaccgtagactttcacctgtgctcaggatgcagggtgtcccaccaccagacttactaagtttgtgtatttgtgatataagaaacaaagaatgttagcatttccctggtagaaaagagaagataagtgccttgtttgaggtcccgtgttggtgaatagcagagtttgtgaagtgaaactctaatctttttttaagtccattactttagatggacaaccaagcttgttcctcttaagggaaggatgtgagccaaataggagattcaaagagatggagtaagggatgatgctccatgaaggaaaatatctggtttcaaaggaagagcatgtcttgacagggtaagagaccaagaatccctttgaagaaaaggtaccatttactaaaaaatatcagtcatagtgactatagttgagaaataaatgaacgctcacaaattgagaaatgtaggcaagtaggctattgacttcggcaagcccgactctctatctcagggtttcccagacatcaggcatccctggaccatgcccccattccatttgtactattgactaatattatctgttttattcactcttgcatttatacaacatggtcctaagcaataatatgcataacattatggactaatgtgttaattattcactcccattaaaagaaatgcataacagtgaacaatttttactatttacatgtactttctaacatcagtaacttcactttccacctgttgtacatatttcataattttgtgttcagtttcatctatggctgtaaattaaacaattctaccttggaaaatattttcacagaagaataaaggatccaaggacagtagaaaaaaatgaagctcaaggtcaatgatttggccaagttcatcaaattctgtataaaagagactaaatcatgcaagtactgcatttttatcatgaaaaggtgctctaactgtttgctaagacagttcctcaaatttaccaccaaattgatggaaaacctagttttcatgatgatctagttccctttgttctgacttcacaactaaatgcaagatgttaaaacgtgatttcttctatctcagattgggaagggtccctgagaaacagcggccctgtcaaaatgacttgctgtccacctaagcagcacttgatcaaaaggagacaaaaacctgagctctagttctaatgccttcactatgggaaataaggaaaggaaacaagcatactgtctcatcgtaaataccacagagaagatagcgcagtaatggaaactacgctaacaccttgatgtataagactgatcgtcctcatcaagacttttttttccttttgcaatgttttatgctacatatttaattatttcatacatacacacacacacaaattaccacattaaacttcccctacaaaccaatgtatgtgttgttgtattttacaggttataaaacagaggcatagcaaggatgaataaccgtccaactcttttgttgttgttgttgtttctttttaaagagacaggatcttactctgtctcccaggctggagggcagtggcgcagtatcggctaactgcagactctgactcccaggttcaagtgatcctcctacctcagcctcctgagtagttgggattacaggtgcactccaccatgcctggttaatttgtgtgtgtgtctgtgtgtgtgtgtgttttgtttgtttgtttgtttgtttgttttgagatggagtctcactctgtcacccaggctggagtgcaggtgatctcggctcactgcaacctctgcctcctgagttcaagcgattctcctgcctcagccacccgagtagctgggactataggcccgtgccaccacgcctggctaattttttgtatttttagtagagacagggtttcaacatgttagccaggatggtctcgatctcctgacctcatgatccgcccacctcagcctcccaaagtgctgagattacaggcatgagccaccgcgcccgacctaatttttgtggttttggtagaggcaggatttctccatgttggccaggcaggtctcaaactcctcgcctgaagtgacccctctaccttggcctccgaaagtgctgggattacaggcatgagtcacagcacctggccctgtacaactcttatagtaagagcctcaaatagaaaatgtcagagctggtatctggacaagactatacaaaatctatacccgacatcgctgtaacacaaaacttatataacaacttcatttaaagagacactaacctatataataattcattttgtgtgagctctgaaatcttagcaaatgcatctgtgtgctcaaaatgcaatggggatgaacagaggatgtttaaggggtacaaatataagaaatgatataagaaataaggcctagtgtttgatagatcaggaggatgactatagttaatgataatctactgtatgcttcaaaatagctagaagagaataatttgaatgtttctaacataaagaagaggcaaatatttaaggtactcgatatcccagtttccccgatgtgatctttacacattatgtgaatatattaaattatcacatgtaccctgaaagtatgtacctctattatgtatcaataaaaagaaataaggccaggcgccgtggctcacgcctgtaatcctagcactttgggaggctgaggtgtgcgaatcacctgaggtcaggagttcaagaccagcttggccaacgtggtgaaaccctatctctacaaacatagaaaaattagctggacgtggtggtgcacgcctgtaatcccagctactcgggaggctgagaaaggagaatcatttgaacccggtaggcagaggttgcagtgagctgagatcttgccactgcactacagcgtgggtgacagagtgagactccatctgaaagagaaagaaagaaagaaggaaagaatgaaagaaagaaagaaagaaagaaagaaagaaagaaaggaaggaaggaaggaaggaaggaaggaaggaaggaagaaagaaagaaagaaagaaagaaagaaagaaagaaagaaagaaagaaagaaaaagaaaaagaaagaaagaaagattttaaaaatatgcaatgggacacgaatgcaattttccagtttcttaggaaacacactttatttcatccctcctaagacacacctctccataattccatcggggctctattcccatttcttccctttccagag

SEQ ID NO: 103 - DNA, 8923 bp, Homo sapiens
atattagatattttttatctgaacgtcatgctgttgctacagattcagtggagttggacagtacttttctcttcccgtcctttcccttccatagggtagcatttgctggcttacaaaggaaaagcagaagctttgctccactatcttgtcttgtcttgtcttgtctcttttctttttcttttttttttcgtcttctgttcagatagtctcactctgtcacccaggctagagtgcagccgtgttatcatggatgggttactgcagcctctaattacctggcttgagcaatcctcccacctcagcctgctgagtagctgggactacaagtgcacgccaccatacccggctaattttactttttttttctttgagacagagtctcactctgtcactgaggctggagtgcagtggcatgatctcggctcattgcaaccgctgcctcctgggttcaagagattctcctgtctcagcctccagagtagctgagattacaggtgcgcaccatggcacctggctaatttttgtatttttagtagagatggggtttcaccatgttggtcaggctggtcttgaactcctgacgtcatgtgatccacccgcctcggcctcccaaggtgttgggattacaggtgtgggccactgtgcccggcctttctttttttaaagacaggttgcaaggtggtggctcatgcctgtaatcccagcactttcggaggccgaggcgggggtattgcttgagctcaggagttcgagaccagcctggccaatgtggcaaaaccccatcctatgaaaaaatacaaaaattagccgggcatggtggcaggcgcctgtaatcccagctattctggtggctgagtcaggagaatagcttgaacccaggaggcagaggttgcagtgagaggagatcaagccactgccctccagcctgggtgacaaagtgagactgtctcaaaaaacaaaaacaaaattataaaaaagagaagaagctcaacaactgatatgtttttcccggcatgaatatttttatattgaggaaaaataaatcacttaaaatttttttaaaagaaagagggtatactaaaaatacaaaaattagctgggtgtgatggctctctcctgtagtctcggctactcaggaggctgaggtgggaggactgcttgagcctgggaggtggaggctgcagcccacaacattccagcctgggtgagaaggaagaccctgtctaaagaaaacaaaaacaaacaaacaaacaaaaatgagtggaattggccgggcacggtggctcatgtctgtaatcccagcactttgggaggctgaggcaggcggatcatgaggtcaggagatcgagaccatcctggctaacacagtgaaaccctgtctctactaaaaatacaaaaaaattagccgggtgtggtggtgggtgcttgtagtcccagctactcgggaggctgaggcaggagaatggtgtgaacccgggaggcggagcttgcagtgagccgagattgtgccactgcactccagcctgggcgacagggcgagactccgtctcaaaacaaaaacaaaaacaaacaaacataaaaagagtggaattgttccctttaaccctcaattcatatgttgaagccctaacctccaatgtgattgtatttgaagatagacctttaaggaggtaattaaagttaaatgatgtcatgagggtagggccttaatccaatttgattggtgtttcttttatttgtttgtttgagacagagtcttgctctgttgcccaggctggagtgcagtggcacaatctctgctcactgggtttgtgtgattctcctgcctcagcctactgagtagctggaactacaggcatacaccgccacacccagctaatttttgtatttttagtagagacggggtctctccatgttggtcaagctggtctcgaactcctgacctcaggtggtccgcctgcctcagccttccaaagtgctgggattacaggcgtgagccactgtgcccagcctgattagcgtttgtatttatttttattttttgttattttttaaaataatttttttttaaatttttgagactgagtctggccgttgtcgcccaggctggagtgcaatggcgtgatctcagctcactgcaacctcagcctcctgggctcaagcaattgtcctgtctcagcctcccgaatagctgggattacaggcatgggccaccacgcccggctaatttttgtattttttagtagagacggggtttcaccatgttggccaggctggcctccaactcctgacctcgtgatctgcccgcctcggcctcccgaagtgctgagattacaggtgtgagtgaccgcacccgatgtggttagcatttttataagaagagaagaaacaccaggaatatgtggtcacaaaggaaaggccacgtgagggcacaaggagaagctaccatctgcaaactgtgacaagaggcctcaggttggtttccaatcctgctagcacattgctcttagccttccagcctgcagaactctgagaaaataagtttctgttgtttaagtcaccctgtctgtgatattttgttatagcagactaatacctggccttccataccataagctcctttccctatataatttgcaataaacagaggcctggagaatggagacaaagctattctggagacccaggggtctaggctaccttgcctttgcctcatttcacacttcaggctatatgagctctatccccaggaaaattcagctcttgctatttggattcattaagtggagaatagaatgagatctgttttgggtatcaggccagaaattatcagcatcttggaacgtcagaaaataatggatcagtacccaagttacttagtctcaccccatacagtcttccaccacctacagctgggtactataacaacacatcctaagagaaaagaggctcagagacttctttagcctaagaacctctaggacctaactccccagaagccttagcgtcaggtcaagtaaaggagcacacacaggatagagagtggaaatgtttctgtttttttttgtttttttgagagggagtctcgctctgtcacccaggctggagtgcaatggcatgatcttggctcactgcaacctctgcctcctgggttcaagcgattctcctgtctcagcccccgagtagccgggactataggcacacaccacaacgcctggttaattttttgtatttttagtaaagatgaggtttcaccatattggccaggctggtcttgaactcctgacctcaggtgatctgcccgcctcggcctcccaaactgttgggattacaggcgtgaaccaccgtgcagccgggaagtgtttctttcactggaggggcagaggtagttgtgatgaccctactgtggccctggggagaagagtgagaggataacagtgaacaaggggctaagtgaagttcttagaagtagggtggaatgagtgtgagagaaagggggaagctagtgaggcttttctcttatgctgatgtaaagtaggtttccaatagaagaaatttataagtaatacagaggataggatgattaatctaaattggaccagagcagagttttgttggccccagaggttttaagattttgtttaggtaagatttgtgtttagtcccagcaatttgggatgctgaggtgggagaatcacctgagcccatgaagtcgaggctgtagtgagctgtgattgtgccgccgcactcctgcttgggcgacagagcgagaccctgtctcaaaaacaaacaaacaacaaaaaagaaaagataaataaacctagattcttattgcacaccatatgcgaaagtaaatttcagatggaataaagatataaatgagcataacaaaactataaaaacgttagaatcaggccaggcatggtggctcatgcctgtaatcccagcactttgggaagccgaggtgggaggatcacctaaggtcaggagttcaagactagcctgaccaacatgacaaaaccccatctctactaaaaatacaaaattagccgggtgtggtgacgggtgcctgtaatcccagctactcgggaggctgaggcaggagaatcgcttgaacccgggagacggaggtggcagtgagccgagatggcgcattgcacaccagcctgggcaacaagagcgaaactccgtctcaaaacaaaacaaaacaaacaaacgaacaaaaacggttagaagaatatttaggactctataaaatcttgggatggggatgtgcttcatttttttttttttttttttttgagacagagtcttgctctgttgcccaggctggagtgcagtggcgccatcttggtctcgatctcttgacttcgtgatgtgcctgcctcggcctcccaaagtgctgggattataggagtgagcccctgcgcctggcctggggatgcgcttcttaaacaaaatagcccagaatctataaagaaaatattattacacaaaaataaaatctttgggatgaaaaaaggcagcataaacacaaataatacagttggtagaaaatatttgcacccataccaccaattgatgaattttctaatatacaaagacctagtattggaagaaaaagttgacaactcagtagaaaaataggcaattgatataaacagacaaaaggcagacgagcaattctgaatggtaaataagtctttttttttttttttttgagacagagtctcactctgtgagcccaggctggagtgcagtggcatgatctcggctcactgcaagctccgcctcccgggtccacaccattctcctgcctcagcctcccgagtagctgggactacaggtgcccgccaccatgcccggctaattttttgtatttttagtagaaacggggtttcaccatgttagccaggatggtctcgatctcctgaccttgtgatccgcctgcctcagcctcccaaagtgctgggattataggcgtgagccaccacgcccagccttctgaatggtaaataagtctaataaaagctacccaggcagcctccccacccctcccgcaatgctcgaccccaggattgccccggcttgcctgcccgccatggccgtcaaggaagcagccttcgatgatggagtggaagacgagtgatcaacgatgagtacaaaatacggaaaaaaaacaccccttttctttaccatttggtgatgacccatgctctggagtggccagcctaactgtccagtggcttccagatgaaatcagaccagaagggaaagatttcagcattcatcgacttgtcctggggacacacacattggatgaacaaaaccatcttgttatagccagtgtgcaacccctaatgataatgcttagtttgacgcgtcacactacgacagtgagaaaggagaatttggaggttttggttcagttagtggaaacattgaaatagaaatcaagatcaaccatgaaggagaagtaaatagggcccgttacatgccgcagaactcttgtatcatcaaaacaaagactccttccagtgatgttcttgtctttgactatacaaaatatccttctaaaccagatccttctggagagtgcaacccagacttgcgtctctgtggacatcagaaggaaggctatgggctttcatggaacccaaatctcagtgggcatttacttagtgcttcagatgaccacactgtctgcctgtgggacatcagtgccattccaaaggagggaaaagtggatgcaaggaccatctttacggggcatacagcagtagtagaagatgttttctggaatctgcttcatgagtctctgtttaggttagttgctgatgatcagaaacttatgatttgggatactcgttcaaaaaatacttccaaaccaagccactcagttgatgcttacactgctgaagtgaactgcctctctttcaatccttatggtgagttcattcttgctacaggatcagctgacaagactgttgccttgtgggatctgagaaatctgaaacttaaggtacattcctttgagtcacataaggatgaaatattccaggttcagtggtcacctcacaatgagactattttggcttccagtggtactgatcatggactgaatgtctgggatttaagtaaaatcacagaggaacaatccccagaagatgcagaagacaggccaccagagttgtttattcatggtggtcacactgccaagatacctgatttctccttgaatcccagtgaaccttggatgatttgttctgtatcagaaaacaacatcatggaagtgtggcaaatggcagagaacatttctaacggtgaagaccctgaagggagtgtggatccagaaggacaagagtcccagacgtatctttacttcttgtgattttagactccccttttttcttctcaatgctgagagtgatttaacactggttttgagacacaaactttgttcagctatccctctatataataggtaccaccaataataccattagccctaacagtgggtgttttctaaatattaatggtggggcttgattcagcaaagccacagacttattacactgaagttttcttcaggaattttctagtaacaaaaccaggtctaaagtagctacagaaacgggaatattatgtgtgattatttttcttcttatgctatatccgcaagtttttcagactcatttaagtaaaggctagagtgagtaaggaacagagccaaatgaggtaggtgtctgagccatgaagtataaatactgaaagatgtcacttttattcaggaaataggggagattcaagtcatatagattcctactcgaaaatcttgatacctgactttccagcatgcacatgaagaccagtagaccaggaaacaggtagacgagtttcctcttggttccttcagttaagtcagaactacacgttcctctttccccatatatttttgcttgttcgtgtatttcttaagctgttttcatgctgtttctttcctttctgtggaatggttttttttttttttttttaacttaggactaccaagttgtaaagatgtatgtttttacctgacagtaataccacaggtagactgtcaagttgagaagagtgaatcaataacttgtatttgttttaaaaattaaattaatccttgataaaagttgcttttttttttttgagatggagtctcgctctgttgcccaggctggagtgcagtggcgcgatctcggctcactgcaacctccgcctgccaggttgatgccattctcctgcctcagcctcccgagtagctgggattacaggcgcccgccactacgcccggctagttttttgtatttttagtagagatggggtttcaccatgctagccgggatggtctcgatctcctgacctcgtgatccacccgtctcaccctcccaaagtgctgggattacaggtgtaagccaccgcgcccagcctttttttttttttttttaggagttagtccttgaccactagtttgatgtttgatgcatctccattttgggtgacctgttttaccagcaggcctgttactctccatgacgaactgtgtaagtgcttaaaatggaataaattgcttttctaccttaaaaaaaaagctacccagtctctttattcatcaggagaaattaaaacaaaaatgaactgcccattagattggcaaaaattagttgataagattcagtgtgggtgagagtgtgggaataggcattcatacagacacacacaaacacacatatatatgcctcttgggtgtatgaattaggggtgggtgtatgaattaggagcatgaattgctacaattttgggggaagaaacatagtaatatctacaaatattaaaattatgtatcctttggccaggggctgtgactcatgcctgtaatcccagcactctgggaggccgcggggcggagggggtggggtgtagattgcttgaggtcaggagtttgagaccagcctggccaacatggtgaaaccctgtctctactttactaaaaatacaaaaattagccaggtgtggtggtgtgcacctgtagtcccagctacttgggaagctgaggcaggagaatcacttgaacccggaggcagaggttgcagtgagctgatatctcgccattgcactccagcctgggtgacagagtgagactccgtctcaaaaaataaataaaaagtcaaaggcatatacattgttctgcaccttactttttcagttaagtatatgtcttaatttttttatttttatttatttatttatttatttatttaattatttttgacacagggtcttgctccgtcacccaggctggagttcagtggtacaatttcagttcactgcagcctctgcctcctgggctgcaatcctcccacctcagcctccagagtagctgggactacaggtgtgcgccaccacacctggctaatttctttgtatgttttgtagagatggggttttgccatgttgcccaggctgggttccaactcctgagctcaagtaatctgcccgccttggcctcccaaagtgtgagaccctgtacatggactgctgatttataaatctgtgagctaataaattggatattgtttcttttttctttttttgagacggagtttggctcttgttgcctaggctggagtgcaatggtgcgatctcagctcactgcaacctccgcctcccgggttcaagcgattctcctgcttcagcctcccaggcgtgcgccatcatgtctgggtaattttgtatttttggtaaagatgcagtttctccatgttggttaggctggtctcgaactcccgacctcaggtgatccacccgccttggcctcccaaagtgctgggattacaggcgtgagccactgcgcccggctggatgttgtttaaggcgctaaatttctgct

SEQ ID NO: 104 - DNA, 4764 bp, Homo sapiens
tggaaagtaaaaaaatacaaactactgaaagccaaattgcctagacaaacaggatctgcagtagagctgggcctcatgaagatggactggtcaggaacagggaatgaatcagaatatagggcagctctggtgactgggatattttgttgtccctatcagaagaagacatcatttggtccaaattgtgtgttgccttgttatggtaactcaataggtctccatctctgcttcttccagtactcctgtgactgacagaccaattttttttttttttttttgagatggagttttgctcttgttgcccaggctggagtgcagtggtgcgatcttagctcactgcaacctccacctcctgggttcaagcgattttcctgcctcagcctcctgagtagctggaattacagacacgtgccaccatgcccagctacttttttgtatttttagtagagatagggtttcatcacgttggccaggctggtttcgatctcccaacctcaggtgatccacccacctcagcctcccaatgtggagggattacaggcgtgagccactgtgcccagccgctttttgtttttttatgtatctctttggtttggttggtcaccttccgtagaatggctcacactgcctcttgtaggggattgtggccattttcatcaaataatttttctgattccacagtcatccatacttggcaatctaagcttatgatccttgttctcaaatttccgacacatcttttttaagactctttatttatgctactactaataatacagtatggatgatgatgtttattattatttgttggatacctcccatgtttaagagctttacaagtgttaatttattcaattcttgttgaggtagatatgaatatccttattttatagaagaggcaactaagttcagagagtttaatttgaatttggcacaaggccatatttccagtagatggaaaagtcaggattcaaatccagtgtattttttttaatacctatgctctttctactccactatatcatgatgtctctctaaaggacataccaggatttaatcagagaatactttgtttaaaggcgtgtatatttaccagataaaacactgggtccctccagtgaagcctttctctagcacccattagcaatatgatgctcaaatatcttttttttcccctgtcccatgtcttgccttgtcttttatttttatttgtttatttatttttgagacagtctcacctgttgcccaggctggagtgcagtggcgcgatctcagcgcactgcaacctccgccttccaggttcaagtgattctcctgcctcagcctctcaagtagctgggattacaggtgcgcaccatcacacctggctaattttgtatttttagtagagatggagtttcactacgctggccaggccggtctcgaactcctgacctcaggtagtctgtgcgcctcggcctcccaaagtgctgggaggtgtaagccaccgcgcccagcctgccttgtctttaatgcaagaaacagaatgcgagtaatcagaaagccctagaaggcatcagttaatacaagatattaatttcttaattccaaaagcacttgcaaagaaaaacttttaagggggaggggagcagggggattgaagcacatcataactggaatcccatgagtgtgccaagtctcatgaggctattttttgaatttatcctttacttgttcatttttttctctcaaataataagtattatttttctttgatatttcccctcaaaggataaaacatatgaaatataaaatataaacgaactcttgtattgtacagttagaagttatagaactatccggctgggtgcggtggctcatgcctgtaatcccagcactttgggaggccaaggcaggtggatcacgaggtcaggagttcaagaccagcctgtccaagatggtgaaaccccgtctctactgaaaatacaaaaaaaaattagctgggcgcggtggcaggtgcctgtaatcccagctactcaggaggctgaggcaggagaattgctggaatctgggtggcagaggttgcatcgcgccactgcaccccagcctgggcaatagagtaagactctgtctcaaaaacaaaacaaaaccaaaaccaaaacaaaacaaaaaaatgaaacaaaaacaaaaacaaaaagaagttatagatctacacactgataaactgcataaaatcttggataactcgtgaatatacaaaatatcagggcacagaaagaagtaaacccactttatttttgtcacacataagattcaaatattcaatctgaagaaaagcaatcatttttgctgtgttctaggttgcatgttgatacatttattaaaatattcctgcataatcacatttggtattactatttcaagtcagatataaaacttcaaaatctgccagccagacaaaatgggtaatcagaaagattatctctgccccacctccctaacctcgataagtataaactcaattttatgacatgactccaaaccctagattgtgatgacaaatgctaggtccgatttctttataatccttttcggggtggcatacttgatagaactcaagcatagaagtctgcattggtcctccaaaccaaattgcatattgctctacgtggtgtgtaatgacttgtacatcaatagcttctggcttcaatctactgctacttaattcctcacttaaggtcagcctgacatctacagttcttttcatatctcattgcaagtgatgtccaaagtccctgaacacagttgaacctccatagacaacaatattcttgttgagaggatgtctcacatcaataggacaattctgaattacttcatctgcaacatctgagatgggatgtataaagtctggattagcaaacctggatgagaaaagatttcaggtcccaagaatctctcatgtccaatatcggtggaaaattatttatttgagatggcattgattcttatacactgtttaaatccactgcgacccatctgcaccttactttttaaattcttttactaaatctgagctaacataactatagtgatcctctactgccttagcagtttccagggattgctctggagggattcctacttcttggtctctcagtagttgctgagtaagatatgttatagctcatcctgcaattggaatgtgtttaatacagctgccaatcacatacccttcaggcgcggaaatgccatgagtgacaccgtttcaacttgtctataacctaccagtcaacatgtattctcctatttgtcttgtggtccaggatgtagctacagcaagaacaacctgcacagcaatgtacaaacctgaacattgaaggacccaaacactatttcaggaatatattccctgctttctggagtattcagcggaggtccagtcaaaagaaaataatggtcttcaggttctgcccttaaatatttaaagatcacttgctctataaagccttccattgagttccaatctttaactagaccatgatggatgggctctttgttgtatatgtagattttccaatgcttcatcgccagtaaagacgtctaggtcatcagcatgtttcatcaccctccttttgaacttgaccacccacttttgttgagttttttttttcatggatgaataatttattggtagaataatacagagtttaccttcaattctatatctgttttgttgagttgttaatggcagtacaggaagggatggtaaacggagattctttattttggacatatcctggttttgtatacctggtaccacagtctgctatgtaggctgtcagctgtcaggtcatctttcctccttttatcctgctgctgctgctgcagcggctgccacttgctccatgctggtaggggccagaaattggcagtgggagatggggcatctgaccatccacagctgagctgccttctctgtggggggtgggtgggatggggatctgtgaaggcaaagcaatagcaagaaagcatcaggctcagtcagcactattcaccacccagcactatccacaacccaggcaggcaggccatacctcccctgtcccactgtggcctcctcatcctctcccttccctcctcgtcactcctgctcccaccctacaacttggtgtccttgtgctgcttttccccaggtagccaagatgcccaggcaccctaaatacctttgaaatggttagagtgtgcatcagttattttcacctagtgtggctcagtttaatcagttccttagtaatgctacttgagatcctgccagtaagatggaagccattttagtatggatgaaaggaaaaagggaaggaaaagaaaagaactggggaagggaggaggtttcacttgaagtaggtttcagaaaggaaattgtatatattatgggaccaggtttgtatgtggcaaccagagtgtgtgtgaggaggtactttatgaagtgggatatgaataggtgcaggtttatatatcattttaaaagttgttcacaccttggtctagtttcatgttgaagctagctgagtccctgctggcagctctgttccacaaaagtcatgctgtattctacaaaaatatgtttattgatgaaatttgtaatgatacatatactcctaaaagagtagttaggttttatggattaaacttacatatgaacccaagatctcacagccttaacagcatctcatttccactgacaagaacaataaggttttccagcttaggtgctatataaaa

SEQ ID NO: 105 - DNA, 7857 bp, Homo sapiens
aaacttcattttggtgtttgagaacacagtagataggtgtgtgtcctaaatgttttgagccatatgcaggggcaggtataggatagtgtatctgaagatgctgttgggattctattgtcatttatttatgatgtggtaaaaagtctgactttgtgtctctttaaaggaaagttttgacaatgaatataacttataataatacttttatgtatttacacttttcaaagtcatttcataatgtttgctattcagtttagtttagtggctctgggtaatctatttaaagtccattttcagtttgttagtttctgtagactacaagtgtagagggaaaatgtatttcacgtatttcactgggtaagagaatggattattagcaagaacttaaatctaaaatttaagcagtttctagtgctgagggacacgatagatttatgctgaattgtatatttctgtatttgatttttttttaaactgcaggcatctgtgtcttccaaggtgagaaaaaacgttaaaacatatcatgtattttctggcctcctactatgtaccaggtggtatgaggacataaagaggcagaagatacgattcttgcccctagatagcttcacatttagctgaagaaacaagacataaacacaggaaaagttagctaatcatgcagggtttaaatagcaaggcatgacatgactaatggggagatgcattgtttaggcagtaattcctacaggagttcagaagaaagagattattttaggctgtgacagtaaaggaagggtgtaaagacttaaaaggagaaaagagaaaaggcttatgtagaggaactgaaacttgggaatgactgaagccttgttctaccacttatgccttaccttgtgcctcaatttcccaatctgtataacataatgatgatgtgttacctcccagactgtcagaagatgagacagtgattgcagaaaagctctttgcaaataatgcctggtccctccatactgtgtagacagtaaaaatcgtacactttttgaaagtctttgaaaatttaggttactagggtataatttctgtcgttcaagtttgccaagtaggattttttaaattagcatattgccagaagtttgactttcttctttttcccagtaaggagagatttgtaagactctgaaaaaattttaagcaagcaattagacacattattactttgggaaaattgcttttatggccaggcatccttttctgtttctttatttccttgagcaaagataatgattgataaggaagtaaaactagaaagaagccagatccaaacttagaaggaaaatattttgtcacgtatggaagttcagtggaggttgcaggttggctgatgaccactttgggtgaacccagcctgacactcagcattttggagatgatagtctcagagttcacaggtttcctgtgtataaggaaatggatgtcggtcatttcaactgtactgttaattgctttgggaaaatgagtggtattcattaggcaaggaagcttgtagccagccctgtaattaatgtgaaaccttttcatacagccagtggctcttcagcatctctgtactttatgtttatgtgtatacttaggcttgcttcagtggccagaggcttcaaggcattcagggctctgggggctcttattataatggtaatgaaaattggaccctagaactttggacctccccagccttaaatccactgagaggagctctctgtctagggatgtggctccttctgctggcttcttcccttctctaagatagcagtgagatgcactaaacatgagatttctaaaacaaatacttcgatgagtaggaaagtctgttttcctgaatatatccactttcctacatattccattgcttgtggaagcaatgacccaagggttatatgcaggactttttcttactttggcagactggagacccagagctcagagaaggcagaaagtgtgttaaagaacaataggaaaagtggtgagagacaggcagatgaaggaagcatgaactaccatcacagagaaagggtagagtcagcaggtaattctcaaagggatgtgcatctgcccctaacccaatctaaatgcctgactcaatgtcctcagaggacacgaaccctggaaaacaagtatgagatgatactactcaggtattgcgtgtgtgtgtgtgtatgtgtgtgtgtgtgtgtgtgtgtgtcagaggtcagccctgatgtaattgccaccgaggtcaccgtggatgaggtcattgtgggtgaggttacagtgcaagagctgtcttttggtgctgttctggtcttgtgatttccctattttcagcacccagtaggtaggtgctcaataaatgtttgttggaggaatgggtgctggggccagccccctaactctggcctctgttggacgttttgtgacctggaatcattctagaaggaaagagactgcccagagtggatttgtgtcctgcttgtgactttcttggtaacaactacaatgaatatgctccccaggctcttaatctggagaactcctttttttttttttttttttaaacagtctcgctctttcacccaggctggagtgcagtggcgcaatctcggctcactgcaagctccgcctcccaggttcacgccattctcctgcctcagccttccaagtagctgggactacaggagcccaccaccacgcccggctaattttttgtatttttagtagagacggggtttcaccttgctaaccaggatggtctcgacctcctgacctcgtgatccgcctgccttagcctcccaaagtgctgggattacaggcgtgagccaccgcgcccagcctggagagctcttgatctgtaggtgaatcttagtatgagggccttggaggagcttccaagtgtctgagagcctcatgaaatgggatgcaaagttaggaatttctaaggagaaagtcagaggagcctctgattcccagccggctgctaagcccttccttaaccaaggttcaccctcccatgttgcctgctgggctgccttacagcagcctctagttccaacatctgctgtagatttctgacactcacagtctacccttcacctcttctctggctattaccagtacttcctcactatccctagtcatgggaaaaaaaaaaaagagaaccgtgtccccaagatgatcttgcctttgagccttgtgtgtttcctgacagggaaaaggccctgtactgccatgtcctcccctctggctgcttcatgccgggtcttctgcctaatacctgacacaaggagactcctccagactgaactgcgaggaaaggctttacaggcagaacaggctctgcagagttgctgctcagtaggccaggggtcagcagacttcatgctgtgtgccttaggccacatgagtgatcctcctgtagatatttcccatcagtgaaaacagagctggcactgatcacctcctctcttacagactgcggagctaaagtgggctgctggttggaatgtgctgtgaaagttggaatgtttttgcaaattttattttattttttgaatttgaagtagaaagctgtttgattataaatggtgacttttcccttctaaaatcatttaaaatttttgtaccctttgaaaatgacatttaattataggcactcaaagtgcagttgacaattattgttatttttggggaattgtttaaaggatgttcattcatgcatgcatttttttcattatttacttattcagaaagatgtggaagtctaatatgtgccaggcactgggaaacagtgatcctgctgctcatatttccattctacacccaagctgtgtacttggtcatgtggcttggatctttgtaaatctcctttaccctctttgccctgaagaacgttattagaacttggtatgcaaaatacaccattggctgattgttggaatacttttgagcaggtttgtaaccactttcagtggatgctgtgtgaagacccactaaagcagtggttctcaaggtgtagcttgcatcagtatcaccgggagggtttgttaaaacagcttgctggacccccatgcccagattctgtttcagtccctgactgcatttctaacaagttcccaggggatacttatgctgctggtcttggggatcacactttgagaacctctgcattagagacatttctttagacctaagggctttgaagtctcttctcctgagaaattggtgtggtttcattagggtttatcgtgaaccttgtttgtgaacctggttttctttttgtttgctttgcttcgcgtcagaaattcagattcaaatttgtagctcaactttaagaaaattttaacagttacatcttaacttttcccagccttgatttcctatttcattttccccattctgattttacatgtttacacaatataagttcctgtatactgactgttttgtggaatgtagtatatattgagaaatatgattgcagtcagtgttcttttcttggacatttgtctttcgaatcaactctaaagtattacatgttttgactgtttaatgcattagttatgggagtagattccccagaagaattatattattaatagcaactaaccaaaggattggaaagaaaaaattgggaagaaagtgacagaaagttcttggtaaaaaacagaactttatttttaaactattgatgcatagatagtatctacaagcagtaatacatatgcatatatctgtatgtttatatgtgtatatatatgtgtgtatgtatggttttttatttttatttttatttctttttgagacagagtcttgctctgtcacccaggttggagtgcagtggcgtgatctccgcctcccaggttcaagcgattctcctgtctcagcctcccaagtaattgggattacaggcgcccatcaccacacctggctaatttttgtatttttagtagagacaaggtttcaccatgttgctcaggctgcctcgaactcctgacctcaagtgatccgcctgcctcggcctcccaaagcgttgggattacaggcgtgagccaccgcacccggccatgtgtgttcttttaaaaactgagaaccctaatacataaacaatatactttctttggttgttggagaaaaagcgaagggatgaggtggtgatgagaacagtgaaggcaaactacagtggttgcccaactttactggagtcacctggagtttgttaagtgcgatgccagtttgctaggcctgggggtggggcctgcatttgtaataagtgtatcaggaaattctgacccacgagaggtgggagaggtttagcactgggtagaaaaatgaaaggcccaatctgtattaaacctgctccaaatctttgtatccatttttggatgaggagttcctgttcagattttctgcaacttttcctgaaatcagagtgtaatgggcacaatatcattcatattagtcagtcttagctccagaaagtactcattatgttagatgttcattggaagtagtttgtagctgatttttttctctttcttcgctctctgtatttctgtcttctacttctgtttttagttgaagagaagatactttaccaacagcttgtctgaaaacaatttgcagataggagtactcatagaaaactcttggggttctcactgtgggtcttctccaggggtgtggataacaccaaacactgcagtatggaaactagcgcaaaatgggatgtgctgtgacactggccagctggagacagttgggacaggggatgacttaacgttaacatgggaatgttacatacacagtctagaaaggccagatattcttttgcactgctgcctctggctctcttttcatctatttagtgaataaccaaatttatcacctgtagtaatcagttactaatttagaatttaatttctttaagagttacctggatttagggctcagtgaaggcagtttttatttaaaagcattttcttgaataaacattttagaacagttttagtattacagagaaactgtgaagatagtgcagagaattcccatatacccaacagtcagttttctgtattattaatgtcttaggttagtatgctacattgtcacagctaatgaatcaataatgatacattattactaattaaacttcatagtttatcagatttccttagattttacctactgttccatttctgtgttaggatcccattcaagataccacatcatgtttatatgtctgcttaggttcttctagtctgtgacagtttctcagactttccttggttttggtgagcttgacagcttgacaagtcctcgtcaggtattttatagaatgtccttcaaattgggtttgtctaatgtttttcctgtggttcaagggttttgggaggaagaccacacaggcaggcatagtaccacatttcattccatcatgtcatatcaattgcataattagcttttacatgcatacatgctatcaaaacgacctatcactgttgatgtgaaccttgattgcatggctaaaattatgtttgtcagatttctcacataaagttcctcttccccttctttccatactgtactcttgggaaggaagtcactgtacatagctcacactttagttgtggagaattatgctctacctccctgagggaggtagtatttagagaaattattgggaattcctctgcttgggagatttgtctattctcccccatttatttattctatcatttatttgtatcagtatggactcatgcatattttatattttaggttataatctaatatcacatgattgtgctcctcaaattgtttcagatttggtttttgggagctgtttcaataggctcctgtgtccctttgtgacatgccacccatcctggtgggtttttgttgttgcatgtgtgctttttaaaatcacatccttattctttctggcactaaaagatgcccctggctcactttgtatattctttgccccatccctagaatcagttatttctccagggaccctggttccttttgttggagaatggttttagaaaccaagttctgggcactgcgtgtccttgttgctactgaggtgtcattgcttttaggtctgttcagctgacggaacagagaaataggtgtatactcacccttgtatatacacatatctgtaaatatttctatatgtatccatctgtatctatattaagttgaacatgagttcatgctaatgttttcaactccgatacagtgttacagacctttttttactagcctttctcccttgtctgcaaactcctgctctaacagtgaaaaactggttcctaccacccaccatccatttacttacatgtatagtggtttcagaattgttaacttgtatcccttatgagaaagaactttattggctagagttcagtggttatgtgaaattcgttatgtaaaattcattttgcccttagatctagagtccatactcatttctgaaggtccttaagccagcatcttttccctcacttctttcagtgaggttatttcatgcattttgatacagttgattctcatgtcatagtctgcatttcatattccaccccaggatctcttgataccctaactttttaaattgcatatattcaagttctgtgtgctataaagttctatgggttttaacaaatgcttagtgttctctgtctaccattatagtatcatagagaacaatttcactgccctaaaaaaaattctctgataggcctcaactcatcatttggcttaacagtcctgctgagagagtcctgccagttgcatctgagagacagtcctgccagttgcacctgctgagagagtcct

SEQ ID NO: 106 - DNA, 8396 bp, Homo sapiens
ttaagtttcaggtcccatttatctttttgtcacacatttctaatctccctacaaatcagtatttttaaaaaccagagtcatcccaaaccaactgaccctctagattgccttacttcttgcagatttagtcttaccgtcttccagatactacagctgcctttgggcttttcatcatcccttatccttagccaccaagtcctgctgagcttcttttgtaatacttctctcctgcctcctccactgcacacttgtaccactgagacagtctcttaattctgcccagcacctccagccccatctacacccctctagtttgtcctccagcatgttgttttaggactgttgctagcctaattatttgaaatgaaatttcagttcttaacttggcatccaaacctttcgtccattgcatttctagctttaccttctaatttctagctttaccttctaattcacttaaatgagatacaatttaattaaaccatgtattccttgcagcttctgtgctgttttccacatctgtctctttccccatgttggcagggtaaattttagaggtgtaatgaaatttgcaggtggaagttatggggatatagattgtctttagcttaatgtaaggatgacctttccaacagaattgctaatgatggggtgggtatcatggaagaagtctacctgtcatctcccaggtcatctactgtcatctcccctttaaagacctcatcttccatatctgcacatttggcttctcctctcttttgaagctgcttgtttccatgtcccatgatgctaaacttggggactcctcccacctctcagattgtattttctctggttctttctttcactcctttagtgaatttgctttttcttttcttcttttcctgtgctctttcttgaaaaatttcactgctcttagacttagtgtttaccttttgagaaaaattcccaaatgataaccccagccgtatgtttaactacatgatttgtctttatttccaacatcttgccagatatttctatttgagtacttttgtgtccaaatttaaactcatttctttccctttaaaacatgttctttccctgagttccctggctgattagtggcaacagagatgggcagatctttctgtaaagggccagagagtaatatttttgtcttcatgggccataaggtctcaatcacagctactcatcttgtagataatatgtaactaaagggttgtgactgtgtttcagtaaaactttacttatcaaaataggcagcagctggcattggcctttgggctgctgtttgctgaccctgatctaggatacccaggccccaaactccatactcctttggcctttccactgcttttgtttgctctcttcacatgattattaattttcactgatttcacccttagcaaaccattcatacttctagaccatagctgtctgtctattcattcatctagtagacaaaatcttccttttacatgttaatctctatcattttacataatcaaaaacctctagtggctccccttggcctgcaatctaaggttacagttctctgggtgtagctctttctgtgttttgcctccagccttctctcttactcctgtatggacattcctccaatgacactgatcaagtgtgtgttctgatattagttctatcacttctcacaggttgctcctgactcagaatggtctcacttcccactaattgaaacttgccttcaggcctcaattcagggtctcacttcccaggtaaagcttcgccctagcccagtgattgctcctctcctagggctttttttttctttttctttttctttttttttttttgagacagcatctctctctgtcacttaggctggaatgaagtggtgtgatcactgcagcctccaactccagggctcaggtgatcctcctgtttcagcctcccaagtagctgggattacaagcatgtaccaccacatctggctaattttttttatagagatggggtcttattttgttgcttaggctgttctggagctctggcctcaagtgatcttcctatcttggcctcccaaaatactgagattacagatgtgagccgccacacccagcactgaatagtgcttttgatgttgccactgacctattcagttgagaccgcattgggttgtaatttgtggtgttcctccctctccatctgaattttcagaagctgttaaggacagcccagtagatgctcagatgtcataggtaaaggtcatacattgaactctttgtctttcctccagttctgcttcccccttggagtccctgtctcagttaatggcaccagggatcatcattgccttgtgattctgactccttctctttcacctccaccctacctgcatcagttacgaaaagtccagctgctgctccctcctatgtctttctcctatctgccctctcctctccatcccttctactgctgccttagctcaggtcaccactgtctttcactcagaccattggacttgccttgaacatgaattcccaccaccagcttctctcctcttataatcccaacagttatgtatcgggatctgacatgtaggtatgaccttgtaactttcctgattgaaacccctcagtggctccccattgccctgggataaggaccagcctgccagcatgtcgtgaggccattattgattggatgcactttcctctgcagtcctatttctgacttgtctcatttacacagcttacatttgatcatctgtaacccctatacatcttctgtgcatttgcacactccccgtctctgtgtagatgccccccctccccaggtccacttggaaaaccatcacctgaatttctaggcattgtacaaacgttccctcttttgtggagctttcgtctccttccctccagaagaccaagaggagtaaaggtgttatcatagaataactgttgggatagagatataggcttcatctattttctaatgcctcctcagattcagagtcttccaaagtttccctgcagactgagcaatgaataattaagcaaacaagtctctaaaacatcttgaaatgcttatgtatgctaaatatgtagttttgagttcttgttttggttttgctggagcttttgccttcttcctccattacaatggatgatgagaatcaacaatgtagaattattctcggttagtttatatcttgtttttaacctggtatcttcagtgtgttaagacatttttcctttcttgtgggggttcccctgcaaagaaggaggctcacttgtggggccgatgaccactgtctctaggcaacccagagaggtgtgaaagaaagaagggggctgtgaggctgcagggagtatattccccatctccagccagggtcacacctgtcacttctgtttagtacctcttcctagtaaggagaacgtatgctccctttctggaagggtctacttagcagaaacgaggagtggcgagctcatgtggaaagtgcttttttgatgtgttctttcatgtaggggacacacggtgtggaggggatgcacaattactcttctgtggttcctctttcttactccagggtctcctttgccatgaggtccctagggacgtcttatcagaggagaagaaaagtaccttcttagttcttttttgttttgttttgttttgttttattatggggtttcactttgtcacctgggctctccggggtgcagtgttggaatcgtggttcattgcagccttgacctcccaggctcaagtgatcctcccacctcaacctcccaagcagctgggactacaggtgcatgccaccacacctggctattttttattttttatagagatgagatctccctgtgttgcgcagactaatcttgaactcctggactcaagtgatcctcctgccttggcctcccaaagtgttgggatttcaggtgtgccttggcctcccaaagtgttgggatttcaggtgtgagccactgcagccaaccccttcttagttctggagagcagagtcttgcctggcatcctggtgctataccaagagtcctctcctggtttccagagaggacatttgacttcttcaggagaactcaccccactccttttggtccattaggagcaccagaagctttggacctgatgggctgggcttggtctcttcagagcctctgtcctcattcacagaggaggtatcaggtaggccttccagcacagaattacattacctgggaatttaagtgggaggaattgcagtggagtattttgaagatcctaaggcatccttcatttaatttacattttcgattcttcagatattggaatcaaagattgagacacacacataacactagagcacacagtagaccatttctaccttgagctatctccttgttagagaaaaaatagttttgactgtttgtgattttttactacgggcagaaaaactttgaaaaattaatttcaatgtaaaagagttttacttttgccagatgataacacttcctatgctagaacctgggggtactgggatctgacttgaagtaattctaagtttaaatttatagcaaccatgtgggtctgttcagctgggaggggagaaatattgcgagccataaggatgtattttagagagtttctttagtagtcttcagatgtctacttgccctgtacaaagttcagaaactgtttaggacttggaaccttagaatatcagatagaaaaggattgacaggcttagtctactctgtttttgagatgccgaagccaggtgacttcccctagtggcaggtaggcaatgtcagagttgtgatcatggcctggggctcttttccaacctgctctctgacctcacataggatccggattgagcagggtaaagggtggaccagtaaaggctttaatcagtaaagtaatgacagtgttttccttcatttgaaaccagtcagatttgatactacttttctgttcagtttttgccatcattgttttctggaagtttttaatctgtaatacctcttagtatgctttaacacataacacctagtgtcattgttatagagatgaaagtagaaaattagcagggatgtagtatttgcctattgcaacttcttttcctttaaaccccttcccatgtcggggggataccttgtgtgtctgcagcatgtgatgctgactcggactctccaggcagctgactaacggcacctaaactgcctgctgcattttccctgccccagcacagacttgcttagcagctcccgcctcgggccctcattgagaaccatccagcggcacatcaggctggtgccactcccagtggccttggcagtgaggaggtgaggcgagagcaccctcaggtgctagtggcacgagtcttgcccaggctcccaggggaatgagtggtgtgatgacctcatgtgccagaagccagggcaggcatgcttgaggctgagagaaagcaacagatggacctcaggcagaagcagtcagagcagcctcaagggaggctggtgcggcaccagcgtggcatcttcccagcatctgaatgttggcttgaccttcgctgtttgtgtgacctcacccaattcagtaacctcactgagcctccctttttccatctgtgcaacggtgatggtagtacttcactctgcaagcggtggaggtgagagataatataggtcaagcatttagcagttggccaagctaaagacatagctgttgtttttgttattagaaacacagcctcagccaggcacagtggctcacaccagtaattttagcactttgggaggctgaggcaggtggatcactggagctcaggagttcgacaccagcctgggcaacataatgagacctatctctacaaaaaatacaaaaattagctgggcgtggtggtgtacacccataatcccagctacactggaggcttagttgagaggttggcttgagcccaggagatggaggtttcagtgagctgtgattgtgccactgcactctagcctgggtgacagagccagactctgtctcaaaacaaaaaaacaaaaacaaacaaaaaaaaacaagaaaaaccaatacaatctcatttttcctgttaggttattcatacaaacctgttggaattttttttctttaggaatttgaatgctcatttttaagccagacagtttcaggtggaagagaatcatgaaatgctttatcatgtttttgttatttatcgctagagtaagacttaggaaagctatagaaaagagccatccagccaagaatttgaattttgtcaacttctctattacagaggtttgctcaaagcccatagagtctagatgaaccttctacctttgcccccaaaattgcttttttcttttaatatgctagatccctttgcttattccaggctgaaatgaatgttatgtagctagaagtttcctgtctgtgatcaattctaatggcttttgtgaagggaaatggttgtaaattattaccagttaattaaatgagtgtttctcttgagtcctttgtgtaggcttttatccaagcctgtttagaatcatggaacattacagctagaatatttttagacaactcttgtttcatggacaaggagacttaaccagtgatataagtacttgcctaactcctgcaaagtgatgccaaggaaaagcaaactttggctgagggtgtaggagtggctgtgctggggatccggtgggtacatcaagctaacagagtataatttctaagcagtgagcccttgtcatccatatgtcaccggtattccttggagccatcttggagtgcttttattttttacaaagtgctatcttgtaggactattctatagtaaatattacctttcctatttttataggtgaggaaattgaggtggtcagatgaccttatttagctcttagatcaactcagcagatatgtattgagtgtttacttggttcaaggaactctgcgaggctccttgggaacataatgtcagatcctgctggaatggaggttacagacttattgcaagtgatgagatatgtgtatgaaaatgtaagtaattgttcaaggtatagataagtgttaataatagttgagatgtgaattttgagaccggagggatcaatgtgaatatcaaatcctggcaccagtttcttccttctgctgctcatgaagctgtgtcatcttctgtgctcggtaacccatccaacctgtagccctaggagctcctctggggagtcttgagtaccttgcagttgtcccgaccctgggagtcattcaataaaggttcaaatgaatgaatagataggtgcggtgaagagagacaggttttccaagcagagaacacggcatgagcaaatgtgtggctgagtgatagagccaggagaggggcctgactaggacagcaggttttaaaaagtgatttttttcttctttttgtattttaactttctaaagtgacaatggaaggaagggaattttgaaaacaaagtttggatagattagtgggaaggcagcaaaaggggagcccaagtggtcctgaaagccaggtggagcagggtgttttattctgaagactctcggagaccagcggaggctttagagggggaagttgatgagatcagcactttagaaaaggctgctttgtttttggtggggtgttccatgactgcaggagaaaggatgagggaggaggcctgcagtgacagggatcctagaatgatggagggaacgaagggaaaaacagatggtcacggtgcctcaagtcggagtggctccaggattttaagcctgggaacgcagaagaacagtggttctagtgattcagtgatgaccactggaagctttaggaggaaacatgggattggagccctttaaagctggaattggccccttagagagaatctggctcaggcttcccagatggtggtccgtggtctggctatatcagagttacctacagaacttttaaaaacagcagatgcctagaccccgttcccttgccccagaaaatttaaaatcagtagatcacctgtggggtctgggaatcttatatttaatccctttctgtgattctttggcaaagaagattgaatggccttcctgatgtcgcagattggtcaggacagagcaccaggacccaggtcttctctagcattgctattactcagccacaatgtgggagataggggataagttcagatggggaggtatagtatttgaggcagcgctgattcatgtgagttcaacactgatggctctttgaggaaggggttacttggcatgagaactcaagggttagatggctctgagggtgcacgttgggaatcattcagtcaagaaatgctttcccgagtggctgctgcaaaccaggcataggatattttcagtccacttcgggg

SEQ ID NO: 107 - DNA, 7268 bp, Homo sapiens
atctaataatctgcatcacttatttgtgcttgaaacattcagtgttaaccccaccctttcctttttctctaggcaaataagggcgagactgaaaaatcaagtcactcagttgaaggagcaagtacctggtttcacaccacgcctggcaatattacaggtattatgatagtgtattttcattaatgttgtctttgcttgatttctcagtatcatttcagacctctccctctactttcctcctttttttttggctgttgtgtaatctcatgccttttcagtctctcttggcaggctcccccctttggctcagcttctaaatgttggcatatcctggccctctgctcttctctgtggataccctttctctaggccagtgtctcttaacctttggtcttagtagggcccctttacaatcttttttttctttaatttaatgtatttatttatttatttacttttgagagacaaggtcttactctgttgccaggctggaatgtagtagtgcaatcatagctcactgtagcgttgaactcctggcttcaagcagtcctcctgcctctgcctgccaaagcatgggtattacaggcgtgagccactgtacctggccccgtttacactcttaaagatgtaagacctcaagaagctattgtttatacagatttatccattaatgtttactatattagaaattaggaagttttggccggacacggtggctcctgcctgtaatccagcactttgggaggccgaggtgggcagatcacctgaggtcaggagtttgagaccagcctggccaacatggtgaaaccccatctttattaaaaacacaaaaattagctgggcgtggtggtgggcgcctgtaatcccagctactctggaggctgaggcaggagaatcacttgaacccgggaggtggaggttgcagtgagccaagattgtgccactgcactccagcctgggcgacagagagattccgtctcaaaaaaaaaaaaaagagaaattaggaagttttaaaaatgtttattcatttaaaaatgccaatagtgagctcatttattatatgttaacataaataacattttatggaacaaaaacttttttaaaaagaaaatttagtgaaaagaggggcattattttatatttgtgcacacctctttcctgtatggcttagtagaagagagctggagtcctatctgcctctgcattcagtcttttgctgtgtgctggtttgattgaaatatatggagaaaatttggcttcatacagatgtgtagctataaaagggaagaatttttttaacagtccttccaggtaattgtgggtatttttctttgatgttgtaccaggactcagtaagtaaattttaaaagattagttgcaatgtagaatctgaaactctatcagtgaactttgatactttgttacatcttctcagacttgcacactttgttacatcaaaatgttacatttggaatgaatatttaccccatgcatggttttgtaacatcctttgttcctcatttggaaaataatagttcccggaattatgcagatcttccaaatgttaacatttcattatgcaatatgaaagaattggaatcattaacatcaccaacaagctcatcagagaagttttcaagtattgagaagctgtcaagctcacaggggtggataaaaaattttaattttcacccaaaaactcacattttatcattggcaacaaatacaattaattgtttcccttgaaataccagtttcactttattcatttttgagaaaatatttgtcaaatactcaagcctgaataatcattgcttgtcagttgttatttcaagtaggtgtttcatataaaaatgcatctgtttcagctaacaaggcaaaaaagcacaagtgcagcctggacaacaaagtgagatcccatctccacaaaaaaattaaaaaatgagccaggagtggtcgtatagaggtgtggtcccaactacatgagagggagacaggagatcacttgagcccaggaagtcgaggctgcagggagttgtgttcatgccactgtactccagcttaggtgacagtgagatcctgtctcaaaaaaaaataaaaataaaaataaaaaagcactaatgctttagtaacaaccacaaccactgtacttctgtatatagcagaagtgcattatgagtgcttcccaattccttacatagactattaaaaacacatgcactcaagagttgaggtttatttatatatatatattttttacttttttgggacagagttttactgttactcagtgcagtggcacaatcttggttcactgcaaccttcatctcccaggctcaagtgatcctcccactcagcctccagagtagctgggattacaggcatgcgccaccatgcctaatttttttttttgagacggagtcttgctctgtcgcccaggctggagtgcagtggtgcaatcttggcttactgcagcctccgctcccagattcatgcaattctcctgccttggcctcctgagtagctgggattacaggcacctgccattgcaccctgctaattttttttttttgaaacagaatctcgctctatcccccaggctggaatgtaatgacataatctcagctcactgcaacctttgcctcctgggttcaagtgattctcatgcctcagcctctggagtagctgggattacaggtgccacgcccagctaatttttgtaattttagtagagatagggtttcaccattttggccaggctggtctcgaactcttgacctcaggtgatccacctgcctcagcttcccaaagtgctgagattacaggtgtaagccactgcgcccagccttaattttttgtatttttttgtagagtttttttttgccttgttgccctagctggtcttgaactctgggacccaaagtgatcctcccattttagcctcccaaagtgctgggattacaggcatgagctactgcgcttggccttaattttttgtatttttttgtagagacggttttttgccttgttgcccaggctagtctccaactcctgggctcaaagtgatcctcccgccttggcctcccaaagtcctgagattacaggcatgagccactgtgctcggccaagttgaagtttaagaaaattaataatgtatatttcttcatcaagggtggtcctagtgaaactggcatttagttttactgggagtgtgtggtagtgaaggataccttgactactagtccaaagccattgtcttgatttgtgctggttcactagtagtcttacacaccattgcttttgcaccatcggtacagacgttaacacaatgaaaaaggcaaacaacattgtagtggtattattatgaagctagtctggccctcataaatctttgaaaaggtcttggggtccctcaagagtgtgtgggccacattatcagaaccattattttaggcagtttcatctatcaggccagtgacttctaaatctagatttcttctgagctccaggctcttggtctgggacaccactggtttccttcccaccttcaagtctcctttgcttgttgttgctcatcaccctaatacctaaaccatttgaatgccttgggctcacccttgagatctcttccccatcttattctttccctaagtaacctcacccagtcccatagcttcatgagggaatgcttccaaatttaggtctctatccagtatttcttccctgagctccagattcacccagtagggagatattcaatacatatttttacggacaaatgtatgaaggaatgtttgcaatcttgatttggatgacaggaaactcacggctttcatttgaaactcccatcagagtttcacccaagttggacatagtctccttctcaatctctttatttgtatgtctccaatagatcatttaatcccttgctaaatttctatcccttgttcatcaagaatgtcaaggtgggcatggtgcggtggctcatgcctataatcccagcactttgggaggctaaggcgggtagatcacttaaggtcaggagtttgagactagcctggccaacatggtgagaactcatctctactcaaaatacaaaaattagccaggtgtggtggtgcacacctgtgatcacagctactcaggaggctgaggcaggagaatcgcttgaacctgggggacagaggttgcagtgagctgagattgtgccactgcactccagcctaagactccgtctcaatttaaaaaaaaaaaagtcaaagtgaatagtacttaaatattcccctctcctcctctgctgtttgtctaagagggcttagctgagaagaaaagcacagaaggcctgtcactctctgcctggcatgttctctgctgtggtggattttcccttttttgcaaattactaagaatcaaaagtatatattgtgggtgtatactggtacatttggtggctggttatttcttggcttatttttgcaaattgtttgttgtagaaagagtaaatgtcataggcaagaagtataccctttttaaagcaacattgggggtgttttttttcctccattttaaaaactgacttccaaccttgttttttaaatttattgattacaaatgtttttattacataaacactgttctacagctcgtctcctacgtccttgctgataaaacagtggtagaatcttttaattttgtactttagcaccagagtcaacagctttctgtgatacaaggtttatataatatgttgtaatcacatctccctgcctcagacctctagtctttttcgctgtggtgctggcaccaccatcttcccacattccctgagctagaagcctgaggccgtctccttaggagctctcttcctcactccctgcatccagttaggggctattgtcctattgattgtgcctctcatcaactcttggaatctgttgcctccccttgattcctatttctcccaaccctggggccactatagttacctgcttaatgatttggggttctatctatatacctcctgtctgtcctcctgactgcaattgcaatccttgttaaaatgcaagtctgatcacaatctatccagccacactcactctccatcctttaccagaatgatagtacaagttgagtatcccttatccgaaatgcttgggacaagagtgttttagatgttggaatctgtatatacatagggatgagatccaattctaaagcaaaatttatttgtgtttcattatataccttatacttgtagactgaaggtaattttatatatatgtgtgtgtgtgtatatatatatataataataattattattattattattttttttgagactgagttttgctcttgtcacccaggctggagtgcaatggcacgatctcggcgcactgcaacctccacctcctgggttcaagtgattctcctgcctcagcctcctgagtagctgggattacaggtgtgttccaccacgcctggctaatttttgtatttttagttgagatgagatttcaccatgttggtcaggctggtcttgaactcctgacctcaggtgatccgcctgcctcggcctctcaaagtgctaggattacggacatgagccactgctcccggccaattttatatatttttaataatattttgcatgaaatgcacttttaactgtgttttgactgtaagccatcacatgaggccaggtgtggaattttctacttttggcgttgtcagtgctcaaagtttctgattttggagcattttttatttgtggttttttttttttttttttttgagacagggtctcactctgttgtccaggctggagtgcaggggtgtgatcacagttcattgcagcctggatctcccaggctcaagctatcctcccatctcagcctcctgagtagctgggactacaggcatccagctaattttagtatttgagacagaatttctccatattgcccaggctagtctcagactgagctcaagtgatccacctgccttggcctcccaaagtgccgagtcaccgcacctgactgattttggatttttgagttagggatcttcaacctgtactacttatatagagtgtctacaataattcaaattgtttgtttatatttctaatcgttctatgttttatactaccctacgatgtaggagatgtccccttatagccatagtaactcatgctcaaagatcttgggtagcttgcccaaagccagtcaggaagggactgagtctgggaaatgaacccagatctgtctctaaaacccatttgttcttcccctttgttttcctaattccttagcaatgcattcaagaacattcatgatctggcccaagtatatatttaaaagttgagttttcatttttttttaataaagtggatgagtaacttcccaaataactgaatatttataggaaattaagacttgacttttcattataagagatactaatgggctaggcatggtggctcacgcctgtaatcccaccactttaggaggccaaggcgagtggattgcttgagcccaggagttcaagaccagcctgggaaatatagagagactttgtctccaaaaaaatacaaaaattagctggttgtggtggtgcttgcctgtagtccccactactgaggaggctgagctgggaggattgctcacgcctgggaggttgaggctgcagtgagctgtaatcgtgtcattgcactccagcctgggtgacagagcaagactttgtctcaaaaaaaaaaaaaagtttctggtaaggtgatagaaatacagcctcagccccatagcctcattagtatctctcactctctctcttttttttttttttttgagtcagaatcttgttctgtcatgcaggctggagtgcagtgatgtgatctctgctcactgaaacctctgccctcccctgtcccccaggggatcctcccaccttagcctcccaaatgagctgggactacaggcacaccaccatgcccagataatttttgtattttttgtagagatggggtttcgatatgttgcccaggctggtctttaactcctgggctcaagcaatccacacaccttgacctcccaaagtgctgggagtataggcatgagccactgcacctggccaaaaaactgatttttaacagtattcgggaactattcagagtgctttatgtatagtaactcattcagtcctcacaaaatacatggacagaatacagttaataaactcaactagcctgtatcttcataaggttttctgaaaca

SEQ ID NO: 108 - DNA, 4522 bp, Homo sapiens
ctcgctggaatttgagcctgttttgcttttttaaagtgagggcaatgctactggccccacccatcttacaggacaagggaagcccaaggacatgagagctttctgagctgcatcccaggccctgctctgccactgactcgctgaggctgggtttccccatctgcaaaataaggacataaaaacccatctagagctgggcatggtggctcatgcctgtaatcccagcactttgggagtccagggcaggcagatcacttgaggtcaagagttcgagaccagcctggccaacatggtgaaaccccatctctactaaaaatacaaaatattagccaggtgtggtagctcatgcctgtaatcccagctactaggaaggctgaggcaggataattgcttgaacccaggggacggaggttgcagtgagccaagatcacgccactgcactccagtctgggtgacagagcgagaccccatttcaaaaaaaacaaacaaacgaaccaaaacaaataaaaacccatctagagtgttgtggggattaaatgagttaatatctgtgaagtgctttgaacagagctggcacggccgggcacggtggctcacgcctataatcacagcgctttgggaggccaaggcagggatcacttgagcctaggagttcaagaccagcctgaccaacatggcaagaccctgtctctactaaaaatacaaaaattagcagggcgtggtagcatgctgctgtaatcccagctactcagaaggctgaggcaggagaatcgcttgaacccaggaggcggaagatgcagtgagccaagattgcgccattgcactccagcctaggtgacagagcgagactctgcctcaaaaaacaagaaccaaaaaccccttaagagaaatggggttttctcttatgagaaaaataaatatctccggtgtttcctctgacttgcccagggctgcacagctcacaggggaggggtggggaccgggacctggcacttggctcctgctgctctgccctatgcccttggggacttctggacaagggtgggcttctctgggctgacagaggagacagaggcaatggtgtgctggtaaatggttaacaactggctctctggaaaaaaatgccctaactgtagcaaaaaaaaaaaagagactagaactggcacattgcagatgatataggcatttgctgtcactatcagcatcagcatcattacttgtcctttcaacaaatatttcctgagcccctgtcgtaggccaggcccagtgctaagaggtggggacacagtggagggaagacagaaagttaagtgtgctgtttccataaagtgtgctgacagccatataggagcactggggctggggtgtctctacggtgcctgggagggtctcctagagaaggtgacatcaagcaggttctgaaggatgagtaggagttggaaggagttggaagagctcctgccctttgtggagcaggagagggaggtggtccagggacctttctggccgaccaagcctagagccaattgcagtgagccattgtgacattggacttgaaactggtcactgcgagagtatttataccatagaaatttgcaaatgctacggttagggcatttttttccagaaagcccgttgttaaccatttaccagcaccccactacctctgtctcctctgtcagcccagggaagcgcacccttgtccagaagtccccaagggcatagggcagagcagcaggagcccaagtaccaggtcccagcccccacccctcccctgagagttgtgtggtcctgggcaagtcagaggaaatgccgggggtatttattttaaaaagtgtctatcaggactctacattatgccaggggtctcaaaggtgaaagaggcatgagtttgtccctcaagcagctcaggaggagctggaggaggtttcctaggcacgagcttatccacaccatgacacatagaccctgaagtgttttaaatcaattacaaaaagcaaaaatacaaggaagctgacagatctttactttgggagaagtggaggcttgggaacaaatgagatcatcaaggtctttttgtccgttttctaaggagttggggtcattggctgagatcctgcagatctggaggtaccaacatgagactccgagggccacctcctctgcccctccctccccaccccctttaaggccctctctggaatccatcccttttcctccatctccccagacctggctgaggcctccgttgtgcctctggtctggtgcctcagccccctcgcttcctgcttccagattttgccaactgccccccacctttgaccatgtccaggcatcctggctcaaaagccaagatgagatctatacttgagagcgtatatgagagggatgcaactgaggctacctggagtgcgtggacacagccatggcctcaggtcatcatctcccccacgaagcctcccacacctcctgtccccaacttgggcacacttcccaccacctgggagacccctgagggcaggcaccatctgtccttcaccactatatccccctataaagagagataatgcagtgaggtgccggggttcaaatcccaactccacccatcaccagctgtgtgactctggacaagccacctctgtgtgactctggacaagtcacctcactgctctattcctccaatttttataaaattgggatagtaccagtgcctgcatctaaaataggtgtggattacatgaattatttcatggaaagtgcttagaacattgcttggcattcatagtaagcctccaaaaactgaagctattattattccctggttgctggcccagactaagcactcataaatttgttgaatgaatgcaatgtaaacagggaaatgctctgtaaatgctggtgcaagctcatcagcttcgttgtcgtcatcagcattgtcctgatgctattcatggtgggtgtcctgtctggagccctgctggctgtagaccaccaatgtgggcacagtcctagcccctcgctcaagtagggtatgcgaggactcaggagacgtcaacagacattcacagtatttacactgggaccttggaaccagtgtggttgagtagacacccggaggacagagttctgagtttatttgggaggggttgccggggagagtcagctgtctggaaaggcttcctggaggaggaagatttgctagaggtgcttgagtggttggtgcaagggggcttgtggggaaccagagcgtcctggtgtttagagcagcaaggaagaggctgggtaaggacaaaggacattgggacagacagaaagcctgactctagaaagaaggggccaaggtcactggagaggagagagaggaaggattaaggacgattgagtgggtcataggggttgagggctctgtgtagggaaaacagtttcccactcaatcctttcgatgccactgtgattaaatgtgtgggtttatttcctcagaaattgtcttacaattccgttcagttctgacattatctgcccggaggcagcacaggataagagctcagtcccacaagactgccgccacttcagaacccatcgcaagtctcaagtggcctgcacttctgaccaaccagctgtaaggcagggttcccacaaccccctccacgggttcagtaatttgctaggatggctcacagcatcagggaaacatttacttacattactgacttataataaaagacaccactcagccacagccaggtggaagagaggcacagacccacacgtggggcaggggcctggagcttcggtgctgtctctgggggcaccaccagctcagcacttccctgcgttcaccaactcggaagctctcccaatcctgtcttttagggattttgatggaggcttcatcatataggcatgatggataataaattcaatctccagcccctcttcccttcctggaggatgtggggtgaaagttccaagctttgtatcatggcctggtcattctgatgacagcccccatcctgagcctatccagccaccaccaagagccacctcattagaacaaaagatgtgcctatcatctagaaatgtcaagggagttaggagctccgtgtcaggaactggtgtcaaagaccaaatatgtatttcctaatatatcacgatatcacaggttgtgagaagaatgcaatcaatggtcaaactccagagctgcacactctccaatatggcagtgaccagccacatgcagtcaccaagcacttgaaaggtggctgcttcaaactggtatgctaagtgtaaatacacactagattttgaagagttagcaggaaaaaataataatataaaataactcaatgactttttgtattgattacatattaaaataatgttttggatatatttgattatatctcatatataaccaaaattgatttcacctgtgtctttttactttttttaatgtggctactagaaaatttgaagttacttctgtggctaactttatagttctattggacatcaccgaccg

SEQ ID NO: 109 - DNA, 16494 bp, Homo sapiens
tgacacccatgaagaaattagagaacaaaataggtatagtcagatgccatattgtgtggtttaaattctgagtgctgagggggaaaagaaagatgacatctttggggtgctagagggggctttggggatgtgaacccccaaggtgtgggatgaagttcccccctgtagtaggttccatgatagctatgcaacagcattagttgctcaaataaattgaagaaaggctgtttctttgatacattgatgggcagagtgactctcaatgggaccatggaatcttagaccctttagtaagaaggataataaaaattgttttgccaaacaaaaaaggaaggggaagcccagagaaattcacctctgttgatttcaaccaatgttctttttgtaaaatttaatttgtgtaaaatgtttaaatgcatgatttaatttttaatgcatgatttaagttttaatgcatgatttaaattttaataattaataactttaatgtctatgattgaaggttaaaatttgataagcaatttaatttctaagcctgatatttctattttctcataaagtaaaatatgatgggattaaaggcaggacagactcacccttcctggtttgtgattgagaaggtcaccgatggtcataattgcctccttttttatgtgctgttgccctgctaagacatttcttgaaacacttcatactgtactcacccaaggtttctaaagctgtcaatgtcaattgcttttgttcttaccctaacacatgttgtcacatgagaaacataaagcctttcttgtgaagataaggtgagctattatgggtgcctaaaaagacttggagattaaggataccctctatgacagtcaggtcatggcaagaagcagaatgcaccctagatggatcaaatgaagacacttgaaagaaaaagatacttacacatgagccgataatagggcaccaacagtggatgttagggcactcagagactagcatctgagggatggggggagggaagctgttattacccttatatctgaaggaacaaggagagtaaatagtgttactggagcccagtatgagctgcaccaggaagaaaggaaccacccaagaggagctgtaggtatggggggtggcaaatactgccaaagacaggcatgacatcagggagacggagagggagaaaaagatttgatctcactctcttcctgtccccagtctcctgctaatgtcccctctggccatacccaaccagaaatgagctgtcaagggaggccaggaggtgcatccacagaggtcaggctttgtggcatggagcagggcagagaagagcagagaatagatctgagtagggtgtgtgtgtgtgttgccagggagcagggggtggccagccaggatgttctgagagcccaactagaaaaagccgcacatgatggatgccatcagctactctgaagcaactctagtcaggtaaccaaaggttgagcagacccaggattccactcacagtgctttggatattattcttgggaagcagaactggaatataatttcagttaaggaactctgattgaaaattaattgcattgtacccaatctgggagttgtaagaactctcggagtttggacagctggggtgagaaggctcggagagcaagaatttggccatgtgtctccaacactatccaggggagaaggtaggctcactataaatccccttcaagccttcccccaaaggggagtgaatgcattagactgtcatagctcagtgatatctgccatgaagaccattcgtttcttctcatggctctgattccagagtccccagaagccttgtgtttcgcatttgacttctcataaagctctgtgctgattagcccacaaagggttctgattctcttgacagctataactcattgtaaattaataaattggcgtctggtgtatctgatgaactagagcattctgaatcagggctttacatctcctcagtcacctcctgcttcatcttcagggaacagtcacacctagagtcaataactcagtgtctgaagctctgatgaggagtaccacattttgaagtgaggactttgcctttctgcacaacctcgccaggcagcctcaccagaacatgtctttacttcacttttccagctgtagtgggaagctcacagtacatactccacctgccttttcgatgcttgttcctaggaaagttgagaacccaaggttgtaaggggactgtgagactagccattccattcccctctatccccccgcccagatcattttttagaataggaaggagcatgatgagtggatgaatgcacgcatgaacggatgcctggatggatacagtgcatggatggagatatggctgcgtggctgcgcagatgaaggcgtggatgcacggatgtatggacggtgctgtggccagggctgctcttcaacacacactctgttcttgttgtggcagaggcttgggtgccctgtgccactgctgcagccatgttgttgtatatttccatgcatattattagtgccccacctcgggcatctcctttttctgcttcaggtcattctccaaagctgcagaaactcagcctaagtgcagagcaagcaggaagtgcagaggggtcaacatcctcaggggtaaccctcaacccatgatggatgaaaatccatgcttaaatgttccagcctcccatccttcaaaggaacaattctgagatacattctatatgattcctcagaggttcgccagcaggactgacctgtccacaacagtaaccaactcagcatcacgccctttactggcttttcctccttccctgcctcactctccccactccctcactcctgcttcctgggatcatctccccccaaatgctcaaatccttgtctaaggctctgcttccaggagaaatgaaacactggtcaaactggtctatttctcttcctctggaaggaagatgctggtatttattcatgcatatatgcattcctcctttccagatgagcaaatcaaggctgagaaagattaaggaactttcccaacttcacaagacaataagtgacattgctgagctaggtggataccaacctataggacaatccttagttatgggcctgcagaatctcacagctggaaggactgaggactcagaatcacctagtgcaatgtttctcaacctattatgaccttcccaaagagccttttaagacttttttttcctaattacccccatgacattttaatactaaaactgtattgcatatctaactatggacactctctctctctctctctctctctctctctctctctctctctgtgtgtgtgtgtgtgtgtgcttagctagatattctttgtaatgttgacaattttaaataattttcagcagttgacataattactggtgggttgactcacttagaagaatgaaatagtaaaatataaattatttttatttatttctcaaggcttaagttacacacaaaagcactgaggatcaaacataagcaacacccacaaggcagctaatggcagccaataggcacacacaaaccagctgtcatgatggaactttctcatgcagcaagcaatgaaaagaaagtccccgcatcccaaccatctattcaccatagctttgcagcactgatcttgcatgcattttgcgtatctcccatgaacttaacatcgatgctgttcatttaatacccaagaaaatccaattagagaaataagcactaaggaataagatttttttgcctggtatggttgcactttggcaggctgtaaactattgtaatatctaagattttttttgcctccacaagaatcatgttttacccccttgggtgagctgagaatatatgatttagtccaacaccatcattttccagattagagggacactgaaggctaaaggtgcagtcacatgatgagacaaagccgaatggagtgaaaatcagatcttcagactccaggcacagagctcattttaaattacccaagaggcggagtgtggtggctcacgcctgtaatcccagcactttgggaggcctaggcaggcagatcacctgaggtcaggagtacaagaccagcttggccaacatggtgaaaccctgtctctactaaaaatacaaaaagtagccaggcatggtggcgggcgcctgtaatcccagatacttgggaggctgaggcaggagaattgcttgaacctgggaggcagaggttgcagtgagctgagattgtgccactatccccaagcctgggcgacaagagcaaaactccatctcaaaataaataaataacccaagaaccttgctcaccagtcaatatgaattaggcctaggctcagctagtcttggtgctttccggccctcaatttttgttggggaataaaaaatcttcatttcactgtggaaggtatggtgagtattaagctgtgttatggtgtctccctgaccccatttccactggagcatacaaaagcagagagctaattatatgatagtaattacctggaagttgtatgtttattggttttccattagtggatactattttcgaactcttcgttgttatgctctagcgacaggagtcacactgtctctactccaaatgtcccctccaatctcatgattagcaggctttttacatggggccattgctggcagcatgagacacccccagggtagggaagggaggtttgactcagtccatacaggaggccccagaggtctccacccacattcacgggcacctcacttgaaaagagcctttaataataaagtactcaacatctggtctaaatgaagcatattcctccttgcccttggatactgagaatcgtatccaataggaaggggcctcccctgtcaccagatatatttatgtatccttcattatgtgccttggttaattgtccctttcctttttttttttttttccttgagaaggggtctcattctgtcacccaggctggagtgcagtggtgtgatcttggcttactgcaacctctgcctcccgggttcaagcaattcttttgcctcagcctcccaagtagctgggactacaggcgcgtcccaccatgcctggctaattcttgtatttttagtagagacgaggtttcaccatgtttggccaagctggtctcgaactcctgaccttgtgatccacccaccttggcctcccaaagtgctgagattaccggcatgagcccctgcagcctggcctaattgccccttttctaccagctcttcttacaacagagaaatcctgagcctcgcttgtaattatagtgaggaaatatttctatgagcttttaaaagggaagcctaaactgggtcaaaatgttgaaggtgataggtcagggagcaagggtcaatactagctttactctgatgagttgattgctaggggctttgagtgtcttttgccaaatttgagggccctctcctagaattccactatcagcacctcatcctattgttattattgttacaactgagattgatagacatctgtggaggattttacagtctgcaaagtgccttttacatgaagtacatcacttatcttcactgcaaatgctgagggcaagttagattacttggccctacttactgcactgttaaaatgcatctcttcactcctccagaagggccacagggcacttgtttccagtcatatttatgtttgttgtgggtaaaaagctagcttgggctgggcatggtggctcatgcctgtaatcccagcattttgggaggccaaggcgagaggccaggagtttgagaccagcctgatcccatctctatttaccaaaaaaaaaaaaaaaaaaaaagctagcttacagtactagtagctcctgccttgttcataggaggatctcagcacctagcaaaatgcccaacacgtagaatacaggaaatgtttattgagagaaagaatgcatgcatctagcctaggagtttttttcctttttattttttatttcaatagcacttggggtacaagaggtttttggttacatggatgaattgcacagtggtgaaatctgagattttagtagcataggaattcaagtgactattgctcatttataggccctctccctgttcagtacattctcacatccatgcctttgcagattccacgtacttgaaactccctctaaaaatgtccatcagctttggcgtggatgctactaatttagagaccctcccggggctacggacccacagtgatcctttcttttctgaaatccttcagccctcctcacccaaatcatcagtgccactcagccttgacatcagattggaaccaattaattacctgctaaactacctcatgtaagaaacaggtctaaagatgtaaacagccttgcccagtgagtcagtggcaggcagggtcagacccagaatccaggtcttttattagctgcccagtgtacttcccattacatcaagaacaggaaataggtttcaccatgactatcacctttgatcaagctgtggtggccgcccagagtgatagactgagaatgcctgtgagagagcagcccaggatggtgggaaagagtgctgcaatcgcttgatcatgtctgccaggctgtggaaatgaagagtttggtgtggagagtggctcacattgcaaaagttgggacccccatttaatctgacctgaatcctccactgtaaggatgttgttggctgtcccttcactctcccaactccaagagaattgattcagggcaactcccttttgctcacattaaaaagaaataataagcttttttttcttctcagacagagtctcgctctgtcacccaggctggagtgcagtggtgtgatcttggctcagtgcaacctctgccccctgggttcaagcaattctcctgcctcagcctcccaagtaactgggattacaggcacatgccaccatgcctgactaatttttgtatttttagtagagatggggtttcaccatgttggccaggctggtctcgaactcctgacctcaagtgatctgcttgcctcagcctcctaaaatggtgggattacaagcgtaagccaccacacctggccaagaaagcataatctgaaggtcagtcctggggttaggtcagaacttccctcctaccctgcttggagttaaggatatagtgcttgttacttgtcccccaactccagagtcagcttcaaagatttgactgtgtatttgtacaattagaagagtaatctctaggaaacaagcagctcagtaatgaaatgttacaatcccagcagggccaagcaagcctattgtggtgctttctaggcagaaggaggcttaaggaaaggatcaagcacattgctgctaagaatgtgcaataccaactccactgagagagaagcacggttgcaaactaggggacaattagatgttttccttctttgtggatttggaagagtggttgcaaacacagatgcctctaagggcaacacagataatataaataagtgaatcagcctgggtgtagggcagcagggagcagtggggactgtggctgagagtgcctgtcctacctaaaggatttccaattctcaggtatttttaaaaacgtagtactggccagccggacgcggtggctcacacctgtaatcccagcactttgggaggccgagataggcggatcatgaggtcaggagatcgagaccatcccggctaacacggtgaaaccccgtctctactaaaaatacaaaaaaattagccgggccgtggtggcgggcacctgtagtcccagctactcaggaggctgaggcaggagaatggcatgaacccaggaggtggagcttgcagtgagccgagatcacgccactgcactccggcctgggcgacagagcaagactcagtctcaaaaaaaacaaaaccaaaaccaaaaacaaaaaaaaactcataatactggccaaatagaagatgtttgcaggcttcgtttggttttaggactttagactgaaaacattacagatatgtgtgtatccaatctatctaatttatccattacttaatggcaaaaactgaaattacttttgcaccaacctaataaaagttatgcactggtggccgggcgtggtggctcacacctgtaatcccagcactttgggaggccgaggcaagcagatcacttgaggtcaggagttcaagactagtctggccaacatgatgaaaccctgtctctactaaaaatacaaaaattagccaggtgtgctggcacacacctgtaatcgcagctacttgggaggctgaggcaggagaatcacttgaactcgggaggcagcgcttgcagtgagctgtgattgtgtcactacactccagactgggtgacagagcaagactccatctcaaagtaaaataaaataaaataaaagttatgccctggttaatcagaaaaataaagaagcatacctgatcctccggatggtagttctgttttatggaacagtgtgcctctgctgactgtgatcagtcctgctgaccctggatatcatcccagactcaataactcagacttaaagaatggtattgaggagaaggagatgctttggggtaagatcaagccctagactttgaaggtgagatttcctgaaaagtgggagaagatttgcaagccagagtaaaaagatgtgcaagtcagatctgtaaggcagaagcacaaaggaggaagctttctcagagaagcctgaggctggggcacaggattagagactggtagggccccaggtaggactgagttgtgcaacatggcagccctggggagggtttaacttattgatgtgctccgtcaaactatgaaaaattatatagcacgcaagcttaaaatgtttcccactactacacagagattcccctagatatcttatcctcctagtttcgcctcatatgacattgctgtggagataaagaggtcaggcagaggaggagagtggcctctccctcctgtgagaaaaggcacttgctcccaacaggatcaggagtgaggactcagatggtcctcgcaagccatcagggggagcatgtggtgttgaagagaccctgccgttcaaacctccttgctggtagtgacactgagggactggaaccccttaaggggaagcagctgaggtttgggccagctcaggtgaagcaggctggctgccctctgccctaatcctctgaaggagctggaggtaagaaatgctctgactctctcacaggagggctggaagacccagttcagtgggaactgtaaaatgcttgggaaaacagagacccctattaatgcaaaatattattatgaaccctccctccccacatacttttcaacctcatgaggtgttgtctttaaggcccagtctggtttaaattataagatgaataaactcacctgacctgacaagcaaatgttctgctggacccacagagccttggaaagagcagcctttgcttctccgcccgtttaggaggagcaaccctgtgggcctgtgggaaatgcatggactgggtgtctggcaggtctgggtttgaagctcagcttcatgagcagtgggccttggccttgctgcgcctcattttccccccctcacagggctgtcttgaggctgggtggagtagtcctctggaagccctgaaggtttgaccgttctaaagcagtgtttcaggtgaatttatacattgatgggaaggaaagaaagtctgttggatttttagacgatgcttatgctttggatacaatcaagctctttccccaagggccagaccagggacaaatgagctgtatccctagtaagctagctttcttttaatatgaggatgtattatttgccacaaaggacaaatgtgaaactacctcttgatcagtcacagactgtgggcctcttgggagtctgggaggtcacaggtcaaggcctagagaaatggctgtgtcctaggattagggacagtggaactgctttctctcctgaggcctctttggtgtggtcatggggtgctgctgatgtctgcagccctctgggcactctctcaaagctgccctgtagctggaacatctatctgcatccctactcagcgcagaggcagtgaaatggcagcaaacaactcccttctatttcctggtggcttgttctctgggacacggagaagagcatggtgactgccaggtttcaggcctatctagcagggcaatgagagctcctgggcacctgaggattcagaaccacttctttctttctttttaattttttttttttttttttttttgagacaaagtcttgctctgtcgccaggctagagggcagtggtgcgatcttggctcattgcaacctccgcttcccaggttcaagcaattctcctgcctcagcctcctgagtagttgggattacagacacacacaaccatgcccagctaatttttgtatttttagtagagacggggtttcaccgtgttggccgggattgtctcgatctcttgacctcatgatccgcctgccttggcctcccaaagtgctgggattacaggcatgagccaccgtgcccggcccagaaccacttcttaattgaagagaacatcttccttctctttgtctatgggataaagtcctatacctgtaaccaaggccatacccaagggtcccccaaatagctcaactcaactggctgatgctcatgggtagccatgacccctccagcccattgcccagcctgtcacacgcttcctgcctttacacatgccactccctcacttcctatttctaccagatgaacacctgcctgtttatcagtgtctctgagaaaacatccccctttccccccaagagcaagggcaaggctctgccttcattgcatccttagccctccaagctagctgatctactctcacatcactcccctgaccagcatgtagaagcaatccacacagaagcaggcctggcatgaagtgtggtcctggggcccctgttgggccatcttaactcattggttgcttgatcatgaggtggggcccaaagaagtgacagggctgctgggactgagggaattactcaggcaattgatgctgactctacctttttgtgatcaatctggtctccttggttccaggatttggagctctgtgctccagcaatgcaagctgcctctgaaccatttgtcttgtcctcctgccctaggactttccttctgcctttgactttaattttctgcatggatcctggacatggttcaaacttctggttctagtggcccaactctctatgaagaagaattccctgtctcagccccagaatctcaggttttcacccagcttgctatcctcaagggataaatcagactctttcctctctgcatcccatctttttgttgtataacttattttgggttttgcttgtttgttttttgagacagggtctcgctgtgttgcccatgctggggtacagtagcatgatcacagctcactgtaggttcaattttctgggcttcagtaatccttctgccttagccttcccagtagctgggaccacaggtgtgtgccaccatactcggctaatgtatttttattttttgtagaggcaaggtctcactatgttgtccaggctggtcttgaactcctgggctcaagtgatccacctgccttggcctcccaaagggctgggattataggcatgagtcatcatgcctgacctaacttatcattttgtcttctaactatttgttttcatgactaagcccctccctggactgtgagctatttaagggcagagtggatgtcataacatatttcataaattaatgcatgaatcaatgatgatcagtgtctgtagtattacaatcacttgtaatgctacagatgatattatagccctatgaattacatagaaaatcatttttatcatccatgacttccatttcaagtctcccaagagggaggaaaaagaatctctgcctgtctggccccacgtggagtccaaggaatattatagttcttttccttgtatttttctaacgccactacattttggggggcttatccaccttagtacctactaagttcaaatttggactaagtctgtagctcggttgtgcattttgaacttcatcttaaattggtcatggcccattgctactgcttcacatttcctccgtcgtgttttctcttttattgcttctataggttgtgagttaggataataaagtcaagataaaattgctccaagccatttgcagctctgggaagctggcacagggctgccaggagctggctgggtgccaccaagaggaaaaaatattcttccgtgttgccagccttatcaggactcctcacagtttcttgccaaaattttaggaaaacgatgatctactcccctgcagctattctgtatgtttctataggtggggagtctttcaacaaggattttcactaaaaatacctctcatgtttttcccctggtttaagactgtaacttgagctccatattgtgaaatactgacattgagatattaatcactgtgcatagttgaggcatcattgtcatcatcatcagccactcacactaactgaaagtttataagctatggaatcccactcaggacgtgctcatgaaagaataattggagattattttttaactgtgaaaaatgttcttttggaggaatgaggaattgggaaaataggaacagattatagaaagctggtaggaaatcacaattctattcttttattttctttctgtttgtttttccaagataaagggtctccttatggtgcccatgctggccttgaactgggctcaagtgatcctcccacctcagcctgccaaagtgctgggattataggcatgagccactctgcctagcctaaaattttcaatttttttatggaggtgtggtctcactatgttgtccaggctgttcttgaactcctccctcctcggcctcccaaagtgttgggattacaagcatgggccactgtgcccagcccacacaactctactcttttaaatatttgctctacatctgtttgatgccacaacaatgactcaattccgacaattcaatttatttatatgggtgtggcttttttttcttattcgatgggggagtttgtctatctggcatagacagacaagccaaatttcaaattcttgtttaagtgttgagaagatatggccataagcatgtctttactcagtcaatcaattgaacttcaatcaacagtgcctactgagcactaactatgtgcatgcccagtcctgtgtttggaaggatacagagaataaggtaccatttctcccttttctttattaatttatagtctagtcagaatttatagactagtcaggcagtcctgggctcaaatcccaatgctataacttagcagcaaagtggaattttggcaaatgatctaatatctctgcacttctgtctcctcctctgtcaaatggggtgatgataacacctaattcacagggctgctgtaggaatcaagggagattgtgggtgtattctgtggggtgtatctataagtattggctttcttccccttcccttagcctttagcctggggtaacctcagtggagaggattcctagaagccctgtgtaaaagccttcttcttaaggctaagggcaattacctccatggccacgtgaaaatgggcgcatagtggctggctttaagtgaaggctgcaaactggctgcccactggccaaagccagagttagacacttccaattagtcctatatgatgttaaaaaaaaaaaaagtaatctgcgggcacagtggctcatgcctgtaataccagcactttgggacgctgagctggggggattacttaaagtcaggagtttgagaccagcctgattaatgtggtgaagcctcgtctccactaaaaacacaaaaattagcagggcatggtggtgcacgcctgtaatcccagttactcggaaggctgaggcaggagaattgtttgaatctgggaggtggaggttgcagtgagccaagatctcgccactgcactccagcctgggtgactcagtgagactccaactcaagaaaaagaaaaagaaatctgttgcaagcatttaaatatcaaaagctattcattaaaaccccaatttggggattctcttgaaaatcggaagattctggcttttgacatttggatggagctgaccacaagctactttctttggatgggtcaagcactctccagagtgcttgtgacttcccacagggagatcagatgtggtaaaaggacaccattagttcagatctagccaaagttcaaagcttaagaaaaagaaccaagccaagaatgatgagccagggcagccctgataggacccaccagaagagtaaaggcttagttcatttaacaaatattattgagcaccttgatgtgcaagtcactgcattgggtgcaagtgggaaagagaaagaacatgtgttgggagcctactatgtgtcaggctctgacatgagctcatctaatccatcaacttcttgaggtaggtattaagattttttttttttttttttgtaaatgagaaagtaggattaagtggctaaatggatcagctgctaagtgctggagtcaggatccctgtactctgagggcctaggtttgtcctctatacctcaagcctgcgagagcaggatggaatgcgtcatatgttcctctgtactgttccatgtgcaaactgggcacatgactgtggattgtgtgaattttctggtgaacgataggacagtttttcctctggctcctgctctcaagaagattctagaagcaaaggagacgatgattgccagacaatgaccaaccaaaggctgtggggctcaaggctctgggaggaggcagcgtgtgaactgggccttaaaagtcaggaagtttttgataggcggaggaggcaggaaaggatatgcaaggcatggggacagccccagcagagacacgaggagtaatctggagtatgtggggcacaaggtggtgcatggatggggcccaaaagtcaggatgcagtcaggtcctggatgaccctggtgcagctaaacaatccagacttcctccatttccttcctggggccattcctcaggcccatccttttctctgtccctcttgtccaccggatctttctgctccctgccatggcttctggagcacaagagagatgagggaactcaagcaaatgtataaatgattgaaggcattgagagctcatggtatctaatagggatctgttttaaagaactaaataatatcattatataaagctgaccatctcatacgaaatgactctgaaatgttacccctggatatatattccagtctagagaaactcatgctcaaaactaattatggcagcatgatttgtaatagccaaaaagtaaaaacaacccgaatgcccaacaataggaaactggataaataaatggagtattgtcatagaatggtatgcttaacagctgtgaagataaatggattccagttacagcagtggttctcaaacaggggtgattttatcctccacccgggggacatttggcagtgtctggagacattttcagttgttacaactggagggatgttactagcacctaatgagtaaaggccagggatgctgttaaacatcctacaatgtactgcacagcccctcataacaaacgattatccagcccaaaatgtcatagcatccaggttaagaaaccttgagttacagtcattaaaatggatgaccctcataatgttgagcacagaaagcaagttgcagaagaatatatatacagtataatactattttttaaaattcaaaagtaagcaaaaaagaaagaatacattgtttaggaattacacatatacagtaaaattatgctgtgatttcagaatccacattgcaactatcctttaagaaagtatcacttaatgagttttagtgtgatatcaaagaggaatatccacaattatttgaaaaagctgttaaaatactcctccttgtccctctacagatctgtgtgaggctggattgtcttcatgtacctcaatcaaaacaatatagggttgcaacagattgaatgcagaagcagataggagaattcagctatcttctgttagccaaacattgaagatatttgcaaaaatctaaaacaatgccactcttctatatttttgtggaaaatatagttattttccataaaatatgttatttatgttcaacatgtgatgagtttgttgtttttagaagaataaataataaatgttctgttttaatttctgatactgtaaatgttgacagatatagcccacgtaaacaaagtttctaggatcctcaataaattttaagagcttaaaaggatcctgagaccaaaattttcagaacagttgccctagtctaagacagatctatttcctttatctcctttcccattttgtacgctggaagagttccatttagtgagcgccatattgagtttgctttccattaataata

SEQ ID NO: 110 - DNA, 10391 bp, Homo sapiens
gcacagggagatgaagacaactctcccaggattcttaaaaagccaatctgtgactgttctcagggtcgctctctccctaaatgctccccacctctataaatgaccataagcagccaccttcccagagagcaattgtccaacgccagcctaatacaactgtcccaaacaccactcagcctacaaattctggattttcctgttaacatagtttattttcttcaaagcagtgtggcctcaaggtcattactaaatgatgactcagggggaccaaattacagtgattccaaacagaccaaatctaccaaaccagttttccactcacatctcctcttccatttctactggggctatctcaagccaccaggatcctaaggcaaaacaagatttttctaggattctcaatattgggatccaaccccagagatgaaaaaggagccctttttgagggtccacacttactgtgccctcagcagatttccaaacaagctggctaaaagtctccagacctaggaagatgtagagaggcagagtaaagactcagggagtggaaaaagagatgtctctatttggaaggttctcaatgtagcagagcataacatttgggtacacagggaaaatggatgtagtgtaggcttgacgatttttaacactgatgaaaaggggatattaggaagccactatccatctttacttctgtatttcattttgggagatgtcagagtaagggttttagtgcccttccttacaacatactaaccttcaaaacccacatacctcttatctatatttcctgtgccttcacaagaatattgagaagagaggccaagacatatactcatgaggacagacacagagacaactcagcctgcaagagttggacttttcatggataacccctatcaggagctaagagagctgagaaaaggggtcccagaataaattgtgagaaagtgatcataagcttgggtttccaaggagcctgggttcatggctggacctagaagataaaaaaaatcatccactcttcctcttcagagtctaagaagagacccagctatagggagctgaggtgtggtggacagcaactgccccagaaggactcccctagtccactgacactgtctcctagagtctagcaaggcccacacacaggtatgttgaacccagagtattgtatgttctcaacagctggggcccctcttctggaaaccctgcagaagccccatgaaaattatcagagtccccagtttcaaagtgaaagaatccatgagacctcagcagtcactcagcacctgatttgagcagactgctagtgtactgttttggcttctccccactctgactctgacacccagcattctggagttccaggtcctcccttacctctagcctgactcaccatcagcacctgcatgaaaggtacaagagggcaggaaggggaggcagcatgctgttgctccaagcatagaagtggagcaagggaatgaagacaaactaaagcaaggtgtggaattccgagagagtttcccacatcattcaccagcagagggtttaccaaaagtgggagagatatttggctaagtctgtatctaggcaccaaatgccttctcagtaaacccagaagaagggcaagggccaatagtttagccagtaaactcattttctccagaaataatgtagttctaaatatttcactactatttatctttttttttgcatgtatctatttcttttgttatagttttccttttaaaaaaacctttccaattacatgtctttagcaagagctggacagacagtgtctgtggtagcatcattccccctgcccccagctacctgtcccctgctggcacctagaacatcagcccacagactctcctactgcttcccagagcccctgactagggcagcagcagttgctgatgctgcacagggtaaaacctgtcaacttccagggacaattccacagagacgggaaaacacgccaattgttcccataaaaaaagcttcctggctgggcgcggtggcacacacctgtaatcccagaactttgggaggccgagatgggtggatcacttgaactcaggagttcaagactggcctgggcaatatggtgaaatcccatctctactaaaaatacaagaattagctgggcatggtggcaggcacctgtaatcccagctacttgggaggctaaagagggaagattgcttgagcctaggaggcagaggttgcagtgagcagggactgggccactgcactccaccaacaccaaccttcccacatcatcctttctctctctcttttaatcagccccaatttgttacctcggagagctccccagacagtctcagagaggagtaaacactggtcatcatttatggtcagggtatctgaaatgacagaaatgaactcatttagttggttaaggttttctattctcagattatagaccagatattctatataaatcactggactaaaaaaaaaaaacagtaagaccatatattttaaaaaatctttcaatgaggagatgtccccagagcaagacagctgtaggatggcctggtctggggccagagtgggagggtggtcaccacagtgactctgtagaccctggatgatgatgtacagcaagagtcaggctggagtggaggtctgtacaaagcaccacctacctcatgggtcagtttccacagcagaaagatgaaagaagtcttctcctggcaaagggaacagggatgcctgcaggggtgagtgcagcacgcgatgctcccaatgcctttgtaatcaccctcctttccccttcctctatgcttcagctacttcctccaagaatgtgaggaaggagccaaactcaactgttcactttggagactgagaagtccccaaatgctgctcagggaagacaggaggcagtcactggactaatgacttaacttcatctcagtataagtgaccagaacccctgctttccccagtgtagggtctattagagaaaagtagcaaagtatacactttcctaaaatagaaatgtattcagtacaccaggtagaagtcctgtgggactcagtgaagagccagtgtgatgttccacagccaacctttagcactggttaagtttctgcataggaaaaactcatcttccatggctctcagcacttggtgaccctcggtccccagggtcaagggggactccaggccgagcatcagcagtttaggccaggccatccagagttacagcttcagacaagtgtttgctcttctaagacagggaacaggatggtacttacaattctccactgactccaaagtaggaagctggttacatccaggtgtgactacagagacaaccaacacattcttctccagtgtatgccgtttccctaggaagacagggtaagcttggtgcggccaacctgccattagaagcaacaggcaaaaccaagaccctagctctagtccctcagctcacacgcctgtggtaaaggaaagggaggacatggcatttacccttggcataggcagtgcctgatcatctgttcagctgtctcactctcgttgtgcccctcttctcctcagtagctgccctgacccatgtctgaatgctctgggtgacagctcttcttaaccagggctctatatttctgactgcccttggcctgtaccaaacaaacaactccatgacctcaacaactgcttctgaatgaaaggcagctctagagcactgctactccaagtatggtctgcagattagctgccaatttgcaaactgtgttactggctggtcactatatagaaaacttatatgaagcctgaatgtaaatcaattatgtcagagtaaacacactgtctagttctaacattttttcatacaagattttcttgatgaagagatcagtcttacattctggtacatatgcttcttatctcattgaagattggcatattaagtagtactgctcttgagggctccagatgaagggtttccagttttgcaaaagcctaggagctaatggagcagatgacagaaggatcaggcagaggaggcctgagatgatgcaactgatacctcagagaagatcagggtcacccacccatcttgcttccttccttcctcttcccaaacaggttctctatccaaggtagattttaccctaatagtggagggttgaaccaacatagtatctaatatagctttacagacccttgtctatgcagaaaaaatgccaaagccaaaatatgaatacactgtctcttctcaccctcctgctggttcttccctgtgattttcagggtggctctggtgttatagccccaagccttaacttaatgaacccctctctattctattctttcctggagccatattcatcccactggcatcacaacatccatgacttcttatggcactacaatgtcagggataggatggcctggcagaaggcaatgagagaattcagaaccaaactggaatctcaaatgttacccatctccaggcagaaggaatccaagcgctcagatcatctcacggaagcctgctcagacctcttgagcactaccacatggctgtatctcagctctttggtctgccaagaagcaagccaataagggggcctttcctaccatcatgaacaacacattctttcccttaccagtaaataccctggatccccacaccaatacctgcctacattctgcaaagaggagggaatctgaggcaactctgggccaggtcaattcacagctccatacttgaaccctaaaactacattgttacaacacaaaaggacaagcagaccttcaaggcaaagaccacactcaaggcagaatctgcagggccatccaagcagacaggctacaaacccatctccacaggagactctacagggagaccaatgaggacttaacctaggagcaagggtgaggaaaaactataccccatcctctgacttcttgcccccactcccaaccccacacatcatggagccccaatatcattgtgtggagaattcatctgcatatctacccaggcagccatccaaaagacagccgaagtcctgagctttagttctaatcctctggggctcagcctgccacataaggagaaatcacaactaatccatatgcaactaccatggctcgctgccctcatgacaaaataagagaggccacacaaacaccaggtttatctgaactattacttggaagacagaaaaatacctaatctttcgatttttaaaaaatttatttttctaaaagacacctgcactgtactccctaaatctgtagtcttttggagagtcacagactcctttgcagatctgctgaataggaaaacactttttttcccagaacaatgcccctaatttaagggctgtttctccagaattacaattcttccactccctgccatcaatctcatggtgaagaatccctgtccgaagttctctcagtgactcatctgggtttgggctgaaagaagtagatacgggggcatggctgctgtttaaacaaattatgagagggatgtttgggggaggcagcaacatgagagctggcaaaacaggagggacactaggtcattgtaaaggatgtaaatagggtatcaccactgtggttttccgcctccaagttgctactttgcctggctatgaagagggcaggaaataggcaggggacagtagtacagccgcctctacacacacccgcccacaccctgaacactgagaagcaccaacgtgtgggaagcacagtatggcaaacagcccggtcagccagcaatgtcatgagcacatgtgccatgagtctggctggaacagcaggaaattgagaagcctccagggcttaggaggtagcatgaaaaacagaccagagggctgggaaatcaggacaggttgcttctggttctggttttgctgctgccaagctgagcaagtctcagggctcccatttccttccctgtaaacaatggcagggtgggaccagattccagctactcctcttcagatctaagaccttgtgattccatagacagataatacactccagggtcccattccaggaccacagcctgctacctctgcagctcactcatctccctgctttcatgtaaacctactcttctctttgggttcactgaaaactttgtatctttttttaaaatcaaaacagttgtataggcctggtgcggtggctcaggtccatgatctcagcactttgggaggctgaggcaggcggatcacttaaggtcgggagttagtgaccagcctggccaacacggtgagaccctgtctctactaaaaatacaaacaaattagctggtcatggtggtgggccctgtaatcccagctactcaggaggctgaggcaggagaatcacttgaacccaagagacggaggctacagtgagcagagactgcaccactgcaccccagcctgggcaatagagtgaaactgtctcaaaaaaaaaaaaaaaaaaaaaaaaaagagtagtacatactggttaaaaaaaaaatcaaacagtactaccaaacagtagaaaatatttacgattaaaaaaaaaaagtatctttggtacccttccttagtcccctcagtaaagagacaaacatcactggtagttttctacccctgtagtaccttatagagtaattttgccttattcatcacagacaggtcacctctggacatggaattctaataacaaggacgctctatcaccaaagtcctactgttgaaccttctccagactccagtactatgacccctccatttcccttctgttctcagtcttctctcattcttgcttccttccctgctggcctacatgtagtgattcatcacctcaaacgcaatctagccaatactcccaacgatctgtctcttttcttctgtcacaaccaatgggcaaaactttcaaccctggatcaatctaacatctgcctgctgtgcccctgaccccggctactgtaccctactggagggaagggagaaaaatcacaaaacagcaggactggaccactgcaaaataatggtctccatcttggctgggcccttgatgctaccctgaaaatcttctatctccatcattgcttcattctattctctacaccttcctcaagtctacttgatcaccacctcccttatgctcagcagacaatcagaagagaactttcaactatccctaccctcttcccctctcctcgctgacaaaaatatctgcaacacacacctgcctgtaccctctcctggacctccaccttgatggaaggggcttccttttacctgtgctctggagctcttctcagtctcctcttgtataaattatttccccttttcccaaagccttcaaattatttctttcaactctcatcagcattaaaatgtttgcaatcttcctggcctcacttactctttcttttgccttcctgccacaaagactccctagaggaaatgtagcctgggcagctaaggacctgaactccaaaggaagacagatctggattcaaatcttggttctaacactttctagctgcaggccttctctaggcaagttatttaccctctctaagctgcagtttcctcaactgtaaaatagggatcataatacctatataattgggctgctgggaaggttaaatgagttaatacatgtaaagtgcttagctcagtgcctggtacctcctatgtgctcatgatgttggtcatacttagtattttgtagctgcttccttacaacctatctattcctcaatccactataatctggcttccttcaccaccacttctctcaaaatggcttcaccaaagtcctgtggttctgtaaccaaattcaagggactcttttcaattcattcattcattcaacagtaatttactgaatgcttactatgtgccagggtgttgtaagtgctggggatacagcagtggtcaaaacagacaaaaatcccagctgtcagagagctaatagaaaccactcactccttctgggacctcttgacagcatcagacatctctgaccttcttgaaactaaactcccttagcttaggggacattgctctcttggttttccttctaactccttgaatatgcttcttcattcaacttctcctttaccaatcccaatgtactaatgttacccagggtatccaaggttccaaacttctctttttcccttcgcttacactctccctagacaatgtcatccactcccacagcaggccaatgactcccaaatctatctttccaagccaactcttcttctggagctctagacttgtacacctccactcaaatgtctcaaaagccacttgaatcttaaacataaaactaatctaactcttcattcctcctcctggctgatcctctctctcactttgataacagccccatctattcacctataccagaaatctccttcttctacaccttccatctaactgagtagatcacaagttcatcaactcaaaataacatttacagactgtctgatatctcaaacattgtgttaagcactgagattacaacagtaaaaatactttttaaaagtcttacaattacacaatccttataatctcttaacacatcgccattttcccagccccactgggccaaagccttaattcagcctcttgtaatttctcacctggatgactataaaaaatctcccaggcagtcttcccctgcctccaggaatacccatgtcaatctactatcctcagagatattagaatatgaagataagagcatgacagtctccgcttaaaatcttccaatggctcccatagctttcagaatacagtccagaattcactgggtaatcataagaaaatgccttgtctttttctgctcctgtgcaggaactctcacaatgaacaatgaactcttaacagaaccctgaaaatgccatattttctccatatttttctttgcacatattgcttcctccaattgaaacaaactttgccttcccgccacatctcccctaattaagaaacagctctattttccttttaggaaacttttctgttattccccccctctttcctaagaaaccctcctatgtgatcatgcagcaatgtatacatacatttttcaaaacacttttcttaagatatgctgtttatttgtctatctcctcacctaggttgtgagttcctcaacaggagggaccaatctcagtgtctttgtattcccagtgcctgacacacagcagtcattcagtacatgtttgctgaaaaaatgaatgatgttggaattcaaaaaatgcatattttatgattgtgctatgtgataatcaggcataaatagcaagtagttaatgtagagattacttttatatccccaaacctagtatttctgaaatcctgagactggggtgggcgatgctaagaagacgcccagacttacacaaagtgccttttcagacactgctctgaagacctctggatccataaattctaagatttaggtctttccacttctctgagaggaagaactcgttgctgtattagggtcactaataactattagggtaacctggaaactatcaatctttacctcagtgcacaatagcctttccctctaccacccgttccctcctgaatcaaaacacttccatcgtatcaatgtgtttgattcacagaatcccagcactatggaaaaaaaacacattggtttcggttataaagtggtagctgattttgcttctggattgaaaactaagaaaggcaacccagactttgccaccttcccactctttaatgtctactctgctcccatatcccctggtaccctcctaggctggtgccaaagtttgttcccatgcccactttcttctcttccccctcccacctttatacacatcatatccaggtttcatctcccccatattctgcctaataaaagcccattatatcattcatttcccactcatttcttcattccaaccaagatatattgtgcatttaatgtgcatcaggaactgtgctaggtgctggggcagttaaaaagaaaaacaaaccctggtccctgcccttgaggagatcacagtctagcaggagagatgaacacaaacaataattacaaacattgtgataagggctatggtagatttaatagccacgtccaggaaaggtggaaggcttgacgttgaaggggacctctgagtgggatcttgaaccctgaattggtgttcaccaagctaccaagaggagaaaaggtattccaagcctgggaagtgaattggtgtagctaggagagaagtcaaggccaaccttgtcaaacttcttatcccagtaaagtgggagtctgtgaagccgactgccctgagctggggccttctccttagtgctgctgaatttagtctagatcatggtacctcctcctgt

SEQ ID NO: 111 - DNA, 32623 bp, Homo sapiens
ggcactgttggggcaatttatgccattgctacccctacttcagattcttcttagaccttggagaataccttctccttccagcacctgactcaaatgcctcttcctgcagagagctctcctggatttcgactccatccctgttcccctcacacccctaaggtggcatttgaggggagacatgggtcaggggaaggagtaccaggctttacctgagtcatgtgtgtgcgaccctggagtgtgcgtgaccttggagactgtaatgtgtgtggtcaggggagctgggacttcttcctccagtctctgaggctttaggggtcctcagggatagaaaggaagacagactaggtgcggaatgtcaggcctgccttggtgcagttggtgacaaaaatcctgtctccccagcacctctcaagctcccctggagtaagcctgcgtgcagtgcctgggagagctcagggggttgtggcggggatcctggccccgggacccactccccaagcctgggaatgtcctgggagacctctgttccttcatagtccttaaagactacctccctcccccaacttctcacacccagcttcccacaccagcagctcagacacacacctggaatccactgcacagtgagaaaggagaattgggttggccaggaacaacagccagggcaagcagggcaagtgccaggcagcagagggtagctgtccctggagagttctctgaggctccccaccccaccccagtccagaggtgaatgtagggtgtgcttgcgcatgctctgacctggactgaagtcaccctccatgcccacctccctggatctccgtgagggggggtttcctgagcccacagagagcccagcgcagcatctggcacatggctggtgcccaagaaaccgcaattgctgtgatggtcatggagactgcacagtgctgaggtgaagggcagggaccccagccagacagcctggggttcaaggccaggccagccactttccagctgggccgctctggatacgatcacatgtcaccctcctacacctcggtttccccacttagctgagatagggatattggaagggtggcactgtgagtgagtgaatttcaggcctggctgtcatcagggggacttaagggtggctcttcccatctgctatctcatgctgatgtgtgtcctgtcctgtgagctctccagatgccaggcccggcacccccggccctgtcagctgggtggggctcacttatgtacctgtcacctctgcagatgtgaggggacctcctgtgtgcctgtgtaaagccaggtctggagtcccaagagcttgccctgagcaggggagatggaggcaggagggaggctgttcccagagatggtgggagggtccccacagggctgtgctcagtgtcgcctggtcgtggccctcatgtgtccttctgtcctgtgtcacagtgcagggacttcacagcccacacgggctacgaggtgctgctgcagcggcttctggatggcaggaagatgtgcaaagacatggaggagctactgaggcagaggtgagctgctgggcaggccatggggagcgcaggcaggaagcaggtggcttccgctcggctcctgggacagtggacgaggcccccatcccagccaaactctgtcagaacacgccctgctttaaaaaactcttctgtgttccctcaaacctgggcctcccccagaggtggcaagtcactgatgatctttcaaatgcccttttttttgcagggcccaggcggaggagcggtacgggaaggagctggtgcagatcgcacggaaggcaggtggccagacggagatcaagtaagatctcccgggccctggggctcactcctctcctctgctggcagtttctgggcctttagatgaggtttaggtcttcctggcatgggggaggctgggcagaaccagggtaggtctggattgctccttggtgcctggttattgggcattcagggtgaggccaggttctgtgagggaggaagcccgagggtctgagttctggaaagggtctgggcaggggagacaggaggccatccatcctcagtcatttgcagcgcagtctgcaccagcctgggtggcctccactgaagtcctgaggggcaggtgacaggcgtctccactggtggctcaagtcccctgcagcactggctcagcatgggcttcaaggatggagatgtagccagagacaggggtccaggaggggacacacctgggttccggtgtcagctcctcaccccccagctgtctgaccatgggctggctgctgacacactctgtggctccgtttcctcatcagtgatgggaaagtaacgcagccctcctcaaaggaagaagtgggcccatgggcttagctgaggcctggttagagggcaggccgtcagggaagtggctctgatgaagcgggagtctccagccccacaggtctctgcacgcagactgctggggtgggaggccaggtgaggagatgaaggtgagttcaggacacagccaccctaacagtggagtggaggggctgctctgggaaggcccagactgtccccctgggtgaggacagagccaggccaaggggcagacagaccaccggcctccaacttcttgaaagggctctgcagagtcctcctgccgaggggccctgagcctgaccctgcagctgctgtggaaccccttcccttcctgccttctcccccgagagaggaactgaatgtgccatactctgaaggtcccccaaagacaccaggcaccctggcggctcctgcttccaaccaggagccagagatcacaggaaggcttagatgtggcatgagccgtgtgtgaggccagaaagttgcacacagccctgggaggacggagggctctgaggagcccttggagctctggtcccggctcggccaatctgagctgtgggactgtgggccagtcgcctagcctctccaagtttgtttctcacctcccactccagcgagctgccgtgcaaatcaacaagaacatggtctgagggcctcccaagggaagggctgagggccgggtgcaggctgggcacagaggagggctcaggacatggtgaggagtgaatggacgtatgcagggaggtgttttctgcaggaagcagtgcccagagctctcagccaggggaggagcagctgtgggggcctggcagcatgaccaggggagcccctcctggtctcctggcctcccagcctccaggccagctggaagagaactttcccagaaagagagggtacctcatggggagaactcagagactcaggagaggtggagagggtggccccagcagggcacaatgggagccaggctggagtgggtctgtgtgatgcaggctcaggggattgtgagtcacaggggatttacagcagggaaagagaagctacccacagaaaatacaatgggggtggggagcagggtgggcctcaggaagcaggaggtacgcaacatcttgctccatttgtagaactaggaaggggccaggtggaggctctgggcggccctgattgcgccatggttattcaaggccaggtggggcagggtctgccctgacttatcctttgtgtggccctggatggtcctccctgtctctgagtccagggtctgtacctatggaaggggatggtcacttggagaggtgttctgggcagtcacaaggacaagcagagagtgccaagccacaggggttcactgcacacagtggggctccatagtgttgctcttgacccatgtggcatgaagtactgttgatgaggccatgcagctgttcctttcggtgtaggccaagcatccatcctccatccatttagtcaccatttaattgaggacctactatgtgccatgccctggatgggtcaggaggattcactaatttaaaataaaataaagggctttgccattccttagccagagtccagcacagtgagggtgacttccttctccttcctagtcctttgcattagggcccatttatgcgccacctcctccaggaagccctcccagacaccttgccttgccttactgtcagagtcttggcttagacccaattacccctccccatgccaacctgaagggcttttggtggggaagtgtgagcagtggccgtggacctgtttcctcatcttagactcctgtggggggggggggtgtgtgtgttggccctcaggaaaggtgacccggctcttcaacatcggggctggtggcccaccctccagggcccatccctgagtaggggaagcccctggcctccctgaggcccacagctgccccccaggtctatgggatgctcattccctgccccttgcagaacgggcaggggactgggggatgggaaggctaggaacagggtgcagaacgaggacaaaagccaggtggttaagtgaccctataaatagcctagtgagccctgagggcagaactgctgcctgaaggtactgcatttctgcagtcccctgacctcaaaccagccgggagccaccctcaggcctggaggctcgggccactgaaattaacaggaggttacatcttaagtgatttttgacatgtacctccttcacatgttaactcagcaaacatccgtggggcagtggcaatggaggatggacaagtaagacccagtccccaaactccagggatccccaccagcgctttcagtgcattttaaagacagcattagggccaggcgccgtgcctcacgcctataatcccatcactttgggaggctgacctgaggtcaggagttcgagaccagcctggccaacatggtgaaaccccgtctctatcaacaatataaaaattagttgggcatggtgacgcgagcctgcagtcccagctactcaggaggctgaagcaggagaatcacttgaacctgggagacggaggttgcagtgagcccagattgcaccactgcactccagcctgggctgcagagcgagactccatcttaaaaaaaaagatagtgttagtatttgcagggggcttaccaacattgctgacatcacatgtccagccctgcagagactttgcctgactctcctttccagcctctgggcctttgctcctgctgttgccctgttgctcccctgcccagtcccacccatccctcaaggcctgcctgaaatgtcacctccctcagaaagctgtcacctccactcccctattgctcatcctgcgtcaggtaaggtgctgggggtgctgcatgcccccagaagctgcacagggcaggggtttgggaaacaaaggaaaaccaaggcaaggccagcttcctgtagcccctctgtggttaccagtgggcaggtacagcccccaaggggtgcaagtttgaatcctcacgtccctgcctcacccccagttgtcacaaaccaaaaatgctgtggttttcctgtcagagagatttttaaaatttttttcatggtctctcttcctctgaactcagagagaatgacgacattgctgaggatattggcgggagagagccaggccctgttcctgtcagatgtcccctgacgctggctcatcgtgggcacagcctcagcacagggagccgagagggctactcctgtcagctggtgggcaggcagcagggacacagtggggtcagagcaggaaacacactggaaatctggactgtatttgagcacagaatttcagactgagcttcctgagagccgagtcaaaaagggcaatgggatgagttacacatgaaggcactggtgacagatggcagtaggcagaggcctgtgcaggaccctgtcttcaacatgcgatggagacacagtagaggtgctcagggagatcttgacagtttccctgcacagacggtgggaggaagcaggaatttcatggggcagagaatgactttatgtggcccccagatcctccccaagatcagagctcaaggctgttcactttgggggttctggggcaaagctgggctcctcctctcatccacagagctgaggctgcctccttgaaatttcatctggggccaagaaagggaggagtgttctgggccttgttgtgtgagctgaactagggtggcctgatggttccagcaacggggacaggggacctggggcaggaaggcctgcagcccaggggacaggaagaggggcctggaggggccaaagcctgcctgcccaggtaccccagacagaggtagcaccagtatctatgcagtacccaaggcctagccaggtcatggggacaaatgggagttcaaggtgagcacagaccatcactgtcaagactgtcccaggggtgggacagaggctgaatgtccacctggcagtgctgtacgttcaggcaggctcccagctttcaggtgggggctgggaaaagggccagcagctcccagaacctgcgattccttacagcacccctcagcctgagaccatgaaccggggtggcccacaggtgggtttggggttgagaaaatttagattatgagcctggggacaatgaggaggagagccaggcattgcccctgtcctcaagggctcatggttcagctgcgtgacagacatccgctgggccagcccaaagtgacatcagtgctcagaaaggacaaaagaggatgccaggcaaagatgcagcaatggagatgggcacgtgcaaaggccctgaggcaagatggagcctggcacctggaagcaacgggcggaggggcagagagcagggctgacaggtgggaggtggaggtggtgcggcaggggctgcagcggtggtggcagctagcgtaggacagtcacgagatttaggagataaaatagaaggtggcggcaaggaagggagaggacagagcctggtgtgactcctgggtttctggtgtgtatagctggtggacagtggtgtctttgccaagaggggagccctggaagaggagaggtttgcagggcaggtgctgagtccggttttggacacgctgaatttgaggtatctgtcagatatgagacccaaaaggtgagggcggggaagtggatgtgcaggccctgagctctgggaggggtctgggtatgctgtggtcatgaaggaggcggggctggagggtggtgtgcgtaagggctgggttgggggtgcggggaccacgctgtgcctggaggcctctaactgaatgagtgggactgagctgaggggtgaactgacaggaagcagagggattggaggtgccactgctggtgaggagtcagagaagagtcctgagccccacaagggaaggtggggtcaccacacagccacccctctccttcttcctctccctggttccgcctcttaccgcagggtggccacgggcgcagctccttcactcctctgacccttggcttctcatctgtgaaatgggataataaaggcacctgtgctggcagagttgtgagcagttctgacgtctggatgggcatcagcagcgcttggggccgggccccaccccgaagcctcagcctcaggaggtcggggaggagcctgagaatctgtatttctaacaggctccgcggatgctgatgccgctggtctgtggacctcactttgggatccacgagtttagggcgaggggcctggcccccaccgatctcccccaggcctggatccccaggctcctgccaggctactgctcctccttggcctctgcttccccaggtgtctactgagaggagaagccccctgagaagcctgcctggtgcgctgccccctccacccagggctgtccggtgggcgtcatgaggccatatggccgccagggggcagccgagctgctccacagagaggctgcagggagagccagataaaatactggatgcccaggtgaacgtgaatttcagataaacaacaaatactttaaaaataaaagtccgttttaaatactacaaggggcatactatactcaaaaagtgctcgttcatctgagattcacattgcactgggtgtcctgtttttatgtgttcattctggcagcccccgcccatcattccctgcctcctatgcgcagtgctgggcccttccctccctccctccctccctccctccctggcagacagtgcccacctctcaactcctgcgccctgccctgctagcctctcccacggccatccaacctcctccaaacatcccccgggccacctgctgagagcccatctgaacactgtcccctcccctgtagcctcaccctggggccatttggtacctgccgaggagagagggctgtgaatgtgggagaggagttcaggggagggagggagggtcctgaagacaatcccctcttctctaagaatgcagctaggagcacagatggtgggggccttcggtacctcctccttctgccacattgcagagggttgattgctttaatttgcagagagctttgtcttccagaaatcagtctggggccccagtggatggtcaccatctggctaaagggtcccttggttctagagtgacccagggtcttcccaccaaaataaaagtcctccccactgcccaccccgccgggaggcagcctggactgtaggttcccgctgtgctctcctcctcctgacctggacccatctgttttgcagctccctgagggcctcctttgactccttgaagcagcgtaagtcccctaccctggggcaatgggatcttttgggactgcgaggctggtggagggtttggggggacagaagatgaggtgttggggctggggctgggctggcccacacgggtgagttgtgggtggctgaggcccatcagatctgacactggggaccagtatccatgctctgcccccagaaatggagaatgtgggcagctcacacatccagctggccctgaccctgcgtgaggagctgcggagtctcgaggagtttcgtgagaggcagaaggagcagaggaagaaggtgaggcaggtgcagggggcgggggagctgctcccccattgccagcctctcagttgctgtgggggtagggggctgaccttcctggtagagccagtggagggcggcaggggtggtggtgggacagcactccaggctttggggcttgagggtgatctgaagtgggtagggagggcagaggcctggccgctggcactaaggccaactcttagtcccagagccccatggaaggtccttcctgtcgagctgcctcacgcctaggaggatcctactacagcagactctagagggtctgtggcaacttggcagtgtccagaggaggcagtctgagttgtgggggtcactggaaactggtcttgagtccaaggatcagggctgattgtcctggaaaaaggcagacttgcagccagtcaccccacaggactgcccaaggctgaggggtcagacacagactggggtgggagagttgtatggcattgcttagcatccaaaggtacttctcacccatatgtagggcatggctgtcccgagacagagtgactgcatggaagtgaagtccccatcatgggaggtgtgtaagcagaggctggcagatgcttgtcagggaggctgcagggctgaagttggatataggttccctggagggcaggcaggacgcagactggcctggaggctgggcttgggcctgtgaggatgggggctgagcctctcagggccttagtgatgagggtggtgccctgcacagggtggcagggcagcacacagatccgcttcttgcctggggaggaaggatcgttgtgaagtggccaaagaattgaaaatgaaaagtcacaactgagccttgaaggggaagaagctgtacctgaggctggggccaggctaggcctgggtgtcctggccataccacttcccatctctgtgcctcagtttccctctcacaggatgggacacatatgtctacctcccaagtgctgggagctcagcccaagccatgcgcccctcagtctccacagacagggctccagctctggttagcagctctgctggcagaaatgtagcgtggctgcccgtgccacctgcccatctgccagctgggctttcaggattctaaatgtggggttctgagcagacagggggtccccagaagccagcccaggcttgaggtgccggagcaggcaccctctctgagctgggacgtgcccgcagagcctgcagagaacctgccaggaaggagggaccccggccctgctattttgggccctcctgtggccagaggagctgcactggctgcaaaggctgttttggacagagcattctttctccaagtggccagggccccgcaggcagagcgctgtgttgtagtgtgtgccatgtgtgtctgagcctgtgtgtgtatgtgcgtgtgccacagagcaaggacatgtgcttacaggatggtgcacacgtgcctacgctcccctgcatatgcctgtgagcatgtgtccttgtccagccctgtgcacttgggtgttttgtgctgtgtgtgtgtgagtgcctgtgcctcgctggtctcccagctggcacagaacccctcccctgagaccccaggcacaaactggctcagttctcctcctacctcataacccagtcgctgtcctggctgttttgccttctctatcagaacaggaagcctgggaggtgaggggaggctttggccccagacctcggcacaggggcccagtggccactgtgcctgcatgtggcctgtggttgtgtgtgggtgactgtgggagtgtgtacttgtgagtggcatctgtgggtgtgcacaggaatgcctgtgatcatgcgtgtgggcagctagggatggggcctgtgtgcctccgagttaatgtggaactctgcatgtatgtgtgtgccagagtgtacacacacgtgtgagcgactgtgatgcctgcagaggctcagggatgcaggatgaacgactgtgtgcgcacgtgtgttggggtgggaactccccagctggagacgaagctctggccaaggtctgcagcaaggacctcacggcacacccatgccctgtgattctctgtggccttccattgtgagggtcactgtgaagcagcaggctctgggggagggagggcagcctgtcaccctctctccagagccaggagaggtgctgcgcctcatcccagggacactccgtcctcttggcctaggggagcctcccgaggccgcggccctcggctcagaacctcgtgtcccctgcagtatgaggccgtcatggaccgggtccagaagagcaagctgtcgctctacaagaaggccatggaggtgagcgccagggcctggggccgcggccttccctcgaggagcagcgcaggtctcagggtgcgatcctgggctgtggccccgggcagggcatttggaacaggctgacctcagccttggtcctcggacctcggccttgggcgcaccagcctgcggggcgcttgggcccgtgctgggcgctatggccccgtggggatggtcccgggcccttcccttgtggggctcgtgaatgaagggcagatgaagtcagctggggactccaggggtggagggaggagggacccctgagcttgatcctgcgagacgctggacaggaagggagaggggctcctaagagggcgcggcgtggcgaggggcgtggcgaggggcgtgccctcgccgaagagcacagcccaggaggcggggcccggggcaggccgcgctgtcctcagtggggagggcctgagagcaggactaccagcagcccccacgccttctctatctccttccggacccccagatccctgtccctggtgaggatgcccccactccacccgcaaccctcgccagggaaaaagggaggctgggctaagggagcctcactcccggggaccacagaacagggctgtgcagcccccaagtcacgcccctccacacccccagtccaagaagacatacgagcagaagtgccgggacgcggacgacgcggagcaggccttcgagcgcattagcgccaacggccaccagaagcaggtggagaaggtgcgctgggctgctgggccgtgtgggtcgcccagggctgggggcagtgggggaggcaaggaaggggtgccgtagacacccccaggcaagatctgcatctggggatgctgcttagccctctctgacccccaatctccccatctgtgaaatgggtttcctggagagaacctcaggccatggacaggcaggtcagctggatcccctttgccaccgtcaggcggcactcagggacccattcctcggtgcaggcccactgaggcccacagggtgatgagagcagacgccaaccctcacacaaccttggagaagggctcagtaggcccatgtcacagagaggaaactgaggctcacagtaagtgacttgtctaaggtctcagagccaggaagcagcagaaaagggacccccaactcaggtggtctagagcccatgctcctgatgctgtggcccctaggccagagtgggggtatcagagctcccagagcccaggaaacacatcactcattgcacagacaggaaggctgaggcccagagagggaagtggcctgagggtgagctgggggcagtcagtcaggggccagagcccaagtcccagccagggggctcagcagtagttgcacctctcctgtgggttgtggtctcactcttcacaggcatcctcctgggctcggttcctgtcttcgttctctttccatggagctagcctgtggtcctctgtgggcggaggttgcttgtggatgatggcatctgcccatagttggctcctgaatgttccccccagggtggccggggaagcttgacagtcacttcaggtctgctggggtgggccctggctcctggggcaggggcttagcgctgcttcccctctgtttcctcagagtcagaacaaagccaggcagtgcaaggactcggccaccgaggcaggtatgtgggcctggctgccccgtccgaccagggcggaggcctgggcggtactccccacacacacctcctcaccctggggacacacacactccccctggctgcacaatcatgggcgcggcgctctcattccagatatgtgccgtcaaagtaaacgctgtgttcccccattcgccagcccttcttggcgcttcatgtgttcagtcctcacagctgccctccgaggtggctgctgttactgttccctttcttaacagatgaggaaacagaggcactaaaaggtccagtacttgccccaggttacagctgcatttgaacccaggccatcgggcttcagagcccaggacttgtgcacatagccttctctgggcctctgtccttcacttgatgcccgaatcctaccaacactcttgtccctgctggtgccccacccaccagacacagcacccaccctcctcccttcccctgggaaggcctctcccttctgctctgcctttactgggactcagctactccctcggctgggggacaggtgacctccagagatctgggcacagaagttgtgacccaagcctgtgggactccacccctcctccagcgccctctcagctgccttctctgaacctcagtttcccctctggaaagtgaggtggggcgcccagagatgcccagaggccaatactctggacttgcatatatgaggctccactccagccctcaggcagctcagagcacagttggggagcagcagcagcaccagcgtgggtggccctgacgggcattcagatgaggccccgccatctgctagggcaggtcccatgggggaggcggggctcccagtgggaggaggcatccaggatgggacctgctggagtacaggggtggaggagctcgtgtcagggccctccctgaggctgcctgcgctttcagagcgggtatacaggcagagcattgcgcagctggagaaggtccgggctgagtgggagcaggagcaccggaccacctgtgaggtgagtggcccacgtggagcctcgttttccccagctgggaagtgtgagacgcccatccctactccagctgcttaaaggggcccaagtgaggcagttggggaaggtacctgttactcactcgtttattcagcctcctgctcacaggcctgtgctgggccctggccctgttgcttgtcgcctggccttgagtcctgggccccttcgttgcaggcaggcattcttccaccctctttgttgaagccaaaactgggacttggactaaacccacagcctctctgggtgctgccgatggacagggcctggggaacagggctcaggactcccgtccgaggtccctctcactacccttctgcctcggtgtggtgcagcctgaagggaggctggggcagggaccccctgggcatctccacctccctccctgcagcctcagggctggcccggagtcgggatggggaccccagggcactctctcctttggactgggcttccagcagagagggctggcctggtcagctccggctgagctgtgaatggggcccagcctggccgggccctgcagccgcctcctcactgctcacctccctcccactgcccccaggcctttcagctgcaagagtttgaccggctgaccattctccgcaacgccctgtgggtgcacagcaaccagctctccatgcagtgtgtcaaggatgatgaggtgggggctgagggccttggtgtggggtaaggtagggcagcctctaggcagcaaagcacccaggtccatctgagccggtcaacaagcacctggtcctctgtgatccaagcctggccccaggggtctcaggcctcagcagctcagcctttgcccccagaaccccaagacaggagctcagtaccacacagggccatggcttctctgcctggaagatgatgactctgtggttcccctgacttcctccttatgcctcagagccacagagcacctgccccctctgccggggatgggaggggaggtggacacagctgtcagaggttggcagaagctggaggaccgtggctgctctgctctaggcctggtgcttgcaggagccgaggcgcagtccttcctctgctccccacatctccagggtgtcctggttccccttactgagcccaacctgctgggtgggtcctccccagcagagagggcccccagccagggtccctgagctctgtggatggatgcagcccagcacacggctctcccgggcagccctggcccccttgcctgctgtgtttcctgcctgacgctcctgtccggggctgtgggggttgattttcttgttgtttttgcccaagtgactcgagccccctgctgcctcctcgcctccttgaggtagaagggcgagctctggacccactctcctagccccaaggcctggctgtgctgcattctcgctgtgaccttgggcaagtcactctcctctgagtttcctcatctatccaatgggaaaagtggggtctaccttagaggacaggtgtgagttaagtcccttgcacagggccttgcacacagaaggtgttcaggaaacaggaagctgtcagccagggccgtgacccctcaggatcaaagaccccgagccgcgcacaatggcctgtgaggaggccggtgggtgggggccgctggtcagagttcaggcccacagaggggcagagtgggcatcgggctgcggcctctgctctttcctgccccagctctacgaggaagtgcggctgacgctggaaggctgcagcatagacgccgacatcgacagtttcatccaggccaagagcacgggcacagagccccccggtgaggtccggcttgcggacagcgcagcctctaggtgcattgagcccctgggaaggcccggccctgagcctcaagtgccaggaccgggctggggtagctcacagctcccttcagggcagagaagccctagcaggggttgtggggagttgggtcccaggcctgctgcctcctctcaggcaaagctaagggcatgatggcactcagaggaagaggtggggatggggattgaggtgaggagctcccacggcccccactccccgcctgtttggttccactggatcacgggtccagaatattaggtcttgatggtacctacggtggggtctctcatgggagcaagacaggcacctcctcaggcaccaggatgggccagggccagattgggaatgtagggccccagctgagtctggcagggccagaatggggtgttgggggccgccctggggctcacggcttgctgtctgcagctccggtgccctaccagaactattacgatcgggaggtcaccccgctgaccagcagccctggcatacagccgtcctgcggcatgataaagaggtgaggccccgacagacggagggagggcctaaggctgggccaggaagtgggtcgagcccctcctctgcacctggcccttcctcgttcactgagcacctactatgtgtctgtatctggtgcccagtttaggtgctgggcactctgtggagacaagataggctcagttcagcctatggaaccctcagcccaagggacccagacactagaataatcacaccccaattattcactaggggaggtgctccgagctctggggaggcccctatgctggcttccttgtccctggggcctcatgtgagcctggtgccctgtcaggctgcagtggcaacgctgtctggctggagcaggactggggcatctggagaattctccaggcttttccagggctccttccccggcctggctgcagtcaagtgccaaggtcctagtgctgggcctcaatgtgtgacctgggcaagtcattcacactctctaaggccagggccctgagtgttggggtcagattcagaatctaaggactctcctggttcaggccttgagtgacgaaggtgacagcccattgggagcactatagccagcttagggagccctcgtagccaggcctttgagggaggccatgtgccctgtgagcatccacaagggtctgtgggtttcacatggtgcctgtgcccccaccgccatgccaccactcttcagccacccttcaaccaagaaggccctgcctctgggaggtagtggactgtggggagaggctgatgcagttcccggcccttcccaaggaccagctcattccagggcctcaggagcccctggaacttcctactcctgggaggcagaggctcgtgggaaccacccgtgcttagagagggcacacacacaccctctttgagaatcttgtgcaagcagtgaccccaggaggcagcacacccgcagcctcacatgctacaaaagcttgtgagacaggcttccctgtgcctggtgaggacctggatcccagcaaaggtggtcatttaagcaactggacaaaagagctcacctgaagcagtatcaggaaggggcagaaaggagtggccccagagaggattagagagagagagagagatgtcctgcagggccgagggaggcctggctgctggagggggctggtcaggcctctggatggggcatctagaagccaggcaggactgggaagaggcgggggtcagtgactgggagtcagaagtgtagacagtctggggaaaagaggtgtgggggcacgcagcacaatggctcagcaagccctgcacccctttccccctgccctggccgcttcctccacctgtccccagcccctgctggcttgcaccctgtcctttgctgcctggggagctggcacgtgtgtctgcccgcctgtgttggtgtcaggccctcccatgtgctgggtccacgcatgtccaccctgcgcatgtgtgtgcactcctggggccttggccctcggcgcctcatgtgggaaaggccccccacatgccaccttgaattgcagggctgccccccacaggcccctgagtcatggctcagcccctcacctgcattcaagatccctcagggtctggtccagtctctatttcagtcctgtcccccacacacccaaattggtccactccactccacaaaccccacctgtgccatgcctcctcccctgcacctgagccctccctctcctggtcacctgcagtgcctcgctcccccttctctcctagtaaagcttcactcatctttgaagactcagccccaccccactaagaagccctcttgccttggaggcagtgtcagcctctacttgttgagccctcactactgcccacttcagggggtgcccccagcatctgccgcatctgcctcttctgttttattttcctttattcagtaaaccttcatgaccccagctcagtccaggcctaagcctggtgcaggggcaggggtaaagtagcccagcgctgtcccggaactcctgtgaacagggtggctgagctggcctgatcaccgtgggcccacagggaggagggctggctcggcccaggcagtggaggcctcagcagggcacgtgagccaggctttgtgtggcagtgcaccccccacccctacccatgggggaagctgctagggcaagctagagcaggggcctggagggtgaggactgggcatcttcccacgaggcctcagtgcggaggtcctagaacccccaaagggccatgggagtcttccaatgaagctacagcttcgggggttctaggatcctcccaagggccctgcagggagcaggtgctgagatggcctgcagagggcgccagtggagggcgtagctggggaaggaggagccaccaggactactttctggggagccctcctgcctgaggggcacctcataaatgacatccatgcctggaggctaggggcagtcccagccctggcagagcgcgtgcagctctgagacctctccctgtctaaaccctccctcctggtgggtccctgagtgtggggcggggacactcaccctctttcctccctgttcccaggttctctggactgctgcacggaagtcccaagaccacttcgttggcagcttctgctggtaaagggggtcaggaggggacccccaaacacactgatcctgggggggaggagaggtctcccacatggcacagatggggccactgaggccctcaagaggaagtgtgtgtcccccaacagcaagtgtggacagcagaaggaagaggcagggcccagcatggagaaaccccattctagtaggacttccaggggccagtgtccccagaaggggaggggtctatgtctcaccctgctcttagcgtccacagagaccctgacccccacccccgagcggaatgagggtgtctacacagccatcgcagtgcaggagatacagggaaacccggcctcaccagcccaggagtaccgggcgctctacgattatacagcgcaggtgaggcctctataccccaaacccacctgtgccacctcccctgcacctgagagctccctctcccatccagtgccttgcgtcctcatctctcctcatggtttcactcatcttcgagcatcctctcctcctcaggagggcacgtgtgcccgagtgtgtccacactagcaagggtacctgggagtgtgcttggatgtgagctctgagaacagcacccagggcttgcggggcctcagtgtgcatgtactgactggaagctggtgtgcagcaggcctgtgtctgcccgggcctgtacacagcacacacgtggagcacatgtacctatgccgtccacacaggctgggcgctgagtggtgcacacgtgcggggagctggcagagcctggagctgcctgcaggtcatagcttgagggccaggctctgtgcctttgggtcagggccctgtccttcgtggccatgggtgtggaaaactgtggccagaatgagtcttgctatcgtgccaggattgattttctgatgtccatagggtgaggatgaaccaaggcagccacagggcagctatgagagtcctttctgctccctgcttgaggggaagaatgcatagccagacctcacatccacctggactgaggccaagcacccccacatagccaggcaggctgggtgtggactccactgatgaggccagggctcggggaggcagggaagccaggccaggagagtgatggggtacttggatggcagtggctagctggggctggggaccgcaaaggggaggcttgtggtaagcttaggcatgagtgtgccctgggcttggggtatgatgagcacccgtgacccctgacatgctccagtcactgcgtctccagaatgggagaggggaggtgaggctgggaagaaacccaggttgggggagaactatgatgacaaactgagggggatgggaggcccggtccgttgggttacccccatcctgtgtccccaaggggctgcccctgcccaccctgggagacatgccgcatttactgctgggtgggggaacgccaggcccctccctgcaggcccttccctgcaggcccttccaacgtcatgcgctttcaatctcttggccagaacccagatgagctggacctgtccgcgggagacatcctggaggtgatcctggaaggggaggatggctggtggactgtggagaggaacgggcagcgtggcttcgtccctggttcctacctggagaagctttgaggaagggccaggagccccttcggacctgccctgccagtggagccagcagtgcccccagcactgtccccaccttgctagggcccagaaccaagcgtcccccagccccgagagggagcctgtcgtctcccagggaataaaggagtgcgttctgttctccttggtgtgctggggtcccgttctctttttctcctgctccagtgtccgagtgctcagttcagaggaggcaaaggaacaagggaaggagcctggatgtggagctccccaactcagccgaggcttcagctatagttggagaagaggcctggccccagttgctaggagctcccagactgccaaggagacacattcacacctggacagaggacacaggggtgcaggaggatgtggcaggggcaagaaggggctcagcagggctgcaatggggagagcaggcttcttgggggcggagggttgagcaggtccatggctgggcagcagtggccaggccagggcaagtgcgtgggcaaaggtgaggttgggggtacacccaggaatattcggaggactcagtttggaaacaggaagctggtgatggatctgttggagaggccatggtgggagcccaggaagacaggcttgtggcttgtgggtgcaagtggggcctggggaagccactgctgcccatgacactcccctcaacatggcaaccccggccgagcaggggtccacagcccaggcacgttggccccgggcacagagggagctgttcttgaaggccttcagccccttctctttttagtcccaggaacataactttcactgctggccaagccctgctccaaccatgataggcttcatccatgccaaaggcattgggagtgggtgtggaggagagggcccctggccattgaccactcctcagtcctgggagtggccaagccggcccacctcacaccctcctgggatccccacccggcttcggagccaggcaggcccaggactgtaaggggcgggatgggggacacagtggtcctcctctgctgggaccacactgatgagctgctgcagggcactgctgttccccatggggaggggggagagagaaaggagggaggggggagagagagaaaggagggagggggggagagagagagagagaaaggagggggagaaaggagggagggggagagagagagaaaggagggagggggagagagagagaaaggagggagggggagagagacagaatgcccatctttataccctgatctttacttgagcaaaaaattgggttcagttaagcaagcatgagacatggacattctaatgactcatgtgtggcccacactgtacctgatgatgggggtgtggtgctaaaaggggcctcaaagagctcactcagcccaggaggacagacagccaccctctaggccctgagatgtgaggcagtaagtggggggagtggttccaggggctggtgcaggccatccagcagaggggagggtggcttgtctgggaagtggtgactgggctggagagcaactctggaagaacacagggagcagatggacaggacttggtaacttacgggatgggagatgggtgggaagagagggaaagtgaggaggtgaggagtgacttcggagcccagacttgaagatgggctcctccccaggtggaggagctggaggggagtggtgcgggaacaaagcctgggcgagggctgggagaggcgggacagccgcgtaggcttaccactgggtggggccatgtgtgggcagggaagggaaaggaaagagtaaaaaggtatcaatactttacttattccttgaagatgccttgtcatcttgattgaacattccattccactgcaaagattttttaaaaaacctttggcctagatatttatcatcatctctgacaggtgccgcagtgtctgtgggccccagagcgtgatgggtaacaagtgctagataacagagtctgttctccagtcattcgggtggccagagaatagaactgaaagcaactcttgggtcacaatttatgccagggggagaatgcccacaaatgaatccaagtcagattcactgcttctgcagctttctccgttctcccatcactgggcaccacctcagctgctgggaaccaactgcatggatggatggccttcccagcagagacggtgccagataaagagggagttagcgtgtaattgggtgtataaataactgcagcctcttcctgaccgagggccactcaaagacagcaaggagcaggaggacaagcatggtctctgaatcacaacatcagggcctgaatccaggctcacgctttcttgggtggtcttaggcaagtcacaatttctctgggcctgtttcagcatcagtaagatgggtgcaatatgcccccatgcaaaatctcctaaggttcaaattaaacaatgattaggtattacttaccagcaagggataccacttttaaggaaaagacccacaacctctgaatcttggctacactcaacagcagctttgcgcttggcataatccccctcgctcagcacaccctctgggacagctgtggttatgtcagtgaatccttcgcaatgatgacaaaaagcagcaactcacgtttggccaaactggaagcacgcgccactggtgtccaacacctaattccaaccactctcacagcctttcctaggccaagaaacctcagcataagggtcacctgcttgccttggtctgactacctgggtgtctgcctatttctccatcccggcttttgagccaacacaagcccaggacaaggtcgcaccagcaactgggctcgctgccctcagcaccctcacgggattatcaaactgtgctcagtagagccctcttaggggccagtgggaggagaaagggggcacccactccacttcgagatctacttggagagtttacatattgcacgtgcagtggttctcaacccagctgctcaacggagtcacctgagcagattttcaaatgctgatggttgggtcccacctcagacaaactgaaaccaaatccctgcaaactgagcttgcgcataaatatttgaaacattctcctggtgattctgatacgcagccggagctgagaaacccctggctaacaggatcttcagctaaacatttttaaaagtttgaaaaacagttatggcaccatagtgacttatctcaggtgatagtgcccactacctgccagatggtgggataacaaagatcagcaagtaggccgggcacggtggctcacgcctgtagtcccagcactttgggaggcggaggcgggcggatcacgaggtcaggagttcgagactagcctgaccaacagggtaaaaccccgtctctactaaaaatacaaaaattagccaggcgtggtggtgcgcgcctgtaatcccagctatgtgggaggctgaggcagaactgcttgaacccaggaggcggaggttgcagtaagctaagatcgtgccactgaactccagcctggatgacagggcaagactctgtctcggggaaaaaaaaaaaaagatcagcaagtctcttttctaccctataatttctacatctgtcttactttcttcattggataaactcaggggagcaggatttatgtatgactcaacttccccacaaatagcaatgcagcagcaccattcagtagatacgaggtttctgccacgtcactgtgttacaccctcaggagacctcacagatctcacaggcactgcaatagaaagccacgtgcaacacacaagttattttcaagaactgcaaggatgcacccaaaaagcaggtgctgttacacaccaacaaccaccaactcggaaataagttaggaaaaccattgcattcacaatagctacagacattaagcttcacagaaaagtttcctaagtaaactctgttaagatccgaaagaaaaaaacccaataaccaatcaaaccgggcagaggacagaagcaaaattcagaagatacaaatggctgaaacacctttaaaagcatcctggccctagctaacagtcaaataaacacatattttcatctctcagaatggaagaaaagatgaaggctgatcacaccaaaagtgtcaacaagggtgtaaagaaatgcacatttcattcactgctggtgggaatagaaattgatataagctttctggagagcaaccagatgtatccatgaaaatgtttaaacgtgactttttttttttttttttttgagacagagtcttgctctgtcacccaggctggagtgcagtggcataatctcggctcactgcaacctctgcctcccggttcaagcgattctcctgcctcagcctcccaagtagctgggattacaggtgcatgccaccaggccctgctaattttttgtatttttaatagagatgggtttcaccatgttggccaggctggttttgaactcctgatctcaagtgacccacctgtctcgacctcccaaagtgctatgattacaggcatgagccactgcacccagccaaacatgacttttccatccagagtaaatccaactaacaagaatccacccttggagttcatgtaaaaatacatgacacagggtgatgaaagtgctttgaaactagatacaggcagtggttctatagcatggtgaatgtactcaaggcaacttctttactttaaaatcgttaattttatgccatgtgaattgcatctcaataaaaattgttttcattttaaaaattgtaaatgactgcagtgtgtgtatagagatgatcactgtggcgagtagtggaggcactggaggcagcctgcaggcctgccctttatacaccttggttaatcatggtactaatgtacccacacagctaacacaatggaatgacaaatcctacagttagacatggaaggagcatcagactatgttgtgaagacagaaagaggatcttgtaggataaaattcctattagcaaaaagcaaaaaccaaaacccaataccaagtctgtttctgtgtatgtagtctgcaaagacacatgccattgctgaactgctgaacttgcttccctgtgggtacttctttacagatgtctgtattgttcacattttttaaagcaccaattacttttgtttaaaaaaatacacttaaaaaaggcagtaagacaagctctgtcaatcatctataggacaagaagcaaagacaccccagctgcaataagcacacctagtgccagggaccagggctcctgggacaaacactgatccatggctggtgcccaggggcctggaacatcttgttagatcagaaattaggggagtgcttccaaaaatgctgggatataggaggcactcgaaggggctctcgctggccaagtcgggaactatctgaggaactcttcccccatccccaaaggtcaatgatgaagtcgacttttgaaaaaatgggaatccatagtggatatatgaaaataaatgaaggagaagggagggatgactggcaaatgaggaaggagtgctgggctgcagaaacgtcgcttggcagtcatcataaagattgaatcaggccagaatcagcaacatttgctgaacctggtcggggaatgggggaagagtctcatgaggaacagggtatgtacatggagacagtgtgtctccagagatttcttattagttgaaaagaaaaaaacagtaaccatgctatggagaaagtggacacacctcgactaggtgtgccaggtactcatttattgcctcttaactccaaatttccctgaccttgcccttccttgtcacactgaagagggggctctgaaaactcctttaccctttgccagcctgacccacagtgggctctgaaggggctaacaaggctagaggaggaagatggcctttttcttctgtctcctttcgtcctgcacgggtcccagcagcattccccaccgtgacagctctctgctcctgtggcttggcgggggggcacctccagtaagttgattctccagcatgggacaggcagcatatcccaggcaaccacagccacccctcggaggtctctccaccttggggaacctcctctgagtttccacgttccttctctgttttctcttcccttagccctaggggtgatggctgttctctgctaagctgctttagagctcttttttatcccttttagtagttaactaccttctacacagttaacaattacttatattaaaaccttcctgttcacatttcctcctccttggactagatgatcaaaacgaacatccccactgtggggcagatgggcattgtgtgcctcgagatgcgatgccctgagaggccgcgtgacgcaggtagtggttcagccacctggaatgcaaaaccaaatctaatcacgaggaaatcgcagacaaacacagataagcagcaccacctaaaacgaactgtatccttacaaactgttcctatcatcacagacaaagctatggaaatgatccagattaaagaagaccaaggagacatgacaactcaactgattacctgatccagaccagatccagcaccgcagagggaaaggtgctatagaggacacgatgcggccaatgggaatatgagtggtgaggtattctatcagtgttagatggacggaatttgacaactgtactgcagtcgtcagagagtatcttcttcttggtaagtacccactgaggtattaggggtaaaaggccatgacaggtgtggaggcagcaggagggagggagagggagagacagggggttggcgcaagggagagagaacgcacacacatttgagaacacacatgacagatagaatgggacgaaatgttaataggtgtatctgggcaaaggatatttgagcctcatttgtacagtttttattcttgcaacttttctgtagctttgaaatcatttccaagtaaaattaacttttttaaaagaggccatacaatatagcagtggtcctcaaccagggctgtgtcctggacacaccctagagcaccttagatgctctgggacccaggcatctgtagttctcaaagtgccccggtgcttccaatgtgcagccacgggcaggaaacaccagcctagtgggtgagctcactcactaaatttcagacatgacgagcagtgcttttgctctctgaagaacaagcactgggtaatgccaacacctagcctcagctacacgggggaagggcagaaacaagatgttgaatttgcatggccctggccaacacagacaacatccccttctagtggttcccaggcaagagaaaaaggcatttccaggacaactgtgccaggaattaaacacaagttaaaactggcaggagctggaatggtttcccagacctcagagctacctccccacctccatctttttggtctcactggtaatatggccagtctgggtccagctggcagagcacacgggaggaggctgctctctcaccaggcaaactgaggactgagtacaggaagggtgtggagaattatcctcttgggcaagttgaagaacaaggctactgcttggcatatttcccaaagccatttcccactctagaggccctgttctgtcctgtagaaagagtggagaacaaccaacatcacagtccaaatattgctcacctcagggccagcctgtgacagggtacccacaggatggttcatattgaaaactggggggaccatgctcgggggaggtggtggtagtgaaaggtcacaaacattcttgcccactgtgcaacaggcaggggcaagaggtgggatgggtcagtagtcacatgataaatcccccggggcctctgaaatcacattctggtaacttccactttgtgaaaaggagttagtttttactcctctcctttcccgtgtcttctccattttcaggtgggacagatctgcatgatatttgggcatctcaaaactgacgagcccaaaactgaccatgagtcacacccccagatgtgttctctaactactccctagctctgtgactttgtttccccagttgactgagccagaaacctgggactcatcctagatgagtcttctcttctcccttctctgtcccacgtccaatcaatgatcgaattccaccactgtcctgcctccaaacagccagaatccaccgctcaccaccgcccccaacagtgccctgctgcccactgctaagctctctcaactgctatgccagcctaactgaagcccagtcacaccaattcatcctggcttcagcacggccggcttgcatcaccaccttcttctcagttcaccttccaaatcaaacctccaaagagctgcttccacctacaagtcagctctcacctccacaggatgttccgtaagacactagagggcctgggctttcctgcttctccaacttctttccccagccttgtattttaagctccctgcacacacaattttgtttcacactcttgtgtaccatctttcaacaaagcctatccagcctccaagcttgggcatctcctccaggaagtcacccctgacctctccggaactcccctttggactcccattctattactacaaccactgcagtgtgaaaattatcttctcctatgtatgtctcctatactaggactccgaactccttgaagacaaggacagtatcgccactgtatccccagtgcattgcacaaagtagagctctatatttctaggatatactggactgaaagcatctgtggttttttgaatatcaagccctttagaatctggcaacagctataacgaaaacacacgtaaaccatgatgaactatagacagcaccaacaaagaaaacatgatactgctgctctggaactgaaatatcccccaaataatgaaaaataatatgttgggggctgatacagagtttattgaattagatttttctatttacaactgagatcacatctacatactattttgctagtctacatgggtacattatttccaacaagcttaagacttaccatgaatgggctcattcatacaaaaacacactcacactaattcttttaaaacagtagtgcatacattatactcctcctataaagccaactttgattaaaaaccactagtttcaaagctcagtctctgattttgaagatgaaccaagatatacgccatatgatcctacaatctattttagtcattttgtacagctgctatcttattggactacagtaaatattttttaaaaggacaccaatgaggggcaccatctggtgttaaccttaaccagaaagctggtttcctcctcctccccgcaaaaacctttggccaagagttctccactgtgaagactgaaaggacctggtgacatttcggcatcagtcctgttaccacttggaggtaacagaagcaggctcgtgtcctcctttaattctaccacactacatgactcgcaattggttctgaaattagaacgttcaccatcgtacttaaaatcttaggggcatgaagagtcagctagaacaaggaaaaagaaagtcgcaggtagtaggtaagtaggtgggcacatgaaaagccaagctgctctgtccaacaccagtgtacatgtgctttaactaaatgaactccagaggccaacagcagcagacctgctcaattcaccttccaaatcagaacaagaccaaaaagctcaggcttgagttgtcaactatgcataggttccgccagtgatgaggagctcgtaagcaggatctctactccttctgcacaacacgatgcaagcacacagcatgcccagcagctgttgaaagaaaacaacaatggggaaaaaaggctgaaaaccctctcatggcaggtgtgtatttctttgttggtaaaagagctgtttcaaagttcaatgacttcaaatcatcaaaaaggcagtaacaacagtgatagaaggaatttcttatgagtacattattttttaaggaactaagtcctaagcttcagcttccctcccaggaactcttcgtaaagccagcagggaatcaagtctctcttatttggcatccccactactagtctagcgagtgctgtccgaaagaactttctgcagcgatggagacataccacatatgcactgtcatgtggcctcatgtgactactgagcacctgaaatatagttactgcaactgagttgcacttttaattttatttaaattaatttaaatgtagacacatgtggctagtggctaccattctggacagcaaaggcctggggagtagaatgagcaagaatgtgtgtgtttaatagtggtcttttcaggtcttttggtttttggaaaacgaaattcagtatgtgaatagccctatggtagaaaacaaattctgatgccaaaaaaaatgtagttggaaggttttttgtttccttcacattcactatttttgaaatccacggttctgtggtattacatacatattacttttgaaaggtcactcttccgtcatcattttatttcaataagtcctaaaccttctgtggtagcatattggaatagtaataaagtcatgccatgttattttggataagcaaaaggattaagctggattaaagagaaaatgattctagaatttttgacctaccttctcccaaaatataatttttttgtgagataatttgctgttctaacttctcattgatgaggaaaagcctcagttatttgattttaaaagacagggtcctctgtacatttgggggtcaatctaatttccgcaaaatgtacccaatccataaacagactctcaaagtttgaagtggaagattaaccactactaagacacacatacacataaggatgtcctcaatctgaattctccatggtataaagtcacccactccaatttctaccctcacattaacctatattctgcccattcgggatatatatttcctgctcaaatccatcagtttcactatttcaccacttgcaccatttgcaccatttcaccatttgcaaagcaccttaaacacacttaagaggtgaatattatttaaagtttactaaacaatttaagtcaattctagaccgatgaagtacctaattcctagagaaatacatttctgttctctgtacatcaaaacattgttagaacagctataaactcaaatgcaattatgttctcaggcaatgttaaattgagcaataaaaatgctaagctcagaaatgactggtttgctaagggaaaaaaaatctctcttcccacccccacctccccacactcctttcaattggttaacttctattagagaagccagcattctcaaaatgaggtctgaaataagtatttctttcccaatttgtttatttcaatgaaatcaacttgtattgattttaaaacaaataaacttgataaaattctactcatgcttgggaatcagtctgcttaagaatattaagctctacataataatttcttatcctcaccattaactattacaggctcatttccaaaggcctgctatactgaaattccattgatttttgaaacattccaacaacatacttggaaacattacacaaatattttatctccaacattatttcttgcaatgaaatactctcttgcaatattcaaggcatgagaattaaacttcacttagcccaaatataacacccagcaactgcaaaaattgaaaaaaatgactagtggtgattaaaaaaactgactggcaaagtaaaatgttctatgatataccatgttgctggtggtatggggaaataggcattcttatacaaaaataagaacttttgcacattagaaacactcttttctgagaaaaaattggaaatacctatcaaaattcattcatacattctgatactgtaatttcatagttacaaatttttgctataaacagcccatcaatattgattaaagtatgcctataaaatggaatactatgcagacatgaaattaaaaaggcagatctatatccaaaatacactaatttgtttttaagaaggtacaaaaggttgcaaactatatgaattcatttatataacattttgcaatgttggccagggtgtgaggggaaggaggaggaagtttctcattttaacgaataactggtaattgaggaggaggaggaaagagcagtctccaccggcttcacatgcggcacagagaccagaaaaaaagcaacatggccttgggaaa

SEQ ID NO: 112 - DNA, 14283 bp, Homo sapiens
ttttaaaatttttttcatggtctctcttcctctgaactcagagagaatgacgacattgctgaggatattggcgggagagagccaggccctgttcctgtcagatgtcccctgacgctggctcatcgtgggcacagcctcagcacagggagccgagagggctactcctgtcagctggtgggcaggcagcagggacacagtggggtcagagcaggaaacacactggaaatctggactgtatttgagcacagaatttcagactgagcttcctgagagccgagtcaaaaagggcaatgggatgagttacacatgaaggcactggtgacagatggcagtaggcagaggcctgtgcaggaccctgtcttcaacatgcgatggagacacagtagaggtgctcagggagatcttgacagtttccctgcacagacggtgggaggaagcaggaatttcatggggcagagaatgactttatgtggcccccagatcctccccaagatcagagctcaaggctgttcactttgggggttctggggcaaagctgggctcctcctctcatccacagagctgaggctgcctccttgaaatttcatctggggccaagaaagggaggagtgttctgggccttgttgtgtgagctgaactagggtggcctgatggttccagcaacggggacaggggacctggggcaggaaggcctgcagcccaggggacaggaagaggggcctggaggggccaaagcctgcctgcccaggtaccccagacagaggtagcaccagtatctatgcagtacccaaggcctagccaggtcatggggacaaatgggagttcaaggtgagcacagaccatcactgtcaagactgtcccaggggtgggacagaggctgaatgtccacctggcagtgctgtacgttcaggcaggctcccagctttcaggtgggggctgggaaaagggccagcagctcccagaacctgcgattccttacagcacccctcagcctgagaccatgaaccggggtggcccacaggtgggtttggggttgagaaaatttagattatgagcctggggacaatgaggaggagagccaggcattgcccctgtcctcaagggctcatggttcagctgcgtgacagacatccgctgggccagcccaaagtgacatcagtgctcagaaaggacaaaagaggatgccaggcaaagatgcagcaatggagatgggcacgtgcaaaggccctgaggcaagatggagcctggcacctggaagcaacgggcggaggggcagagagcagggctgacaggtgggaggtggaggtggtgcggcaggggctgcagcggtggtggcagctagcgtaggacagtcacgagatttaggagataaaatagaaggtggcggcaaggaagggagaggacagagcctggtgtgactcctgggtttctggtgtgtatagctggtggacagtggtgtctttgccaagaggggagccctggaagaggagaggtttgcagggcaggtgctgagtccggttttggacacgctgaatttgaggtatctgtcagatatgagacccaaaaggtgagggcggggaagtggatgtgcaggccctgagctctgggaggggtctgggtatgctgtggtcatgaaggaggcggggctggagggtggtgtgcgtaagggctgggttgggggtgcggggaccacgctgtgcctggaggcctctaactgaatgagtgggactgagctgaggggtgaactgacaggaagcagagggattggaggtgccactgctggtgaggagtcagagaagagtcctgagccccacaagggaaggtggggtcaccacacagccacccctctccttcttcctctccctggttccgcctcttaccgcagggtggccacgggcgcagctccttcactcctctgacccttggcttctcatctgtgaaatgggataataaaggcacctgtgctggcagagttgtgagcagttctgacgtctggatgggcatcagcagcgcttggggccgggccccaccccgaagcctcagcctcaggaggtcggggaggagcctgagaatctgtatttctaacaggctccgcggatgctgatgccgctggtctgtggacctcactttgggatccacgagtttagggcgaggggcctggcccccaccgatctcccccaggcctggatccccaggctcctgccaggctactgctcctccttggcctctgcttccccaggtgtctactgagaggagaagccccctgagaagcctgcctggtgcgctgccccctccacccagggctgtccggtgggcgtcatgaggccatatggccgccagggggcagccgagctgctccacagagaggctgcagggagagccagataaaatactggatgcccaggtgaacgtgaatttcagataaacaacaaatactttaaaaataaaagtccgttttaaatactacaaggggcatactatactcaaaaagtgctcgttcatctgagattcacattgcactgggtgtcctgtttttatgtgttcattctggcagcccccgcccatcattccctgcctcctatgcgcagtgctgggcccttccctccctccctccctccctccctccctggcagacagtgcccacctctcaactcctgcgccctgccctgctagcctctcccacggccatccaacctcctccaaacatcccccgggccacctgctgagagcccatctgaacactgtcccctcccctgtagcctcaccctggggccatttggtacctgccgaggagagagggctgtgaatgtgggagaggagttcaggggagggagggagggtcctgaagacaatcccctcttctctaagaatgcagctaggagcacagatggtgggggccttcggtacctcctccttctgccacattgcagagggttgattgctttaatttgcagagagctttgtcttccagaaatcagtctggggccccagtggatggtcaccatctggctaaagggtcccttggttctagagtgacccagggtcttcccaccaaaataaaagtcctccccactgcccaccccgccgggaggcagcctggactgtaggttcccgctgtgctctcctcctcctgacctggacccatctgttttgcagctccctgagggcctcctttgactccttgaagcagcgtaagtcccctaccctggggcaatgggatcttttgggactgcgaggctggtggagggtttggggggacagaagatgaggtgttggggctggggctgggctggcccacacgggtgagttgtgggtggctgaggcccatcagatctgacactggggaccagtatccatgctctgcccccagaaatggagaatgtgggcagctcacacatccagctggccctgaccctgcgtgaggagctgcggagtctcgaggagtttcgtgagaggcagaaggagcagaggaagaaggtgaggcaggtgcagggggcgggggagctgctcccccattgccagcctctcagttgctgtgggggtagggggctgaccttcctggtagagccagtggagggcggcaggggtggtggtgggacagcactccaggctttggggcttgagggtgatctgaagtgggtagggagggcagaggcctggccgctggcactaaggccaactcttagtcccagagccccatggaaggtccttcctgtcgagctgcctcacgcctaggaggatcctactacagcagactctagagggtctgtggcaacttggcagtgtccagaggaggcagtctgagttgtgggggtcactggaaactggtcttgagtccaaggatcagggctgattgtcctggaaaaaggcagacttgcagccagtcaccccacaggactgcccaaggctgaggggtcagacacagactggggtgggagagttgtatggcattgcttagcatccaaaggtacttctcacccatatgtagggcatggctgtcccgagacagagtgactgcatggaagtgaagtccccatcatgggaggtgtgtaagcagaggctggcagatgcttgtcagggaggctgcagggctgaagttggatataggttccctggagggcaggcaggacgcagactggcctggaggctgggcttgggcctgtgaggatgggggctgagcctctcagggccttagtgatgagggtggtgccctgcacagggtggcagggcagcacacagatccgcttcttgcctggggaggaaggatcgttgtgaagtggccaaagaattgaaaatgaaaagtcacaactgagccttgaaggggaagaagctgtacctgaggctggggccaggctaggcctgggtgtcctggccataccacttcccatctctgtgcctcagtttccctctcacaggatgggacacatatgtctacctcccaagtgctgggagctcagcccaagccatgcgcccctcagtctccacagacagggctccagctctggttagcagctctgctggcagaaatgtagcgtggctgcccgtgccacctgcccatctgccagctgggctttcaggattctaaatgtggggttctgagcagacagggggtccccagaagccagcccaggcttgaggtgccggagcaggcaccctctctgagctgggacgtgcccgcagagcctgcagagaacctgccaggaaggagggaccccggccctgctattttgggccctcctgtggccagaggagctgcactggctgcaaaggctgttttggacagagcattctttctccaagtggccagggccccgcaggcagagcgctgtgttgtagtgtgtgccatgtgtgtctgagcctgtgtgtgtatgtgcgtgtgccacagagcaaggacatgtgcttacaggatggtgcacacgtgcctacgctcccctgcatatgcctgtgagcatgtgtccttgtccagccctgtgcacttgggtgttttgtgctgtgtgtgtgtgagtgcctgtgcctcgctggtctcccagctggcacagaacccctcccctgagaccccaggcacaaactggctcagttctcctcctacctcataacccagtcgctgtcctggctgttttgccttctctatcagaacaggaagcctgggaggtgaggggaggctttggccccagacctcggcacaggggcccagtggccactgtgcctgcatgtggcctgtggttgtgtgtgggtgactgtgggagtgtgtacttgtgagtggcatctgtgggtgtgcacaggaatgcctgtgatcatgcgtgtgggcagctagggatggggcctgtgtgcctccgagttaatgtggaactctgcatgtatgtgtgtgccagagtgtacacacacgtgtgagcgactgtgatgcctgcagaggctcagggatgcaggatgaacgactgtgtgcgcacgtgtgttggggtgggaactccccagctggagacgaagctctggccaaggtctgcagcaaggacctcacggcacacccatgccctgtgattctctgtggccttccattgtgagggtcactgtgaagcagcaggctctgggggagggagggcagcctgtcaccctctctccagagccaggagaggtgctgcgcctcatcccagggacactccgtcctcttggcctaggggagcctcccgaggccgcggccctcggctcagaacctcgtgtcccctgcagtatgaggccgtcatggaccgggtccagaagagcaagctgtcgctctacaagaaggccatggaggtgagcgccagggcctggggccgcggccttccctcgaggagcagcgcaggtctcagggtgcgatcctgggctgtggccccgggcagggcatttggaacaggctgacctcagccttggtcctcggacctcggccttgggcgcaccagcctgcggggcgcttgggcccgtgctgggcgctatggccccgtggggatggtcccgggcccttcccttgtggggctcgtgaatgaagggcagatgaagtcagctggggactccaggggtggagggaggagggacccctgagcttgatcctgcgagacgctggacaggaagggagaggggctcctaagagggcgcggcgtggcgaggggcgtggcgaggggcgtgccctcgccgaagagcacagcccaggaggcggggcccggggcaggccgcgctgtcctcagtggggagggcctgagagcaggactaccagcagcccccacgccttctctatctccttccggacccccagatccctgtccctggtgaggatgcccccactccacccgcaaccctcgccagggaaaaagggaggctgggctaagggagcctcactcccggggaccacagaacagggctgtgcagcccccaagtcacgcccctccacacccccagtccaagaagacatacgagcagaagtgccgggacgcggacgacgcggagcaggccttcgagcgcattagcgccaacggccaccagaagcaggtggagaaggtgcgctgggctgctgggccgtgtgggtcgcccagggctgggggcagtgggggaggcaaggaaggggtgccgtagacacccccaggcaagatctgcatctggggatgctgcttagccctctctgacccccaatctccccatctgtgaaatgggtttcctggagagaacctcaggccatggacaggcaggtcagctggatcccctttgccaccgtcaggcggcactcagggacccattcctcggtgcaggcccactgaggcccacagggtgatgagagcagacgccaaccctcacacaaccttggagaagggctcagtaggcccatgtcacagagaggaaactgaggctcacagtaagtgacttgtctaaggtctcagagccaggaagcagcagaaaagggacccccaactcaggtggtctagagcccatgctcctgatgctgtggcccctaggccagagtgggggtatcagagctcccagagcccaggaaacacatcactcattgcacagacaggaaggctgaggcccagagagggaagtggcctgagggtgagctgggggcagtcagtcaggggccagagcccaagtcccagccagggggctcagcagtagttgcacctctcctgtgggttgtggtctcactcttcacaggcatcctcctgggctcggttcctgtcttcgttctctttccatggagctagcctgtggtcctctgtgggcggaggttgcttgtggatgatggcatctgcccatagttggctcctgaatgttccccccagggtggccggggaagcttgacagtcacttcaggtctgctggggtgggccctggctcctggggcaggggcttagcgctgcttcccctctgtttcctcagagtcagaacaaagccaggcagtgcaaggactcggccaccgaggcaggtatgtgggcctggctgccccgtccgaccagggcggaggcctgggcggtactccccacacacacctcctcaccctggggacacacacactccccctggctgcacaatcatgggcgcggcgctctcattccagatatgtgccgtcaaagtaaacgctgtgttcccccattcgccagcccttcttggcgcttcatgtgttcagtcctcacagctgccctccgaggtggctgctgttactgttccctttcttaacagatgaggaaacagaggcactaaaaggtccagtacttgccccaggttacagctgcatttgaacccaggccatcgggcttcagagcccaggacttgtgcacatagccttctctgggcctctgtccttcacttgatgcccgaatcctaccaacactcttgtccctgctggtgccccacccaccagacacagcacccaccctcctcccttcccctgggaaggcctctcccttctgctctgcctttactgggactcagctactccctcggctgggggacaggtgacctccagagatctgggcacagaagttgtgacccaagcctgtgggactccacccctcctccagcgccctctcagctgccttctctgaacctcagtttcccctctggaaagtgaggtggggcgcccagagatgcccagaggccaatactctggacttgcatatatgaggctccactccagccctcaggcagctcagagcacagttggggagcagcagcagcaccagcgtgggtggccctgacgggcattcagatgaggccccgccatctgctagggcaggtcccatgggggaggcggggctcccagtgggaggaggcatccaggatgggacctgctggagtacaggggtggaggagctcgtgtcagggccctccctgaggctgcctgcgctttcagagcgggtatacaggcagagcattgcgcagctggagaaggtccgggctgagtgggagcaggagcaccggaccacctgtgaggtgagtggcccacgtggagcctcgttttccccagctgggaagtgtgagacgcccatccctactccagctgcttaaaggggcccaagtgaggcagttggggaaggtacctgttactcactcgtttattcagcctcctgctcacaggcctgtgctgggccctggccctgttgcttgtcgcctggccttgagtcctgggccccttcgttgcaggcaggcattcttccaccctctttgttgaagccaaaactgggacttggactaaacccacagcctctctgggtgctgccgatggacagggcctggggaacagggctcaggactcccgtccgaggtccctctcactacccttctgcctcggtgtggtgcagcctgaagggaggctggggcagggaccccctgggcatctccacctccctccctgcagcctcagggctggcccggagtcgggatggggaccccagggcactctctcctttggactgggcttccagcagagagggctggcctggtcagctccggctgagctgtgaatggggcccagcctggccgggccctgcagccgcctcctcactgctcacctccctcccactgcccccaggcctttcagctgcaagagtttgaccggctgaccattctccgcaacgccctgtgggtgcacagcaaccagctctccatgcagtgtgtcaaggatgatgaggtgggggctgagggccttggtgtggggtaaggtagggcagcctctaggcagcaaagcacccaggtccatctgagccggtcaacaagcacctggtcctctgtgatccaagcctggccccaggggtctcaggcctcagcagctcagcctttgcccccagaaccccaagacaggagctcagtaccacacagggccatggcttctctgcctggaagatgatgactctgtggttcccctgacttcctccttatgcctcagagccacagagcacctgccccctctgccggggatgggaggggaggtggacacagctgtcagaggttggcagaagctggaggaccgtggctgctctgctctaggcctggtgcttgcaggagccgaggcgcagtccttcctctgctccccacatctccagggtgtcctggttccccttactgagcccaacctgctgggtgggtcctccccagcagagagggcccccagccagggtccctgagctctgtggatggatgcagcccagcacacggctctcccgggcagccctggcccccttgcctgctgtgtttcctgcctgacgctcctgtccggggctgtgggggttgattttcttgttgtttttgcccaagtgactcgagccccctgctgcctcctcgcctccttgaggtagaagggcgagctctggacccactctcctagccccaaggcctggctgtgctgcattctcgctgtgaccttgggcaagtcactctcctctgagtttcctcatctatccaatgggaaaagtggggtctaccttagaggacaggtgtgagttaagtcccttgcacagggccttgcacacagaaggtgttcaggaaacaggaagctgtcagccagggccgtgacccctcaggatcaaagaccccgagccgcgcacaatggcctgtgaggaggccggtgggtgggggccgctggtcagagttcaggcccacagaggggcagagtgggcatcgggctgcggcctctgctctttcctgccccagctctacgaggaagtgcggctgacgctggaaggctgcagcatagacgccgacatcgacagtttcatccaggccaagagcacgggcacagagccccccggtgaggtccggcttgcggacagcgcagcctctaggtgcattgagcccctgggaaggcccggccctgagcctcaagtgccaggaccgggctggggtagctcacagctcccttcagggcagagaagccctagcaggggttgtggggagttgggtcccaggcctgctgcctcctctcaggcaaagctaagggcatgatggcactcagaggaagaggtggggatggggattgaggtgaggagctcccacggcccccactccccgcctgtttggttccactggatcacgggtccagaatattaggtcttgatggtacctacggtggggtctctcatgggagcaagacaggcacctcctcaggcaccaggatgggccagggccagattgggaatgtagggccccagctgagtctggcagggccagaatggggtgttgggggccgccctggggctcacggcttgctgtctgcagctccggtgccctaccagaactattacgatcgggaggtcaccccgctgaccagcagccctggcatacagccgtcctgcggcatgataaagaggtgaggccccgacagacggagggagggcctaaggctgggccaggaagtgggtcgagcccctcctctgcacctggcccttcctcgttcactgagcacctactatgtgtctgtatctggtgcccagtttaggtgctgggcactctgtggagacaagataggctcagttcagcctatggaaccctcagcccaagggacccagacactagaataatcacaccccaattattcactaggggaggtgctccgagctctggggaggcccctatgctggcttccttgtccctggggcctcatgtgagcctggtgccctgtcaggctgcagtggcaacgctgtctggctggagcaggactggggcatctggagaattctccaggcttttccagggctccttccccggcctggctgcagtcaagtgccaaggtcctagtgctgggcctcaatgtgtgacctgggcaagtcattcacactctctaaggccagggccctgagtgttggggtcagattcagaatctaaggactctcctggttcaggccttgagtgacgaaggtgacagcccattgggagcactatagccagcttagggagccctcgtagccaggcctttgagggaggccatgtgccctgtgagcatccacaagggtctgtgggtttcacatggtgcctgtgcccccaccgccatgccaccactcttcagccacccttcaaccaagaaggccctgcctctgggaggtagtggactgtggggagaggctgatgcagttcccggcccttcccaaggaccagctcattccagggcctcaggagcccctggaacttcctactcctgggaggcagaggctcgtgggaaccacccgtgcttagagagggcacacacacaccctctttgagaatcttgtgcaagcagtgaccccaggaggcagcacacccgcagcctcacatgctacaaaagcttgtgagacaggcttccctgtgcctggtgaggacctggatcccagcaaaggtggtcatttaagcaactggacaaaagagctcacctgaagcagtatcaggaaggggcagaaaggagtggccccagagaggattagagagagagagagagatgtcctgcagggccgagggaggcctggctgctggagggggctggtcaggcctctggatggggcatctagaagccaggcaggactgggaagaggcgggggtcagtgactgggagtcagaagtgtagacagtctggggaaaagaggtgtgggggcacgcagcacaatggctcagcaagccctgcacccctttccccctgccctggccgcttcctccacctgtccccagcccctgctggcttgcaccctgtcctttgctgcctggggagctggcacgtgtgtctgcccgcctgtgttggtgtcaggccctcccatgtgctgggtccacgcatgtccaccctgcgcatgtgtgtgcactcctggggccttggccctcggcgcctcatgtgggaaaggccccccacatgccaccttgaattgcagggctgccccccacaggcccctgagtcatggctcagcccctcacctgcattcaagatccctcagggtctggtccagtctctatttcagtcctgtcccccacacacccaaattggtccactccactccacaaaccccacctgtgccatgcctcctcccctgcacctgagccctccctctcctggtcacctgcagtgcctcgctcccccttctctcctagtaaagcttcactcatctttgaagactcagccccaccccactaagaagccctcttgccttggaggcagtgtcagcctctacttgttgagccctcactactgcccacttcagggggtgcccccagcatctgccgcatctgcctcttctgttttattttcctttattcagtaaaccttcatgaccccagctcagtccaggcctaagcctggtgcaggggcaggggtaaagtagcccagcgctgtcccggaactcctgtgaacagggtggctgagctggcctgatcaccgtgggcccacagggaggagggctggctcggcccaggcagtggaggcctcagcagggcacgtgagccaggctttgtgtggcagtgcaccccccacccctacccatgggggaagctgctagggcaagctagagcaggggcctggagggtgaggactgggcatcttcccacgaggcctcagtgcggaggtcctagaacccccaaagggccatgggagtcttccaatgaagctacagcttcgggggttctaggatcctcccaagggccctgcagggagcaggtgctgagatggcctgcagagggcgccagtggagggcgtagctggggaaggaggagccaccaggactactttctggggagccctcctgcctgaggggcacctcataaatgacatccatgcctggaggctaggggcagtcccagccctggcagagcgcgtgcagctctgagacctctccctgtctaaaccctccctcctggtgggtccctgagtgtggggcggggacactcaccctctttcctccctgttcccaggttctctggactgctgcacggaagtcccaagaccacttcgttggcagcttctgctggtaaagggggtcaggaggggacccccaaacacactgatcctgggggggaggagaggtctcccacatggcacagatggggccactgaggccctcaagaggaagtgtgtgtcccccaacagcaagtgtggacagcagaaggaagaggcagggcccagcatggagaaaccccattctagtaggacttccaggggccagtgtccccagaaggggaggggtctatgtctcaccctgctcttagcgtccacagagaccctgacccccacccccgagcggaatgagggtgtctacacagccatcgcagtgcaggagatacagggaaacccggcctcaccagcccaggagtaccgggcgctctacgattatacagcgcaggtgaggcctctataccccaaacccacctgtgccacctcccctgcacctgagagctccctctcccatccagtgccttgcgtcctcatctctcctcatggtttcactcatcttcgagcatcctctcctcctcaggagggcacgtgtgcccgagtgtgtccacactagcaagggtacctgggagtgtgcttggatgtgagctctgagaacagcacccagggcttgcggggcctcagtgtgcatgtactgactggaagctggtgtgcagcaggcctgtgtctgcccgggcctgtacacagcacacacgtggagcacatgtacctatgccgtccacacaggctgggcgctgagtggtgcacacgtgcggggagctggcagagcctggagctgcctgcaggtcatagcttgagggccaggctctgtgcctttgggtcagggccctgtccttcgtggccatgggtgtggaaaactgtggcca

SEQ ID NO: 113 - DNA, 10018 bp, Homo sapiens
atcgttgtgaagtggccaaagaattgaaaatgaaaagtcacaactgagccttgaaggggaagaagctgtacctgaggctggggccaggctaggcctgggtgtcctggccataccacttcccatctctgtgcctcagtttccctctcacaggatgggacacatatgtctacctcccaagtgctgggagctcagcccaagccatgcgcccctcagtctccacagacagggctccagctctggttagcagctctgctggcagaaatgtagcgtggctgcccgtgccacctgcccatctgccagctgggctttcaggattctaaatgtggggttctgagcagacagggggtccccagaagccagcccaggcttgaggtgccggagcaggcaccctctctgagctgggacgtgcccgcagagcctgcagagaacctgccaggaaggagggaccccggccctgctattttgggccctcctgtggccagaggagctgcactggctgcaaaggctgttttggacagagcattctttctccaagtggccagggccccgcaggcagagcgctgtgttgtagtgtgtgccatgtgtgtctgagcctgtgtgtgtatgtgcgtgtgccacagagcaaggacatgtgcttacaggatggtgcacacgtgcctacgctcccctgcatatgcctgtgagcatgtgtccttgtccagccctgtgcacttgggtgttttgtgctgtgtgtgtgtgagtgcctgtgcctcgctggtctcccagctggcacagaacccctcccctgagaccccaggcacaaactggctcagttctcctcctacctcataacccagtcgctgtcctggctgttttgccttctctatcagaacaggaagcctgggaggtgaggggaggctttggccccagacctcggcacaggggcccagtggccactgtgcctgcatgtggcctgtggttgtgtgtgggtgactgtgggagtgtgtacttgtgagtggcatctgtgggtgtgcacaggaatgcctgtgatcatgcgtgtgggcagctagggatggggcctgtgtgcctccgagttaatgtggaactctgcatgtatgtgtgtgccagagtgtacacacacgtgtgagcgactgtgatgcctgcagaggctcagggatgcaggatgaacgactgtgtgcgcacgtgtgttggggtgggaactccccagctggagacgaagctctggccaaggtctgcagcaaggacctcacggcacacccatgccctgtgattctctgtggccttccattgtgagggtcactgtgaagcagcaggctctgggggagggagggcagcctgtcaccctctctccagagccaggagaggtgctgcgcctcatcccagggacactccgtcctcttggcctaggggagcctcccgaggccgcggccctcggctcagaacctcgtgtcccctgcagtatgaggccgtcatggaccgggtccagaagagcaagctgtcgctctacaagaaggccatggaggtgagcgccagggcctggggccgcggccttccctcgaggagcagcgcaggtctcagggtgcgatcctgggctgtggccccgggcagggcatttggaacaggctgacctcagccttggtcctcggacctcggccttgggcgcaccagcctgcggggcgcttgggcccgtgctgggcgctatggccccgtggggatggtcccgggcccttcccttgtggggctcgtgaatgaagggcagatgaagtcagctggggactccaggggtggagggaggagggacccctgagcttgatcctgcgagacgctggacaggaagggagaggggctcctaagagggcgcggcgtggcgaggggcgtggcgaggggcgtgccctcgccgaagagcacagcccaggaggcggggcccggggcaggccgcgctgtcctcagtggggagggcctgagagcaggactaccagcagcccccacgccttctctatctccttccggacccccagatccctgtccctggtgaggatgcccccactccacccgcaaccctcgccagggaaaaagggaggctgggctaagggagcctcactcccggggaccacagaacagggctgtgcagcccccaagtcacgcccctccacacccccagtccaagaagacatacgagcagaagtgccgggacgcggacgacgcggagcaggccttcgagcgcattagcgccaacggccaccagaagcaggtggagaaggtgcgctgggctgctgggccgtgtgggtcgcccagggctgggggcagtgggggaggcaaggaaggggtgccgtagacacccccaggcaagatctgcatctggggatgctgcttagccctctctgacccccaatctccccatctgtgaaatgggtttcctggagagaacctcaggccatggacaggcaggtcagctggatcccctttgccaccgtcaggcggcactcagggacccattcctcggtgcaggcccactgaggcccacagggtgatgagagcagacgccaaccctcacacaaccttggagaagggctcagtaggcccatgtcacagagaggaaactgaggctcacagtaagtgacttgtctaaggtctcagagccaggaagcagcagaaaagggacccccaactcaggtggtctagagcccatgctcctgatgctgtggcccctaggccagagtgggggtatcagagctcccagagcccaggaaacacatcactcattgcacagacaggaaggctgaggcccagagagggaagtggcctgagggtgagctgggggcagtcagtcaggggccagagcccaagtcccagccagggggctcagcagtagttgcacctctcctgtgggttgtggtctcactcttcacaggcatcctcctgggctcggttcctgtcttcgttctctttccatggagctagcctgtggtcctctgtgggcggaggttgcttgtggatgatggcatctgcccatagttggctcctgaatgttccccccagggtggccggggaagcttgacagtcacttcaggtctgctggggtgggccctggctcctggggcaggggcttagcgctgcttcccctctgtttcctcagagtcagaacaaagccaggcagtgcaaggactcggccaccgaggcaggtatgtgggcctggctgccccgtccgaccagggcggaggcctgggcggtactccccacacacacctcctcaccctggggacacacacactccccctggctgcacaatcatgggcgcggcgctctcattccagatatgtgccgtcaaagtaaacgctgtgttcccccattcgccagcccttcttggcgcttcatgtgttcagtcctcacagctgccctccgaggtggctgctgttactgttccctttcttaacagatgaggaaacagaggcactaaaaggtccagtacttgccccaggttacagctgcatttgaacccaggccatcgggcttcagagcccaggacttgtgcacatagccttctctgggcctctgtccttcacttgatgcccgaatcctaccaacactcttgtccctgctggtgccccacccaccagacacagcacccaccctcctcccttcccctgggaaggcctctcccttctgctctgcctttactgggactcagctactccctcggctgggggacaggtgacctccagagatctgggcacagaagttgtgacccaagcctgtgggactccacccctcctccagcgccctctcagctgccttctctgaacctcagtttcccctctggaaagtgaggtggggcgcccagagatgcccagaggccaatactctggacttgcatatatgaggctccactccagccctcaggcagctcagagcacagttggggagcagcagcagcaccagcgtgggtggccctgacgggcattcagatgaggccccgccatctgctagggcaggtcccatgggggaggcggggctcccagtgggaggaggcatccaggatgggacctgctggagtacaggggtggaggagctcgtgtcagggccctccctgaggctgcctgcgctttcagagcgggtatacaggcagagcattgcgcagctggagaaggtccgggctgagtgggagcaggagcaccggaccacctgtgaggtgagtggcccacgtggagcctcgttttccccagctgggaagtgtgagacgcccatccctactccagctgcttaaaggggcccaagtgaggcagttggggaaggtacctgttactcactcgtttattcagcctcctgctcacaggcctgtgctgggccctggccctgttgcttgtcgcctggccttgagtcctgggccccttcgttgcaggcaggcattcttccaccctctttgttgaagccaaaactgggacttggactaaacccacagcctctctgggtgctgccgatggacagggcctggggaacagggctcaggactcccgtccgaggtccctctcactacccttctgcctcggtgtggtgcagcctgaagggaggctggggcagggaccccctgggcatctccacctccctccctgcagcctcagggctggcccggagtcgggatggggaccccagggcactctctcctttggactgggcttccagcagagagggctggcctggtcagctccggctgagctgtgaatggggcccagcctggccgggccctgcagccgcctcctcactgctcacctccctcccactgcccccaggcctttcagctgcaagagtttgaccggctgaccattctccgcaacgccctgtgggtgcacagcaaccagctctccatgcagtgtgtcaaggatgatgaggtgggggctgagggccttggtgtggggtaaggtagggcagcctctaggcagcaaagcacccaggtccatctgagccggtcaacaagcacctggtcctctgtgatccaagcctggccccaggggtctcaggcctcagcagctcagcctttgcccccagaaccccaagacaggagctcagtaccacacagggccatggcttctctgcctggaagatgatgactctgtggttcccctgacttcctccttatgcctcagagccacagagcacctgccccctctgccggggatgggaggggaggtggacacagctgtcagaggttggcagaagctggaggaccgtggctgctctgctctaggcctggtgcttgcaggagccgaggcgcagtccttcctctgctccccacatctccagggtgtcctggttccccttactgagcccaacctgctgggtgggtcctccccagcagagagggcccccagccagggtccctgagctctgtggatggatgcagcccagcacacggctctcccgggcagccctggcccccttgcctgctgtgtttcctgcctgacgctcctgtccggggctgtgggggttgattttcttgttgtttttgcccaagtgactcgagccccctgctgcctcctcgcctccttgaggtagaagggcgagctctggacccactctcctagccccaaggcctggctgtgctgcattctcgctgtgaccttgggcaagtcactctcctctgagtttcctcatctatccaatgggaaaagtggggtctaccttagaggacaggtgtgagttaagtcccttgcacagggccttgcacacagaaggtgttcaggaaacaggaagctgtcagccagggccgtgacccctcaggatcaaagaccccgagccgcgcacaatggcctgtgaggaggccggtgggtgggggccgctggtcagagttcaggcccacagaggggcagagtgggcatcgggctgcggcctctgctctttcctgccccagctctacgaggaagtgcggctgacgctggaaggctgcagcatagacgccgacatcgacagtttcatccaggccaagagcacgggcacagagccccccggtgaggtccggcttgcggacagcgcagcctctaggtgcattgagcccctgggaaggcccggccctgagcctcaagtgccaggaccgggctggggtagctcacagctcccttcagggcagagaagccctagcaggggttgtggggagttgggtcccaggcctgctgcctcctctcaggcaaagctaagggcatgatggcactcagaggaagaggtggggatggggattgaggtgaggagctcccacggcccccactccccgcctgtttggttccactggatcacgggtccagaatattaggtcttgatggtacctacggtggggtctctcatgggagcaagacaggcacctcctcaggcaccaggatgggccagggccagattgggaatgtagggccccagctgagtctggcagggccagaatggggtgttgggggccgccctggggctcacggcttgctgtctgcagctccggtgccctaccagaactattacgatcgggaggtcaccccgctgaccagcagccctggcatacagccgtcctgcggcatgataaagaggtgaggccccgacagacggagggagggcctaaggctgggccaggaagtgggtcgagcccctcctctgcacctggcccttcctcgttcactgagcacctactatgtgtctgtatctggtgcccagtttaggtgctgggcactctgtggagacaagataggctcagttcagcctatggaaccctcagcccaagggacccagacactagaataatcacaccccaattattcactaggggaggtgctccgagctctggggaggcccctatgctggcttccttgtccctggggcctcatgtgagcctggtgccctgtcaggctgcagtggcaacgctgtctggctggagcaggactggggcatctggagaattctccaggcttttccagggctccttccccggcctggctgcagtcaagtgccaaggtcctagtgctgggcctcaatgtgtgacctgggcaagtcattcacactctctaaggccagggccctgagtgttggggtcagattcagaatctaaggactctcctggttcaggccttgagtgacgaaggtgacagcccattgggagcactatagccagcttagggagccctcgtagccaggcctttgagggaggccatgtgccctgtgagcatccacaagggtctgtgggtttcacatggtgcctgtgcccccaccgccatgccaccactcttcagccacccttcaaccaagaaggccctgcctctgggaggtagtggactgtggggagaggctgatgcagttcccggcccttcccaaggaccagctcattccagggcctcaggagcccctggaacttcctactcctgggaggcagaggctcgtgggaaccacccgtgcttagagagggcacacacacaccctctttgagaatcttgtgcaagcagtgaccccaggaggcagcacacccgcagcctcacatgctacaaaagcttgtgagacaggcttccctgtgcctggtgaggacctggatcccagcaaaggtggtcatttaagcaactggacaaaagagctcacctgaagcagtatcaggaaggggcagaaaggagtggccccagagaggattagagagagagagagagatgtcctgcagggccgagggaggcctggctgctggagggggctggtcaggcctctggatggggcatctagaagccaggcaggactgggaagaggcgggggtcagtgactgggagtcagaagtgtagacagtctggggaaaagaggtgtgggggcacgcagcacaatggctcagcaagccctgcacccctttccccctgccctggccgcttcctccacctgtccccagcccctgctggcttgcaccctgtcctttgctgcctggggagctggcacgtgtgtctgcccgcctgtgttggtgtcaggccctcccatgtgctgggtccacgcatgtccaccctgcgcatgtgtgtgcactcctggggccttggccctcggcgcctcatgtgggaaaggccccccacatgccaccttgaattgcagggctgccccccacaggcccctgagtcatggctcagcccctcacctgcattcaagatccctcagggtctggtccagtctctatttcagtcctgtcccccacacacccaaattggtccactccactccacaaaccccacctgtgccatgcctcctcccctgcacctgagccctccctctcctggtcacctgcagtgcctcgctcccccttctctcctagtaaagcttcactcatctttgaagactcagccccaccccactaagaagccctcttgccttggaggcagtgtcagcctctacttgttgagccctcactactgcccacttcagggggtgcccccagcatctgccgcatctgcctcttctgttttattttcctttattcagtaaaccttcatgaccccagctcagtccaggcctaagcctggtgcaggggcaggggtaaagtagcccagcgctgtcccggaactcctgtgaacagggtggctgagctggcctgatcaccgtgggcccacagggaggagggctggctcggcccaggcagtggaggcctcagcagggcacgtgagccaggctttgtgtggcagtgcaccccccacccctacccatgggggaagctgctagggcaagctagagcaggggcctggagggtgaggactgggcatcttcccacgaggcctcagtgcggaggtcctagaacccccaaagggccatgggagtcttccaatgaagctacagcttcgggggttctaggatcctcccaagggccctgcagggagcaggtgctgagatggcctgcagagggcgccagtggagggcgtagctggggaaggaggagccaccaggactactttctggggagccctcctgcctgaggggcacctcataaatgacatccatgcctggaggctaggggcagtcccagccctggcagagcgcgtgcagctctgagacctctccctgtctaaaccctccctcctggtgggtccctgagtgtggggcggggacactcaccctctttcctccctgttcccaggttctctggactgctgcacggaagtcccaagaccacttcgttggcagcttctgctggtaaagggggtcaggaggggacccccaaacacactgatcctgggggggaggagaggtctcccacatggcacagatggggccactgaggccctcaagaggaagtgtgtgtcccccaacagcaagtgtggacagcagaaggaagaggcagggcccagcatggagaaaccccattctagtaggacttccaggggccagtgtccccagaaggggaggggtctatgtctcaccctgctcttagcgtccacagagaccctgacccccacccccgagcggaatgagggtgtctacacagccatcgcagtgcaggagatacagggaaacccggcctcaccagcccaggagtaccgggcgctctacgattatacagcgcaggtgaggcctctataccccaaacccacctgtgccacctcccctgcacctgagagctccctctcccatccagtgccttgcgtcctcatctctcctcatggtttcactcatcttcgagcatcctctcctcctcaggagggcacgtgtgcccgagtgtgtccacactagcaagggtacctgggagtgtgcttggatgtgagctctgagaacagcacccagggcttgcggggcctcagtgtgcatgtactgactggaagctggtgtgcagcaggcctgtgtctgcccgggcctgtacacagcacacacgtggagcacatgtacctatgccgtccacacaggctgggcgctgagtggtgcacacgtgcggggagctggcagagcctggagctgcctgcaggtcatagcttgagggccaggctctgtgcctttgggtcagggccctgtccttcgtggccatgggtgtggaaaactgtggcca

SEQ ID NO: 114 - DNA, 16851 bp, Homo sapiens
attatcagaagttgtgaggaccgaattgaatgtgaaaactctagccataagatgtgttcagaagagaacacccgaaggccgggcgcagtggctcacgcctgtaatcccagcactttgggaggacgagaagggcagatcacctgaggtcaggagttcgagaccagcctgaccaacatggagaaaccccgtctctactaaaaatacaaaaaattagccaggcgtggtggtgcatgcctgtaatcccagctactcgggaggctgaagcaggagaattgcttgaacccaggaggtggaggttgcggtgagctgagatcgtgccattgcactccagcctgggcaacaagagtgagactccatctcaaaaaaaaaaaaaaaaaaaaaaaagcagaagagaacacctgtgaagggaaggaagggaagggccagcttaaggacttagggatgtgctgagtccagggccagcttaagaacttagagatgtgctgagtccaggggaggaggcagctgtaggcgaccggtgggtgtggcaaggacttgctccgcccctactgccaggaggtggcagagagacctactggggaaattatttaccctacagatgaggacacgggggctcatttccttcataaacagccctttatcaataagataaagcccaacagcccaacagagaaaagaggggcaaggagaggatcctgcggttcacagagaaacacaagtaactaatatcatgaaaagattttggatctcactcaaaattaatgctaattaaaacatcaacaacgctgaacaatacatattcaccactggcaaaactttttaaagattgctaattttcagggctgaggagggtgttggggaaatagggttcttccagctgacgggatgtaaattggaacaacctttctagaggacaatttggcattagctgtcaaacagaattactatttttatttttattttattattttttttgagacggagtctcgctctgtcgcctaggctggagtgcagtggcgcgatctcagctcactgcaagctccacctcccgggttcacgccattctcctgcctcagcctcccgagtagctgggaattactgttattattttgagacaaggtctcactttgtcgcccaggttggagtccactggctctatctctgctcactgcaacctctgcctcctgggttcaagtgattctcccacctcagcctcctgcgtagctggaaccacaggggcccaccacaacgcctggctaatttttgtagtgtttgtagagacagagtttcaccatgttgcccaggctggtctccagctcttgggctcaagtgatccactcgcctcagcctcccaaagtgctgggattacaggtgtgagccactgcacccagcctcaaacagaattactaagatcctagaagaaaatatgataaaatatttctatattcttggagaagggaaaaacctaagcaagacacaaaatccagaagccctaaaggaaaaaatgaacagatttgacctcataaaaatgtaaaactgtagggctagagactatgacaaatataaaagacaaataatagacaatatgtgcaacatgcaaaatagcactaaaatgcaaacagccccttcatatcagaggataaaactttatattccaatatataaatggtcaatggataagaacaggcaacttgcaagagaagaaattcagatagcctggagttgagaaatgaccttgatgctccctggggatgagataaatgcaaattttaaaacagataatatctagagttggcaaagggaaagtagtgctccgtaaactgtgggcactatatgctgtagaatcttttgaagggccatttggaagaacctatcaacactgcaaatgtgcagataaacttctaggaatctgtcctttggaaatgccagctcaaccctacatggacatgaacgagtacaataggcaccccccttatcctcaggggatacgttgcaagacctccaggggatgcctgaaacagctaataggactgaacgctatgtagactatgtttgttcttatacatgcatacctatgataaagtttaatttataaattaggcacagtaagagattaacaactaataataaaatagaacaattataacaatatactgtggtaaaactgatgtgaatgcggtctctctctctctcaaaatgccttattgtactgcactcacctatttttagatggtggttgaccgcaggtaactgaaaccacagaaagcaaaactgcgatgggggggggctgcctgcatgctcctttcagacctgtttgtgagagagttttaactggagggcatctaaataatcagagagtgggaagagaaaggggtactcactttttatagttttgtattgtttgtgaatgttttctatttcatatgttttgtaattaaagccaaaaagggtaatgacaaaaaggaaaaaaaatgctatgtgtctgactttcgggaatttattagagggagtggaaattctaccacctcctattgctaaatctcattaaaatgcccttgaaatcaacccaaaccaactctcaggcacagccagaacaacggaggcagagcagagctcaggatcctgaatccacaccccccggccactcctggtgggaagagaagaagaggagagctcgcttcccaccatccccatcccacctggctggagaggctgatgtggggcgaggtttggccatcagtccacagaggggacttcatgtacacaattcattaacatttattgagcacctatgatgtgccaggcactgttctaggtcctgaggatatggtgatgaacaagatccctgctctcataggttacccagtgggtgccctaagcaggcaataaataaatatgtgagcaagatgacaagagaatagcagaaggcactaaagttttggagtaaagccatgaactctttttttttttttttttttttgagacagagtcttgctctgtcacccaggctggagtgcagtggtgcgatctcggctcaccacaacgtctgcctcccggattcaagcgattctcctgcctcagcctcccgagtggctgggattataggcacgtgccaccacacccagctaatttttctatttttagtagagatggggtttcaccgtgttggtcaggctggtctcgaactcctgacctcgtgatccaccagcctcagcctgccaaagtgttggaattacaggcgtgagccaccgcgcccggcccgaaagccatgaactcttttcccaattattttcttattgagaagcatctctcagcttgctgttgggttctgctgttagtaagcgtaaggatggaggaaggctggctgatgacattaagcagctaaaggcgtggactgtcgaggccaaatagcatcagctctctttggcttccccagcccatggaacagtcttcctattttgcgaatttcctaccttatgaactcacacctgcttatgatggaagccagaacctttccccatctctcttgaagattgggcacagcatacaacttaagacaccacccgttggctgctcctgcatgaggctaagtgacactgagaagcagatgactggagtcctttctgtcaggatgacagcagatcccagaggcagcagcagaaagaaccagtgcaggtaaatggcctttgagcctggttctctgatttcgctaagattttatgaggcacctcctatcctttaataggttcctctgtagcttaaaagcagctaaagagcagtctgttgcttgtaattaaggactcctaccagtacacgaagggagaaaagcaataatcaaataaattactttcagatagagatcagtgctaggaggaggtcagcacaaggtgatgtaagacagagtgacaggtggggtgagggctacacttgataaggggtcagtgaagcctctctgaggaggtgacgttaggctgagacccaaacaatgagaaggaactagccatagaaagatctgggcgaggagacttctagacacggggagcagaaaatgtaaaggatgagcttcagatgttgatggatgtagggagggttgatgtgtttggagtttagtgcaggtgaataaagaggaacataatgagattggaaagtaggtaggagtcagttcatgccaggccttgcagatcatggtaagacatttggattttattctgaggttagtgggaagccattagagagttttaaacaggacataatatagtacctggggtagccagcctccaaaacatcctccagtgatccttgcatccttgtatttacactcttgtgtagcccctctcacattgactagggctgacccaataggatgctgcaatgtgacggtatataactttcaaggataggtcataaaagacattgtgactctgccttggtctctcaaatgtctccctctggggaagccagccaccatgttgtgaagatactcaagcagccctatggagaggcccacacactggggaggcactgcggctttctgccgacagccttgtgaatgagacaccttgaaagaggatcctccagccccagccaagctttcaaatggttccaactctgacatgctgacaacttcatgagaggccctgagccagaaccacccaaactcctgacccattagtgtgttatgtaacaaatgtttgttgtttcatgccactaagttttggggcaatttgctacctctagccattgttcccagctggtgtgtagtctgactggcaggtgcccatgctttattagtggtttgatattttgactatcggccctgagtaggaggaatgacacagagaggagatagagttgtgagtgagaggaggccaaatcgtggtgtcagagcgagaagcagcaccctggggagggctgagtcacttgtgctgtctggaggaaggcggagcaaagatctgcagcccagctgactgtggtctcagcttttctagcctccaggctttctcccgggttcctaagtctgtatgtgctcactggaaatgccccatgacttggggtgacatgggtgagttttcttcctccttcctcccagagccacgccagacctgatgctggagggctgggctcttgtcctagttccccgtcctgggctgggcccagggcaccggccagtgggagaaactgccttctccgcctcctacatgcactggtggtcacacctcgccccacatcagcctctccagccaggtagggtgggaaccacaggaaacgagcccccttcttctcttcccaccaggagtggccggggggtgtggattcaggatcctgagctctgctctgcctccgttgttctggccgtgcctgagagttggtttgggttgatttcaagggcactttaatgagatttagcaataggaggtggtagaatttccactccctctaataacttcccaaaagccagacacatagcattttttttcctttttgtcattaccctttttggctttaattacaaaacatatgaaatagaaaacattcacaaacaatacaaaactataaaaagtgagtacccctttctcttcccactctctgattatttagataccctccagttaaaactctctcacaaacaggtctgaaaggagcatgcaagcagcccccccacattgcagttttgctttctgtggtttcagttacctgcggtcaaccaccatctaaaaataggtgagtgcagtacaataaggcattttgagagagacagagagagagagagagagagagaaaccacattcacatcagttttatcacagtatattgttagaattgttctatattattatcagttattattattatttttgagatggagtctcactctgtcgcccaggctggagtgcagtggtgcaatcttggctcactgcaacctccgcctcttgggttcaagcaattcttctgcctcagcctcccaagtactgggatcacaggcacccaccactgtgcctggctaatttttgcatttttagtagagacaggatttcaccatgttggccaggctggtctcaaactcctgacctcagatgatctgcctgtctcagcctcccaaagtgctggaattacaggcgtgagccactgcgcccagccttagttattattgttaatctcctgctacactaactccatggcctgaacagtccacccctttggctgcttaacatcgtcatctgccttcttccatccttgcactcacaaacaacagaacccaacagcaagtggagagatgtttttcaaaaaggaaatagttgtgaaaagagttcatggctttgctccaaaacttcagggctttctggcattctcttttcatcttgctcatatatttattcattgcctgcctagggcatctgctgggtaagctatgagagtggggatcttgttcatcaccatatcctcaggacctagaacagtgcctggcacatcataggtgctcaacaaatgttaaattaatgaattgtgccatgaagttccttcctatattgaatagagctgacctgtgtagccaatagggtattgcaaaaatgacagtgcatttcatgaagcctcagtttccatggctaagtgcctcttcctttggttattcccaatttcagattccagagaaggggaatatgattggctcatcttatctgtctgtaccaagccatgccatagattgccaggtggcctataaattggaagcttcagggagatgtgtctgcctaccttagtcaattagaagtcccatggccgctcagacactgtggttgacaagtctagtatgatagggtcacatcttatcggaggagtgattctaaaatctctacgtaagactttatcccatacagagttactcatgaaaatcccttaaattacccatacatttatttatttatttatttatttattttattttatttttttttttgagacagagtctcgccctgttgcccaggctggagtgatctcgcgatcactgcaatctctgcctcccggattcaagtgattttcctgcctcagcctcccgggtagttgggattacaggcatgcaccaccatgcctggctaatttttttttggtatttttagtaaagacggggattcagcatgttggccaggctggtcctgaactcctgacttcagaggatccgcccacctcagcctcccaaattgctgggattacaggcgtgagccaccgtgcctggccaaaaaatacacatctttagacatgaaagtcacagtcctcataatgagatgctcacagtgtaagaggcatttgtgagacccactgagagagtaacaggctcccatcgcatctatctctgcttattctgggcacacactctgagtagaatgataggtagactcgctggcactatttaaattgtcctctcccctccgctccattcctccttcctttcttctctttatttacacatacatgctacaagggtttaaacatccacttgctcttgttggatttacacatgaattgcatggaggtctgaatataagaggaagaaaattaatctgatcccagtgagaaagccctgagcacagatgtaaaagaagaaagcagcaaaattgtattgataatcctatttcctgaaatagatctctcatatgaaatgtaaggagattttagaaaacagctattacctattctgagggagattagacagggacagtgcagggggaactgggtgcttcatcatatcagattgtccctggaagcggaaataaataggcttacaggaaattggattattaagcagaagatcaacaagagaaacctatgtggcaagtgagggaaattaatggagagatgaaaagaaaacaagggaaaatgccaggcatttaggataaagtgtgaagatatagtatgagggaaaaacactttaagtttctggataaaataaatcaggtggaaggaaatcaataatcaaaaacttgttctctctctcactcacaccacacacacacacacacacacacacacacacaccccattgtaaaatccttaaggacaaagagcttgtctattttcttcactgctctctccccagaacttaaaacagtgcctacctagcatatagtaagcactcaataaatatttgtcaaataaatgaatgcaagactttaaaatgaactgagatgggtcatcttgtaccaattaaaacgagactactgaccctaagctatctcttggcgaaactcttaaacttggtacaaaaataaagacttctggccaggcgtggtggctcacacctgtaatcccagcactttgggaggccgaggcgtgtggatcacctgaggtcgggagttcaagaccagcctggccaacatagtgaaacccagtctctactaaaaatacaaaaattagctgggtgtggtggcgcatgcctgtaatctcacctactcgggaggctgaggcacaagaattacttgaatccgggagtgagaggttgaagggagccaagatggccactccagcctgggcaacaagagtgaaactccgtctcaaaaataaataaataaataaagacttctcccaaatttcatgcagaaaaaattcaaacttagatgatttccgaagatcttaataatcaggacaaccgtgaacttctcatgcaaccgtcaatgcctgagacaatggagtgaaagctaccagatccttaagagaaaagtgtcccccaggactcttaaagccaccagccctgatgttggccacgggaaaagacaatcaaggaaaatctccgaccttcggtgaaatgcagagactaagggacccctgtgctgcgtgtgatgcgattttgagagaaaaaaaaaaaaaaaggccaggtgtggtggctcacgcctgtaatcccagcactttgggaggcccagacaggaggatcccttgagctcaggagttagagaccattctgggcaacatggcaaaaccctgtctctacaaaacaaaacaaaacaatacaaaacaaaacaaacagaaaaatagccaggtgtggtggcacgtgcctgtggtcccagctaccctggaggcctaggcggggagatcgcttgagcctgggaggtcgaggcttcagcgaaccaagatcacgccactgcactccagcctgggccacagagcaagattgtcttaaaaataaaacaaaacaaaaactaacggagccctgaaaagggagcgcaattcatcaatccgctgacggtgatgggccccctggcccggtgcagcggacccttaggtcctggtgggggagtcggtcagtcaatgcatgggtgagcaaatgagtgaagcaacgcgagcacagcgctggcccggatctaacttggcggtgacagcccagccccgagctggacatggcaggcccctcggcctggccgttgcctgagaaccctaggatcacagcgttgggccggagtgggacagggccgggtagcgtcccccgacagagctgggtcagggccttgttgtggccgggggcaggcccggcagctgaaagcgtaagacccccggagcccggcacagcgctcctcaccaccgggaaaggcggctgggcctgaccgggctcccgcatccccccaccccggagcgtgcagccgccccaaacccccagcggcctccggcttccaggtgagcagcaccggaagggagcggcgccgcgtcctcaccgccgcggggggggctccccagccgcgtccccgccgcttcacgccctccgcgtggaaggacgggggcccggggacccctgcaaacggctgagaccccaaagcccggctcctctgcccggctgtccctccccggagctccggccgcacggccgcttccggcaccgaggacgccccgggctccagcgttcagcctgcgtttctggacacccgggatgcgcagggggttggacaggaccgccccaaacctgcgtcgtggggcttcgccctcctgagatcacccaggcagcctgtgcgcggccccaccacagcgcctgaggcggcaccgcctgagcgcgttcagaaagtaggcagtacttttatttttattcttattctgagacagggtctcgctttgtcgcccaggctggagtgcagtggagcgatctcggctcaccacagcctcgaacttccgggctgaagccatccttccgagtaggtgggactacgggcgcacgccaccacgcccggctaatttttaaactttttgtaaagatggggtctcactacgttgctcaggctggtcttgagctcctgagctcaagcgatcctcccgccttggcctcccaaagtgatgagattacaggcgtgagccactgtgcgcggctggtagtactttttgtaccttggggacaaaaataaaaacccaggcacttaagtggcactcctacagcagcagtgacttaataactggagatagaaaaataaaaaaaaataaaaaaaaatactggtgtctgaacaaagagacatacttagaaaattgtgttatactgactgacatgcctaattcccatcccttgtggggcgtggggggcggagcacttactcctcacccccgaaacccctcaaaatgataaaaataagtgagcaaaacagacccaaaacagcagccctagctcccatcattcccaagcagtttgctgactgactcacctggcatttcgtggatgcaaagaagagccccttccaccaggtgaagaagaaaagggggtctgggcactatggctcatgcctgttatcccagcactttcggaggctgaggtagacgaatcacttaaggtcaggagttcaagaccagcccggccaacatggtgaaaccccgtcttaactaaaaacacaaaaaaatttgccgggcatggtggcacctgaggcagaagaattgcttgaacctgggaggcggaggttgcagtgagccgagatggtgccactgcactccagactgggcaacagagtgagaccctgtctagaaaaaaaaaaaggagacgaggaaggagaagaaacacgtggttttaggggggtttatctgagggtggccaggcagctcctgggaatctgcgctgaggagcagccaggcctgggggcagggatgtccagggggagccaaagcaggcccagcttgccttcctttctgtctgcgcctctgttgctcggtggcatcttttttcgactgtgtccctgtttctgtctttccatcttgccatcacttgaatcctgtttgactctgtctccaactgtccctgcctcaggacagaaatctcttctccctgtttccccagctcacctacttttcccctctccccgctgtgcagagctgctccctcacctctgctgaaacacgtgggtctttccatgatccaaacaagtttggtgattacactaactgaccctgtctctggatgtccccatccagatccccagggcagactgagcaatgggctcagtctctggggcacttccccacggggcagctgccccctctgccctgtggttgtgtgagcacgtggggttggaatggggacacagtccactcttgggagtggcagtgagtgtgagagttctcagctaaagggcaaaacctggggacacacctcaaaaaaaaggcttctatttagggcagtgaaactactctgtatgatacatccatactctgtatggatgcatgtcattgtacatttgtccaaacccacagcatgttcaacagcagagtgaaccctaatgtacgctgtggactctgggcaatgatgatgtgtaggttcatggattgtaaaaaatggactgctctgaggggatgttaatcatcggggaggctggcagggagtacaccggaactctctgtaccttcctttttgctgtgaacataaacctggtctaaaaaaaattaagtcttaaaaaaaaattttagctgggtgcagtgactcatgcctgtaatcctagcactttgggaggctgaagggggtgggtcgcttgagcccaggagttgaagatcagcctgggcaacaaagtgagacccccatttcattaaaaaattagccaggcatggtggcacacactgtagtcccagctactcgggaggcttgagtccagaaggtcaaggctacagtgggctatgatcacaccactcacactccagcctgggcaacagggaagaccttgtcttaaaaaaaaaaaaaaaaaaaaaaaatcaaggaccaagagcagtggctcacacctttaatcccagcactttggaaggccgaggtggatggatcacctgagttcaggagtttgagacctacctgaccaacatagtgaaaccccgtctctactaaaaatacagaaattagccaagcatggcagtgtgtgcctgcaatcccagctacttgggtggctgaggcaggagaatcacttaaacccaggaggcggatggttgaagtgaactgagatcgcaccattgcactccagcctgagcaacaagagcgaaactccatctcaaaacaaaacaaaacaaaacaaaacaaaaaattaaatttttcttaaaggggaaaaagaaaataaaacgcttctatgttaaggaaaccccacaaaaagaggtgctcctggaaatcctgcagaaaagcctgaatgtaactctcctaatgccttgtgctcccttctgcagattttacaaatatatagaaatatatgtacattcctaaggcttaaagataaatttcacatgtgactgtgaaatgagatcgtaaaaagatgtttctgttctatatgattcagggtgaaaggctttctaaatgcagtatgttgcattagtatcttcatacagcctcttcctgacatcaaggttctatgcttatatatcatgcattaacattgctgaaaatctatgtaaaaacttggcccaggaagaacctaattaaaatatgcagtttccttgatttaatatggccaagattttgccaaaaaaattctacatgttttcagagatagctctgggaacagagctttttctgtcgctctttctcaagacaccccctttgaatctcagtgaaggaccaggaaggtacctcaccagccaagagagaccatctctgaaagacacagttgcttagatgtggggccagtgatgattggtagatttattcttctagattcttttttttttttttttgagacatgttctggctctgtctcccaggctggagtgcagtggcaagatcttggctcattgcaacctatgcctcctgggctcaagtgatcctcccacctcagcctcccaagtagctgggactacaggtgcatgccaccacacccggctaattttttttaaaacttttttgtagagacgtggtttcaccatattgcccaggctttctaaatgttgaataaacctcaaaagagaaatggcagcatttgcttctttgtagaaactaaatgtggcaaaattctcccatcctgaatcacaaattaattgttcaaatggctatttctcatccaaggtgttagacagttctctcatttccagggagtttcgtgaaaccatggtttgcctggcttctgttttttgttgttgttgttgttgtttgtgggtttgctttctaagagacggggtcctgctctgtcgtgcaggctggagtgcagggcacaatcatggctcactgcagccttgaactcctgggctcaagcgatcctcctgcctcagcctcttgagtagatgggaatataggcacatgccactgtgcctggctaactttttaacttttttgtagagatggggtgtcactgtgttgcccgggctggtcttgaactcctggcctcatgagatcctctgggcttggcctcccaaagtgctgggattacaggcatgagccaccagacctggcctgcgtctagtttcaaattgtgctctgagagtcccagggatgggctggagctgccctcctaccccacacagagcagctctgatttgatctgttttacttattttcctaatgtagttgttgtttgattagttatacattaaacatcagttatatagcaacagccccctaatccagccctgtagttgtcaaactcttgggtttttaaaaatatttacatttctaattctaaataataaagcttatatgtctattgattttttcaatttgaaccaccatctactgacttcaaacttcctactctgaaaaatggagactaagctctctgaccatacccctcaacacctatacacaaacacaccatttccccctgctgatcttccccagagagttacatcacaatgttcaaagaaatcaaaagtgtttgtttgtttatttgttgagacagagtcttgcactgtcgcccaggctggagtgcaaaggcgtgatctcagctcactgcaacctccacctcccaggttcaagtgattgtcctgcctcaccctcccgagcagctgggattacaggcatccgccaccgcacccagctaattttttgtatttttagtagagacggggtttcaccatcttggccaggatggtctcgaactcctgacctcgtgatccacccacctcagcctcccaaagtgctgggattacaggtgtgagccaccgcggccggccctcataagtgtttatatcatgatgactgtagaaggtactattcaccctgcccatgataggaagaatgcctaactccaagtgtgagatcgggcacagatttccagaagttaacagataaagtgagacttgaagaacacgcctagggtagcaaggagacggggagcttgggtggaaagacatttggggaattggaggcatgagggaaactgagaggcgctcaatgggaggggctggaggggtggggagcagggggagacgccaaggagttcagtgcagagcagtgtcagatcagatttgcattgaggaacatgcctgtgtggtgcctgatgaacatggacacaggggtgactggaggtacagctgggcctaccccagctgagcctcatgagtgagctaccagtgagttcggggtagtcctctggcaagaagtgtcacttgtcagaagtcagaggccacccagggacctggttggatggggatgccaaccatgagagtaaagaacagctcaggccgggagcagtggcttacgtctgtaatccatgcactttgggaggctgaagcgggtggatcacctgaggtcgggagttcaagaccagcctgaccaacatggagaaaccctgtctctactaaaaatacaaaattagcccggcgtggtggcgcatgcctgtaatcccagctactcaggaggctgagacaggagaatcgcttgaacctgggaggcataggctgtggtaaggtgagatagccccattgcactccagctctgggcaacaagagcaaaactctgtgtaaaaaaaaaaaagaacagcccagcttagaagggagaaagatgagttctcatctgggcacgtcgagtttcagatgcctgtgggagctgtggggctgaagcttaggagaaaaaggccaggaacaaggtggagaaatatatattttttaaattgtattaaaaaaatataattttttatggctgtaaaatttctgttaaaaaattggctttgtgtgggaaaaaaatcgtgctaagagcttgctttggaaggtgaaacgcccacttctggagggccggggtgtcagccgatctcaagattcagaggagggaagatgcttcagacaatagggaggactttggagttgcagcagtaaaatgaaaggtaaagtgggagaggagctgaggtggaggcaagaagcaagatggcagaggctgtgccagtcctggtaagacccctgcctagacagcccccaagacctctggcaaagtctaatgaccccacagtggggtgtgattaaatgttgtgggggaaccaaagacaaagttgagttttccttcagaacctggagtagacagagaggcagcacacaggaagtcagatcccaagaggagacgaggccagagtccctgggaatcacagcaaaaccccagggaggccttggaattccaagatccatggctcacctggatttccagtggcttgggagcccctaattgaactgtccaaaaagatgacggagtgaatgaagtcccacactggggtggagggagaagggaagagggcctacccccgctaaggcctgggtgtgagctgcctgggaagtgtgggtcacagacgtggggtaaagggagatttcaaggaagaagaggccccaaacgccaggtggtgctgggaagccaagtatgatggggagtccactgggtctagtgacaaggaagatggcagatgtcggactgcagatgggggaagagtgaacaggtgccgtggattgaatatgtgtatcccctccccagattcatctgttgaaatcctaacccccaaggtgatggtattaggaggtgagcctttagaaggtgattaggtcatgagctaagagcccccagcagtgagattactaccccatgaaaggaccccagagagttcactctgtctctctctccccatcacatgaggatacaaagaaaattcggccatctgcaacccagaagacatcccttgccagaactcaaccatgctggcaccacaatctcattccagactccagaatgtgagaaagtgcatttctgttgtttataagcctatgggagtctaaagcaacctgaatggactaaaataggtgatgagaaagtaaagcacagagtgcatatgaaactttctagacacttgaacatgacgctgtcctgggagccctttggttatattctcctccaaaagcccaaagaccctgtagtaccatcacacagctattttgttttgcatatttttctggaaaaaagga

SEQ ID NO: 115 - DNA, 109077 bp, Homo sapiens
tggatgccaaatagacatttgttgtgaccagagaaagactctagatgctatggaatattaaaacaaaaagaattaatttggatgggaaggttcattgaaggtctctgtgaaggactagcattgaggttgatgggtaggtaggaattagataggaagagagatggaaaggagtggtgcagactgaggagacagcgtgggcacagcttgaggaggagaggaacctggcaaggttgatcaatccacagatgagtgtgtccagagtgatgtgacaaggggctagagacatcagccttggaggcacagtagggtttggactgggttgtgagtacactgggaagccattggaggaatttaaaggttgggggtacctgatccaataaatatttttttttctatttttatttttttgaggcggagtctccctctttcgcccgggctggtgtgcagtggtgtgatctcatcccactcggctcaccacaacctccgcctccccagttcaagtgattgtcctgcctcagcctcccaggtagctgggattacaggtgcccgctagcacgccccattagtttttatattttttagtagagatgggggtttcaccacgttggccaggctggtctcaaactcccaaccttaagtgatccacccacctcggcctcccaaatttgctgggattgcaggcatgaggcaccacgcctggccctgatccaaaaaatattttaataagatctcttgggctattgggagaacacttgtttgggaggggaagcgtcaatggatgcctatagccttgcctggtacagagaaagtactcagtaactgtttattgatgaatgaatgaatgaatgaatgaatcagttaattaattaacaggagatatcagtaagtgatttgttcttaaaaagaaaccttgcagaaacttgaaggtgtttgtttgggatgactaagcaagggtagacagattgttgttactcataaatgtcaaaataagaattataaaatttagaataatattgttgtcatgctaagtgatatctggagttaagcgtcctctctgacctgcgactgctcgtgagacagttgcatttactcaggtaactgtggctctcagagtcattcttaaatgttttctttttctccccaatgtgtttgtgactttgtccatctggaagtcaagttcattttggccaattaacttcaaaggcctgacttctctatttttttttttttttttttgagatggtgtctcgctctgttgcccaggctggagtgcagtggcgcgatcttggttcactgtaagcttcatctcccaggttcacgccattctcctgcctcagcctcctgagtagctgggactgtaggcgcccaacaccatgccccggctaattttttatattttttagtagagacgggttagccaggatgttagtgttagccaggatggtctcaatctcctgaccctgtgatctgcccacctcggcctcccacagtgttgggatcacaggcgtgagccaccacgcccgaccggcctgacttctcttgtgaagatggctccgttagtgagcgctgtggactaagatccacaaacacagctgctatgcgggttccctttctgcatctttgtgagtttcagtgtcctaagctagccctcatataggcatagactccttgatattttactctgcataatcaggacaggaaaagatataggacctgtattaaagggacacaagattcagaatcacattaacttccaaatctcagtgccttaacacaatttaagtttctatcttcttggccgggtgtggtggtcacgcctgcaatcccagcactttgggagtccaaggtgggaagatcacttgaggccaggagtttgagaccagcctggtcaacatggtaaaaccccatctctaccaaaaataaaaaaaagtagctgggcatggtggtgcacgactgtagtcccagctactgggagaggctgaggcatgagaatagcttgaacctcagaggtagaggttgcagtgaaccaagattgagtcattgcactccagcctgggtgatagagtaagactctgcttaaaaaaaaaaaaaaaaaaaaaaaaaaaaagtttgtatcatgtgtagctctaaatcggtgtcctgatggatggacagttctactccataatgtgatacagggacccaggctccttccctaggtggctccacctttatggttgccaaagaaagagaggatcatatgtgctgagcctaaaatgataaagagcagcacctccattcccattccatctgccaaaagtgtcatctggtcacatctaactgcagaagaagctcagaaatacagtctctgtccttggaggagaaaagaaacctactgttcaatagctagctcagctctgctacaaaacgcctgctatagaaatgggagacaatcatgcattccttttctacaatttatggtatttcatgggtgaaccattaatacgtcaccgggtaacgcattattgaatatgttagtcattttcttttctcatcgtttcttgaaaaagaagttgtctaacagtcctaacttcccatctggcttcttaaaatctgttttacaagcaatgagatagttaaggattttcagctctgtggttgaattactccaaagaaagaaaactgcttttgaagttagaaactgaaacacacagcaacagaagcaaccagaaaccccatagggttttaaccttgttttgtcatatttctcaacaaactccttatttgtttggggattctgcttagctctgtgcagaggtatcttgctttctgtatcacttcaaaccttccttctacgtgagttagccttagggtatgaccacgaatgacaccttcaaatgggaaccttttgtgcctagagaaatcaaatcatctttcaagacttggctcaaggggtgtatcttctgtgaaggtcttacggactttcaccccgcttcgggggtgacagttcctttcttatgcccctaatttatcctgtgtggactatgatagctcccttgctacaataacatagttctttgcatttattttcttaaagtataacaccagttcattacagaaatttctaatttctgtaattagaaagtacagatgttttttaaaaaatcaagtaaatattatgtgtgagtccatgatgcagaatacttactgctgaaccacagggcctgtatggttaatcattgaatcagcgttgccaagcaaagagtgtgacacacattacttccatatcagtagaagggtggaaggatggctggatgggtggatggatgaatgactcacatagcttctcacggatgaacacacctatttactcggcttttacagtaagcccaggacagggtaaggatgagttggaaatgatatatattggttaacaatagccagagcagtactgagagttcccttgtttgcaaacagtacagttttaagttattcaggaaagctggttttctgagtttaaataactaaaatcaggttaggttgtactaggtaacatacaaactgtggatctccgtgttttaacacttgcatattgctctctcatctgagcgtgctgctagtctgttccacgaggtggctcaagacccaggctgcttccattttgtagatgtgccacctggctgactctgataaggaagtggagtcagagttcttgggttctccgcaatggtagtgacttccaatcacggtccaccagctagagctgatcacccagcctcacccaacagcaagagtattttgagccactcagaaggtgatgagaactagacatggatgaacataaccatgtcctatgcagtaccgggtaattgggaagactataataaaaatggtttagcatgtgagtactgggctcagactggttttgagcctctactgggaacaatttgtgcaatcttgggcaagtcgctcaatctctctaagcctcactccctcattgaaaattgaggataataatagttttaattaaataatgtgctaatcactgtgggcattgtgcaagttcagataaacattagttatctttaaatgtccatgaatacttaaaataattgtcattattacaatcttgttatcattggtagaagtggtagtaatgaggtagcacttgggactccacttcagaccacattgaagactggcggaaactgagaagaggcactgaaagcatgcccaacagcaacaatgacagtttactgtcaccatggcaacagcaggaagttaccacctctttccatggcaacacctggaagttaccacccctttccatggcaatactgggaagttaccacccctttttttttttttccattttactttaagttccgggatgcatgtgcagaacatgcaggtttgttacaaaggtatacatgtgttgtggtggtttgctgcacctatcaacctgttgtctaggtttaaagccccacatgcattaagtatttgtcctaatgctctacctccccttgccccctagcccccgacaggccccagtgtgtattgttcccttccctgtgtccatgtgttatcattgttcatctgccacttaagagtgagaagatgtggtgtttggttttctgttcctgtgatggtttgctgagaatgatggcttccagcttcacccatgtccctgcaaagaccattaactcattcttttttatggctgcataatattccctggtgcatatgtgccacattttctttatccagtctattattgatgggcatttgggttgactagcccttttctagaaatgtctgaataacctgccccttaatttgcatgcaattaaaagtgggtataaatgcaactgcaaaactgcttctgagctgctactctgcacacactgcctatgaggtagtcctcttctgctgcccctctgctgctgctgtgcactgccacttaagtaaaagttgctgtctaacaccactggtttgtcctagaattctttattgggcaaagccgataaccttcccatgctaatccccagtctgggggcttgcccgtcctgcatcggtaatacatttgcttagcatcctccaggggtctcaattagtgtcatacaaatgtacatgcctcaaaaggatatatcagaatactccattctcagctttctcaggtgcttccccgtcatactctgaaggaaaatcacactgagaatctcacccacagaaaaaggattcttcattattaaataccattcaagactgtgcactggtttttgatttttttttttaagaaaaaataaggggaggagtgtatccatcattttcttttttttctttatttttgtgaccgagtcttgctctgtcgacgaggctggagtgcagtgctgtgatcttggctccctgtaacctctgcctcctgggttcaagtgattctcccgcctcagcctcccaagtaggtgagattacaggcacacaccaccacacccagctaatttttgtatttcttgtagagacagggtttcaccatgttggccaggctgttctcgaattcctgacctcaagtgatccacccgcctcagccccccaaagtgctgggattacaggcaagagccactgtgcccggcacatcattttcaacatagctgcctcagtctgaaaacgataactcctcactctactattaaccccactgactccatctgggcagaaaggctgaggttaggttgtcagctgcgtcactgctgtggaaacatcgacagactcaataaacaccctgaaatttaacatgcttctgctatctgctgaacagctctgggcacaaataggtttcttttattatggacagaaaggccaagtgaaattttaatcagacagacaaggagggtatctgagaacactgaaatgccagccctgctggtatttccacaatattgaacttgtctttcggggaccttggtaggtatttcaattagctgtgagacacacagcctgtgtttttgcaaactctcctatttttaattaagatgctgttcactgggatattagaaggcacacgattcttcttgtaatatgcaaactatagaagagaaaattaagcagttgaaacatttggatgtagaaagtggattgtagtcatagctaaaatcatagcacttcgtgtactcatagctataatcatacctctgttcttacgtgatatttggggtatcttttcccctcccatcccattctctcgatttcttaactttcaattgcattattatgtatatttgctttaacgtatgatgagcctgttttcctgttttctttttaaaataacgaaatatttggtataaacaaaataatatctgtagcaactatggaccctgggaaggataataaaacaaaaatccgtgagtttactactcaacttaaaaattaaaatgctgatcagtactactgaattgacttgcttgcttcttggtgagtttattttttcatggagataatcaggcaccgttttgccagttaaggtgcctaaaagcaccataaatcactggaaattctagactaaaaagaggtctttctttctttaaagctttgtccatcttttagtcacacggaacacactgaaagaccttccgaaaaatgaaaaggcaactttagggtgtaaggggctgcagggccgcctctaacattcattcgttcattcattggtccctgtatttcaggattcctgcgttggttcctccattccttcattaaatgttgagtatgatcacagtcttctttcaactataattagtagaattaactgctattggctgaatgttcatgtccccctaaatttgtgtgttgaaattctaatcccaaggtgatagtattagaaaatgggatctttgggaggtgatggggccatagagcatagccctcatgaatgggattagtgccttcataaaaaggcttgagtctggtcacagtggctcatacccataaccccagcactttgggaggccgaggctggtggatcatgaggtcaacagatcgagaccatcctggccaacatggtgaaaccccgtctctactacaaatacaaaaattagatcagtgtggtggtgtgcacctgtagtcccagctactcgggaggctgaggcaggagaattgcttgatcctgggaggtggaggttgtggtgagctgagatcgtcccattgtactctagcctgggcgacgaaagtgagactctgtctcaaaaaaaaaaaaaaaaacgaaaaaaggtttgagagacccctcaccgctttaatcatgtgaagttagagttaagggtatctaccaggaggtggacactcaccagacactgaatctgccagcaccttgggcttagcctccagaattgggagaaataaacttgttttgtgcaagccacctgtttgtttgtttttaatttttagcacctttttttttcaattttcttgtgcatttgcttaagttccttgtacactctggatattagcctatggcattttgctagaagcctgaacagactaagacaatgattatgaaaagatttagttataaacattataataatggtcagttatcctgcccattatactcaggttcttttgagaattccttgcgaggtttgataaggacattagattttgtttacatgtttgtggttttagacagcaaacatgcattgaagaatgttagacaggaataaagttgaaatagcctcactcacactaaagagcccagagtgttaattgacatcctgttttccataatttttttcttttgtttgcttgtcaataaaaccctcatgcaacctgagtggaaggggagagtcattaatgcggtagatctggatgattttctgaacaacctaacctcacgctaatgaggcgagtattaccacaggccctttctcctacgagctgtccacccacagttgaagagctaattttactctcaaaactctcacgaatgcttttggttcctgccggctcttgagtagtaacagagtgctttagccctctgtggaaaatgatggaggcattgtcagggcacatgaaccctctaagaagtggatgtggtcccacctctacttaaacctggaccatgcagcttaagggttccattctcaagccagtgaacatcactgtcttcatgtgaatgttcttcaggtagaattttttagcataaaaaattccaacaggccgggcgcggtggctcacgcctgtaatcctagcactttgggaggtcgaggcgggtggatcacgaggtcaggagatcgagaccatcctggctaatacggtgaaaccccgtctctattaaaaaaaaaatacaaaaaattagccgggcgtggtggcgggcgcctgtagtcccagctacacgggaggctgagggaggagaatggcgtgaacccgggaggcggaacttgcagtgagcggagatcgcgccactgcactccagcctgggtgacagagcaagactgtctcagaaaaaaaaataaaaaataaataaataaataaataaataaataaataaattggaactgagtgttagctatttgagtagtctcagctgaataatacctctgacatggtatcattctgtggcatatatttttctgtaaggaaataaaaacaactttcttaattatttttttctgatcagagaaacaacacatacacatctttggaaagacaaatactttgtgcacatatagagaagaaatgttctccttatttaatccaactacttggagattattcactgtttgggcaactttgctgaccttgctctatatttatatacaaatatgaatgtgtgtgtttgtttagaaaaaccaaattgaatcatatatttttatcctgcccttttcagcttgatgaatatctgtatcaactttttaatggctctgcagtgttccattgtatagacatacttaatttatgtatccagtttcctgctgacagacatttagactgttttttttaaatctatttgctttttttttttttaattttacttcaagttctgggatacatgtgtagaatgtgcaggtttgttacataggtatacatgtgccatggtggtttgctgcacctgtcaacccgtcatctaggttttaagcccggcatgcattaggtatttgtcctaatgctctccctccatgttcccccaaccccctgacaggccccggtgtgtgatgttcccctccctgtgtccatgtgttctcattgttcaactccgacttatgagtgagaacatgcagtgtttggttttctgttcctgtgttagtttgctgagaacgatggtttccaggttcatccatgtccttgcaaaggatatgatctcattcttttttatggctgcctagtattccatggtgtgtatgtgccacgtgttctttatccttgatgggcatttgggttggttccaagatttactattgtaaataggttgtttcttattgttgttgttttcaaaacataacacattttaagcatatgattctctgagcaaagttttctattagagtggatgtctcttgggtttaaagaatgggtgaaaatctctttatttctgtgaaccttttgcaaagttggacagcagtatcaagttagccaaggaaggatgtcacacagagtggccatggtggtcttctggagcaaatagagaaaacacatattccagggaggaaaaaaaaaaattccttactttttgtatagcccaatcttattttcagttaataaagctttggccagacatggtggcttacacctgtaatcccagtactttgggaggctgaggcgggcagatcacgaggtcaggagatcgagaccatcctggctaacactgtgaaaccccgtctgtactaaaaataaaaaaaaattatctaggcatggtggcgggcacctgtagtcccagctactcaggacgttgaggcaggagaatggcatgaacccaggaggtggagcttgcagtgagccgacatcgcgccaccgcactccagcctgggtgacagagcgagactccatctcaaaataaataagtaaaattataaaaaagctttacaggtagttccttttcacatataaattaagttagtagatttaggaacgtatccttcactattctgttccatgccaaaagaaataacaaaaacaagatttgacccttaggttgaagttctcctgaactgactgttccctcaatatcttcatatcccctggattgtccttcagtatctaagaatatgggggggaaattaccagaattctccactgtctcatggaaatcacaaggcttgcttggatcgtaatgtgtacaattcactattaacaaaggatatggcattttctgtctgaaccttttcccaacaatccattttctttctctctctctttctctgtctctctctccccacccccaaatccctctctgtctctaagccaccatcacatcttccctgcatggcttttctctctctccatcattacccctacaggccagtccccttatagcttctggaggaatcttctttttttttttccttcatgttttaagttcaggggtacatgtgcaggatgtacagatttgttacataggtaaataggtaccatggcagtttgctgcacaggtcatcccatcacctaggtattaaatctggtgttcattaggtattctttctgatgctctctttccttcccctcagcagatccccacgcccattgttctctcccatgtgcccatgtgttctcatcattcacctactacttataagtaagaacatgtggtgtttggttttctgttcctgcgttagttatcttccaactccatctatgtctctgcagaagatatgaccttattcttttttatggctgcatagtattccatggtgtatatgtacgacttttttttttatccagtctttgtcattgatgggcatttaggttgagtccttgtctttgctatcgtgaatagtgctgcaattaacttacatgtgcacatacctttataaaagaatgatttctgttcctttgggtatatagccagtaattggattgttgggtcaaatggtatttctgcatctaggtctttgaggaattgttagaccatcttctgcaatggttgaactaatttacactgcctccaacagtgtaaaaatgttgctttttctccataaccttgccagcacctgttttttaatatttttattagtaaccattctgactggtgtgagatggtatctcattgtggttttgatttgaatttctctaatgatcagtgatactaagcttttttcctatgtttgttggccgcatgtatgtcttcttttgagaattgtctgtttatgtcctttgcccactttttcatggggttatgtttttcttgcacatttgcttgagttccttgtacactctggatattagacctttgtcagatggatagattgcgaacattgtctgccattctgtgggttgtctgttcactctggtagtttctttttctgcacagaagctctttagtttaattagatcccatttatcaattttcgcttttgcagcaattgcttttggcattttcgttatgaatccttgcccgtacctgtgtcctgaatggtattgcctaggttttttttttctagtgtttttagagttttgggttttacatttaactctttaatctttcttgagttaatttttgtgtattgtgtaaggaagaggtccagtttcaattttctgtgtatggccagacagttgtcccagcaccatttattaaatagagaatcctttccccattgcttgtttttgtcaggtttgtcaaagatcagatggatgggggtgtgcagtcttatttctgagttctgtgttctgttccgttggtcgttgtgtctgtttttgcaccagtgccatgctgttttggttattgtagccttgtaggtaatcttcttaaatcatacattttatcaggacactatcacttacgacccttcattggtttctcattctacaaagagaaaatttcagagatctcaccagaacgttccaggccttgcttctctgacacagacccatgtacctccttcctgacccccatacacaactcacactggtcttttatcagatcctcaaacaagtaaggctctttcatattttagagactttgtacctcttccttacccctcttgggataatctcagtcccacttgtgtatggctattccttctgattctttatatctcactttaaatgtcattatcttaaaaaggcaaatctcaacctgccatggacagcagatgcttcttccttaggtgttactgataaaataatgcatcaatgcatctctgtaaaatgaacctgtgcatctgcttcaggccatatttctgtccctcaacaagcacatcacagttgtaatctgtgtccattcatatttctgtaccactaaaatataggtatagtctttgtttttcattcgtatatcagacttgttgcctagcccagagctgcttacacggtggcccatccaataaatatttgttgaagactgaggacttgggaagggtgtgtgcatgttttcagtctgtgtgatagcttcacctcctattacgtgaattggcccgaagatccccaattccgtgtcatcaagaaacatggacacatcacagactcactcaacatggacacatcaagactcacttaacgcagggtggcttcccaacagcaagctgtattgctgaaaagcaggccttttccagtaagaacatggacaaggacaaacaagagactgcactgtgttctataagaagacacctgggtcataatgagggagagaaaaataagaccacagcaaatgaaacaaaatgtgtaacataccagacaggggaggaatcaagggagctgttcggggagctgctgcaatgcgagattggagctacaaatgtggaaacgcacgaagacctttgcccctatgaatcatgtattgggaaaacagttgagcatctacagacgtcaaataaccaataaaatttcatgaatggtaacgttcgccagtatccgggagaataaggctgagctctcaacatgatctgctaacaaaattaggtcatttgtctttgataggagatggccactttcttattttttatttattcatttgtaagcagctgctttaataagcctacaggatcttggatggcatgctcataagttctagtaaagcctggaagaaaattacaaagggaaagactgcctctaaattaccctaggaaacaaaaaaaaaaagaggtgatggctacagttttaccatgtctttgggggcaaagtgatttccttctttctgtgttcttgttggggaaaaggggaaggtgttaaatcccacagctgcaaaatagattcatttctgcctctcttgtaaagtgaagcatctttccttcccagagaactttatcttgcctcagtcaaccctgctcagagatggttcatccactcctgtcttgcggccattaaacatagcaactcaagccctcacttccagggacttaatattggtcatttaatactgcataacaacatttcatgatatacaacatgtatctctcatgcctttctaggctggctggggtttggctggcccagactgtgctcatttggacagctctgcttcatgctatgggtccagccagacctgtgtcctcacaactgcaagggggtcttcaatctgccctatgtgtgcacattctggggccgggtctaggggaagcagccgtctagactgcttggtgctctgtcatcatcttcacagcaatggggagccacagggggtgggctggaatccttaccactgtggcccacgttttattggccaaagcatgatacgcaactgatggcacagtcaaggtgtagggaagtgtggtccatggtcagtcgctgaaaagttgcatggcaaagggagtgaatacaagggacgtgaagaatggaagaattgctgccagtaattcagtcgaccacagcataactacaagaggctgatacggttatttgacagtgatcgtcaggattagagcacccatcaacctgtgaatgcttacacatttttattctgttttaaaacagtcacgtgtggcttagaaattaaataaaatctggtaattttactatgaaaaaaattattcccaccaagacttccttttggtggtggttgttgttgaaatggagtcttggtctgtcagtcaggctggagagtactggcacaatcttggctcactgcaacctctgtatcaagcaattatcctgcctcagcctcccaaatagctaagactataggcacctgccaccatgcccggctaatttttttatttttaatagagacacggggtcttaccatgttggccaggctggtctccaactcctgacctcaagtgatccacccaccttggcctcacaaagtgctgggatttgcaggtgtgagtcattgtgcccgatccaagactgtctaatgctgtgttaccccacaaggaggctgatcacagcctccttgtggggtgatacagcaagtggcgacaccatggtgagctcgggcccatgaccattcaaagggagtcacttcacagctgcagctgattgtgaccatgtgggaaggtgggcatagtatggccaggctttctcatttctccagagaagtttggcatctgcattttttatgagtgaaatttatagtttttgaatgttagtcactaatacaaagttttatgaaaatgctttgcatgccaaacaaacacttctgttgaccacacatggccagcaggcacccgattgccagcccaccttagactgaaggcactatttgctattttcgacattattggtcaaatctaaatagctagatggatatatagaaaaagaaaagaagagatagaaaaaaaggtgatagaaccaaagaaagaatgaaagagaagatgtatgtgtatgtgtgtagagagagatgatggaaggaaggaaaggagggagggaaaaaagcaacctaggtagatagctgggcagatggatggaatgagagataatagatggataatctttaacgttcagtaacatatgacaagtcacattgccaagtagaagaaactcagcaggcagcatttaaagagaaagtttcacactcatggaggagcaggccagtgattagtgtcagggataatgacccaaattcactgattgtatttcctcaggtgtcaaagaggaacagaaaacgatagtgttgcaaagaaaaagaccagagaatgtctcaccctgggtaattctaccttgcttcatgcacgcttaactagcaacttgcctgtcctgattccaaagcacgtttaggtagtcccaccattggccaggcttacgtgtccctgaacctgcagatttaggaaaaagtaaacagctgtcctcaagagtgcatgagacgctccacatttctcctttgtgatttatatataatcatccccagagagtgaaacaaaggaaccaagtaacttgctgaacactcttgaatgtagaggaaaaattatccacctatcagagagtgtgttgacagtagtgagcttttaatactgaggaagtctttccgtggcacctaaaagttagctcctgcaatattctgctcattggcaaaaatcgtgttcatttttaagagaaatagattatgacaaaagtagaaaaaatatagtcttatactttagatagaactgaaaggcctggctgggtgtggtggctcacacctgtaatactaacacttgggaggctgaggctggtagatcacttgaggccaggggttcgagaccagcctcgccaatatggcaaaaccctatctctactaaacaatacaaaaattagctgggtatggtggtgcatgcctgtagtcccagctactccacaggctgagacaggagaattgcttgaatgcaggaggcggaggtttcagtgagctgagattgtaccactgtactgcagcctgggcaagaaagcaagactccatctcaaaaaaacaaaacaaaataaaacaaaaaaaactgaaaagtccatctgccatgactgtctacatcgcctacatcccacatatccctaagacccagtacaaatgccatctcctccaagaagccaccttgatttctacccactgaaaatcctctctccctcttttctttgtccgttgtgccttatttttcttcctaccctgccacttaactctccctgatttataattatttgtgtgtgtatatctcccagttgactaggaagatgacttggattagaaagctggagactttgtctttgaatcttgcaatactgttgattttggtagatgaacaaaagtgacaagtgacatcttttttctcaaagaaatacaccatgtactcctttgtgcatagataccttcttaaccgagtcgattgacatggactcttaagtatttagcttcttggattctaaagtaaacttacaagttcctgcaccctagggttcctttccctttatcatttagtccttcattcagtgaattcagttgttcctcaaatgaagcagaaatgattcctcttttggggcgtaaagtgtagtgtgaagctttaaaaaataaaagtaaataaataattgcatacttacaaatattgacaggtacgatgaaagaataaactacgttgttctacaaaataaaattaaggtgagtgtagttgggagagaaccctacttaggtaggttggtcctggagggcttctctgaggaggtgatgttcaagctgaggggtaaaggatgacaaatgaggtttgagttgagagcttatcaggagactgattgcctaaggtacaataagagaagagatgggagaggaagttggaggaagaaacaaggccagatctgtacccacacagctaagattatatccctactggccttaacaaattaaagcacttcttcccatgccttccacagatgactcctaatgtcattcttttgcaatatttctaccttctttcattttaacttccgttacatatagctatgcagaaaaaaaatcaatttgttggctaaaataaagaatagtgacaataccaaatgctgtcaaagatcactcaaatattgctggtgggaatgtcaaatgacttaatcactttggaaaatcatctctcattttcttgtagaactaagcatgcacctcccatataattgagcaattgcacacttgggcatttatcccagtaaaatgaaaacacatccacaaaacaacctgtatgcaaatgttcactgcagctttatttgtaataatagctaaagactgtaaatagcccgtatgttttcagtgcatgaatggttacactgtgataatccacactgtggaatactatgtagcaataaaaaagaacaaattattgatgatagacacacaacaactaggatgaaactccagggtgagtttcactcccttgtggtgagtggaaaaaaagcccatttctaaatcattttgtccagtctcagcaatcatttttatgtatctaaaggttacatacaaaatgataccgtgtatgtagcattcttgagtttaaaattctagatatagagaatcaatgcgtggttgccggggtcaggagtgagaggtgtggagtgacagtagggtgtggtcatagaaggcgtctttttgtctgtggactattttttgtcctggctgtgatatttatagttttgtcagatgttacccctggagcaataagagtagaggtcatgggctctctgtatattacttattaaattacatgtgaatctacagttatctcaaaaagtttaatttttaaaattccttcatataacaacttagagtttgaaagatattcacaacatattttacatattaaatttttatttaaatatttgtgttctcctctgccaaattgtaagagctttcccctaagagatcttgtcttaattatctttacatgcctcctctcaagcctcctgttgtcagggaaagaacaaggctctagggtcgagaagacatgggtgagataacaatttcaatgccaggcaaaggactttggcaaattcagagcatgatttgataaagactggaactcacaggcagaaggactggcaggtggcacccggacccttaactccttcctctgggcatcaaggcgcagacatggatgatgccctgtgtgcttgcattctagaacagggacaccactatcctttagctgtattttttggggggttggagagtacggtgtattagtttccattgggttttttttttttttctttttttgagatggaggttcgtcgcccaggctggagtccagtggtgtgatctcggctcactgcaagctccatctcccgggttcatgccattctcctgactcagtctcttgagtagctgagactacaggcacctgccaccacgtaactaccacagatgtggtggcttaaaatgatataaatttattatctaacagttttggtgatctgatgtctgaaatcagtgtcactggcctgcaaccaaggttttgatagggctctgctttctctggagtctattcttctagcttgtagtggctacatgactgcagtctctgcctctgtgttcttgctgtcttccgttctgtgtgtgcctctgcgtctttcttttaaggatgcttgaggttgcgtgtagggccctctggataatccaggttgatcacccattttgtgagcatcagttcagtcacatcagcaaggaaactatttccttacaaagtttataagtttcagggatttttgacctgagatatctgagtggctattatctggcttattagggtaagtgtgagaacagtcttacaagtagggaacaattccttgtgtctcagaaattaactttggcgagatacatggtggcaactagctgtccaggaaaggtgcatgttggaaactagctgtccagatgagatgcatgctgggaactagctgtctgggagaggtacatgctgggaactagctgtccaggtaaggtgcttgcctaggtgaggtgcatgccaggaaatagctgtgccagcgaggcgtgggctgggaactagctgtctaggtgagatgcatgctgggaactagctgtctgggagaggtacatgctgggaactagctgtccaggtgagatgcatactggaaactgctttccaggtgaggtgcatgctgggaactgctgtccaggtgaggtgcatgctgggaactagctgtccacacaaggtgcatgctgggaactagctgtccatgcaaggaggatgctgggactgtgttgatgacatcaagagaccatgtgagcccagcaccctatggatggacaatctcactggcagaattggaacagctggtcccagctggcttattgccaggcaacccagagacagcctctggtgttacccttcacacagttctatccctccctccatatatactacctaatgattgtgcgaacttgggaaagctgcttaacttctctgagcctgagtttcctcctttgtaaaaggagactaatactggtgtttacccttagggcttttgtgagcattaatgatagtatgtataaggtttgtagtaagtgccatataaatgttggctgtaattattatattcttgtttttgatattgtttctatgaggatggtggtggtagtggtggtggcatacctctgtgcattgtagcataccctaagggttggctgcataacgttgaattttagttcgcagagttactgatagtgcctgcccccagccattgggcttcctggtttaaaaggcaaatcatcctgatggaggatggtgcctacagtgtggtgctcgaggacaatccctgtctgcttgggactctgacagtggtagatgctttcagaatttgggttatgagtgattgagggaggttagcaaacggattcctacctccttgtactgtatgaagcagtttgatgggattaatttgcatggcccatagtaaatgctctcagcctgtatggaggctaatttgtgaacctgtagcaatttatcaccctggttggattcgtttaccagtagacaatgtgattgggataatgcgcctcactgtgcgtggagaggagctgcactctgacctcacttgaagaaaccaccgaggggtaatttcctccccaacggatgactgacattacagtgtggtgacaaatgatgagtatggtaaatggttaatatagccagggccaggatctatatgatttatgcaaataattagctcttcctgggtagtagcctgcatgtctaggtaacttttattttttcagacagtcatctccgtaatgagctattagtctgcaggccagaaagaaagaaaggtagaaggaaggacagacctcaggcagttaagtctttgttccttccagaaatcctatttatttaaagctgagtgtgataatgttttcttttacaaaactccattgctctgtattgtaaaagcaactcaaaatatgagtgtctgacgtttattagtttcaataacggtttctggggtttagacagagcttgcattcatcttcactgagttccattaacacggagggacatataccattagcaccatttcctagttagagaatgtaaggaaagatggaggatcaatatgactgtattaggaaggagtctttgggtacaaattatggaacctatgaagaggaaagggcttaaggggttaattattaaaaagcttatctaaggaatattttatataaatataggatgatctgggaagctaaattgatggaaattcaatggcatgttacaccttgagggctgccagaaataggaagtttagcgaagttgggactttctctcaggttacctgttttgcctggccaacgacatcttctgaacctcacgcattacctccctgccaactaggagaggtgaatttttttttttttttttttttttttgagactgagtctcgctgttttgcccaggctggagtgcagtggcgctatctgggctcactgcaagctccgcctcctgggttcaagtcgttctcctgcgtcagcctcccgagtagctggaactacaggcgcctgccattgcgcccggctaattttttgtatttttagtagagacggggtttcaccatgttagccaggatggtctgcatctcctgacctcgtgatccgcctgcctcggcctcccaaagtgctgggattacaggcgtgagccaccgcgcccagccgaggtgaataatttttttattctggtttctatatgacagaggagaactttgatcaccgagattagaatcccttgttaatgcttggactaatctttggtggcaaaggagtcagtgccacctaaggacaatgtttcactgttgggaggtgggtgggaggagtaggtcctgagaggagagagtgatgatcccaacagaagagaaggatgctatgtagggagttgacagattccagcactatactgtaaattccgtgagtgtgtagctatacgtgttctggtgagcatgatatccccagtacccaatatagtacctggcaaaatgataagcatgcagtgaacatatgcatgaggaagggagggagggagagggggaaggagggcagtcagcattctagtatacaggtctgagatagccaagaaaaagcaagcaaaattttcagcaggtagtcacacaaaacagaaataagaagagatcttggccgggcgcagtggctcacgcctgtaatcccagcactttgggagggtgaggcgggcggatcatgaggtcaggagatcgagaccatcctggctaacacagtgaaaccccgtctctactaaaaatacagaaaaaattagctgggggcgatggcaggtgcctgtagtcccagctactggggaggctgaggcaggagaatggcgtgaacccgagaggtggagcttgcagtgagcctggatcgcaccacttcactccagcctgggcaacagagtgagactccatctcaaaaaaaaaaaaaaaagatcttttaactctggagagttatctcagcgatcgaaaccttgattgcacttcctagatttattggattcatttaattgcgcagcccttggaagttttatcctctacctttagaggatttgagtgataaatttccttcttcccttccttcctccttccctccctccttccctccctctttccctcccttcctttcttccctgctttcttccctccttgtctccctccttacctcccttctttccttctttctttactcatgcacatattcacttcatgggctctgtcatttgtacccaaagactcctgcctaatacaggcctattgatcctccatcttcccttatattctctaactagggaatggtgctcatggtatatgtctctctgggttaatggacctcagtgaagatgaaatgaagacccttcccttcccttccctttcttccctttccttcccttccctttaccttcccttccctttaccttccttgcttcctttccttcccttcttcaaatgtgtattgagaaccagatactgtgccagccacgagaaacatctgaatcatcaaggcagcctccatctgctcagatctttttagtaggtgttttattgttgagtatgatgatgtaggagttctattcccaattcatattgttttgaagccacgtctgaattctgagtaactaggatgatgagtagactatgtctccttggagtccctgtttgaggctaggatttaggtgagcaatcctgatcccactcaggagacagcaggaccacctgagccactgacctttaaacccaggatataaaggttatcattgccctctagaaatatcaaattggtaagaaaggaaaatgctccctcatgaatgttcatcaaagagtgtttcccatcaggtgatattctgtcccttcaggccaccgtggaattcattaaagatgagaagacagtgataaaccacctcttgtgcaggaatatttatatattcctgtattcttcaagatgttacaaattccatttaataagtaaagtggttatctcaatcacaaactaccatgaggcaataatgatgatccatttgtcaaaaaccgccactcaagcactaaggagatgtgtgtaacagttggcattttaagcattgcgattgtcaaaccactgattgacagatcccttaattgtcaattcagataataataattctgctgcaaaatgttagagacagagaaagggaaaagaaagaaagagaaagagaaggaaagaaaacgaacggagggacatgagaagaaagggagggacaaagagaaggaggacttgagataaatattagacatgctttggagtttttcaatggcttactgcaaatcgtgttcaaccccacatcattgctggctggttgtctttcttatttgttgtgaagtgattgcttcaaaaaccctgacacaaatctctgtagagtgattttttgtgtggtcaagaattttgtgattttaaaaagactttcaggttcctgctgatttgggactttggctctctctacgctgatatataaatcatattacacaatattgataactccccaatctctaaataaatcgcaaacttattaggaagaatcccaaagaagaagtcaacacctttactgaagaactatttaaaaagatgtatgggtagcatctaagtgctcacgttattcttagtgaatcagaggtctccatcctacgaagcatgggagaggtcaaatcccatgtacgccagctgaaagagttaagccatttttctatttacatggtttatttcacaagggtctgactcattgggcataaccagcacagttaaatttcaaaattactatttggtcctttttttattgactacaattcaaggctgcttcaagcctcccaaatttaatcgccgtagctctttgccaagaacattatgttttattttcagtgttaaactgtgtaagatgcccctaaggctacatggaaacttactctctgtgatagcagctaacggagtgtatcagttgttcatgatttcccattctcctgtaaattgggagaggcagggagagcagtggaatgcgaattttgttctgtcagcactttcttgccccagctttagcccaagcagtgcctgttttggtaattaattatagtgtgtttgtagctcttcatgctcagttaccatttagcaacctgtcaaatcctgagctaatgagcctatcccacagaagtcattgcatttactttattttatttttaagcatcaagacaatactggtttttcgtaggtcagatgaagttgagagggagattctaaaccagcatatggaaaaggcaaggcttttctcttctactcacaaatgttcatcccaagaatggccttgcttaaagtttttcattgatgtttctctaactagaaattggagttattaaatacagttattaaaatacagttattaacgtgactgtaatttaatatttgaaggaagaaatagctcactcataagtgtccttttcaaagtgttgttggtaaacgaaggttgaatggttttgagatttatctcaaatgatgaactacactttgtagggaatgtttcagaggtcttccctctctgtgttgagagactagattaggatatctagcttaggattttcatctaaaatacaggaaaaagcagagcagattcgtgatactttcctctccttgttggttttgtgttgttctttcttctttaattgtggacttgaaggagttccacaatctcgttatgggaaggacttaggcatagcactttggtttccgggcagaggtagaacatactccttgaagctgcttttgtatcacgcttgcttgttttacttagaatcgtacggttacagctcaattaaaatagcagagttttctgagaatgatttcattctctttatgtgagactcagacgatttcatttagtttatatgagacatatcactaatctctactaaaaaatagaaacaataattttatggaattacatatcagaatatgagtgttcagctcagcctctttatggaacagtgtataccaaaaacacatctttattcttagttgaaagttttagaaaacccagaaattagagcagtggcattcgcctctgctggttagaagtataatcttcaattcaacatgcaaaactcagactcgtagctatttctgaagctcagctataactacagtatcatgtggtcagtaagttctgcatttctaaaggaagatattattttcactgtcaatcaaaggtaggtaaaaacacatgtacacattttagcttagctgaccaggtcacagggatgtgtacctgtttatgtataagtgccaggactgaggctggaaggaggaattaagttatgctcccttaataccatcagtgttgtattgtcctaaaaaaagtgtatatatatatatatatacatatatatacgtatatatatatgtatatatatacgtatatatatgtatatatatgtatatatatatgtatatatatatatacaaaaattagttcctcaatccaataagaacatgattctgactctttataaaaatgactcctcttgaatattatttgttcccatctcattcgttgataatatctattatatttttataagaaagagtcaaaaattctatgcaaaattctctgttctcctcaaacagatgacgcttttgcccatacttggctctaatatcataattgattttacttgtcagctctctgttcatcagagaacttgataagcagaagaacagttgctcactcttgttcaagtctactgccctaatgcccatggacctgcaaatttcccaaatgtgagtggtttttatgctgcctgtggaaatctgaatttagatgagccacactttgtagaaaatgcttcagagatcttcctgccgcctctctgtgtcgataacctccatggaactgtgtttgtgagatactcaataatggaaccatttaattcaaattttttaatcgactacggtatcagcaaaatgagaaatgtctttcacccttgatctttgacaatagcagacatgttaatatgaagttactgctaaggctccaaaaggcattgatacaagtatattttttctgccattcttgtttctttatagaatcacacttttgagtattcagagcttgcttttcctttgagttagaggaatgcattggagagaagtgttattgatgagggctgattaagcaaattaatgaattgagacagctgaatagtaagtgagaagaatttgaggagtggaattggtttttgctcattgactgtaaagtgtaggagttaacaccacaagggtacctgatggaacgagctataataccgaggtaagtgaagagagagcatttggaattgtgtactatttttcctcttccaatgaatagctgtgcgctagctgttcactgctttcctggcatatgtttttcttgcttcattttctgagtcatctgcaatagcggaaatgaattcattcaacaatatatattgaatgcccgttatgttccagacacaatgttaggcacttaatggtacttgtggaaatacattatttaatgtctgatgactaaatgttctcagttctgatggagtcaagtgtttttggctgggggtggtaatatttgggaagcatcttggaaagcatttgttatttcaaactcttcaaatctgcaagtcttacaaaacactacacgttggctaagacgcgggggcagcgggcgctctaccgtgctgctgatggaagagtatattgatgcacctgctttggcgctcactttagtaacatcatgggacattcaagatgcatgtagttttgagatatttcatccctaaatgcacacatgaaggagacacatagaagattcattgtggcatccaagcaaaacattaggaagacaacaatcaaccagacattaattgtccaccaatagggaaatagaagataaattgtagcaaaagtcatgtctggtgtgtcatgttaaaataaataaattagatctctgtgtgccagtgtggataaatctgaaaaccataatgttgaacaacaacaaaaagtaatttgcagcaggagacatacagtatgacatcatttatgtacagtttttggacacagtaaaatgttttcaaaaatatataaatgtattcaaaaatagatattccaaaatatacatttatatgtatttatatatgaatgtgcccaaaaatatatattctcttggggtctatgcatatatggtaaaacgagatagagctatgtgggaatgatacacagtaagttcagcagtatgcccaccactgttagggagtaggggagcggttgtaatctgcgagagtgactgacaaggattccattatatttgttatattttatgttgcaagctgcggggtggacatacggcatttgctccagcatcttccgtattttttatatgtctcatgtattgcataagaaaaaagagtgcatctgaacagctacagttaccgctgtgtctgtgtgtatttgcatgctgagttttttgagcaccacactctaaccatagtctttgcaaaagggttttatacaaaaacaaggtccctttcgagtgcattgtcttggtaagattgttaagggcagatgagtaaagagatgcagtaccctcaatctacaagacaaaagatggaccagtcaagcagttccctaatgtctttgatcaatgtaaactgctaattgcaaggcctgactctcttttccaaaaggaatgattcccctcccaaccccctccccccccgactcaattacaagaataattgcttcaactctcaatgttcctttaactgggcacgttcagtgttagcatcttaggctctcatttcatatgaaagtactaagttgttccagtaaacagcctctacattgggtctttatgttgcaatattacagacttggcatgcaacctcctctatttttcactgtgtataatgaggtcaaattcgttttggaaggcccggaagtcttcaggatttacagctatttgaaaaccctattgataataagtatttggccaaagtgtttccacgttcatacactccccctctttcctagccagcgtcccttggtttttttttttttttttttttggttttttttttggtctagcttgcactttctccctgcccagaaatgtcgttaacattaacaagagctctctctggcactggcagggggtctgcaaacagaactggtttggaatatgcaatgggaggcttgaatcaaagaaaagctgtgatacagactgtggagtgtgtaagacaaactcgataagctccagtcaatactgtcaggaaaaatcacagcaaaactgatttcgatgagaagatgtcattgggctgtgagggatacttggaaaggatgcttcagcaacaataacaacaaaagagtttttcatttagattgtgaagggcttgctgtgtgtgtcatgtttagggacataaataagtactgacccttactctagagagttattgcacataagaaacccagagtcctaggccacctccagagattttaattctgtaggtctggagtggagactgtttgccttgtgaacaagctcacaggcgatgctgatcgtgcaggttcctggaagcacattttgaacaccaaggccccagagcaggttcaatgaaatggaggaagagagtcaaataaaaatcctttcattcggtgctatggggatgcaatggcagagttattagcaatattacagttacctaggaaaaggagcaaacagctctgccttgcccaggcaaccagcagaatggaggtgatacttaaccagcatcttgaagagtgaagagatttccaggaagaaaagagagttcatgttacaggcagaggaagtgacatgaatgaagtacaggacacaaatggaaaatgaaagtggttttgtatgaacagagctggaggtagaattggaatcatcacagatgctgtttaagaattgtctgtggctcacacctgtaatcccggcgctttgtaaggccgaggctggtggatcacctgaggtcaggagttgaagatcagcctggccaaaatggtgaaacctcgtctctactaaaaatacaaaaattagccagtcatggtggccggcacctgtaatcccagctactcaggaggttgaggcaggagaatcacttgaacccaggaggcagaggttgcagtgagctgagatcacggcactgcactccagcctgggcgacagagggagactctgtctaaaaaaaaaaaaaggaagacaggccgcagctgatttttgaaggaatttgcagagtccttctaaggtgtttggtacattattctatgatgtatggtggagaacagtggaaggatttttacagattattggtgggagagtggatgaagagaaattaataagcaggggatcaaaagtctaggtgaaaaaacaggagggcttgcctgaattactttttggaatagagaaggacatggcacaaaacattccaacctaaaggcaagaccctcaaggttggagacgaagtatcttctggatgcagactgggaaaagtgattagcagcaaatggtcaagatgaatgggtagagacaaaacgtggctcaccaggagggtggtgactcactaatcttcaagaatgtatggctaaagattcaaagctccttactaaaatttagaaaaggcccataatggaaggaactaagcaagttttgccttctgctacctctgaattcattatgttgcctgtacaagtagaacacatagcaggaactgtgttttaatactaattacaattattttctggttacatagataaatgtaaataacattaaagatgtgatctgttcctggacgccatttttatcttctttgtcagaaggagggagagagaatggcatcaaaataccaaggttctgtttttttttttccttaaaaaaaaaaaaagaaaaaaagaaatgaccggaagcacaaattggatgcctgcgctttttttttttttttttttttttttttaccaaaaccaaatacaaccttacagaggtaataaaccttgtgatacagtctcaggaggatgtgctatgaaaggagccaaatcaggtaaccagaaacaaataccaagttctttactggtattttgaatgtttattaaacagttaccaatccattgccatttgtttccttcacactttgtgctccctccttcttccttctcttgcaaaatcctcacaacttcttctgtctttatgttcctttttttttttttttgttgagattatgccttgcaaaacctctaattaacctgcctagcaaaagctgaaccttcttcagactacagggagagtagcagaaaaaataaaagtgacaaagaagaaagcgaaggagtctctttagcaggaagaaggaggggtcatttcagggaaattattttaataattcttgtcccattacataaataattcacttttttcttctatgtcactgtattcctagggttcttctcaaagcataactcttccacatttagacacgttcaaaaataagaaattagagaacacacttcattctttccttatcctatccagttatttcaagacaaacatttgaaaaacaataataatttcagactgcaataaaggaaggctatttgttttacttttgcaggcacagaaattttgtgaaatcaccaacaattcagaaaagaaatgacatcatcatgcccgaaaaagtataaatgacataatctcaaattaacacataaaaacgttaattaaaaatttagttttaaacccccctattctctccttcctcttttttttttttttttaatcatggcctaatacatcaaaacaggctggatgtgtcaacggcaggatatttgagaatcaaggatctgattcaaatgttttatttgttcttgatggaaaattccaaactggcttttaaagcctttcaataatgcatggaatcctgaagaaaaagttgcttcctagaagatgttgctctgttcaacctgtatttttaagtgtctttttcctctaatgtgggtttaaaaacaataaggagagacatatgctacttgggtattttgttgaggccatttccctttttttatctgaggtcatgtgaatggatactcatcaaaacaagaggggcgtttttggtttctctttttgctgataaatcgaaaacacaaaggtcaaaaataagccctgttcctcaatcccagtgccaatgttggagtgggtttttctttttcttttttttttttttttttttttttgagatcgaattttgctcttgtcacccaggctggagtgcagtggcgcgatcttggctcactgcaacctccgcctcctgggttcaagcaattctccacccttagcctcccaagtagctgggattacaggtgcccaccaccactcctgggtaatttttgtacttttagtagagatggggttttgccatgttggccaggctggtctcgaactcctgacctcaggtgatccacccgccttggcctcccacagtactgggattacagacgtgagccaccgtgcccgacctggagtgggttttttaagtacttataataattacttgaataatatgtgttcattgtagataacatgaaaaatgcagaaaaacacaaagaagaaaaatcatttctaattttaccagtgtttatcattagtgtgtgccatggggatatttcctttctagccccacacacccaggcaccttcttgttttttaacatttatttaacacatggttaatgacttgctactatgctgcaggaattgtatcaggtggtagaaatacaatttgtattaattgtagataatattttgtgatacattattttttaatttaataagatactatggactgagatgtattcttcatgacgtgtgatgacaacgtagtaatccctaattcctttagttaataagttcattttaccttctcattttgcctctcatttgctattttatcacctttcacaaataggtttatttgttgttattttttcctgctttatttgtaagcagtattagataacagttgcacacggagaattttcaggtacaattaacttctctcttttttgcgtgtaggcttatttcttcctgacaagtcttttgccttctaagtaacttagtgttgaaacattacatgaaaaagccacctcatttggttcttgcacagtaatgtctaaatcacataagaaatgcattgaaaaaaacaatcggggaaaaaagagggagtaatattggctagcacatctttgaatgcatctggaaagaaaagagtaaatcaggattgaaatagaagccaaaagatgatatttttatggaaaataattcccctctccttttctttccccagctctttttctatctaatatgcatttttctttatattataaaacagctttgctcaccttatctctggtagttctttattacttcagtgtcttctcatcattttttaaggttctggaaatgtaaactactttcctaccacttttcatttttgtggatagggtggctgatgggctttaagtttcaagctatgatgaaacaaggaaatagatcacttcttacagtgtaataatggaactctgttgatgggtctaataaagaagaaaaaaaatcaaaccttatccatcatctccatgacttctagtgtctttcccatctgcatcttcatgttaagcaaaaaatatataatgcaaaaagtgtgtttcacaaaggactttttttaaaaaaaaaaataaggttagggctttctttccttctattttttttttttttttttgagttggagtctcgctctgtcccccaggctggagtgcagtggtgcgatctcggctcactgcaagctccgcctccccggttcacgccattctcctgcctcagccttccgagtagctgggactacaggcgcctgccaccacgcctggctgatttttttgtatttttagtagagaaggggtttcaccgtgttagccaggatggtctcgatctcctgacctcgtgatctgcctgccttggcctcccaaactgctgggattacaggcaggagccaccgcgcccagctaaaggttagggttttctaaggttgtaacttttgcatgtgtattacttgccacacaaagcatcaagataaggaaaccagcccttatgggtccttagcttcatgacaatatctaaaggtcatactgttttaagcatacagaaaaccctctagtcagagtctgtgttagctgttctttaaaaaaaaaaaaaaaaacttccatgtcttgctattattatgagtttgtatttaaaaatttcattctaaccagcaagaacacttccagtgggaatttctgataaagcagtcaggttttagcttggagatgtactaagtgcagaagttttgtgagttttcttcttggtcttgcaaagaaaagcatgaagctatataagtctttctgtaggggaaaaaaaaatactttttttcttccttttttttcctttctgatgagcatggatggaggagagatccatccatattctggatcattattggctctgatgatggttttgtacaaggaataacctctcttggggtagtgattctttttaatgacctttataaaccagaatttttgttcatctgagaaactaatgaggattaagggaagaaagggggccgggtgtgggggctcactcatgtaattccagcactttggggggccgagacaggcggatcacttgaggtcaggagttcgagatcagcctggccaacatggcaaaacctcatctctactaaaaatacaaaaattagccaggcgtggtggtaccggcctgtaatcccagctacttgggaggctcaggcagcaggatcgcttgaacccgggaggcagaggttgcagtgagtgccgagattgcctgggtgacagagcacaagactctgtctcagaaggacaaaaagaaagggatccaacagatatttatcagttaatgtgtgaattacccatggcatcattacctttaggtttgctcagaacaagtcctgtttatcccttgatcctggtgtaattattgacatccccctttctgctgacaggtgtcccagtttcaacgatgtattatatagtcattccatactcttaaacaagagagtaatcaaatatagaagccaagcgtccagaactatggctcagacaaattggcagttgaattttgatttctgtacttgattttttctgagaagctgaaactactatacttcagttaacttatttgcgaaatataggtattatagtaatgtttttgccgtatgggtgttgagaaaattaatatgtgaaattttgatcaaagtacctgataaatagtaaatactcatttgaaattagcaaataattattcctatattttttttcattgaagtctttcagtgctacatgttacagcctccaagtcatttaatttatagaaacagaaatacttcgtggtctgcagcagtggacacaggaagtggcttataagaagatggacacagaaagtggtttgctgaagtaagaggatggtaaaacagagtggattcatctatgataagtgtctataaagggattatggatctagagaaatttctgtaagttttcttttgggttagtgttcaaattggtaaagttgccagggcgaggtaggaaagtcacattcaagccagtgtttcatatttattggtttatgatttttttttgagacagtctcactctgtcacccaggctggagtgcggtagtatgataacggctcactgcaacctctgcttcctgggttcaagcaattctcctgctttagcgtcctgagtagctgggattataggcacacaccaccacgcccagctaatttttgtatttttcctagagatagggtttcaccatgttggccaggctggtcagaacttctgatctcaggtgacccacttgctttggcctctgaaagtgctgagattataggcatgagccattgcacccggccagtatttcttaaagataggtaataaggttgcatctttttgctcctcgaaagatgggctttgccatatgacttactttgactaatgaaatatgcagggaggtgatgtgactttctcataggtggatgcttgaagtgacattttgtgagttaccacattttctagcccttgccttagagattttggatacatgaggtgagagaaaccgtctgtcagctcatgtccctgagtgactacaaaaaacaaaagttccagccaacctgtattgagcacatggtacgaatgagaaataaacttccattgctataagccactaacttcaggggctgtttattacagcagcattgtgttgcccatactggcttatgcatcttgcctcttgcttacctgtcatatcttctgctgctttgcacgctcatctcttccttcccccacttgccattatcagcaacacttgctgaccacctatatgtgcaaagtgcttggtgtcaatatgtttctcataagaaccttatcaagtaaatacttattatatcttgccactgccagatgaagaaatgggctcagagggtcactgttcacaaatcccatagttgtaggtagagaaagagtcaaacatgggtctttcaagctccaaattctgttattaaccactgtggtatctgtcttgtattaggaaggagttcccttactgtcttttgaggttttttttttttaatgtaaatgccctgagtttttcaacacatataaaagggttttatgaatcctttttgttcataaaaggagattaacattaatttctgtgcagagtaggatgaaatagagaaagaaagaacaggaaaaatataattggaatctgttttcaactctgacgtgttagaactaggatttttacccttctcaaaacaaattctaggacacacattcatgcagttggcaaagccatgtgactctagagaaccgtgttgactgattggaaatgggtaaaattctaaacagcatcagcttgatgtggaatttccaattacttaattctggttggttttgaagacacatgagctgactgcttcacgggaatcaggaatgaaggggaatctgttcagaacgtatatgtctccccgcagtaaaagcaattcaaagccataaattacttatatcatctcagcgtcttggggactgcttactaatcttaggacctataaaataagggatcaaaggtaacattttctacgttgatgctgtgagatctatgcatatctatctctcagctggccctacgagtttaaaaattgttaaactgacaatttactaatccttctttttggatgatgataataatgatgattttttgcataaggctcttggaccacctagttttcacaggatggtgatgaatgagtttagggtttggcccgaaaaccttatttcatctagaattttgcaggcagagccaagagagttagcagcctggggtggggcaatggagagagcattccctttggtcgcttgaaaaaatccgtgcctttttgtttgtcagcactactgaaattcagcactgctaggaaacagaaatctgatattccaagatgctcctattggattttcacatatctcatttgcatttggattgtttcagcaagtcttacctcacttctgatacctataaatatctaaggttttagttgacacacgtctggctagcttcacaacaaggatttaagagcttcatgatattatttgccatgaataattgctagtggaacatactggatcaccttgtataacttttgcaggctggttttaatttcaggtttgactgttacattgtagctttgcaaagcaataacaaatcataatgtagatgagcagaaacaaaacaaacgatgatgggaatattaccataaccataattttacagcacagtttaattatttggttcagtaatgttgaataattatttcaccaccaaaactcctccccaccccagcccctcaacaaactaaacaactgtttcactactagcaactaatttatgaggcaatttcagattcttatgacttcttgtcgctctgagatttacagtcactaataaaaggccctaactttgagagacttgaattaaaactcatttataaagagaataaaaaatcagactttttccatttctatccgtaagtgtccatattcctgtagacctggatgtaagtggatgaagcccactatccagtgaataacagatgctcattaaatattggaaagcaaatgaagtcataaatgcgtataaagtaggcagagtcttaggaatggacaagatgacttatctttcttcttacattctttaggatggaatttgatgaaggttcctttcttttgtttttgaataaaccaactgaagtttaattccatgtttcagaaaatcacccctgctttttttggagatggagtgttgctctgtcccccaggctggagtgcattggcatgatctcggctcactctaacctccccctcctgggttaaagtgattttcctgcatcaacttcctgagtagctgggattacaggcatgtgccatcacgcctggctaatttttgtatttttagtagacatagggtttcagtatgttggccaggctggtctcaaactcctgaggtcaaatgatctgctcacctcagcctcccaaattgctgggattacaggtgtgagccaccgtgcccggcctcaaaatcactcttgactctttcctctcccttatccctcatgcccagagatcaactccagtggtttatcccctcttaattactgactgaaactttttgcttctctccattctccttctattctcctggccaaagccactcttccctcctgcctggagtgctgtcaacacttctaaactggcctttcttcctccactcttgtccccattaatctattctccatataccagaaagagtgattttctgttacatgatcgccatcattcttgctgaaatttctactctaccttccgctgattttaggatcaagtctggaaatgttgtcagtggccctcaaagtgcagttgctgcttagcctatcgtgtcctaaatccgcatctgatggcactttgtcacaatccaggctctttgagagagggagagagtctgtgtgtgtgtgtgtgtgtgtgtgtgtgtgtgtgtgtgtgtgtgtgtgtgtttccctcggtagagtatggggatctctgaaaccctttgtatactcaatcctattgttcattatgattgtgtgtaggtatcgtttctggaaagcctctcagttacatacccttctttgtcttttcacagcataattgtaatggtacctgttatgttttaatatgatacgctttcttttccaccaaatggaaaactgtgagagcagtactacgtctgtcttagtcaccaacttgtgctcagcacctagcatggagaccagcacatagtagagatttaataattgttgtgtaaatgaataaaacacatctatccagttggataacttggggtagtttgcttctctgcagtctgtctccctctcttccttcctcccttctctctgtttctctctttttctctttctcgtagtaataatagctttactatgaccatagctctttttttaatcgatcaccttttaacactttaagaactatttctaaaaactcaacttaggaaacagctgaattagccccttgctttaggtttcaggcttccctgaattccctatgattttcttatttgaaagtctggttcctgtttatattggaaacattctttaaaaaaagataagaacgtttggaacggcaacaaaacacccaattaatgtgcaactactttgaatattcctgcagtggcaacggttaaagtagaatgattggacactgtcactgctagcaaaattataatccagggtaagctagatttagagttgtgtctcaaaacctgtgttttttgtccttcaggagttaaaagtgcaaaaaaataaaataactgagataagagttgaattgatgccttcgaacaaaatggttaaattctgtttgggtctttaaaagagttaacagaatataacaattcaaagactccatgttccataaaaattgtgctattaggaagaaagccatacttctcagtaacctccctgacacttgctctgttttacttccccggccgcagctggtcttgagtataatgccattgattttgagagatcttataaagataattagatatactgcagtgtgttctatattctcagcatttctgaggctatgcaaagccacccaaacttctgaaatatgtaccttgtatttcttacttgagaaacttttagtttctatgcattggaaaaaaaaaaaaaagctctatagcagactttcctcctgaagcgtgaagaaggaataaacgaggagtagagatttttgcctcctttttcatttatgtaaataaacgtatgaaatggatttttaatttatacattagttatcttggtcccaaagcataactcttttaacaccttgagcttccttatgttggagggggaaaaagagtgcaaaatcattagagacatgattatgctttaatttaggtctttgagttatgtaagcagaatgcaattaaagaagaagtgctcactatgactacctatttcaaataggctttcaatttttcagttttatgtgtatcttctgcaattgcataaaacttcctcaaggctatgacagtggattatggctgtgttcttgtaattattttcagcttaaaaaaaagaacaactttgctgcataaactattgagttaaacatattacacgtctagtttttactgggattgtgtaagattttacaccagccatgagattctctgcattcataggtttagaaggaaaatgtgagtatttatggcatcatgattgtcactgtcactatcatcctctcattgtcgtcatcaccatgaaaatcagatccacaagtgttatcttgcttaattattgcagcaactctgtgatctttattattgccattttccagataaggaaaccgagactttgaaacattaagtaacttgcataaagtcagacagctaggaagcatagtatctgaaataggaaaccattgctcactttggcagcacatatactaacattggaatgatacagagaagattagcgtgacccctgcacaacgatgacatgggaatttgtgaagcgtttcatatttttagtaaaagtagaaatacctgttgatccattatctaccaaaaggaaaagaagtcattatatgaaaaagacacttgcacatgcatgtttatagcagcacaattcacaatttcagaaatatggaaccagccgaaatgcccatcagtgaataagtggataaagaaactatggtgtgtgcatacacacacaaacacatgctactcagccataaaaaggaatgaaataggtcaggcaaagtggttcacacttgtaatcccagcacttcgggaggctgaggcaggtggataatctgaggtcaggagttttgagaccagcctggccaacatgatgaaactgcatctccactaaaaatacaaaattagccaggcatattggcaggtgcctgtagtcccagctacttaggaggctgaggcaggagaactgcttgaatccaggagatggaggttgcagttagtggaagatcatgccactgcactccaggctgggcgacagagcaagactccatctaaaaaaaaaaaaaaaaaaaaaaaaaaaaatgaaataatggcattcgcaacaacctggatggagtgagaggccgttattgtaagtgaagtaactcaggaatggaaaccaaacatctcatggcttatctcccacttacaatggttttccattcccgagttccttaacattgtgttaatatactaacatattctcgcttataagtgggagctaagctataaggacacaaaagcataaaaaatgacataatgtactcttgggacttgaggggaagggtgggaggtgggtgagggataaaagactacatactgattgggtgatgggtgcatcaaaatctcagaaatgacacccaatgaacttacccatgtaaggaacattacctgttcccacaaaactattgaaataataataaaagaaaaacattgttgaaaagataaaattagaaaccaagaagcttggcttcataacccatgttactaatcttaaaaatgattccaagttgggcagaaaatggggagaagttgtgagtgggagcaagtgtggtcaagaacagggcgaaaaaaatgtaaggactcaaaatgtaggttgtaatcttatcaattgactgtgttaccctaagttgcttataccatttaatcatataatgcctacagtgcttgtgcacataatcatcttctttgtattattatagtgctacggttgatgatgatgatattatcactattgtaattcaggaaatttcagtatctctgaagactcttcggttgtctaaacaatacaactcgttatggtgggggtgcgttttttagagaaacatttatattttaatctgtcctttatacacagctttgacctctcctgtccaatatgacctacttctctgaagctggtagtggtttttgaggtttcatttgcaatgtgtggcttcttcccaggactcacacaagattcgctgagagtcttcgaattttttgaatcacccttaagtgcagtatacatcaattcagtgctctggcaaagactatgaattatgtttatgtctgaagcaaggccgtggttaaggaaaatagtagatgtgttaagaccttgtttatttcagcagagaaggttagagttgatccacatctggataaaaataattttaacctaggagaagttatattttctttataccataagctccccttctctggtagcctaaatgaatcagcgccacatctgggcatggtggcccatgcctgtaacagcagcactttgggaggccatgacagcaggattatttgaggccaggagttcaagaccagtctggggaacatggtgaaacctcatctctacaaaaaaattagccagtcatggtggtccatgcgtggaatccaggctacttgaagggctgaggtgggaggatcacttgagccggggaggtggaggttgcagtgagctgcaattatgtcactgcacttcagcctgggcaacacagtggaacttgtctcaaaaaataataattccatttaaaaaaaataagcaggcatagtaacacacgtctatagtcctagcatctcggggggctgaggtaggagggtcacttgatccagaaggaaccccggagattgaggctgcagtgagccatgattgcaccattgcactccagcctgggcaacagagggtgaaggaccctctcaaaaaaaacaaagcaaagcaaaacaaaaagcatcagcaacacaatccatcttagattcctgacatccagtctttctattcttgggaattgtcctagaatcacccagttgcttcctggtcagcatattcaatggacaatgaatgacttgttgactattccaccatcaaagaaaaataatattaataccatccaacccctgaaatgagcctatgttctatgaagtaaattagctgaaacaaagtcactcttaaaaatgaagtgatatcaaaaatcaccaccttggtttttgtcactattttatcttcatcacatagcgctgtacctagcacacagtaggcatttaatatttgtttgcaaaaaattaagtcacttctataaaaattaatagtgtgagaaaccttggactttatgatgcaccatactagagtaaaagacttgtatctattttttttttctaagagtacatttctcacctagggttctatttcttaatcttggctggaaccaaagaagttgttatctgccgtctgatcaagagagaacccatagtccctgcattgtaatttgtgtgctttttcttatttatatttgcattacaagaaaacatgaaataactgtatctgctaaaactgaccgaaagatggatttcagatgtgagcaatggaagtgggattggcattcatcatagtgtaaatgcaaaagtgcttttagcccaccaagtactgggtacactattctgaccttttttcaagtttctcagtatttatggaagaataatttgtagaataatgaatatagttttccagtggagcaacaaatgcatactatatttctgctattgtttcttattaaatattcatatgtatattttgtgtttgcttcataactggccatttactggtgcttaacaagcataggcagtcccgctgaagagaaataacaccaaacaacagtaaacaaaaaagcagacgaatgaaaaaagatatcttatttctgcagccgttacatttaaaaagtgcatttaacatttttaatacagtccatatttcataaatcccacatgttgacatgtcctagagaaagatggatgggttgacttggaggtatgcttctatctagttttatgtgtgcatctggcagagctaatctttacttccctttagcagaacacaaaaatgtaattctctaataactgacataactgcatcattttccaatatggactgcattattaaatcacagagacaagcaaaaccagagtagtggggaagcttgacttctgcttgatatcagaccataaaatgcctacttactgtggccgaaaggaaaaagagcatcgactctcagtgcttggaattcggaacaacttctgaattcacagccccagagtcttgtgtgtgtgcaacaataaccgtgtctttgcatttgcatattgctttagagttcacaaagcatttttacggacaagcccatactgagaatcagagcaaggattgctattctctgtgtatagtgagaaaatagaggctcaaagaagtttccaatatagtaagaattatttctgtaggacttttaaattgtataaattgctttaacgcatgcagttacattttgcttgtgtaactaggagaataagtcatctaacagtcttcttcctatccccaaaatacccattcaaagagaatagggaaaggattgcttccagactaagaacttaggatcttgcgaatggtagttgcaaaacatacacagagtcttggattagcaaaaagtaggggataagggtttcagagagccgagtcattgtgcttaagcatataggaggaatttaaggatgttgttgcctctaagagggatggagctgaaagacacacaagggtaggacagatagaagagagaatggctgagatatatggtggcgtgtatgcaaggacttctaagagaagtgatagctaatgtttgtgttgctacaatgtaaatacttccacttccccaagcaatatattgtatggtcaccatgcaggctcatcaacaaagattccgtttcttccctgctgagcactgcttgaagttcttgtgatttgagtgaggccatgagagcagttctggctaatgaactataaatgaaagtgacaggtgctggaacattttattgctgatgcaagagtttctagaaatttcttatctctctgatatggtggctagaaatatttcagatgatggattttccttcatccaagattgctgagagtctttgagaagcaacaccaccctgtctcttaccaccaaatccatgatggacatgtgatatgagcaagaaataaacttttgttattcctggaccttttagattttggagtcatttgttgccacagcatcacatggcgcatcctgactgacacatgcagtgtcctcatgtgaacattttgtttgtgtgttgtcaaggaaagtcactgtggttcgtgttagcgtcagtttaattcaaaggtaactcaacagcaagaaacagaaagtaacagaaattcagcaagggcaagaaatggaaacctgatatatcccatgagagtttaaggaccctgacaatctgcagaaattttaaaaagtgctttgggcttttcacaaagtatagaaaggggttttggaaaaacctatttgaagttttaaggatcagagagaaattaacagctaatctttgatagttctcccagtaccatcttcaagttaaagaaaagggtaggattttttttcccctatgttaggggaggaaattaaaactgagataaataaaatgacttgtataaggtcatgcaaatgctaataagcaaagcccagattactaaaccatttgaccacacgtgtagtagtgtttcagcccactcttttaagaagttttcagaaagccaatgagctaatagcttgaatatattacagtttgaccttcatttcagcaggacagacaaatcattgacaaaacggctgcaagaatatcagcccttttaataagttgtccagtaatatgatatttttatgattattcaatgaattgatttttatggaattggctttcagtgaatttatttatcagccagttttctgaagggcagcccaacactatatgccataaattttctttgctataattaacttcagacactctgtctcctatctttcctaatttcatctctctctctgccctgtttatatttattggatgctctggtatgtaattattagaattttccctttactttaaaaactgttctttcatctttgtgtgtatcattgattgatgaccccatcatgaccttaattgcaatttacaaacttacttgctacaaagttaggttaatgagattattcactatacaggtagattcaacataagtttccattatcatttttaaagccagtatcatccactaaacatcaatatgtcatgcgatgttttaggagcttcaagtaaggtccagttgtgttatttcagttaactatgttgtacgtctctgtttaattgtaatattcttttctgtggaagtaaattctacctctggatcctacttaacagtgttcctggctgttactaacccttcctctgatttgacattggaatggaagcatttttgatgttctatttatgatgttaaatttacaaagaggtttgagacattttgaattatctcataaatgtgcaatcttgcctcacagttaaatctgatcatttcttttaaaatattatttaaattttcattgcatcatttcttctatctgttcagtggcatttctacttctttatttgttaatcttctgaaatagtcttaatctttcatacttgaagcgcctctgtttcctccatccatgcaagtaaattttcctccagattcaactcctttctccttagggatgttcctgagagtcccctgacctttcgagttacttcttgtcagtggctggtgttagatgcacagttctctaatcatgggatattccacctcaatctgtgtactcctttaaggtataaaagagcaaaattttccaccggggggtagcaacatgacaagaagggaaagagcagagttaaccttggggaaaaaaatgagacataaggttggctgggtagacgaggcagccagagagacagcctctgttgttcctgaccactgccttggtttttagtattatactttccacttcagtcactgcaacccaccgccctgttgcaggaatgaacatgtgacccaggtgcagccaatcagggtttgctcttcccctgtgttggtcattggtccaaggtggacaaatgatgcaaaagctgggccaggtagagagatttcctggaaccttgctagtcaggttagacagcttcagacacgtgaactcggagaaggccagaatctgtttttctttctggactgtctgaaatgtgaactggaagaggcagggtggggaaaaaatcaacccaaataaaattagcagtaaagaaatctagataaaaagagcactgagctgtatgatgttccagagtcagtttgacttcttggacgatgattattttatgattgtatttgattgcgttgtattaaaattattgttatatttttattacagtatttcttatattattgaaagaataaatcaatatataaatgtgttggaattgctggacagcaaactatatacattttatgtggttgacagaaataagctacttgaagctgttgagcttgagcagagtgacaaaaagatgtaaatgctacattaggagattcaatctaataacagtttttcaagatgaatacacagtgagagcctaggcagggctgaaaaatacgtggcccataccctccaccttcccctcctatgcctgtggcagacattgctaatcaatcatggcacttttacccactgagtctgagctggtcttaccatgcttctcagtgaagcgctccaggcagtgactatagatgatcagagctggcacacaaaatgaaacccatttgctctcccaagctcacaggcaaggagaatagccaggagtctgagcatgaattagatataaggttcccaagattggacctaggtggggagagagcaaaggaaggggtaaaacctatcgttgacaatattagtttgcttggactgccataacacagtgccacaggttgggtggctaaaacaacaaacagttactctcacagttctgcagactagaagtccagaatgaaggtgttggcaagattggttccttctgagggctgtgagcaaagggtctgctgcaggcctatccgtggcttgtagagggtcagctacatagagagcctgtgtatctttacatcatcttccgtctatgcatgtctgtgtccaaacatgcatactcctcttcctgtaaacactccagtcatactggcttacagcccactctgaggacctgactttaacttgattccctctgcaaatattccatcttcaaataaagtcacattcttagatgttggcagttaagacttcaacgtcttaacgttgaatttgcggggacaatttaacacatcacactgggtgcctaccatgagccaggcatgagcttatataccattatccactggagcctcaatgcaacctacatactgggtacttttattctccctattttacagagcaggaaactgaggctgaaaaatcttaagaactgtagtaaaagtttcacagctggagttgctgtatagcaggatttagatgtaggctcctgctggctaattgacatagtgtaaaaagaagggaacttggttatgggttagacataaaggagaaatttttttaaaaaaactaaaatcaccaaagactctagacttcatttctggaaaaatggtgatgtcagtcttcctgcttaatatttcagtggccccctattccctgcaggttaagatgtaaattatttagcaggaaagtcaaggctgctgatggtcttagatgcctcattaattctgtctctagcttctctcttcctggcccctttggtccagcaacactgggcaatttatttgcagtctccaccttagagagatggagagggagaaggcttggagagaacagaggatgatggggaggaacaacctgtgcactgggtctcatccttgttgtttgcaattctggctacttttagcagtgagcagtataattacagtttagtcacctaacctctctgattctctctcttcccagcctggccaacatgatgaaaccccatcttcactaaaaatacaaaattatctgggcatggtggtacgtgcttgtaatcccagctactccggagggtgaggcaggagaatcacctgaacttaggaggcagggaggttgcagtgagctgagatcgcaccactgcactgcagcctcggtggcagagttaaactctgaaaataaataaatataaataaataaataagatcatgtttgcagagtcctcagtgcagtgtctagcacttggcaggtacccattggctgtatggataacaaccattcagtttgggatatttggagtctgacataaccaacggcaaccaaagagacgagttccttaccaagccagaaacgcaagaccaggatgcaagtggcattcctggggggtatcaattctctgtttctttgccccttttcagaggctttatgttcacccccaggagtgaacaaccatcttcctgctctgttcctattttccattatacttaccaggagttatgaattgaatcaggatgtcttaggcggcttcccctcctgctttagcaatcaataaattgccatttctaaaggtgagattgtgaattgttaagtccaatctgcagatattctagataacccatatgtctcctgacattgctgtattcatagatggcttctcaaaccattattaatgatgtaattagtatgaatggctacagtatatatcaagcagatcattaaggcagaggtggggaggtagccatttatattaaagatacgtttaatgttctgaacctaagcaatagaaagaaagtacttagcttagaaatctcgctttgctacactatgggttttcttttttaaagttgtcctagaccttctttttgcttgcttaatgctactttttgttggagcccctgggaatttgaatgagttaataaggcagatctgtttgtaaaagagtataatcaagtaaatcacagcctttaaaatcacagatttcaaaatccaatcaacttaattaatgtgttggttcatagacattgtacaagattttatttgattgcactagccgctttctcttagacacccatctgcaagaatatttacttataacttgttgtgtaaagggatcttcctaaacggcacactgccatatgtaactgctcagcttacctttaagagaaaatattgaagtaacaccctcaagctgttctactctgtgttcagaacttttcaaagctagatttctatctttgtagtaagtattgaaaccttgcctcccacatccaggctgttcaaatatgagataaaatagtttctaagaatgatagagtccaaaagttttctacagttcttatagatgttgtgagctgaaaatacatgggttagtgaagaggtttttttttttcttttctctattattatctcttttttccccctaggaattaatgtcctttgtagtagccaaaatgttaaatgtttttaataaaagctgagacttaagttagaggggaacatctttaccccaggtacaaatgacgttgctacttgccacggtccaaagcgcagaggagatggggagattgtgaaaactggggagtcacacacaaggagggggtgttttttgttcttctgacaaactgatcctgttaagcatccactgcagagcggtggctgctgtgttatgcaagcacctgcgatgcgctgcagaagaagagaggcatctgatgctcgaccgagcagagctactgcagacagaagctgcttccgaggccccttctgctcacagggcatgcttcctggctcatgtgcagtcagccatgctgcagaggccagggacccagggagcgtggcaataagtatgtgtccagctttccaaactctgggtactgtgaagcaactgcagctctgagccttgcttaaccagggctggggacctggcagcttcttccaaagtcacttgacaacagttgctctgccctcagtcaatgcaagcaaccacttgtctacaaaaggagtgaggacagtaaagtctctgccttcaaggatcgtactgtattcttattattagtggctacaaactgttaagtacctaccatttgcaaggaactgtgttgatgacatgttacatgtacatcatctgttacattatcataagacctcaaatatgttttattacccccattttgaagagattaaaaaacaaaaaaaactaaattggccaggtgtggtggctcacacctgtaatcccagcactaggggaggctgaggtggtggatcacttgaggccaggggttccagaccagcttgggcaacatgacgaaaccccatctgtactaaaaatacaaaaattagctaggtgtgatggcacatacctgcagtcccagctacttgggaggctgaggcaggagaatctcttgaactcaggaggtggaggtggcagtcagcccagagtgctccactgcactccagcctgcatggcagagcaaggctctctttcaaacaaacaaacaaaacaaaaaaaccctgcaaatattaagtgttaaatcgtaaaactgagaccgcaacccagatctatcttattctaaagctttggttgttttcatttcaataattactgtcatgttttagaaaagcagcaaaacgtttatttaatatgaaatctcctgcagaaactgatacagagacagatcaaaccaggactgctctgactgaaacggaaggaggaaagtctcaagctctgactggaccgcctcctccttccctaattcccaggtagtaattcccaatgactgagccatcacttcagaaaactagaactgtggtttttcagatgtggtctccagtccagcagcgtcagcatcacctggaaacttgctacagacgcgtgttctctatcctcgctgcaggcaaactgagtcagaagctctagggtttgggtgtctctgatttaaacaagccttcggggggttgccgaagcatgctcatgagtcaaaaccaagaatttacaaaacccattttaataacagctgagttctatagtacctttcagtattcgtaacagtgattcctggagactttcttgacaaagtccaggatggtgcattaaatctacttctgcattttatttttttattttttttattttttttgaaatggagtcttgctctgtcatccaggctggagtgtaatggcacagtctcggctcactgccacctctgcctcctgagttcaagtgattatcctgccttagcctccctagtagctgggattacaggcccctgccaccacactcagctaatttttctatctttagtagagactgggtttcaccaggttggacaggctggtctcgaactcatgcctcaggtgattcacctgccttggcctcccaaaatgctgggattacgggcatgaatcactgcacccggccttagtcatgcaatttttattttagagaaattctagaaatggatactgtttactcaatgcagcattggagaatgaacgttgactttattaacccaataataaaataaaatgatttctcttgatttgtttgctgtcaagaatcacaaaccacatggacttgagaaaagtgaaagttattaacgagatttcatgcatcaaggatactgttgactgtccagtgaaagtattttttttttcttttttttttttttgagacggagtctcgctctgtcaccaggctggagtgcagtgacgtgatctcggctcactgcatcctccgcccccagggttcaagtgactctcctgcctcagcctcctgagtagctgggattacaggcgtgtgctaccacgcttagctaatttttgtatttttagtagagacgaggtctcaccatgttggccaggatagtctcgatctcttgacctcacgtgatctgcccacctcgacctcccaaagtgctgggattactggcgtgagtcactgcgcccggcccagtgaagcaccttacgtgtgtgtcaccattgagaagaaaggttaccaaataaattttgtcccgctattgattgcaaaggcattccaatttccaagatatgaaaatgtaggcccagcgcggtggctcacacctgtaatcccagcactttgagaggccaaggcaggtagatcacctgagttcaggagtttgagactagcctggtctacatggtgaaaccatgtctctactaaaaatagaaaaaaattagctgggcgtggtggtgctcacctgtaatcctagctgctcaggaggctgaggcacaagaatcgcttgaacccagcaggcagaggttgcactaaactgagatcgcaccaccgcactccagcgtgggcaagcaagtgagactctatctgaaaaaaacaaaaacaaaacaaaacaaaacaaaaaaaaaaccagaaaaaaaaagaatgaaaatgtgaagaaacgtttgctttagaatcagtgaaatatggcaaaaataaaagagatgcttccgaaattttgttgcattaggtcacttagccaatgaggtcaggtgtctgtggaagcaaaaccgtgtctttgtaatcaatttaaaataacacaaaatgaaaaaaaatgctcttgttcatgataattttttccactttctggtttgattatcttccatatactggtgagtctccatacttggttgtattgtccaagttggattttccctgcagcttcaaaatcatcatgtccctcaccaaactcatgaagttcctttacattgttattgttgactctgctgttcttcttgttattgttggtatactctttagcacttcttcctcctctatctctaattctagtacttggaaggagactatagagtagtgattacctgtattttgagaactgtgttatctgcgaagatgtttcaaagtgtggtggggttataaagggctttgatggtgggacaggatggcattgagtaaagtaagttgagaagttgacagttctccctggccttatgggttcattgtgatttcaagaagccgaaaggatatggttgtatcatctgtgggctccatgaaaactaatgatcattttctaaacttcgcatcatgttttctggctttttctatccctggaatcattaatcatgtatattaggtgatttccctatatctgtttatagacacaaaaacacatatacttttttttttcctttcgaattctgccatatcaccatagaggtcttcaggaagttagtaaccctagttttagaagggtttggttgtttttgctgtctttccatagtcatttttttttttttgaggcagagtctcactctgtcacccaggttggagtgccctggtgcaatcttggcttactgcaacctctgcctcccaggttcaagtgattctccagcctcagcctcctgagtagctgggtttacaggcactcgtcaccacacctggctaatttttatatttttagtagaggtggggtttgccatgttggccaggctggtctcgaactccagacttcaagtgatccacccgtcatggcctcccaaagtgctgggattataggtgtgagccaccacgcctgtcccatcctcatcatttttattactgcatcttattctgtttggggtttttgtttgggtgattgatttgaggtgtttgcttgtgtgtctgatttggggaagacgttcccaggtaattagtgtaaaatttttaataagcctcataagctttacaattatttccctggaggacaggttttatttaggatttaagaacagtaggcagtagttgtgacattttgaacattttatttctttacccaaaaaataactaacttttgtaaaaccaatgaaaagaaatgaaaagaaaatgaaggaccacaatgctttatgggtttgtgtttctgacagcttaagtcctgctcttgaaagtagttacacagttggcaatatacaatgaatcactgaagctgtttgaaaactttttcgtttttttgtgaaaatccaaacttggaggagaaagagcttactgatgtcaacacttagaaagcagtgttctctttatatagtcacttactgtcttgggtttcattttcggttcagggggaaattaaattcccttgcaattgcactctctgtctaccgagaaattttatctccacattgtttttacttgctgtttgtcctctgggtaaaatattgtgtccgtagggttagaagtgcattttagaggtcttttggttcatcaggctgttccttgcaggtcagtatttatactatttctgacccagatgtctcctgtattctaagatcctagtaaaaaagctgggggaagggagaccattgtaagtacacagcagccttactttgtgagctcatgccttagttaaaagattaaccgaagaattttatttcaccctattgtgttaccaaacattagatcttattgcttctaactatatttttatgtcctttattcatccctctttatcccctcctccccaaaaaagaattattttagcatctgaattcattctcctgccaagcagatagaaacctttaatcacttacttactgtaggtatgggcagacacagcttttctgtttcttaagcctgtccttccacttagattgcaaataagtcttcagggaattgcatgtgttctcaaatttgattgtattttttcccttatagacacgggttggttagagggatatcacagtggacaagaattccaaaaaacctggcttcaaatctccaatctattactgtaacattcagtagatcccattgttactgaaaatactgagttcattgtgagccacccctgtctttgagcctttccatgaaagtgagtcttctcccaccccattcttgcccccgttagccccatggcttgctttgaccagtgaactgtgagcataggtgatggatgtcactttcaagtggaaaatttacgagtatgcatgtgcctcattttgctctcttttccctctgcagtaaggccagtgatatcttacatatgacggctctgtcaacttggatttccagaaaaaggagaacgtggaacagataactttgagaaatgggcttttagcaagtgggaaaataggcatgtattttgagctgtgtgttgggttcttcgtgactgcagtgttactcaccctgtcttgaatgatgatggttagtatttgcaacatatacatgtcgaattcccgactagtttgtggaggaagggaagagtgccaatccatatccgtaagcccatcctcaatccaccagcttccaccatgtagtccagcacctaatggttgtttaataaattcttgaagagctatattgaaattggtttgtgtaatcttggaatagacccttcagtggtaaaaaccagcatttttccaaaggttgggtgagattttaggagttctataagtttcttttaggtggttcacagacacagcaggaaacaagattgaatcatagggtggagaaagttttcctttttgagttttcttttaacacattgtatagcattcaaaacaaaatttctcatagccacgtatttcagtggttacctgtgataactagaattccaggagaccaatgtgtttatatttgtacagttgcttaccatttatggttaataatagtagtgtcccacttatactagaagttgattttatagattttcttttaaagtaaaatgtgtttagcacaaagagtacaataaaggaaaataaataatataggtggtaaggtgaaaatgtgaaagcctaaaggtatggtatatgattgaagttgggagaaacactgctgtaagccttttggtaccctaaaatattgttatgaaaacctaaggagggtgggcatggtagctcatgcctgtaatcctggcactttgggaggccgaggcaggtggattgcttgaggtcaggagttcaagaccagcctggcctacaaggtgaaaccccgtctctactaaaaatacgaaaattagctgggcgtggtggtgggcacctgtagtcccagccacttggaaggctgaggctggaggatcacttaaacccagatggcagagatttcggtgaactgagatagcaccatggcactccagcctgggcaacagagcgagactccatctcaaaacaaacaaacaaaaccaaacccaaagaatgtttgaatgggttgtgaggatggtaaagtgatagatttaaggaatcattgctttggttatcgtttattgtgttggtgtttgtaacagtctttccttcctatctagggatttatctccatcttgtctgtccccagtttcctgggatttccgtatgaatagcatattccaagtggagaagaaggagagtgcctaaattcactgtcaccttctgatttaagcttttttaacctacgtacccactctctgttctgtgtgaaaagtaactggaaccatttgtgtaggtgaaaatagcacttagcagactcagtagaactctaaataaaagggatgaagtcaggggtatgaagtgagcatgaagtgagaaacttgaacagactcttgcttgcttgtgactgtaagtgttccctagaattcgtgtggagtcacctggttctttgtgtctcagacccttcaacactgtgaacgttttgaggacaggagttacgtctgattccccttcatgttccccgtcccttcacaattgtttgttgacaccaggcgttcttccaatatccatccattcattcattagtgactttcagttaaagcctactcatgtcttccattacaggtgccaatgcatccatttttattatcagtagtggctacaataatatttgtagcagctacaaattatagaatatgaatcatgaatcctgctagcactttataagaacaactgcttgaagcaacttagcaaggtggcagtattatctctaaagaggaaaatgaaacttagagtagttaatctacttgcccatcgatataagatacagacactaaatttgggtctacccagttctgaaaacccagaaacccgtttgccttttctacctaatagtaccttgttgatgaagacacatacacacacacactagagagagagagagagagaggagaggagaggggaagatatatcagctacataaacttcccagtcctgccttatttattagtctgtgatggttagttttttccagtgctccaggcatagcattcctcagcaccattgttccaaatcactgaagctggcagcattcctttccttgcttaatctctgcaagtttcaacaaattgttaatgtaatgttttccttgaacatacttaacatttacttttattcatctgaacgtggaacgcagcactccatgaaggtgcaatctgtcttcaatccaatgtctcatcaaattcctgctgcccaaaatagagcaaaggttgagccagcctaatgtagggttggcatatgataccattatagctacttagtggacagcaaggccagcactgcttttaaaacaatccctgctcattcttttcttccctttctttccagcaagtcggttttctgagaaggagctgtggctggttgtattaacatttgcattttgatcctgcttactgatgcactgcaaaaaagaatcttctgtgttgcctacttagaattttctgttgtagtcgtgtgaagttgccaggtggatgacatagatcccatttcttagtttcctttacagcacgttgactcttacccaagtccccaaaccccctggttggtgattgcagaccctctttgcaccccttcccttggcgattttatgcaaagttaatgccctttggccaagcagaacttccccagagctccttcaattcttcacatttttgacagtaacactttgtaacgaatgtattttagacaagactcttcgaccgtaaagtactggatctctctaaaaataactcatttgaaaagggggttattttaaggagactcagaaaatatcttaaaatatccaaagtctgagaccaggcatggtggctcacacctataattccagcactttaggaggccgaagtgggtggatcccttgaggtcagacgtttgagaccagcctggccaacacggtgaaaccctgattctactaaaaatacaaaaattagctgcgcatggtggcacacacctgtaatctctgctactcaggagcctgaggcagaaggatcacttgaacctgggaaatggaagttgcagtaaggcaagattgcaccactgtactccagcctgggcaacagagcagggctgtctcgaaacaaacaaacaaaaaagcctgagagtgaagtacagtgctatttgtaggggtttgttaggaagcagaagtatcagaaatgcatattctcaaagcctccctgtctccctctctctctctctctctctctctctctctctctctctctctctctctctctattctgcttcagggtgttctgtgcccccctcccctgtctgatttctgtctctgctcatttctcaccactcactctcagtctttgctcctcagctattcttgcgtgtgtggcgctggctcctgctctgcttttgccttgatctagttttacttttaattgcaaaaactacaattacttttcattgcaaacactgcagttacctttgcaccaaccgaatacatgatctttctcttcagaacttgtaaaagactgcccacctcacctgaccctcctagattccattcacaggagctcactgtctgcagaatgaattgccattgaaacagctctttcacctcattttgcaggcagtggagtgagtttacaggaaatggacaagctcacagggaagcagagactgtggagggaacacagcttctcccagaagaacaccgtgggaagtttggtttcttgtcttagattactgggagtcgggaaagaaagcccctagagatcaaactcatataggtcatctaaaaatacacgatcaagtcacaaaagcacaagataaaaagaaggctttctttatccctgtaccatgcctttacagaaactacctcattcatcaaaagatctttcttttaaacctgaactctagtagctgtgcgatagagaggtcccttgtcagtatcaacagctggggctctatgctgagctcagaaagtggagttctgaatcaaaccaagtccatgagccccaaagtaaatttagaccacaaagaatctcctctccagtttttatataaggagaaaaggagaacaaaagccctgttcctccaatagagcattggccagagaagcccagaactgtactttatcaatgtggaaactaaaatatcttttcagtgtaatttgtgatgaattttcatttgcatttatcatgaagaccaaaacacatgtatcatctggtgagaagtattctttcaaggtatctaaaacttataatcactaataaaaatatgcttaatacttcagggccaatggaatgaattgtatggggaatagtttaggttgtctgatagggtcagctgtcacacatagagggagcaagctgacctggagaatgaacatagagagaacatgataattaaccaagtgctatgatgtcttctaatatcccaaagacagtgctatgatgtcttctaatatcccaaagacagctctttatatgggttttcttcctttgcataatactggatcaatagatagatactggatcgattgatagatagacgaacagatacaaacatacatagattatggacagagatagaatgatctataattgctacctatctcttgtctgtctgtctgtcctttttattcaaagtaagcttcacttccatcacttctgcattttctgtcacagatggcattggtcattggtcatttcagcacagtttcataatatgtctctatttccaaggggtggtctgttgtgcgtttgaaatcccccagatagctctgtgttctgtgtgactttgacagtcagtctcatggatgggtgaaatgaagttttctcttttgttccattcagcccaagtggcagcacttctctaattctgtgagaatgccttcccgaatttgtgcctttattatcttttggttggactcctgggaatctgtctcatgtttctgttcacacctgctctccatcccaactagaggtactcccaaagtgtacccccaaaacaagaagtatttctgaaaacacttgccccatttggggttctcagtgcaatttcgtgacagttttaaactgacactttctctcactttataacagcaggctagagaaaaataagaaactgatagcctcgacctcactaaaacattcatgaattaaaattttgtaaaaaggttaccaacagattgtatcagtttagttcatttttttctattatcttaaaaagccattttccctgtgtttgtaattgtattttatcattttaggtagtagtccagaataagacatgttgggtttaattctctgccacagttctcaaatggatgtttcataagtagcatgtggctttctcagctaaaattaaatgtctcactgtctccaaatgttttctatctagaatttgcaacatacacccttccagaactaacagagactctgaaaattaccactaaacaacgtcagtctagttcatccttcttaccagcttcaaatgctggctgtagataaatacatctttaataaataatctaatgacttaaagaaataaagtctggtcctcttttccatagaagttcagttcagagaagcaccaaatcaaaaaagatgatctatattaacaaaatcctctagttttgtgatgttctaggaattaaagaacaagtccaaacctcagagaccaaatgtatatcccaaatgtatatccccagtggttcctgattcccagaatcccctggatagctctaaaaaatatataaaactggttccattcatgatgatttactaaatatggaatggaactaagcagataggagaactaactggtttaccctcttcgtctgcctcagccactagttgttagtaatatatgtgtgtgtgtgtgtgtgtgtgtgtgtgtgtatatatatatatatatatatatatatatatatatatatttattcccctattggataacaagctgtcgattcctctcatgacctctacaaggcagctgcacatgattgatgagaggaaggatctatgttcagaaaatttttttaaaggaggaagtggaggagaagaaaaaaatggagagtcatagatccttgacaatgccaatgttttgtggaaaggaggcaaaagtacctgatggaagaaataaaggaagagtaaaggatactcatgtgattgcacaaaagtggactacatctcaacagtgaggaatgagccctaagacaggttgaaatcccagctctgccacttcccgaatgtgagacttgagcaatttgtttaaacctcttgggatcagtgttaccatgtgtaaaatgaagatcatcatagtactcatcctcttatgtcatctttttgtaaaatgtttttttaattatggtgggtacatagtaggtatatatatatatttgtggggtaccaaagatgttttgatacaggcatgctgtgtgaaataatcaaatcatgaagaatgggatatccattgggttgggaggccgaggtgggcagatcatctgagcttaggagtttgggaccaacctggccaacatggtgaaaccccatctctattaaaactacaaatattagctggcattggtggtgggtgtctgtaatcccagctactcaggaggctgaggcaggagaatcacttgaacctggcaggcgaaggttgtagtgagcagagatcatgccactgcactgtgcagtttgagactgtctcaaaacaaaacataaaacagtttatcctttttggtactaacaatccaagtacactcttttagttatttttaaatataaaattactactgagtatagtaatcaaataatatgtatgtctttttctttctttttttctttaaactcatcaaccatccctactttcccctctttcagccctggtaactatccttctactgtctatgtacatgagttcaattgttttgacttttagatcccactaataagtgagaatatatgatgtctgtttttctgtgcctgggtaatttcagttaacataataatctccagttccatctttgtcattgcaaatgagaggatctcatcctctgctatgtaatctgcggacggtatttcaaacgcacttagaacagtgcttgggcatcatcaacgccatataagtgctgctgtggtcattgtgttagaaaagtgcccggtaaattatgctctatgaatgcgaggtctgtggattgctcccaagagcgtgaagacccacaaatgtacatgagaggtgggagcatttgagatcatagatgagtttataggatagaaagaagattgcaggtaatataaaaatcagtggaagagtggtgagaaatgattagggaatttaggtgacatttttaaaaaaaatgcatttggtgaaagaaagcaaagaaactctgccacaactcagaatgcagctgacaggccgtctaaggaaatgtcgtggctaacagcagcaggggacgcacctgtgcagagctccctgtgcccagacctgagctctccacaccttcctgaatgctggcagcacctgaggaagggagcaatggatggggctatttatatttggcacataagaaaaccattgctgacaaataacttgcccaagctgacacagcggctgtagagtagagatttaaacacaggttgttttccagaaccctacttcataacttctaagatagagtagaaaatatttgcattccccgtctttactaaaaatacaaaaattagcttgtaagcccagctactcaggaggctgaggagggagaatcgcttgaacccaggaggcagaggttgcagtgagccgaggtcgtgccattgcactccagccggggtgacagagcgagactccgtcacacacacacaaaaggaaacatttgcattgactggggcatgtcctgacacagattaaaacgtgatgtggcttcccactgtatttaagaaaatggtcaagtccagaagtccaggttgggtgcagtggctcacgcctgtaatcccaacactttgggagtccaaggcgggcggatcacttgaggtcaggagtttgaccagtctggccaacatggtgaaaccccatctctattaaaacaaaaaaaaattagctgggcttggtggcacgtgtctgtaatcacagccagttgggagcctgaggcaggacagttgcttgaacccgggaggcagaggttgcagtgtgctgagatcatgctgttacactccagccttggatgacagagcgagattccgtctcaaaaaataaaaaaaggctaagtccttaacatggattacagagccctgcagtttctgagcttatcatccatctgtcccttcataccctatatccccaattccctggagctctttctgtgtctcagacacgagctaccctctgtgtctcaccaggtcggatccctgtgttataggtaacttaaggtctgtaactctgctaaactacaggctccacatggacaagagaccaggtcaggtttttccttttcctcggtgtttatataatgcctgatacttggcagttatttcaaagaaatgaggtgaaccgagtaaattccacaccatattcaggaccaatctctattttgccaaatcatgcatcataattgaggtcgtagccaacggcattaagaatgcttacagtccattgtggagtttgcacccatggccgcccctttggcatcaagctctgactccagctgtgatcacctgccatcctcaagctgccatctgacccctgcccctccacgacctctcagagcatagcttccccttggatggaggggggtgaggagagcagtcagaggtgaaggctaaagaatgtggagggtattgagtgcaccccagcccctgacatttcagcttgttatgtggctgtggtagtaagcatttggaatcagctctatcaattatttaagtctcataattcagtccatagtaaagatttattgcaacaaactgaaaaacaaagtacagacgcaaaggaaacagaacatggattctgctgtgttacacggtacataaacttctcatgtccgtgggagtaacataaaaggaagtaggttatttttaaaatactggagtgtttctgaaagagataattcagctctgagtttctgtgtgtgtacatgtgtatatacgtgtgtatgtgtctataatatatgtgtgtatgtgtatgatacatgtgtatgtgtccatatatataatacgtgtatgcacatgcatctgtgtgtatgcatgtgcgtgtctgtataacgtgcatgtgtataatacatgtgtgtatgtgtgtgcatgtgtatgtgtaatatattacacacatgtacacgtgtataatacgtgtgtgcatctcgtatgtgtttgtgcatatgtgtatatgtgtgtatgtgtgtatatgtgtataatacattgtgtatgtgtatgatgtgtgtatgtgtgcatatatataatgcgtgtatgcatgcgcgtctctgtgtgtgtgtataatgtgtgtatgcatgtgtatgtataatacatgtattacacacatgtacacgtgtataatgtgtgtacatctgtgtatacgtgtttatgcatatgtgtatatgtgtgtatggacacacgtgtatgtaacatgtgtatgtgtgtgtataatatgtgtgtgagtgcatatgtgtgtatatgtgtgtgtatgtgtggatgcgtgtccatgtgtatgtttgcgtgcatgtgtgtataacgtgtgcatgtatgtgtgtataatacatatgtgtatgcatgtgtatgtttcagggtttccttgcattccattttctatttagcatcaggcattttcttcttccctaggcattaaggccctcttggctcaaaattttcatgaagcatggatacattacaatttttacatttttagttggttgtttacggccattggttggtctgtcaagagcaccgagtcatctgcttactataccatcttgagtggaaaggaatgagtttatatttagagacacctggatgtagattacaactccatctctcaccatctgtgagattttgagcacagctccagaatgctgtcagccttagttttctcatctttgaaatgggaagaataaacgtccatacctcctcaagcaagtgtcaattggaattatctctacagattttctcgcccatggaggcttcatgcatgatggtttcatcttgtgctgtccctcaacatttacatgaatgaagtacatcatacttacatatttgaagtatggacaccttttcattgcaagaggaaagcaaaagcaggcaggagcatttcgttagtaaataatagtagggccatgtccaggtgtgaagttaacaatgagagagatttttttgcccatgttctgaccataaccatttgaactatgtttagtcttaatagctgggtggccttggacaaggttaatttgcctttctgtgcttctgtttccttatttataacaggaggatgctcatagcatcaacttctagggttgtcgggaggattaaatgagttaatactcataaaatgcttagaacagttcctggcacatgaaacaaaggtttatttgagtttttctttagttattgctggtggtggtggtggtggtattgttcatgttcttatgctgagcctgtgtggtgaattggaatgtatctgtgaataattcacttgctatttaagcacgttcaaacatcccatcataatattcaaagtcaatatgtgtatttctctgtagttcatccacgaatatcctgttccaagttgccatcatctccccctggagctaccacaaaatcctttagggatccttctgtaacctctatccatgctcccatcaaggaaaaagattttgaaacatctaatcatgctaccactatctgctctcccacttaaaactgtttattgatttcccgttgctcttaggatgaaagcaaacacgattgcatggccttggatggtctggccctgcccttctctcaacactcatctgcttctccccttactcattatttcagagcctttttagtcttttccagttttagcaatgtgctgagtgtcacagcagatgctattccctctgcctggaattctacccttcttgacctcgtcccaccaacatcactattcattcttctggtctcagaatctgtattgctttctccatgatgccgttcctatctttcgtctaaactgggatcttctgtctacgtgtaagaccctctcctcttccttcacagcacacaatgccattcctaatattccacttaacatgttatggttgttgagtgtttgtctttgtgtgagctccatgaatgcagggagctacatatgtcttgtgaactgctagatccccagcattttgcacatggtaaatgctaatgaaaacatttgtagaaggtgtgaatgccatttaagatgttcccataacgttcattagaactagaaagacttcctgatatccctcccattcaccgacattatgtataccgggtgctgtgttcacagcttggccactggatacttctcagttgtgcctctcaccctgtattgtaaatttcctatcgacaggctttgtgtttcctgttagactgtctctttcatgtctcccatcctagtgtctaacataggtattcaataaatatatacagaaggaagataagaagaaagagaggaaagatcagacttcattccagtgaggacagaattgcttgttcatctcttctgtctaagcccatccctctccgtgggctcattttagcaacacggcaagtcaacagaagtttcaacctggaaatgtcccacctagcaaggccaggggtgcaaaatcaaagtgaacaggacgttcctactacctttggggaagacaataacacagagtccaagaggtcaaagggtgcctggcctatgtctgcccctacgactcttccttagcccatgactctcgacctggaatgacagcaagttcatgtctagttaagcaaatccagagaagatttttgtttatgtagtggaatgttcaactcctcaattatgctgtgagaggctgagggggaaaaatagacatttttgcaaaatctgtttctggtaaccttcaacaaactaaaacagttgagcatacagaattttctgttgtttctgcagagataatttgttacatggaagctcatttgcttatttgaagtaaatactgcttcagacccagtagagattaacactcatagatgagatggattgagaaggaagagacataatacttcactgttatatttactgtgttaaatataaagtgggaattgatgaaaaatgttctggagttccccatgtgagcctaagtgatgaactggggtttatttgccatctggcttttaagcagggattttttttcatgtcagaaaaatggcaccttcagaaatattgcgttacagacatctgtttatcagaactttgcctgaatgaattattcagaatgtgcttaaggttgcactttacctgacatatggaaatataaagttgcatacttgatgtcggcatatatttgtctacataaaatcaggtgtcttacttgaaaccaggagtgctggaacttggtaggtggtgcttttcgtacctgggatattcattgttctacctcatgtggttcttgatgtcttcattttttggaaatcattgtgtggaattacatgtaactcacagtttctgtattgaagccccgtttttgtttccactgtgttccttacaactgaaatggaaagctactcttacttgatatgggtttcatggcaaaactctgttagtaatttcaagttggtgaaacaagtgaatatctggagctatcaagaggaaagtcttccaggccatactcagaagacccaagaggaaaaggtggttttgccaggtgcaaaaccatgcttgtaatcctagcactttgagaggcagggtggggagaatcacttgagggcaggagttcaagaccagcctaaccaacatggtaatgccctgtcactactaaaaatacaaaaattggccaagtatggtggcacacacctgtaatcccagctattcaggaggctcagaaaggagaattgcttgaacccaggaggcagaggctgtagtgagctgagattgtgccactgcactccggtcagggtgacaagtcaagactccatgtagagaacaggaagaagtggtttccatacacatcaagttttaaaggaacccttcaactcatcatgtcatcagaaccaaataaagctttaacattatccatgattgtacactgttttccatctgttcatttatttatttatagattgtttcatcagacattgactaagctcctactttaggccaagtattgaagatgtagattctactctttacttgttcggggcttacaagggagcagagaagatggacataaacaaaatagttacacatcagtcaccatgattgatgtgtaacttcaaatgagatgactgctcctgtgaagtgaaacaaggttttgtgagcatctgttggagcaacctgactcaggacttcaagggaaacttcttggaggacgcgattctgaagccatcataagtgacttcacttgttgaagaaggggaggagcctttcagatggcaggacagccatatacaaagatctgggggctagagagctcatgcagcattgcacaagctatttagaggccattgtagctgccgccaggggagctcatatggccaggagggctgaccgttcctagagaggtcagcagcccttacagcctggagtaaggaaggcggtgcttataaagcaagaatgatgggaaaccattgcacagattctaacatagaggccagttctgcgctccaattaaaattgacgaaagatccgtgaagtctgccatcattgcttatctgtctttgaattctctagtgtctagtgttcagcaagtgctggtaaaataaatacatgatgtgggggaagcacttcaataggatgtgagctcggagtgagttccagaaaggtgccccgcaatcacttatcccagaaactggtggggaggtttcagtcaacctgtataaatgctcctggggactgtcctttggataagcaggtgttctctttacctaaaaagagatgcctttcagaaagtctttaagggcagcagagcaagcactgggagggactaataggacctcaaaagaaagaggtgagaggcagagggctgagggcctttcggagctgccgctgcttagccagaggagggaagcaattgcatccccaacaggcgggctgtaaagggaatgcacgtcattacttggaaagggtggtgaagctgggagcaaacagcttctagatcaagctgccagggaggatgtttagtaattaaaggaggctggcaccatttggaggtacaaatctgcaaatccaaggttcacatcccagggagtgaccacgtggtcacaaaacacagcctacaaatgcccccacctgaggtcatacagagataagctacccccatgggggctgtgcgggtacagcaagtcggatgctcttattcaccacccctatacctaatagtgcagttcgttctcagatcatttttaaaggagaaatgaaagctctgtgtctgtgtgtgtatgtaaacaccatcttaacacattgcatgcacttttgatgcacatgtgtgttctaaactgtcatttgcagggacttctgttgttgaacctgttctctgtgaggcacgagtggtaggcttatgaaacccatccatctttaggccaggtgggctggctcatgcctgtaatcccagcaccttggaaggcccaggtgggaggataagttgaggtcaggagtttgagaccagtctggccaacatggtgaatcctcctgtccactgaaagtacaaaaatgagctaggtgtggtggtgggtgcctgtaatcccagctactcgggaggccgaggcaggagaattgtttgaacccaggaggcagatgttgcagtgagctgagatcatgccattgcactccagcctgggtgacagagtgagactctctctaaaaaaaaaaaaaaaaaaaaaaaaaaaaagaagaagaagaaagaaaaattcatacatcttgtacctgaggactgtttggggaagcagctgctttttcccgtcagtttctccttggttttctctactcacagggaccctcgccttgcacctgctgggaaggccagttcacctgcccgggctacttgtgttacacaaagctggaggagaatgaagtcaaagtggctgattttgttagagaagaattgttttgttctgcgttgggtgaagtttctctctattacacttttctacaaattcccctgttcccaattccctcagacaacaaaactacaatttgctgggtaaacaaaagcagtggggatgaagcctccctggcagccagtctgtcagaggtgctgtgcttgttagcatggtaaaagagttagaggaatttttcaagttgtacaaaattgaattacttaataaacttcgtttaactttcttccctgggagtcagtgttgttaaaaaatccaaaaagactgttttgcagcattagcattttacagttggtcagggttttcaaatcctttattctttatccattttttttctcaataacacttgttccttagccctttcttcctagctaacagtctctgtaactgtttaaaaaaaaaattaaaaaaaagaatggctggcctcagtaggtcattcctgtaatcctagaactttgggaggcagaggcaggtggatcccctgaggttgggagttcgagactcccaggccaacaaggcaaaaccccacctctactaaaaatacaaaaattaactgagcatggtggcacactcctataatcccagctacttgggagtctgaggcaggagaatggcttgaacccgggaggcataggttgcagtgagccaagctgatgccactgcactctagcctaggggacagagttagactccatctcaaaaaaaaaaaaaagtgtagatgtttggttaccccttcaaatcatctagctagtaggttggactttgtgtttattccaattttccccgtttagcaacattgcccccaccatcaccaccaaaaggggaaaaaaagacagtgggttaatcatccctgttagaaagaatttctctccaatgcctgaggcaagtttgcatgccatggatggaaatggtattttcaagagacagactgagccggtcctgcctaggaaacctgctgccttggcacggtggtattagtggctgagggctgtatgtttattccctggccctctgctgatccctggaagcaaagtgagtgtccacaggctttctctgtagtgacattgacttccttctgcccttgtgtttccaaggtgagctttgttaggtgccaggctgcagggtccttctgcagcattctgaagaaatcctctgccttcctctggttgggcagaatgcccagtagaatcaggaacagtgagctcatctccacctgatactttgtcttcgatggaacgctttgctttatcattaaaaaaaaattataatgcctcacttagggctgcaaacagtgttgatgtattcaatagcgcattagagaaaacgtcgaagcagatttgtagaaggtgcccatcctatgggcaaccccaaaaagcaatttattacccccccccaaaatatacattgtcatgtggagcggaaggattaaatatttatgtctgttggctggggtaataaaattgtattcaattgtgtctcaggcactacctaatgattgttgaaaactcggtaataacaccgaaactcataaaaaatacaggataaacaatgctggaagaaaattatgggaaaatagcctctggcctgtggaaatgcgactttattttgaaataatttgaaataagagtgtatgcattaaaaaaaagtgagtttatataaccgcaatctaatctctagaaacttttctttatggttttgttctttgtcaagttaaaaacaaggggtacatcagtagtgtttccagtaaatcctgataggtttggatttccttgaggacaggaacagcgttttcttcatctctgaactcttgggacttaaaaagagcctagttcagagcagactgggtgctccataaatatttgcagaactattttttttttttttttgagacagagtcttgctctgttgctgaggctggagtacagtggtgaaatttcagctcactgcaacctctacctcctgggttcaagcaattctcctgcctcagcctcctgagtagctgagattacaggcacctgccaccccacctggttaattttttgtatttttagtagagatggggtttcaccatgttggccaggctggtcttgaactcctgaccttaagtgatcagcccacctcagcttcccaaagtgctaggattacaggcatgagccaccgcacccagcttgcagaactaaatttaaaacataataattgtttatgatctccatgtcatctccgtattccaaggattctcaaccagagtgatttttgttccccagtaggcatttcacaatatctgtagacatttctgtgttttacaacttggcaggggagtatgtcctcctggcatctgtagggcaggggccagggatgttgttaaatatcctacagtgcgcaggatggcccccgaagcaaagcgtttgtagtgctgacagtgagagtcatctttaccgatgtgcctccttcagtattcccagtgcccagagcttcactcagagaaacagtgtatcgagctgtccttgagagaatggcggtatccatgtattggttttctagggcttctttaagaaagaactaaagacttggtggtttcaataacaggaattgatcgtcttgtgttctgaaggctagaagtgtgagatcaagatgccagcaggggtggttccttctgaaaactgggagagagaatcggtcctatgcctctctcttagcttctgtttttgtttgtatgtttgtttgtttctgtttttgatggagtctcactctggttgcccaggctggattgcagtggcacgatcttggctcactgcagcctctgcctcctgggttcaagcaattctcctggctcagcctcctgagtagctgggattacaggcatgcaccaccatgcttggcttatttttttgcattttttagtagagatagggtttcaccattttggccaggctggtctcaaactcctgacctcaggtgaaccacccgcctcggcctcccaaagtgctgggattacaggcatgagcccccatgcccggccagcttctgtggttggctggcagtcatgggtgctccttgcttgtagatatgtcacctgaatctccacctgcatgtttacatagagttctccccgtgagcatggatgtctctgtgtctctattttcccttttagtgaggacatggtcatattggattagggcctatccaaatcatctttacttgatcttctgcagagaccccatttccaataaggtcacattcacagctactgggggttaggacatccacatgttttggagggaaacaattcagctcctaacaatctacttctctgcatccctacatccgtgcagttcagattattacctctgctcagcattgtgttgcctgagatctggcatttcatcttctctcctccagcctttcgggtgtcctctcctgcggctctgggcaggcctgcacccccagcctctgaccatggcttgggcctgtcttgttcatccaagttactctgcctttgcacccttctaaccccgatgtgtgtctgtctgcctgccttctctttcctcccaggaacctttgacttttccactgatacctctggcctctggtgtgacctcttctagactttctccccagcatgcccaatcctctaggaaggtatttccgggttatagctgacaactcacttatcaggttcacctcccaaactacttttcagagtgccaagcatgtcttatccatgtgcctggcacagtgctgaacccccgtgatttaggtggaaatggttaatgaatcctatcctatttcttccagaatatggccctctaattatccatgcagggtccagttgggatgacgagggcaggctccagggtcagaatgccttgtcctcaatccttgttcacctcattgactcactgtgcaatctgggaccaagtgcttactgtctctctgcccagttacctcattgataaatggaggtgaggttgtgccagcctcacaaggctattgtggggactaaattagtttatataataattttgaacaatgctaggcacatcctaagcattcatgactgcagctgctaggataatttggcataatctgtgcttccccccaacacgctctctctgggggctccgttcttctgcttctgaacatgcttagacttccatttctgtaggaggttcttattgttgctataactaaatgatcaccaatttaggtgtaatttaaaacaacacaaatgtattttcttgcagttctggaggtcagaagtccaaaatgggtcttgctggagtaaaatcaaacgtcaacagtgttgcatttcttctggaggttctttgggagaatgtagtttcctccctttgccggtttctagaggccacccagattacatggctcatggcccttttcatcttcaaagccagcattgtggccttcagactccagccctggcttccagcatcacatacctccttctctggtcttcctcttgtaaggaactttgtgattactttgggtccacctggataatcctggcaactcttccatttcaagatcctttattacatctgccaaggttcttttgccaggcaaggtgacgtattcacacctttcagagattacgatgcaggcatctttggcatgagacaagattctgtctatcacactctctaaaggcgttccacctgtgtgatggctttatctccagcaaacatgcattcatattcaggctcagctacctagaagcgagggacatgtaatctccccaagcctgttctctcttttacaaaatcagacaaagaaattatcaagtgaggatagagaagtcggaatcctatgtgcctaacacgtggtacatgcatgctaagtcgtggcagtcacaatgactgttgttggtttcactttttttggtgttattttctcccgagtgtggttcttcccttattacctgcagccatcggtcttctgttgatctaaagcaaggtgtgcagttgggggtgtctgctcggaccaccctcgtgtgactgaatttgcctgcatatcggttcctttgctaattctgttcgggcaggatttgcttttttttgcttagcaaacttcatgagccatttctgatttccaatattgctcctcaggcagatctctcttgaaaggtgttgtttgtttggtttgtttacctcttgttcattactcttacctctacaggctacaagtctcctaggaagggatattgtgcctgtacgtcccaccctggaccacggaaaaccttggtagcgtgcaaagagattgggcattctagcggggctttgatggaactctaggaagtagaaaaagcagactcaagcagaaaatgggaaaagagaaatcctaagaggagtctcatgagatgattacttcacatttgcagttcaggcattttctccatacttccagaatcgtgtagggagttgggcacagagaatctttttaggggcaaagaaagtgagtgtcttttccactccccgtctccacacccatcttcctatttcccttccacacacacaaagaggagagctttaactttatctcaggaattctgtccccaggttcaatgctggagtaaaatcaaggacttggctctgtgcctgagtgggtgattccccacttgtgttaatcactcaaacaacctacatgcttttccttgtagttctggaggtcagaagtccaaaacggcccctattggggtaaaatcaaagcctcagcagggctgcatttcttccggaggttttatgggagaaggcagtttcccatctttgtcagtttctagaggccacctggattacgaggctcgtggcccttctcagcttcaaagccagcagtgtgactctaaagcaacatcatttcctaaagtagcggagaggaggcctgggaagattacacagcaaaaccatcagatcctacgtctgagaatgagaaggttgtttccttttcagttgactggtatatctaagcttatatccagaagaatgcctccatttcatgctggtctttatacctttgccttccttgctaatctctgttagtaaagaggaaggagggtcaggtgcagaggctcacacctgtaatcccagcactttgggaggccgagacaggcggatcacttgaggtcaggagtttgagataagcctggtcaacgtggtgaaaccccgtctctaccaaaaatacaaaaattagccgagcgtggtggcaggcacctgtaatcccagctactcgggaggctgaggcaggacaatcgctggaacctgggaagtggaagttggagtgagccgataatcgcaccattgcactccaacctgggcaacaagagtaaaattgtgtctcaaaaaaaaaaaaaaaagcaaactgaagacttgaaccttgggtagtgcgttagtttcccaggactgctataacaaagttccacaaactaggaggcttcggcaacagaaatgttttgccttacacttgtggaggccagaagtccaagatcaaggtgtcaggagggttggtttcttctaagggctgggaggaggaatctgttccatgcccctccctgtggttgctggcaacgcatggtgctgcttgggttttaactctgtcagtgtgatctctgccttcacctgcatgtgttctccccataagcatgtctgtctccctgtccaaatttcccctttttatgatgacatcagtcatattgaactatgacccataatgacttaattttgttacctctgtaaagaccctgcttccaaatcacgtctcacagatcctaaggggttgggcttcaacatcttttggtgggaacaaagttcaatccatagcagacaggcaattctttttacctgctatttaataacacttttatttgtattgtgtttattttaccatgcatacctacagcaaataattttgtttccacttatagaagagatctattttttcttctttttcagtaaatgaatttactttttaaaaatctcagtaaagtgattttaagaaaagacgttaactatatcatagtacaggtggtcttcagatgtggccaaatatagaagacacagtgtaagatttgggcaatacttggttcaccaatcctttgaggcttgggagtagaaagaacaagaataaagatgttaagtagagtaagatgcattcttcaaagattcctttttgtggaccatttctttgagagagaagttttcttcctgtgaataaatatgctgttgctttttttagctctatcatttatacttactagtatttcagaactttacgtttgagttctattttcatgccataaagaatgaggtaaataatctgaaacttaaattcccacgtggagtaatttctctaatgtggagtttctcaaacttgagggtacgtcagaagcacctgctggcattgttaaaatgaaggttgctgtgctcagccccagattttctgactgaatagctctggggtggagctctgtaatttacacttctagcaagttcccaggtgatgtggatctcggagtggggacggtacattttgcgaaccacggggctactgaaatgaggtgtctgttctctgtgagtaaagatttttcaggatcctttccagccctgcggctcagatagatcagattgaagtattctgggtgggctaagataactaaactaaagaccttctgagatttaggtttaaattcttttctctttgtttcttttactttttctttcttgctttcttgctttcttttcttgtgtgtgtgtgttattactattttttttttttgcaaggtctcactgtgtcatccaggctggagtacagtggcatgatcatagctcactgtagcgccccaacctcctgggctcaagcaagcctactacctcagcctactgagtagctgggactataggcacatgccaccacacgtgcccgcctaatttttttttttaagacagactttgtcccactgtgttgcccaggctagactcaaactcctgagctcaagtgatcctcttgccttgacctcccaaagtgctgggattacaggcatgagccaccaagcccagcctagagctccttgtttttggtcctcaggggatcttgggcaatatctcacctcatctggctgttacccaacactgtgctttatattctacttcctatttctgctgggtgaggatgggcttctgatgggtggaaaagaacttggaaagggccccaggcaggaaaaccattatggaagcaacgtctgtccacccaccaggccgctgggaggctgaagaagacacgtttttttgttttgttttgtttttttgtttttcctgtgggttacttgaaaaacatttttttaaatgcaaaaacagggtatcggaaattattatctgtccacctatttaactgttataaagtagcacttttaattcatttccataattacagcctgtgtcatgctgttcaaaagattcaactggggataaggagaatggtcccattttaacccccttatgagcgtgttagctcaggccaagagcagctgctgtctcttccggcaagccacggcattgtttgagaacatctttcctctcatatcccccaccagaccctgagcatgttgccatcggccttcttcacacccccacaaccctcggccccatcatctgcagtgcccgatgcccagcactgagcccagtgcctggtgttcagggtgtcttttgaaggagaagttataagtcggtagcatccccaagcttttcccagagcaactcaagccctgaggccaccagattgtttgggcagcaagttggtctcctagaagcccttggtagacctggctccttgcctagctgggccaggctctgtcctcccctgcgtaccctcctagccaagcgtctgggcagccagcggttaagtccactgtgggaagctattgagtctgaaacacacagtgacagcaggcatgctaaactacttcccagccctgcatgtggcgtaattgtattttcagggagggccaatctattagcaaggtgccagtctcaactgtgtaacttttataaagcaaacactaaaggcctcttggggtgaaggatattataattatggatgatttatactccccacctcatgtatacattgcacttgatgagaatgttctacttgacgtagccagaaacattaagcaaaaaatagtgttgcattctgggttagaaacccatcttttgttttatgtctaatctatccagtgctaaaacatttggaatgatacctctgcatgctgctgtgaaggaaatacgaacataatgagtgcatttctgatttcagaccagatcatcatttccttctaaaatacctcactgagtttagcatatttattccttggtggaatgtttgctgtgtattgcagtacgaaagcaaaagaaaataatcattataattataatttccgggctaggagggaccttagtgatatatctagtccggggtgtctgggcttaaattacagggtcggctgataagtattctacttttcatgattcagaatctacaagttaaaagaggaagagagaagagaaaagacagtagtaaaggaggtacttttgcattaataagaacacagacctaggtgtctcacctccacctcctacctgagccacctttgataagtgagaatctctctggacatcagttttcagctccagaagaaaacaaaaataaaaaaaaaaacccaaaacagggatcaaggccaggagcagtggctcacgcctctaatcgcagcactttgggaggctgaggcaggaggattgcttgaggccacgagttcaagatcagcctggccaacatagcaagatcccatctgtaccaataagctgaaaattaacctggcatggtggtgtgcacctgtagtcccagctactttgaaggctgaagcaaggaggcagaaacaacaagatcgctgaagcccaggagttcaaggctgcactgagccaagatcgcaacattgtgttccaagctgggcaacagagcaagaccctctcaaaaacaaaacacagatggataggtttgagacagccctcactcacataacttttagagaagtaaatcggatagtgcctgcgtactattattattacagcactattgccaggcagcaagcaggcccagggtggtgtaagtcggctttgctcatccgtagatgaaggatgcagaacattcctcagttgactaatgtgtgaactgcacactgagaactggcctgcggtcctccagctaatcagtggcggagccatgctctccagactcggggtcaaggcactggggctgagctgctgctttccccaggctcccggagacccactcccttgttctcctagcagctggatgaagcctgtggtcctcagcatttctactaattccctccaagaagggcctgggattgtttccattctctgtgttgcggactagggagctaactgcggttcctttctgcagggaggaagcttgctctacagattagaaaggaaacacgcagcttcccaagcatgtcacttctgaactgtttaataaatccacgtagcccgttttcttatttccttgataacttttcaaaaattattccttaaacaaatgacttcctactatagcctaaatctaaaatctaaacaataactattttttctaagtcctcacccccacaccccccttttttttttttttttttgacacagtgtcttgctctgtcacccaggctggagtgcagtgccatgatctcaggtcactgcaacctctgcctctcgggttcaagtgatcctcctgcctcagccttcagagtagctgtgagtacaggtgcgcaccaccatgcctgactaaatttttctactttttgtagagacagggttttgccatgttgcccatgctgccctcaagcacctgtactcaggtgatctgcctgccctggcctcgcaaagtcctgtaattagaggtgtgagccgctatgcccagccttcattcctttttatagttgaataattctcctgaagtggacatgttccgtgaaagggccgtatttgcaaagtggtccccaaatgctgaagttgctgagaaaccaaagtacaaggcagaaaaatccagtttgacattaaaagctgttttactgggaaaacttaaagacagctgtcttgactggcaggaagacagagctccacactgctactccccagacccagggcttatataccttagggaaagggcataagcgctgtgtacaagacaactgaaggcaaccctccaggagaggcaagaatgatcaaagttgacacgttgttatgctaaggactggaaataaagtaggaatcaggaggcattcacggagctgggactgatcagaagtcaatatggcagattagcatccaagatggagtcactgttgtttccacaggataccatagtttgttcatccgttgatggacagttgggttgtttttacctttttgctattatggctaatgctgctttggacctctgtgcatggggtttggatgtaggttttcatttctcttgaatatatccctaggtgtggaattgctgggtaatgtggtctaatacacctttggttaacgaaataaatagcattttagttgtttttttttttttaattgtcattctacgaccatctccaggaccattagtggcacagataccacagtttaagaaatcccataaatcatcgtgacctacacacttgtaaggccttccatcttgcaacgctattggccgttctggcttgtgtttttctggatggtcatcacgaccttcccaggtcgtccttttacctctcattggccgcagttatgcccattcctacttaaaaactcttgcataagctcggattacttccagcttttttctaccacccacttaaacttttcccatctttgaaggctgagttcaaacttcgaagtttgaatttgtaccttgatcttgtttttttatttgtttgtttttgtttttttgtgtgtataagatggagtctctctctgttgcccaggctagagtgcagtgacataatctcggctcactgcaacctccaccttccaggttcaagcggttttcctgcctcagcctcccaagtaggtaggattacacatgcatgccatcacatcaggctaattttgtatttttagtagagatgggtttcaccatgttgttggacaggctagtcctgaactcatgatctgaggttatccacctgccttggcctcccagagtgctggggttacaggtgtgagccactgtacccagcctgcaaatgattttgtccacagagcagactgagtttctgttcttaatttgtatttaaaatagaaaatctcagtggccaccttggtccccgctctcactgcaaagagtctgtcccagctactgttagggactcatttgtaaccaaacactgaacagaggatgtcacagttagtgactaatcccatctggtgaaatcagtatatgggattgcacatgaaatgaagagtttctgaacttgagtgtagctctatatcttataaagaaatctacaagtgcttttgtccttgatgtgtttcatttggggaatacatccatttctgtctccgccttctttaaacctgaaaggaagagagttggtagaaacactctgtccaaaggaagatcaatgctaacaatgttcatttttctaagtgtctccttcttctgaaataaaagttaggaagctctgacaccggctcccttcctgccttctacaccgaagtgggagttaagatgttccagataccatttgctgttttgaaggagggtctgtgtgctgtgtgatgagtagactcttcccctttgcttcgatgggaacctcggcattccaagtggacatatttcatatcctcagggcttgttctcctcctctgtggatctcagtagcagaccttcagctgcctcttagagaacagggccctgggggagacatcatcctttgtcagaaatcctggaaaaataccaagaaactgacacaagtcgaaagagggacaatggagacctgggtattatccctttagggtgttcttactcaacctaagtctcagggtagcctacaggagagccacttacgaatttgttaaaaatgtacatttgtggccaggtacattagctcacgcctgtaatcccagcactttgggaggtcgaggcgggtggatcgcttgaggtcaggagttcgagaccagcctggacaacatggtgaaacccctgtctctactaaaaatgcagaaattagctgggtatgctagcctgtagtcccagctactagagaagctgaggcaggagaatcacttgaacctgggaggtggaggttgcagtgagctgagattgtaccattgcaatccagcctgggtgacagagcaagactccatctcaaaaaaaaaaaaaaaggaaacacacatttggggactccaccccaggcctaccgaatcagaccactgggcttggtgccattgtttatgaatttttaacaagctacccgggtgattctggggcccactaatatttttgaactgtagctataggaagacttcatacatgcagagtaaaaccatcttaaatccaatcaaattaattgttaattaaattaatgtctgcctgggccctaattcataactttcatgttgcaattccctcctgatatccagaggcatcatttaaagaataagtaaccagggacataaaaatgaattatttatcttacccaaatctcatacccttctcagtgaaaatgtggttgcttgtcactgagtgtcctacccaatgggcatatctctggtcgtttcagagaaagaaatcattctctgccttccgaatgcagacaacatgaagcggcagtctcacgttgatattatggttaattaatcttgggcataggagtatgcaggagcattgagcagaagcgcactcgttaataaacaagtattttcagtgcaacacattgcaggcttggcccttacctgatgtaacagatggaggagaaagtgggggtggggaggaaagtggctgtgatctagttacgcagggtcctatttcaaacaccatttctccatttaataacaacagctaatgatttttgtttgtttgtttttgaggcagagtgttgctcattcatccaggctggagtgcacaggtaggatctcagctcactgcaacctccgttcttgggtttaagccattctcctgtctcagcctactgagtagctgggattacaggcacctgccatcgtgcctggctagttttttgtattgtttttttggagatggggtttcaccatgttggccaggctggtcttgaactcctgacctcaggtgatccgcccgcctcagcttcccaaagtgctgggctgggattacaggtgtgagccatggcgcctggcccaagaggtaatgtttcttgaccaattcctatttatcctgtttacatgtattaatttctccaaattaattcctcacaacagcccagcagtttaggttctcttattagctccattttatagaccaaaaaataaaataaagctcccccaaactggaacatagagggtttttttttttaagtaaacttctcagcatcacacactaataaagagtagacctgggatttgaaccatgaaatcccaagagagatccagaacctactctcttagacatttctccacttcctatggcttgaaatttgttttaaaggaaaccctggtatcttcgaacaagtatctggaaattccgtcctttttgttgatggagagataaaaatccagattgaatccagatccataagacattgtcatcagcactgatatattgtatgttatagataaggagaaaaatttccaggaggctgagtgacctggctaagatcattctttttttttttttttttcattattattatttcaatagttctgggagaacaagtggtttttgttaaatggttaagttgctgagtggtgatttctgagattttggtgcacccatcacctgagcagtgtacactgtacccagtgtgtcatcttttatcctttaccccctcccacttttcccctctgagtccccaaagtccattacatcattcttgcccctttgcatcctcaaagcttagctctcccttataagacggaaaatatgatatttgtttttccgttcctgagttacttcacttagaataatggcatccaactccatccaagttgctgcataggccattattttgttccattttatggctgagtcatattctatggtgtaggtgtattttctttatccactcattggttgatgggcattgagtttggttccttatttttgcaattgcaaattgtgctgctataaacatgggtatgcacatgtgtttttttatatgacttctttcctttggtagatatccagtagtgggattgctggatcaaacggtagttctgctcttaatgaagttcactcctgatattgtcatgatacaatctctctcttctgcatgaaaccagagtcctttctactgtttctcttgcttcctcagcttataaatggcttgtttaagttgatacgaaaaagttagatgtgtcctagacattaagggagcaccgagtccacagaggctcttgtaattgccaagggctaccataacaaatgaccagctagtggcaggcttgaaacaacagaaatttattccattactgtttggggaattagaagtctgaaatcaagatgtggagatattagctccttctggaagctttgagggagaatacatttcatacctcttccctagtttcttttggttccaagcaatcattggcaccccttggcttgtggctgcatcactccagtctttacttcatctgcagtgggctttccctctgtctctgtgtgtgtcttctcctcctcttaggagaacatccaccctgaatccaggatgattccatcttgagatccttaacttagttacaccacctgcaaaagctttatttccaaatagggtcacattcactgatatcagggattaggacttggacataggtttttgcaggacactatctggctagtctgtaatgactatcagagaatggattctatagttactggataagtttgcccttgtttgactggaacacagtatctcaagtggttgtggtgaagcccacagactatggggctcagcaggtgttggtttgagctcctgcaccattcgttagctttgtgaccattgataagtttcctaaactcccccaggctgccatctcttcatttaggaaatggtgatattcatcttaactaaatgcatgagttttctattctgtgttacaaattacccacacacatttagcaatttaaaacagcacacatttgttttctcacaatgtctatgggttaaaattttgatacaatttagctgtgtcctttgttcatgctctcacatgactccagtgaacctgtcaggtgggttgtgttcacatttggaggctcaaatggggatggatatgcttcgaagatcacccaggttgttggcacaatttatttcctgtgaccgtaagtctgagattggtggattcttgctgactgttggccataaaccatgtttaccttccagaggctgcattcagctttctgaggtcacccatagttccttcctacatggcctttgccataggtcctctcataacatggcagcttgcttcttcaagcagtggagaaagaataatttatgtatatacataaattactgtatatatatatatatatatatttttttttttcttagggttgctttcaatcaatagacagtatggcaggcagaggtgatggaaagttataccgtgataatgttcatatatatgagcatatgtatgtgtgtgtgtatatatatgaagatgtatgttgtatatgcacacacacatgaacataatcaccatgtaactttccatcacttctgctgcattctgttggttggaagcaagtcccaggtctacccataatgaagaggaggagattatgcaagggtgagaacacaggaagtcagggatcattggcagtcaccttagcttctgcacaccactgaaatattgtatgaattagaatatacacagaactagcacaatgcctaacaccttgtggctatttaatgtatataactgctgttaccaactggcagctggtattactattcaggttaatcactgcccagattttagcatctacaactttcttcacacaggctgttccctgtgcaacttcaggagcaccttacacacaggggaggatgtgaaatggatcctggggggtaggtgcaattcagtggttcttgctacaatggagaggtctgaggcattggcatcgatctcagaaagacctgagcatcctacattgatataaactgtaacttattcagatattggaaagcactggttttcagttccgagtgtccggtggtaatggcaagtttcgcatgctgcagccccttgcaagcccactaaagaacatctgccacccggcacagcagtggctgctggtttttgctctctgcagtgagcacttccaggctgtcttgcctcttcctgaatttgtgggtggttgctaatcttttagctcattttctttgctgtgtttttccacatttaaaatcttttattttcctgcgtctgtgttttcatttccaggagacagttggcttttttcgtgtgtgtggaataaatgaacatgtgattcttttacttgctgactgttgaatgtgaaatgtgcagccacctgtaagccaggtgagggtggagtaaacttaggccatgttttgggcctcactgcatccaccactccaaaaactggaaagccttctgagattttaaacattttccagtaatttccttattgtatggtgactgtgagtaataaatcaggaggtcagcgttcatcacaggtgggattgtgtgatgatggtgtcacagagcacatcatagtgagcatttccatttctaggtgtaccttgggaagtcttaaacaagggggtctatatgtctgtatttccttttggccatttttgataatgaccaaccagaacatatccaaatcagatgatgtaaggtgcctttaatacacaaactacttataaatctataggcagtgtataagcaaaccatagacagtgcagtaccgtcggctgtttatacaagagctgttattacccctaagcccagaaggcaatgagagaaagtgatttgtagaattccaaaggagataggaaagcagctggtccagtgtgagtctgagaataaataccctggtccctgctcctggtcttcagttgcctgcctgagctctccatcagcccagccccacaggctgctagatgtggtatcctggccaggtgtggtggctcatgcctataatcccagaactttgggatgccaaggcgggaggatcatgtgaggtcaggagttcaagaccagcctggccaacatggtgaaaccccatctctactaacaatacacaaattagcaggcatggtggggaacacttgtaattccagctacttggaaggctgaggaaggagagttgctggaaaccgggaggtggaggaggcagtgagccaatatcacaacactgcactccagcctggatgatggagaaagactccatctcaaaaataaataaataaaaagatgtggtattctgttaatcatggctgaccattttccagggcagagagcagggtggaatgggatggagagtgaatcagcaggggagcatggaagatgcatcagatatacccacacaccctttactctttaccccttgactgccattttctagcctttaaagcagtagaaggccagcaaagtggtcaggaacacagatatcaaagcttaattaatagttagtctattttggagtccaataaaggatttgccaccttctagccatgaaacttcaggcaagtgactgaacctctttgagtgtattagtccatgctgcattgctataaagaaatacctgaaggtcagttgtggtggctgacacctgtaatcccagcactttggaggctgagtcaggcagatcacctgaagttaggagtttgagaccatcctggccaacatggtgaaaccctgtctctactaaaaatacaaacattagtcaggtatggtggtacgtacctgtagtcccagcttctcgggagactgaggcatgagagtcgcttgaacccggaggtggaggttgcagtgagctgagattgtaccactgcactccagcctgggtgacaggaagactctgtctcaaaaataataataataataataataatagcaataatgccacctgaaactgggtaatttataaagaaaagaggtttatttgactcacagttctgctggctgtgcagttatggctccagcatctgctctgcttctggtgaggcctcagggaggttccactcatcatgggaggcatgttgggcagggaagaggaacacgcaagagagaggggaggaggtgccagcctcctttaaacaaccagatctcgtgtgaactaacagagtgagtgctcactcatcactaaggggatggcaggcaccaagccattcttgaggaagccacccccataactcaaatatttccctccaggcccacctccaacattggggatcacatttcaacatgagatttagagaggacacatatccaaactgtatcaccgagcctccatttcttcacctgcaaaataatgaggtgcaagtacctacctcttgtccttactgtgataaaatatttctacctttattcttttttttttaattttattattattatactttaagttttagggtacatgtgcacaacgtgcaggtttgttacatatttatacatgtgccatgttggtgtgctgcacccattaacttgtcatttagcattaggtatatctcctaatgctatccctcccccctccccctccccctaccccacaacagtccctggtgtgtgatgttccccttcctgtgtccatgtgttctcattgttcaattcctacctatgagtgagaacatgcggtgtttggttttttgcccttgcgatagtttgctgagaatgatggtttccagtttcatccatgtccgtacaaaggacatgaactcatcattttttatggctgcataatattccatggtgtatatgtgccacattttcttaatccagtctatcgttgttggacatctaggttgttggttttttttttttttttttttttttttttttttttttttttttgagatggagttttgctctcttgcctagactggagtgcagtggtatgatctcagctcactgaagcctctgcctcccgggctcaagcaattgtcgtacctcagtctcccaagtagctgggattacaggtgcaaatcaccatgcccatttaacttttgtagagatagggtttcgtcctgttggccaggctggtcttgaactcctgacctcaggcgatctacctgccttggtctccgaacgtgccgggattataggagtgagccactgcacccagcctatcctttttaatgcgactaatggactccacatttatttatttatttatttatttattgtcctatccaccctattccactgtgaatgtaaatttccgggggggcagggattttgatctattttattcactgacatagctctagcattaagactagttggtggcatagaggaggcaatccataaatatttgggggcatcagtaaataagatagtggctacaaagggcttagggtagggcctggaatgcgttaacagcttgatatttgagcaagtatttggtagtaaatacatcaaagttgattttaaacacccaaacacagacaagcaaagaacgggaaatcccccaggtagggatgatatttagaaataggaataaaataagcctggcgaaattacctttggtgagttccttgcaaggttatgtgatttaaaaaaaaaatctgtaattacatttctctatgtaattttgttttatcatctatttatttatttacttttgcaattaatttattttagtaacctaaactcatcgttaagtctgtagtcctggaaaccatgtcaaccgtcagatctctgtctatgctcaaaaacctcaacttgctggctgggcttggtggctcgtgttagtcccagcactttgggaggccgaggtgggttgatcacttgaggtcaggagttcaagaccagcctggccaacatgatgaaaccctgtctctactaaaaatacaaaaaactagctgggcatggtggtgtgcatctgtaatctcagctaatccagaggctgaggcaggagactcccttgaacctgggagggggaggttgcagtgagctgagatcacaccactgcgctacagcctgggcaacagagcaagactccatctcaaagaaaaaacaaaaacaaaaacccttatttggcagtgactgggtacacagagttgtgcaacaggagacccgcctgcagaaagtacccactgggatcctcaccacacagcaggcctcagaatttcccctgcctcctgatcggtgttcagatgtagatagtaggttcagtgggttgattaagttaatgacatttgtagcggtgttataggctgcaggccagggagaggctttctggaaaattgcagggagaaatcctgcaggctctgcctttgaaagataatgctagttgcatgctggggctgtctcctccctttgtcttgaaggtgtagaagacacagctttgcgggctgagtaaacatatgtgcatggttaaggtaaaaatgctacttagctcttcttcccgttaattcgttcaagaactggtgaaagagagcacacttcttggagactgaacttttaaatgcttctgctgggtctcttgagttcttaaaattatcgttttgatctttctgtcccgtgcagatacaaaatacataaacatccacgtgactctttttatttttcacttagaacctgcgcattgtcctagcaggtactccctcagggcctgggttttgttgtcactgctggaatgcagttgctcctccttgccttactcaggcctctgccagcttctcagacagctttgtcaagcaattgctactcaaccagcgattactattaacccttcgttacctaaatccacccaccatttttcttttcctataccgatgggcctcaagcttgagtttgcattagcttcccccagagggtttgatcccctagagacttagagggtccccaccctcagaagttctgaattgttaggtctgggtggggctcagggatttcattttttaacgaaaccctaggtcctgctgaagctgccagttcccatctctactaaaaatagagaaatttgccaggtgtggtgacacacacctgtagtatcagctacttgggaggttgaggcacgagaatcgctggaacccgggaggcagaggttgcagtgagctgagatcgcaccgctccactccagcctgggcaacagagtgagacgctttctcacaaaaaaaaaaaaaaaaaaaaaaaaatccgaacgtctcgtgttaacaggctgatcattattttcaaaaatgtttcctctctttctttccacatggaagctccatgtgagcagatatttctttgttttgttttgttttgtttttcgtttttgcatcattcactgctgtgtcctgtgtgcctggaaaagtacctgacatttagcaggggcttaatagacatctgctgcatgttgaataatagtgaggatgtcagcatcacctgctgccctttgggggagcagattttagggcactgtagcaaggctgattataagtcagtgccctatgtaaggcctggaacctaaaatctccaatcattgtttttgttctgttgaattaagccaccaccctaaagagccagaagcctaacactgaaggaaatagaaaatgtggatctcacaacacatcatttcaagtgtgtacatatactaatagcatacgctaaacatcatctaaacactaaatataatgatataatggcattggtcataatcttgaaggtagttgcatctccgtaaagtttcccattgagctgctgttccgctgctgctggcttccacccccagcacccacccctctagatttataatttccccaacttgggttgaagccccagatgactgggagctgcttctttactttggttcccttcagtcccttcggcagatggcacaattcttagtgtgtgtgattggggttttcagcattggctgtgcattggcattgcatggggagtgttagaaaagattgatgtctgggtactgcccccgaagattctgatttaattggtctgaggatccctgggcatccagatttttaaaagcttacagccaaggttgtgaaccatcagatcagggacaaaggcgatctggaggaagacggggcggggaaagaaaagaggaaaagagaatcctgatttctggagccaacaaagggccctgtgggagcagaggttgttgtaggataatgaaggggtgagctggcagccaagagctcaggacatgcttgaggaaagaacgttcaactcagaaataagactgctttcatgcgttaattatgcacctcttgtcttctctaatcgttttatccagggtaaccttgttggcccaaggaaattataaattccttgggatcagcaatgtgtcttacagttaccctgtagctcccaaggtctctagcagccttgcattcatgtgggattcttcaaaagtagccctcaaattactgaagaactgtgaggtcagagtggtaagtaaaagattaaaatgtctgccaatcaatcacggttgcatatgtgtgtgtttcatcatttcacattgtttgatttctttccgctatgaaaagacatatgcacacagaaaaagaacagtaacacacacaaaaaaatcagccagttaaaaccaccaccaccaccatcatcaccacagaaacttagaaatggagcccagtagagcatcagttgtcagatatgggggcttcaagtccccaaagcagatgtcatctcatgtcattgggaagtaaagatgttcacggtgcaagcgtcattcacagacacgcatgcttgagttccaagggagcagatgtgagccagttaggaagacgccaggaaaacaccatgcttgccccactccccagtctagtgtttaattcacaggcccacattgcaactcttcaatactttattaaacacatctcttctcctggataccctactaccttcagagcaaacacattctactctttgaaggcaagtgtgttcttaactgcttggatcctaccctttatgacagagaagaagaagatattgctaagggttggattagaggtaggaaactggggaagctctggtaaatggaagaggggtttaccttgttttttcattcataatgtgaatataggcaaggttagaatcccggtgcacgtcaccattgtcaaaatgacatccacaagcagtattgatgcctccaccaggtaaacagcagttccctggtatatatcagaagcgtgcttttctgtattctaagcagtttttgacacagtgctttgctttattgcaagccacaatattttcagaaggcttaaaaatccagttatgactgtagctgtgagggaagaggtctgcatggggccggggaaatttaatttttagcttaaaaaaagtcccaccaaattcaatttttctcacctttagggattctcagagttatatccagcttgcataactagtgtgttagagaatgtgttactacggggttattttttttaacacatttattatttatgaaatgcagaggaaaatagaaatgatcgtttcagggaatatcctgtagctttttttattgtattcaaagaagttgctcatgctgttttaattcaaatattaaaagttaaatctcttttcatcctgacctacatttaaaaaacactgctttagcccttatggaggacagaaaatgtgtggaaggaaaacatccactatgcattccttaccccatagttcgtcaggaatcagaatgactggcaaacctgtccaggaagtaataggaaaaacagagcgagatctctctcttctctccacatccttgcttatcccctctctcccatagcaaaccagccctgctggttatgctggtttactcggcctgctcttgaatgttgagaagctccatgtgagcccctcaatctgtgctagggaaataaagagaagagagatattatcccatctttgataagggattaatattgagaatatattgagaactcctaaaactcaacaacagaaaagcaaacaagctgactcaaaaccgagcagaggatttgaatagacgtgtctccaaaagatatatacaaatggccaatatgcacataagaagatacctaacatcactaatctctagagaaatgcaaatcaaagtcacaatgagataccacctcacacccatcaggatggctatttttgttattgttgttattgttgagaaacagtctcactctgtcacccaggctggagcgcagtggtgtgatctcggctcactacaacctctgccttctgggttcaggtgattctcctgcctcagcctcccaagcagttgggattacaggtaccccccaccatgcctggctaattttggtacttttagtagagatggagttttaccatgttggccaggctggtcttgagctcctcaccttaggtgatccgcctgccttggcctcccaagttgctgggattacaggtgttagcccctgtgcctggcctaattccccgtttttaaaatgggtttaacatctttttatatgtttattggccacttgatcctccctcagagagctatacagttttctcactttattcagtctatgagcaaatgtcatcttgtaagagaatgttctggatcaatcttaactgtaatagcatgttcctatccaatacccctgccccctcaccatagccgagtcttctgtgtatttgtatgtatattcatatatatatatatagtatcccacccccctacacacatacatatgtacttatttcctatcttctcctttctggattgtaaattttttggatgtagaaatcaggttttgttggtttgtttttcattgctgtatgcctaacatttagaatagcagatattgaataaatacttattgatttatattataaaggttgtagttttaagaaaaattcagaacacattgacctttctttactagtaatgcgctgtgtagatatggcataatatttttaacctcttctctctactgatgggaattaaggggttgtttgctctttggtgctaccaaaaaaaaaaaatctatctatctgtctgtctgtctgtctatctatctatctatctatctatctatctatctatctatctctacacacacacacacacacacacatacatacacatatatacatacatatatgtgtatgtttatgtgtgcatgaaccactaaaggcataataaacgtctgctgccttggaccagcatctctgcagggtataatcccagaagtagaacctactacatcaatgagaacactcattttaaggctggggacatcttgccaatttgttcacccaagggctttgtcaattcacactcttgccaccctacaatggacaacatatcccaccccacaaccaccacaatgctttgtctttgccagcttctatccctatttgagagatgagaaaactaatgaaaggctcacagactcaaagtcagacagtttctagttggtgggtctaaccctccctgttgcttgtgcagatctctttgttgtgatctgtttcctgtggtctgccacaaactgggtaatttataaagaaaaataagtttactcagttatgattttggaggtcggaaagtccaagagcatggcactggtatctgacgagggcgtggtataaggcatcacatggcaagagcgcatgtgagagggaggaggcgaggagtaagcaagagaaccagggggctgaagtcatccttttaatcaggaatcaactcccaagataactaacccactccagtgaaaactaactgacacctgcagtagctaacctcctgcaacaatccattcttgagggcagagccttcatgacctgatcatcttggtttttgttgttgttgttttttgttgctgtttttgttttttcagatggcatcccatctgtcacccagcctggagtgcagtggcatgatcttggctcactgcaacctccacctcctgtgcttgagtgatttccctgcctcggcctcccaagtagctgggattacaggcatgcaccaccacacctggctaattttttttgaattttcagtagagacggggtttcaccctgttggccaagctggtctcaaactcctgacctcaggtgatccacctgcctcaggctccctaagtgctgggattacatgcatgagccaccatgcccagcccagatcatctcctaaaggtctcacctcacaataccattacattggcagttacatttcaaccttggaggaaacattaaaaccatagcccttcttgatggattacatccttaggaggatctgcttccaagtgtctcacctatatggtaggtgagttagtgctggctgtaggtcgtaggcctcacttcctcatcccacgggcctgtccacaggctgcccaaacatctagccccaggcatctttcatggagagttgcaccagattctgaagtgctcaaacacatgtctctactttcactaatctctttctgttaaatttgtttttgagttgtgtgaaataaatacaatgtaaaatttaccattttaactttttattgcacagtttggaggcattaaatatagtcacactgttgtgtaaccatggccactgtacatctctagaacattattcatcttgtaaaactgaaactctatatccattaaacattaactcccattatgtcttcccccagcccctggcaactactattctcctttctgtctttatgaacttgactgctctagtatctcatgtaagtggaatcattcagtatttgtctttttgttactggtttatttcacttagcataatatccttaaggttcatctgtgtcatcacatttgacaagatttcttccctgtctaaggatgaattacattccattgtatgtgtaaaccacatttctcttatccctccattcatctgtagacgcttgggttccttccacacttgagttactgtgaatgatgctatgaacgggagtgtacaatacctttcagagtccctgctttcagttgtcttgggtgtatagctgcaagtgaaattgatgaatcatagagtaatttatttatttattttttagtaaccgacatactcttttccgtagcactgcatcattttgcatttccgtcagcagtgcacaagggttccaatctgtccacatcattgccaacacttatattcaattttcagaaataatggccatcctggccaggtgcagtggctcatgcctgtaatcccggctctttgggaagccaaggcaggcagatcacctgaggtcaggagttccagaccagcctgaccagcatggtgaaatctcttctctactaaaaatgcaaaaattatccaggtgtggtggcaagcacctgtcatcccagctactccggaggctgaagcagaagaattacttgaacctgggagggagaggttgcagtgagtcaagatcgtatgactgcacactccagcctgggggacagcacgagactgcgtctcattaaaacaaaaacaaattggaagaatttaaaagggagtggggaagaagtatggtcagaacattttccaaactagtgttcattttctatatccaaaattttcatgcagtgtttacctctctttatcttaagaaatcaataattgggatttcattattttgttttgtcaaaacaaagttattgaacaacaaaataccagtgtttgagtgattaaaaaacaacaacatggtattgaaaaatcaaagtacttatcactaaagttaatgctcatcctctcagcccaccagccaggggtcagggaggggacacgattgcacactgggctagagctgctgtccgagaggccttgagggtaggcgtacgacagcagcatttcagaggtagttggcaatgctcctctgccacccatagtgagacagggaacttcctgggcttctggtacagagttttcctaacagtatgtgcatacctagctgcagttcctggtctagggattcttgctatagaactacagagcggtaacttgagtcactgtgaaagcagctcttcagtctggactgaagttgctgcgcttgggattttctttttcatgatgttttcctttatttcttttatcaatacagaatacgtatttatgtaataaatatgtgagtatttttttacatgcagagaatatgtcatgatcagtatttgaaagggagacctgcctttacatgtttattgcagcactacttaaaatagccaagacatggaatcaacctaactgtccatcagtgggctaatggacaaagaacatgtggtatatgtatgcagtggagtactatttggacataaaaagaaggaattttttaaaaagataacaaagtcatgtcatttgcagcagcacagatggaactggaggtcattgtgttgtgaaattactcaagcacagaaagacaagtaccatattctcactcatatgtgggagttaaaaaatatgatctcgagatttttttctttaaaggaaaaagctgtgaggccctttgcttagtttggaggatctcagagggaaaggggccacgctttgtgtatcacttgaatggtcaatttaagccaggtgcggtggctcctgcaggtaatcccagcactttggaaggccgaggctggcagatgacttgagctcaggagtttgagactagcctaggcaacatggtgaaaccctgtctctaccaaaaatagaaaaaaattagcttggcctggtggcatttgcctgtggttccagcaagtcgggaggctgagataggaggactgcttgagcccaggaggcaggggttgttgcagtgagacaagatcgttccactgcactccagcctgcgtgacagtgagacccccatctcggaaaaaaaaaagaaaaagaaaaaacagcttatttaacctattcgagtgaccttgagctatatgcctatctggcctaattttcccatcatcgaagtgagataataatacatagctcagagtgtatggtcagaattaggggaggcagcagaagtaatgtgtttagtgtggttcctggcatgtagcagatgttcagagtggtagtttcagacgatctctccaagtctttgatagtttcccttcataaagtagagcctcatctccctccccatgaatagaatagaatgtagcagacacaataccatgtgacttccaacagtagatcataaaaaggaaatctttttctctctcttcttgtcaattttcttttgcaataatgaatgattactgttgtcttaagccattacatttcagggtaatttgtctcatggcaatagataactcacactttcagtagtatttgcagccaagatctgttatccttgaatattcaaaaatctgtgacctatccccattgtgcatgtacacacaagcacacgctcccctacatactttgctgacatcttattcttaaatgtaatgtgccttattcaaagggtgattaggaggtttgagaatcagtgtggcagctaagcgagacatcttccttgttttaatcagaagaatggaaagtgctttgtagaggcgaggtggactgtcaagcacagagcatgcatgtctctaaggcatgccacagagtttatccggggccaggatacctgtggtctagatcctagaaaggagggatgctagcctgcacatcggttgctaatggaacccttgggtttgtgtgactggggaccaatctgtgccgatgtgtgaatatgtctgctttgcttacactcaggcagtgattgcatatctgggggctaatgagctaagtttggataatggcaagagggtttcttctcaatgcgcaagagtattttgcctgcgtcaggctgactgcgggcatttccttagatctgaggttcactttttgctccgggggttcagcttctgtacacttgatggatgctggtcttaatttggtgtgttgcagtcattgcgagttgtgcaaggatattaccttaaggatattcttttgaatattaaattagaataaattaagggatgctggatattaagcctaaatcagagatgagtaattgccttccgttttatgccgttaagtttgttggaaatgcaagatatttgttttaattaccaagttgttgaaccaactctcaatgagcataggcacaaacagaaacaaataaaaacttcttggtgagtttgtgaaatgtagataacacctaattggatgcattttgttagtgcctgtcctattatcattactttcttccttcatccaacattgagtaattgactcccgactatgtatccagaaacgtaaaatgctctggggaggatattaagggctacatttttttcattgcttaattgtttcctgtatatgccagcctaagcacttgacatccctataaaatattcacagaagcactataaggtaattatgactatgaccgctatttcacagatacaaaactaaggctgagagaggatagcattagattaatattaaaacaaaaactcatacagctagaggtagggtaattccatactgtattggtaattcaaagcagataaaattgttgcctcttgaaagcctgtgcccaaaacgctttaaagaggttctttccgaatgctcaaaaacagtgtattttaaaagctgctctctgaaatttttaagatccatcagccagagtgtgatgttccccttcctgtgtccatgtgatctcattgggactgttgtggggtggggggaggggggagggatagcattgggagatatacctaatgctagatgacgagttagtgggggtagcacaccagcattgcacatgtatacgtatgtaactaacctgcacaatgtgcacatgtaccctaaaacttaaagtatgataataaaaaaataaataaaaaaagatccatcagccagtaattttacctttaaaatgttatcaaaaatgatatttttttccaaatttttattctggaaaattcaactatgtctgtaagaaatcaaaatagtataatgaatccctgggtactcagatacccagattcaacaattgccaactcacgaccaacactgtttcctttttaccttcattcccacatcccccgaacaaccaccccacatgcacaatgtatcttttgaagtagatacttttctttgttggtattttaggaaagtcttattaatgtagactttttttttatagttttctatgtgttggccattcagatgtcaatgaaaagagtcaaactctgtaaaacggtgaagatatttattctgagtgacataggagtgacacagacatcaggagatcctgagaacacacacccatagtggtcaaggcacagcctagtttcacacattttagggagatgtgaggcattaatcaaatacatgtgagatttacattggttcggtctggaaaggtgggacaactggaagcaagggtatggtgcgatgggcttccacgttattggcaattggttaaaagagttattatcgatagaaaagaatgtctgggttaggataaggggttgtggagaccaaagttttatcgtgtggatgtagcctccaggtagcaggctgtggagagattagattgcaaatgtttcttttcagacttaaggtctgtgttgatgaaatgctggctggcttttcctgaattccaaaagggagatgggtatcatgaggcattcctatcatggtctgaatcagtttttcagctcaactttggaatgccctggctgagaggagaggtccatttagatgggtgggggtggggggtgggcttacaattttatttttggtttacgcaagtctgtagaaatgggagctaattgtgatatggatatccctcagtttctgcttgctttttagaagaaactgcaatcacataccttaaaaaaggaatctacatatagaaattttgaactattcaagttcattgtttaaaaacaaatttctggatttactttcctagtgtagaatataatctgtcattgtccagattagatcattgtcctataaatatcaggtaggttgcagatacaataatgctgcgcagatctttagcctttgtattttttggtatcgtcacaaggaaagtaaaaatagtaattgaaaccgaagcctattgttggcaagaaggttaagttagcacagcacatagagcattacctggaaaatagtaagggtcggaaaaatgtaactgttacactgttgctgttgttatttttgttgttcttgccatcacttttcttgtctgagaaatttctaagtctcatccataatattaataaggattaaataaggtaaatgcctaacattctagcattaccagacactgaattactgtattttttctcttcatttttttttcctctggctatgtgtggtggatttagttggactgtttataggaggacaatctaggttaaagggcagaaaattgtatttttggtagaattggggctttgccatgttggccaggctggtctcgaatcacttgagatcagaagtttgaaaccagtttggctgtcagggtgaaaccctgtctgtactaaaaatccaaaaattagctgggtgtggtgggttgtgcctgtaatcccagctactcggtaggctgaggcaggagaatcacttgaacctgagaggcagaggtagcagtgagccgagattgcaccactgcactccagcctgggtgacatagtgagagtccatctcaaaaaagaaagtaaaataaaaaatggagaatggagattttgcccaggaatgcactgtaactgttcttgtagtcactttccttagagatctgccttgacatgtgacgaactctggaatatcaatgctaccatggggtttgttcttttcctgtcattttactcttgaagaaacagtggcccagaaaaatttagcaacctgccaaggtcacaccactaactaatggcatagctggaattagaactcaggccaatgaagagaaaaataatttattaggttttgaaatttgatatataaaaaccataaaggtttccccacttctcaaatattgcagacatgagtgtaatatgagtcattattttgggccaattttgcttgaaataacaataaattacctagagtcacaaataatatataaattggtccaaagttttaggtagctttatatatgtgtatgtgtgtgtgtgtgtgtgtatatatatatatgtagctatatatagtagacatctgtttttatctgggttaatgaatgtgctctgctttgcacagaatttaaatagtttcagaatttttctttctttttttttttttcttttttttgagatggtgtcttgttctgtcatgcaggctggagttcagtgggagtgatttcagctcactgcaacctctccctcccaagttcacttgattctcatgcctcaaccacctgagtagctgcgattacagccgtgtgctaccatacccagctaatttttgtatctttggtagagttgaggcttcactatgttggccgggctggtctcagactcctggcctcaaatgatcagcctgccttggcctaccatagtgctgggattacagatgtcagccatcatgctggaccagaatttttcactaagagggtatcatatagctggtggaagatacatgtcaaggctctttgtaatttactgcatattattcaatttcactccataaatgcataatttaatcacaactctggtttaaatgatatagcaggaatgacatgggtggaatttaaagtttgtataatttatatcatccatagcactttgaaaaggcacaggtcagcctggcctacagggcaaaaccctgtctctactgaaaatacaaaaaatagtaatcccagttacttgggaggctgaggcaggagaatcacttgaacccaggaggcggaggttgcagtgagccaagatcacgctgctccactccagtctgggcaacagagtgagactccatctcaaaaataaaaataaataaataaataaataggtacaggtaggttacctctggctatcagaggggcttgggcatgagtccttgttgctgcccatataggaaggggctgctgtgagttgctctgaccaagctaggttttgggagatgcttaaaagcaaaagctcaaactacattgctcacttcccatccgacaattccaggaacttaacaattcaggagcagctaaagctcctttaatcttctctctgtccacacagcaaaaactgacgagtgagtgatgacaatgataatttaggtaaatattgatgaagggaagaataattctctatactttgaatgaaattcctctaaatctaattcatcctcttggagagaagcaaaaaattgggtattcaggggtcttatttgtacacttcttttcttttttgaggcggagtcttactctgtcacccaggctggagtggagcgacgcgatctcagctcactgcaagctccgcctcccgggttcacgccattctcctgcctcagcctcccgagtagctgggactacaggcgcccgccaccatgtcccgctagtgtgtgtgtgtgtgtgtgtgtgtgtgtgtgtgtgtgtgtgtgtgtgtagctgggagtacaggcgcctgccaccatgtccggctagtctgtgtgtgtgtgtgtgtgtgtgtgtgtgtgtgtgtgtgttagagatggggtttcactgctttagccaggatggtttcgatctcctgacctcgtgatccatccgtcttggcctctcaaagtgctgggattacaggcatgagccaccacacccggccccccttatcgtatacttctatatgtgtatggacgcctatgtgcgtgtacgtaagtgtggagggagaaatggaggtgggtagttaaacaggaaagagtcttagttggaatttcatttcaagtctactgggatatggaggcaagaatcctcaggaaatccatcagcagactctcattccatgcatacatatatatatattcccttccttccctcccattacctccctccctccatcccctcccattccctccctcccatttcctctctccctcccttccctccttccctccctccctccttccttccttccttccttccttccttccttccttccttccttccttccttccttctctatggcttccagcaagtagattagccgtgtggaaactcagttttctcatttggaatattaggaaatccctaatttaaaataaacaccaaagtcctctaacatactgtaaaagtgccgtaaacttttgatctattctttcttcccagtaaggggaccctgctggtgggtttcctgaaggttctcacacctgtccaccaagagacttgaaattccaacagggaatctcctctacctactaaattatgcccctcctctgcccttcatacctgttgaatattataagaatgggtttatctataaagcaggtcagtcatagtaatagagctgatggttaggaaaggtggatagacagagagagattggatttggcttctgagaatgtggtaactataccaagcaagaggtagaaggcaggtgaactcatactcaccctattggaggacctaacaaataagaatgagctgcttttttttccccctaactctttcccatctggagtgcagtaagtgcaatcataactcactgtagcttcaaatgcctgtgctcaagcagtcctcccgcttcagtctcccaagtagctgggaaaggatgggcacaatggctcacacctgtaatcccagcactttaccaggcggaggtgggcagataatttgaaattaggagtttgagagcagcctggccaaaatggtgaaaccccatctttactaaaaataataataataataaaaattagccacgtgcagtggtgcacacctgtaatcccagctacttgggaggctgaggcaggagaattgcttgaacttgggagatggaggttgcagtgagccaagatggcaccactgtgctccaacctgggtgacagtgaaccaggatcccaccactgcacttcagcctgactgaccgagtgagactccatctcacaaacaaaaaacaagttgctgagaccactggcacacaccaccacgctcagctaattttttgatttttttttgtgacattttgttgcccaggctgatctcgaacccttgggttcaaaccaccctctccgtcagcctcccaaaatgctgggattacagttttgagccattgtgcccagccaggatgagctttaagaatgttgacaacatctccatctcctgggagatgaagcttcctagtgagactatcagttagagcattttcctgtggaagcatcaagaagacaagagtagactaaggcaagtgattgggtgatcaagacagagtggacttttcagtgcaggagacggtgctaggcagagttgagtggacagcgagaaggataagatggtgtctgacttggatgtgaacttgacactggggcatctctttggacaagtgaccatttagagactctcttgagagacagactc

SEQ ID NO: 116 - DNA, 3462 bp, Homo sapiens
acctttatctttctgaaaacgattgctttgttccttcatttaatatttccccacaagtgcttcgcagagcacatagtcgttgtgaaggctctatgtggcactctgagagaaggaatccttcactgctatcactgagatgaaagaaaaagagtaggacctttccctgctacgtttctgtagatttctggttctaaaagaacaaacttaaaggtaaagctcttgtgtgtgcaaaaaagtagaactccagttttgacaaagtagttaacttagacctgttagaaagtaaacttgttgggcatggtggttcacacctgtaatcccagcactttgtgaggccaaggcaggaggattgcttgagcccaggagtttgagaccagcctgggccacgtattaagaccctgtctctacaaaaaattagcaggtgtggtcatgcacacctgtagtcccacctacctgggaggctgaggtaggagaatcacttaggcctgggagatcaaggctgcagtgagccatgatcatgccactggactacagcctgggcaacagagcaagactctgtctccctcctccctccaaaaaaaagaaaagaaaaagaaatgaaaaaaaattatccttggtagggccgggcacggtggctcatgcctgtcagctcagcactttgggaatctgaagcgggcggatcacgaggtcaggagtttgacaccagcctggccaacatggtgaaaccccatctctactaaaatacaaaaattagctgggtatggtggtgcatgcctgtaatcccagctattggggaggctgaggcaggagaagggcttgaacccaggtggtggaggttgcagtgagcctattgccccattgcactccagcctgggggacagagcaaaattctgtctcataaagaaaaaaaaattgtcattgtttgaactatacatctttacctcacctggcaatgtatattaagcattattatttctatattgcaggtggcgaaaccaagccacaaatacaaaaacaaagaaggcttgaaggtctgcgactgagtagaacttaggtgtatgtatgcctctttccactgaaggaaaaataaccatgatcattcccttatattttgctaagctgggtatgtgtccggtgctctcagacctgttacctatggtactctttaatcaaataaaaccttaagttcaaacatatacaccgaaataaggcagaactactctgaaacagaagatttatggagtctctttcaccagcaacttaataacatagagatcacaatgtttcccatatacatgattttttttgttgttgttattgtttttttttgagatagagtcttgctttgtcgccaatgctgggtacagtggtgcagtctcagctcaccgcaacctccacctcctgggttcaagcgattcttctgcttcagcctcccgagtagctgggattacgggggtgtgtcaccacacctggctaatgtgttgtatctttagtagagatggggttttgccatgttggccagcgtggtctgaaactgctgacttgaagtgatccactcatctcggcctcccaaagcgctgggattatgggcatgagccacagtgcccagcctcacacgcacacgatatttacacatacatacatataaatatacatattttatatacataatgggtgttggtgcatttcataggcttgtctttgaatatcaagatttcaaactggtttgcaactgatagaaccgagaaaaataactcttggatacctgacttgaatctctctttgcccattggcggccaaagccagttgttgacgtaaagttttttttggttgttgttgctaattgcatctctttcctgacagaggagtaacctcttatttacaaaagtgtttacagttttacatacccgataggtcttacgcacatgtcaagacaaggtattgagccaggcgcatatacccctaatatggcaagagagagaacttctctgtcaacaaggcggtaataaagtgtaacagacaacacttaaggtgtcagtcacctttgcaggcgtattggaagttacaggttagatctagtggttttgatttattttgatgtcaaaaagttactcacatatttatgtaaaaagagagtggcaaatcaacggggtgttgattttgaaggtgctatgtaataaatcagggtagcgattctggtcatctcgccaattttgacagtgagacttgcttatttatggcgttttaaggtctgaggagttgatttatagttacaataacggtcttccatccattagtagttccggcatgcatagatgtgtccctcgtttgcatttaatgattggcatttttaaaattacacgactataaattgtcaagcaggaacaaaactcagtttaaaacgtaattttgttgaaacatttgttttaataaaaagggggtagttgggataaaatacatgccaactgtcctcacctgttgtccaccccaatgctatattaattatgatcctatatcctcctcattatgtagatggagaaactgaggcaaaaagaggcatgatttttctagggcagttctccaatatcaggtcattgcatttaggggctctcttaagtgcaggtgcccaagtctagccataggtgaggagatgagccccagagaacatgccctccagaggatcttaaatcatcacctgacttgagcacccagtttgaaggcaggtagaagggttcgaacctcatttctgtggattagcaactttataaccttgggcaagttgccttttttctatcaattcatgtgtcctcaaataaagaaaggtaattatcctaaacttattaggctattttaggcatcaaatttaatatgaaggctgggtgtggtggctcgtgcccataatctgagtactttgggagactgaggcaggaggattgcttgagcccgggagttcaagacaagcctgggcaacactgggaaaccccatctctacaaaaaaaaaaaaacacacaaaaaattagctgggcatggtggattatgcctgtagtcccagctacttgggaggttgaggcaggaggatcagttgagcctgggactgagatgtttcagtgaactgagatggcaccactgtactccagcctgcgcaacagagtgagaccttgtctgggaagaaaaaaagaaaaaaagaaatttaatctagaactccctagcgtacgattaagtaagttatcaataatttttttctctttcacctttaagccttccccacatatgcacacacacacacacacacacacacgtgcacatacacacactcaaaacccctgtgttctggacttactgattaattttatgagaacgttgttctgtgttccactggttagaagtacttaaaatgatcacattcaggcaagatatgaatctcacggaattaaattagctcattgcttgcttttttcaaag

SEQ ID NO: 117 - DNA, 6120 bp, Homo sapiens
attgctcattgtggtcacagaagtaacctacccaatagaagcacaccaacttgaagcatgcttccatgatcactgagggaggaaaatgattggcaagtctcgtattggtccttgaagcgctccctataaacacttgtcactgccaagcgtgtatcactggccaaagcaagtcacattgtgatatgattagactttgtgtccccacccaaatctcatcttgaattgtaatccccataatccccatgtgtctagggagagaactggtgggaggtgaatggatcataggggcagtttctcccatgctgttctcatgatactgagtgagttctcacaagagctgatggttttataaggggctcctcccccttcactcctcactcttctctctcccgtagccatgtgagaaggtccaagcttgcttccccttcgccttctgtcataattgtaagtttcctgaggcctccccaaccatgcggaactgtgagtcatttaaatctctttcctctagaaattacccagtctcgggtagtatcaagatagcagtgtgagaaccgactaatacgcatggccatgcctaacttcaaagcggctgggcaagtatcatattgctgtgtacttgggaggaggggagaatcagaatatttgatctggcgaccaccacacaactgaacttctctatttctgtgttcttcttgttaaccatctagtttctgtttcctcttgtgacacatatattaattaatttttcaatacccaaacacaagcctctaatatttatctttgtttagttacttcctaataaactaagatatctctacatcctgatcctaaaattcaaaggctccacgtataccatggtgactagttaattccaatatattgcatagttgaaaattgccaagagagtagattttaagtgttctcactacgaaaaaatgcatatgttaaatagcttgatttagccatttcactatgtatacatgtaggaaaacatcatgttgtacactacagatgtatacaatttttacttgtcaattataaacaacaacaacaaaactgcaaagtctccttagacccacccaatcacatgttgtctgctcatttaatgagtaaatgctatataggttcattctggacctgggtaaaatgatttacggactgggaccaagtgggaggaccctatttcaattcattaggtaaggtcttccaggtcaatatttgaccattgattggcacatctggggtatagttatttaactgccttctagtttacctcaatatgacccctcagtggagggaaaatggagcacaatgactagaagaatgttgagagatgaggaaagagagaatgggatggaaagaacataaaataggaaagcattgacattgtcacttcttggctatttcttcctgtaaaattttgcctggagtgccctacaatggggtccccatcctctgccctgataacatcttagtggatcactcctctctcccttttcattctgcaggacttgcccattggggctctttcagacctgactggtcattgggtatctgtggccatgataatcactctcttcctggacgtgaccctcctctcgttaaccaggatgcctgtgttcttaaggttggccgtttccaaggacagagagcttgcatcccatttctaggggactggggatccaaggactccattcttgacattgtcttgtcagccttgaagtgccgaaacccagcatccctgtctgaggtcatcctgtctctcttccaaacatgaggacttcttaaattttttaaaaaaagtttttacttgtataaattgagaaggcacaagtgcaattttgttacatggatatgttatttagtggtagaatctgtgcttttggtatgtccatcacccagatagggtaccctgtactcattaagtgatttcttatccttcactcccccacccaacccttccaagaaggatgactattactcaacagtcattcagtagccattggagaatgactattattccatactctgtgtctatgtgtattatatagttcccatttataactaagaatatgcattatttgactttctctttctgagttttttttttttaagataatggctttgggttccatcctgttgctgcaaaagacatgatttcagactgggcatggtggctcatgcctgtcatattagcacactgggaggctgacgaaggaagatcacttgagcccaggagtttgaaaccagcctgagcaacttggtgagactccggctctataaaaattaaattagccaggcatcgtgttgtgtacctgtggtcccagtttcttgagaggctgaggcaggaggatctcttgagcccaggagttcaaggctgcagtgagctatgatcacacaactgccccccagcctgggtgacagagtgagaccctgttttagtcaggacttcaagaccagccttgccaacatggtgaagccccatctctgcaaaaatacaaaaattagctgggcatgatggcgggtgcctgtagtcccagctactcaggaggccgaggtggaagaatcacttgaacccgggaggtggaggttgcagtgagccgagattgccccactgcactccagcctgggcgacagagtgagactgtttcaaaaaaaataaataataaataaataaataaaaataaaatcaaaggtcttactcttttttatggctgagtagtattctattgtgtgtatgtatatatagatatacatacatataccacacacatacgtgtatatatgtatatatatggtggtatgtgtgtctatatacacacaatgatatgtatattaatatatatgtatatataaatatatatacattttctttatccagtcatccattgattgatgcttaagttgattccatatctttgctattgtactgtgataaacgtatgagtgcaggcatcttttatataataatttcttctttggatagctgcccaaaattcaggtaaaagatctcagtctacaaggcagctcccaagcttcaaaaaattgtcctgccagatttttaaaagcaagttttctcaaaagcttcgatgtatacattggtcgatttatttatccattaaagtatttattgaatacttcttactgcgtatggtggtggtggtgctgaggtgtctcacagtgaacacaacaggcgtagcctctgctattaccaaaattattgtctggtaaagaatgcagatggctaaccaggcaggtgcctgtacggtgagatatgtgctgtgatggctgtaagcgcatggtgtgagcgtagagttgggtgcttaattgaaggcatcaggaaggcttccaggactaaatgatatcaaagtcccaccttaaggatgacaggtttaactaagtaaaggaggatgtggaaagaagggggagagtgctccaggcagaggaaatagtatatacaaaagcacaagaggattgaagaaccaaaatcactttggcatggctggaatgaagggcatgtttgtgtattttcagggtaggggatgtgtttagggacaagctcagagaaaaggaagtaaggaaccctgtcataaagggctcatctgtcctatgaaagagtgtgtacattttattctgagagtacagagccttttcttttttctaagcattacatgattagatttgtcttttagaaaccactctggctgccgttaaaaatgaatttcacagtgacaaggctggaggaaggatcttgggttaggaggcggtggtagtaatctaggcaggacttgaggacgcctgagtggtggtgaggaaggagagaggtggatggaagattcaagagatatttagggggtgttattgagagaacttagtgattgatttggcgtgggaggaatgagaaagtcagggatggctccctggtttctggcttgggtactaggtgcgctggtggtgcttttgacagagatagaaccatgggaggaggaacatgttttgagggaaggctgtctcccttttagacacctagttggtgtccaaatggcacagaccagttggcgtgtggatatcttggggcttagggcgtggatctgggctcagggtggagatctgagccttagctgcacatcagtagtcattgcagtcatggagtgtgctggggttttgccaagagctcatgtagattcaggcgagaagagaggaggggcccaggctgggaatactggctttggaaatactcttgaaatatatagaaatgaaagaatgtatagggctgtttccacagacgtttattttttatttttatttttttgagatggtgtttcactcttgttgcccaggctggagtgcaatggcatgatctcagctcactgcaacctccacctcccaggttcaagcaattctcctgcctcagcctactgagtagctgggattatagatgcccacgaccatgcccggctaatttttttgtatttttagtagagacacggtttcaccatgttggccaggctggtctcgaactcctgacctcaggtgatccacccaccttggcctcccaaagtgctgggattacaggcatgagccaccgcgcccggcccacagacatttactgagcaagagcttgtgcaaggcactctggtatgcatgcagtcggggaccctctgatgaatggaactcaggccttgtataaggaagtgacctccatcagagggtggagacgctgtcagtgaacatccatcacagacaagtgactgagctaggagctggggtaaggtagaaagaggaggacagtgggcgatatgagctgggaaatgcacctctgttgggggactggggagggcttcctggaggaggtgattttggtatctagtggttttgttttgttttgtttgttttttttgttttgagatggggccttgctcttgttgcccaggctggagtgcaatggcatgatctcggctcactgcaacctccgcctcccaggttcaagcgattctcctgcctcagcctcccaagtagctaggattacaggcgcccacaaccatacctggctaatttttgtatttttagtagagacggggttttgccatgttggccaggctgttcccgacctcctgacctcgtgatccgcccgcctcggcatcccaaagtgttgggattacaggcgtgagccactgcgccaggcctgtatccagtgtttaaggagatgttttgtcagataaagctggagttttgtaatggagttttggagatggggaagggcagactggcttaagagggtgctgcataagagatggctcagaggagagaaagtgtacgatgttttcaggacaaattagtccttcaccatggcaggaatctaggcggccgaaggacatttgtgggaaattgtagcagaaaatacgaggaggactttgatgccaggccacagagtttgcagtcctttttggagactcaggggagttattgaacaattagaaactaaaggctgatgtgacctccacaggatactggctaaacgcatgaactcttgaaccagatggacctggatttaagtctggattctgccatttccttgctgtgtggtcttaggcagattattaacctctctgagcctcagttttctcatctgtcaaataggagtgaaatacctcatagagggttgtgaagagtgaagtaaactaatgtggagaaggcattctgcagtgtctggaattcagcgacccctcagtacatgttaacacactaatactttctacgtaatcatacctgtaacaacacagagacgatggtattatctttacagcttgttcgcttctgtatcctgagcatctaggacagtgcctggcatgtaatggatgctggagaaatatttcttgggcaagaaatgaattgcaccagtttctttttgtaagggatctatttttttcttgtctggaaaaatactttgataaaaccttagggaaaagatgaaattccctttcttctggagcctagatttcaaagaggagaggttgagtgctctgcaaagtagaaggagaagattttgggcagtgaggaggagagaattgatgagatggtggggcacagcgtactatgaaatgtgactcttcccccggg

SEQ ID NO: 118 - DNA, 10654 bp, Homo sapiens
aatcaagtgtcagagaccagagatatgaggtctcatatatatatatttgctcagggcagggggctggttttgggtgataattaggggctagactgaacagaattagtgtttggaagtgagtggtggtggtggtgagggaggagagaagggtgagtcccagggtaagggatgcaggcacatcctgagaaatgaggcagaagaatgagaacttggcttggggcatgttctgttcatctgaatggtggtgctgaggagacaggtggacagagaggtgtggggttcagggaggagcacaggactgagagggaccagcaggaatagaattcctgaagtcccttggattgacaagatgcttcagtgagagagagtccacagggtagagatcagcacctaggacagagcctcgagaacttcctctaggatagggaagggctggagaacaggaggaggagccaaggagaggaggaaggggccaagagggcaggatcaggactgaggcaggccgacttctgcgcagttgaagaactctaatgtcagagctgtccttaggaggcagagaacccctcgtcctggaagagtgcagggagctgcttggtgaccatcctttggggatgtcatggaaaagatatttgcatcaatctggggtgagattaggtgtctggattggttcaggttcttttgtcatttgtaagcacacaaaagaactctagttatctaaaggaaaaaaaaaactggaaatattatgggttggcacacgagtggtgccaggcctcagagagtacagggcccagggtggctctggggatctgggtggcaggagcgaatggatgaccttcacagggtgacaccatcgggaggaatcagctccagctgttttctgtccttgtcccaagaatcaaatcccagggagaacagtgtgattccccaatgttgtgaggttcagtcatgtgcaaggggaaagccgggcacctcgattgacagccccaccaggactgcataccgtggagaaaggatggcttcccaaagaaaaacaacattccagctaccagagaaaagggagtggacgctgggcaggcaaagccaacagacactttttgtagtctccatggtcctgtgtatgattcagtgatttttgcagtattcacttagcaagtcattcctcgttgcagaattgttgctagtgtttttcctggctggggattaagctttttccatttgcctattttagagtgagttgggggcctgggattgacacgcatttgtctctgggcttcaaggtagcccagagattatgccacctcaggaggcacaatttggtggctgtcactccttgtcatgtcaacaaagggtgtggcttgtggctctgtggcctctgctttaccagcaaggggaggatgctggtagtagcaaagggtctaaatcgctgttgcatcagcgaggtggatgtgcctatcctaaaggcacctactgagaagatgcccaagtaacagacactcatgggcacagtagacctgtcaaacctcatagttcctggctgactctctttgggtgacctgagtcacacgcccacgcctgaacacccactgaaactcctaggtgcattacgtcttctgcaatatctaaaggaattaagggaaggatgaaactctgtatctcaactttcctgaattcaccagtatggactgatggaattgagtgctagtaacaccaagctcctaaataataataataaaggcttacttataggaacgtacgaagcacaagagaaataagggcccccacggcccacccttcaacttctcacatttggtttgttagtcaggactcctttggtcacaagagacaaaaaaaacaattcaagttggtttaggaaaagaggcatttattggcttgtacagaggagttgagagttctttaggtctggctggatttaggtgctccagcatggtcatggggcatctcttggctcagcttttctctgtgttggcttcattctcaaaaaaacttttccttggtgatggtaaagatggcagatgcagcactttgggagcctgaggcaagaagaccacttgaggccaggagttcgaaaccagcctggtcaacctagtgagaccccatctctacaaaagaaaaaaaaattcaggtgtaatggtgtgcacctgtagtagctactagggatgttaagtgggagttgcatgaatccaggtgctcaaggttgcagtgagccataatcgcaccattgcactccaccttgggtgacagagtgagattctgtctcaaaaaaacccacaaaaaccgcccccccaaaaacggatggcagatgcaaatttattccctaccagtttaacaactctgctggaaaataaaccctctttcctaataattccagcaaaagtcctgaagctgattctctttgggtgtcctgagtcacacgcccatgcctgaatccccactgtggcccaggtcccatgtccacccttagagccagaggatgagggcagccttagctggcccacacaatcagtgagccagtgaagagcgattcctcacaggagaagcatggaggatgggtgctgtcaggcagaaacaagacatgccaccacacttggttttggggttaggcctgcttctggtctgagcaatctgctgctggatatggctggtgagtgaagagatattgatgtgtcatccccttagaccatggcattgtgtcctgctctctgcatctttgggggcctgatcaaaagcgggaagtcatggggtcaaggacagtctccacgtgccacccaaacaggaaggatgtccccagcaggtgttctgctcagggtctggctctcccagggttgttactgcagagggaagggtaggggcagctttcttctggtggatttatttacttctcaggcctgttcttttcctcatgttggctcaactgttttatcttgcttagttaaataaatttggtaacattataaaggaaaacagtcttttccggcagttgctgaccactgcaaaattactgctctttcttttgtttttcctttttagtgctgggctgtgaataagcaaatgaagtttgctatctcttcctcccctcttccaggaagaaataatcaccatcagaactttaagagtttcccataagactgggcaaattagaggaaggacctctatacggtggaacagatgcaattgtgcaaacagaatggggttattctctacatatggagatggaacagaccctcccagatgtgttagtgtggggaaaagcaggtggtggaggtgcgttcagagtagcagtgttcagctctcccaagcacattcaaatcacccaggagcttttaaaacgtactgatgcctgcccaccaccctctcctcacagccccattaaatcagaatctctgggagtgggacttgagcacttttcattttaaaagctccctggtgactcctggggagccaggactgagaactagtgctgtagaattgtatatgggcaaaacagcagggatctagataaaaaaagaaaactgaagtagggaatatctcagtccgtacctacagatagcctcacacatgtggtcgcgcatacagagaacgtctctagaaggatacacaggagactggaaagaacggttctctccagtgatgaagtacagtggtgattctcaactgtatactcgtttgtaatgttggaattttgaagccacaagcataaatgctcactgtgtactgaaagctggccagacagggctgtaagatgacccctgaactctagcttgtctgtgttggggccggctgcccacagattcacacaaaccatctccctgcccgtggtctctgcttgccctcctctactcagctgcaatgagtggtttccgagtgtgggagagaccagaagagctcattcattcattcattcgctcacatttttagtaagaattaggtataagccaggcacgtggtaggcacgtgaatctgatctcaccttcacaaccgtatgtgaaattggtggtcttatctccattctaagattggggatattttaacacagaaattcatacaaccaagctgtaaatatttgaggccgaatgaccagctaagagagcttataaactggcagcacttagatgtgtttggatggcctgtacagaactttttaaaaaaatcctatttcacgactctggaccagtgaacccagggccactgttggctagagctgagtgtcccttggaagggcatatgcccctcagttcagcgcagtccccccatatcccttcccttctgtgtcacaccagccttgcatcactcagtcacaggcctagcctctgcaggcatttgcgtttgtcacccctgtgttaaggtaggtaggatgagtgaactgtcgtctgtcctgcagggatgctgagctgaagtgtcctgtggaatgtgccatttctattccaatctggccctctgtctgctggctggaaaaccaagctcctttgctttaagtttcatttgtggactgcatgggatgggctgtgggtattgatttgtttgtggaaaagatgtgcacaatagggaatgtgtaaaatacatcatggaaatggatggttaatgccgcctggctggagtgtggggcagtggagtgacaagagatgagagtcaagttagatggtggggtatactgtgggtagatgccgggctaagcattttgaactttaacctttaggctactgctgtccaataagactttctatggtgctggaaatttcttatatctgtactatccaatgttgtctccagacgcatgtggcatcaagcacttgaaaagtagctggcatgaatgaagatttttattggcattttagattttatttaattaatttacttttacatagctccatgtggctggtagctaccacactgggcgctgcagatttaggcaatagcagtggatgtgttggagcagggaaataatatcaaagctgaatcttcagaaggtgatttttccaggagtgtacaggccgcatggggtgagcagaagtaggtagggataatattgacacttcttagcatctattaggcacttcttgtgtccacacactgtgctaagataactcacttattcctcataacaactctatgaggaaagtactatcattgtccctattttatagactagaaaatgagacacagcaaagacaatgggcatattcaaggtcacacagctaatcaacagtggcacacggtgtagaatccaggcagctcagctgtagagcttgtaccatgaatccttccatcctggaaggaaataaatgaaccttcattgagaatataccttctgctgtcccctggtgctgggcattcacacgtaaaatctcatttagatttttgttaacactcatgtgccattcggtggatttagatcctttgtgtttatggaaacttgggctcatagggatgagatatcaaggcaactgcaatctctgtggacaccagttaaggctttattgtaaaattccatgcctgtgggggaaatcacaggctgtgggagtcggggggaatgtacaggaagatatggcataaaaggtgttgcgaaggaagaatcagtgggatttagcaactgactgaatggcgggggtgaggaaagcgggggaggctttctcctggaacagtgagatgaatgacaaacacacatgtaactgcactgtgtgagttgagagtgtgggctctagaggaagacaaactggtttcaaatacaagtgttaacacggactagctgaacaaccttgggcaaattacttctctccgagcatcagtgtccctgttaatataacgaggaccgaaggcaggaggatcacttgaggtcaggagtttgagaccagcctgggcaacatagtgagatcccgtctctagaaaaaacttaaaaaattagccaggcatggtgatgcatgcctgtagtcccatctactcaggaggctgaggccagaggatcacttgagcccaggagtttgcggctacagtgagctgtgattgcaccattgcactccagcctgggtgacagagcaagactttgtctctataaaagatataatgagaatcatagcaccttcctcacaggactgtgatgaggctcaggttaagcacggatatgaaagccctttgcaaactcaatagcatgaccctgtgagtcactcttcttagtgctggtgagaccagccattgggcagaaatggtgaccagaactttctgtctttgatcatggaaacagttcgggaaattgcctgggggaaccccacttcatcttaggtacttggtagagtttaatgcggataagtctgtgggtcagctttgacctaggaggaaagagtggttctcccagcagctgtagagcaaaatctgcatgccagtggctccaacttaaatgcccttttccaccaaacagtttgcatgtgttgtcttatttgagctgcacaacaaccttatatacataggtactgtgataaaataaggctcagagaggtggagacactgagctaatgtccttcagcttataggtagtaaaatgagtgttcaaacgaaggtcctcctgcttccagaaacttagcctgtaattcctgtaggtgatgggcttctcatttcttctcctaccacagatatctgcaactagcgctagaatttctatcccagattgacatggatttaagggtaaaggttgcttcctaagaatgtcagttttccactatagaccccagtaagaattgtgtacaagaggggaatcgactccaaacagaatatatatatatatatgatttaatttagtcctctttggaatgcaatgagtaaattttagtggttagagtaaaccactaaaatttgggagttaggggtgaagtgcagtgtgaagcagagttgagatctcagtgcttttcctggggcagaaacatccgagagggcccctgtcacccaagcttttggctacagtctactccttccatctgggattaaccaggcgtttcttatccttgctgatctagtgtttcttattgctgctgtaacaaattaccacaaatttcctggcctaaaatggcacacatttattatcttatacttctagatgtcaacattctgaacagcaggtcttccggggctgaaatcgaggtgtcagcagggctgccttccttctggaggctctaggggacaatctgtttcttaccttttctagaggccacccacattccttggcttgcgttcccttccagaaatggcacaattccaacctctgcttccatcatcacgtctcatcctctgactccgagtctcttccctccctcctataaggacccctgtgatcacactgggctcatccagataatctagtataaccccctttctcaagatccttaatttaatcacatctgcaaaatcaattttgtcatgtaagtaatatattcacaggtcccaggattaggacacggatatctggtggtggtgtcagggggtcgggggtaggggatgggaacattattctgcctacagagctggcaggtggcctttcttctttcctttcttttcctttcctttccttcccttcccttccctttcctttccctttcccttcccttttttccctttcttttctccttcccttccttttttccctttctcttccccttccccttcccttccccttcccttccccttccctttcccttccccttcccttccccttcccttccccttcccttccctttcccttccccttcccttccccttcccttccccttcccttccccttcccttccccttcccttccccttccccttcccttcccttcccttccccttccccttcccctccccttccccttcccttccccttcccctccccttccccttcccttccccttccccttcccttcccttccccttcccttccctttcccttccccttcactttcccttccccttcccttccctttcccttccttttcccttccacttcccctttcccttccacttccctttcccttcaccttccccttccctttcccttccccttctctttcccttccctttcccttccctttccttttcccttcccttccctttcccttccccttcccttccctttcccttccctttcccttccccttccctttcccttccctttccctttcccttcctcttcccttccccttcccttccccttcccttcgccttcccttccccttcccttccccttcccttccccttcccttcccttccctttcccttctccttcccttccccttcccttccctttcccttccctttcccttccccttccctttccctttcccttccctttcccttccccttccctttcccttgcctttcccttccccttcgcttctgcttcccttccccttctcttctcttttcttttttttctggagtcagggtctcattctgttgcccaggctggagtgcagtggtgctaacacagctcactacagccttgatttcccagcctcccgggttcaaccaattccccccacctcagcttcccaagtagctgggaccacaggtgcccaccaccaagcctggctaattttaaaaattttttagagatggagtcttgccatgttgcccaggatggtcttgaactcctgggctcaagcaatcctcctgcctcgacctcccaaagtgctaggattataggtgtgagccactgcactcagctgcaggtggcctttctgatcttgcctgtaataagggagggtgggaggtggatagagccggagacatctttttcattctctgctggagctgagtagcaatttccccttttaaacaggccatgtgtgcagtcccctacctggccgtcagacattttcattgctcacctggcccctaggcatttgagtttcagaccccattttgtagttctagtaaagccttgctatagactggggtcagagggctgcaggctttcaacctttgtagagcaaggggttattgaataaattatgaagcatctggagattctgggctcttaactgggtacctgtttgaaagtagggtctagtacatttttttcagtagctcagtaaatgttgcctcttcttaaaaaaaaaaaaaacagaaaacaaaaactggtcttactctgaatttgccaaatagaaatgagggggcgtttatttgtgtcacaaaaggatttgatttctttaaataggcagccctactattttcttcaaagtgttttagttaatgggaaatttgatttgcacaacttttcagaaacacactgtgtaaaggaattacctgcaccagaagctcatgaggtttttcaaagtctgttctcagcttctctgcacatcatgctggggttcacttggcctattgattctgcctcagtggggatggactattcatttctgtgggtaattggaagcctacctaaagtgaccttgtcaatggttggattgacaaatatccaggctggtgggatgtcaggcgatcatccaggagctacatctaccatgaagttggttatgttttctcctttttctatgactgatgatattcattttttggttcattcattcaccaaacatttatttactgaatatcaattatgtaccaggaattgtggtagacactaggagactagagatgagctatctttatccccttctgtctccaaaggggataaagatgaataagataataattgatttttttttttgagacagagtctcgctctgtctcttaggctggagtgcagtggcgtgatctcggctcactgcagcctctgcctccctggttccagtgattctcctgcctcagtctcctgggtagctgggattaccggggcctgccaccacactttgctaatttttgtattttttgtagagaataactgatattttagatgtttggaagaaaggttgtagaataaagcacctacttgaaaatgggggaaactactttcctaaatatttctgggtcaaagaataaattaaaaccatactaatagaccacttagaaacttgatacaatgatgggactaaatataaaacataggatgcagccaaaactgtacttaaaagagggtttttagccataacatctttaaatgtttaatgaagaggaatgggaataaattaattgagcagtcaattcaagaagctttaaaaagaacagtggataatattagctgacatttgtagaatagtcatgatatggttggcatggttctgggcatggaataactcatttagttctgacaacaccactgtgatatgggtcctattgttgctgtcattttccagagaggaaactgaagtacaggaagatgaggtagtgtacctagtcttagagtttgcaaatgatagacacaggatatacacctgatcatcagactccagaattcacattcccaaccaataagtaatacaaatacaagtaagcaatacaatcacagacacacagaacaaaaaaagttaaagtagcaattaataaagtaggctaaaaccaggtagagttgataaatataatcataatctgcttctttaacatgatagaaagataaaaatagacaagaaagaacacaaacttctggaaaaaaaataacgagagactacctaacaatgcaatatgaagaaagaaacaaagaaagagaaaag

SEQ ID NO: 119 - DNA, 14280 bp, Homo sapiens
gatttttgcagtattcacttagcaagtcattcctcgttgcagaattgttgctagtgtttttcctggctggggattaagctttttccatttgcctattttagagtgagttgggggcctgggattgacacgcatttgtctctgggcttcaaggtagcccagagattatgccacctcaggaggcacaatttggtggctgtcactccttgtcatgtcaacaaagggtgtggcttgtggctctgtggcctctgctttaccagcaaggggaggatgctggtagtagcaaagggtctaaatcgctgttgcatcagcgaggtggatgtgcctatcctaaaggcacctactgagaagatgcccaagtaacagacactcatgggcacagtagacctgtcaaacctcatagttcctggctgactctctttgggtgacctgagtcacacgcccacgcctgaacacccactgaaactcctaggtgcattacgtcttctgcaatatctaaaggaattaagggaaggatgaaactctgtatctcaactttcctgaattcaccagtatggactgatggaattgagtgctagtaacaccaagctcctaaataataataataaaggcttacttataggaacgtacgaagcacaagagaaataagggcccccacggcccacccttcaacttctcacatttggtttgttagtcaggactcctttggtcacaagagacaaaaaaaacaattcaagttggtttaggaaaagaggcatttattggcttgtacagaggagttgagagttctttaggtctggctggatttaggtgctccagcatggtcatggggcatctcttggctcagcttttctctgtgttggcttcattctcaaaaaaacttttccttggtgatggtaaagatggcagatgcagcactttgggagcctgaggcaagaagaccacttgaggccaggagttcgaaaccagcctggtcaacctagtgagaccccatctctacaaaagaaaaaaaaattcaggtgtaatggtgtgcacctgtagtagctactagggatgttaagtgggagttgcatgaatccaggtgctcaaggttgcagtgagccataatcgcaccattgcactccaccttgggtgacagagtgagattctgtctcaaaaaaacccacaaaaaccgcccccccaaaaacggatggcagatgcaaatttattccctaccagtttaacaactctgctggaaaataaaccctctttcctaataattccagcaaaagtcctgaagctgattctctttgggtgtcctgagtcacacgcccatgcctgaatccccactgtggcccaggtcccatgtccacccttagagccagaggatgagggcagccttagctggcccacacaatcagtgagccagtgaagagcgattcctcacaggagaagcatggaggatgggtgctgtcaggcagaaacaagacatgccaccacacttggttttggggttaggcctgcttctggtctgagcaatctgctgctggatatggctggtgagtgaagagatattgatgtgtcatccccttagaccatggcattgtgtcctgctctctgcatctttgggggcctgatcaaaagcgggaagtcatggggtcaaggacagtctccacgtgccacccaaacaggaaggatgtccccagcaggtgttctgctcagggtctggctctcccagggttgttactgcagagggaagggtaggggcagctttcttctggtggatttatttacttctcaggcctgttcttttcctcatgttggctcaactgttttatcttgcttagttaaataaatttggtaacattataaaggaaaacagtcttttccggcagttgctgaccactgcaaaattactgctctttcttttgtttttcctttttagtgctgggctgtgaataagcaaatgaagtttgctatctcttcctcccctcttccaggaagaaataatcaccatcagaactttaagagtttcccataagactgggcaaattagaggaaggacctctatacggtggaacagatgcaattgtgcaaacagaatggggttattctctacatatggagatggaacagaccctcccagatgtgttagtgtggggaaaagcaggtggtggaggtgcgttcagagtagcagtgttcagctctcccaagcacattcaaatcacccaggagcttttaaaacgtactgatgcctgcccaccaccctctcctcacagccccattaaatcagaatctctgggagtgggacttgagcacttttcattttaaaagctccctggtgactcctggggagccaggactgagaactagtgctgtagaattgtatatgggcaaaacagcagggatctagataaaaaaagaaaactgaagtagggaatatctcagtccgtacctacagatagcctcacacatgtggtcgcgcatacagagaacgtctctagaaggatacacaggagactggaaagaacggttctctccagtgatgaagtacagtggtgattctcaactgtatactcgtttgtaatgttggaattttgaagccacaagcataaatgctcactgtgtactgaaagctggccagacagggctgtaagatgacccctgaactctagcttgtctgtgttggggccggctgcccacagattcacacaaaccatctccctgcccgtggtctctgcttgccctcctctactcagctgcaatgagtggtttccgagtgtgggagagaccagaagagctcattcattcattcattcgctcacatttttagtaagaattaggtataagccaggcacgtggtaggcacgtgaatctgatctcaccttcacaaccgtatgtgaaattggtggtcttatctccattctaagattggggatattttaacacagaaattcatacaaccaagctgtaaatatttgaggccgaatgaccagctaagagagcttataaactggcagcacttagatgtgtttggatggcctgtacagaactttttaaaaaaatcctatttcacgactctggaccagtgaacccagggccactgttggctagagctgagtgtcccttggaagggcatatgcccctcagttcagcgcagtccccccatatcccttcccttctgtgtcacaccagccttgcatcactcagtcacaggcctagcctctgcaggcatttgcgtttgtcacccctgtgttaaggtaggtaggatgagtgaactgtcgtctgtcctgcagggatgctgagctgaagtgtcctgtggaatgtgccatttctattccaatctggccctctgtctgctggctggaaaaccaagctcctttgctttaagtttcatttgtggactgcatgggatgggctgtgggtattgatttgtttgtggaaaagatgtgcacaatagggaatgtgtaaaatacatcatggaaatggatggttaatgccgcctggctggagtgtggggcagtggagtgacaagagatgagagtcaagttagatggtggggtatactgtgggtagatgccgggctaagcattttgaactttaacctttaggctactgctgtccaataagactttctatggtgctggaaatttcttatatctgtactatccaatgttgtctccagacgcatgtggcatcaagcacttgaaaagtagctggcatgaatgaagatttttattggcattttagattttatttaattaatttacttttacatagctccatgtggctggtagctaccacactgggcgctgcagatttaggcaatagcagtggatgtgttggagcagggaaataatatcaaagctgaatcttcagaaggtgatttttccaggagtgtacaggccgcatggggtgagcagaagtaggtagggataatattgacacttcttagcatctattaggcacttcttgtgtccacacactgtgctaagataactcacttattcctcataacaactctatgaggaaagtactatcattgtccctattttatagactagaaaatgagacacagcaaagacaatgggcatattcaaggtcacacagctaatcaacagtggcacacggtgtagaatccaggcagctcagctgtagagcttgtaccatgaatccttccatcctggaaggaaataaatgaaccttcattgagaatataccttctgctgtcccctggtgctgggcattcacacgtaaaatctcatttagatttttgttaacactcatgtgccattcggtggatttagatcctttgtgtttatggaaacttgggctcatagggatgagatatcaaggcaactgcaatctctgtggacaccagttaaggctttattgtaaaattccatgcctgtgggggaaatcacaggctgtgggagtcggggggaatgtacaggaagatatggcataaaaggtgttgcgaaggaagaatcagtgggatttagcaactgactgaatggcgggggtgaggaaagcgggggaggctttctcctggaacagtgagatgaatgacaaacacacatgtaactgcactgtgtgagttgagagtgtgggctctagaggaagacaaactggtttcaaatacaagtgttaacacggactagctgaacaaccttgggcaaattacttctctccgagcatcagtgtccctgttaatataacgaggaccgaaggcaggaggatcacttgaggtcaggagtttgagaccagcctgggcaacatagtgagatcccgtctctagaaaaaacttaaaaaattagccaggcatggtgatgcatgcctgtagtcccatctactcaggaggctgaggccagaggatcacttgagcccaggagtttgcggctacagtgagctgtgattgcaccattgcactccagcctgggtgacagagcaagactttgtctctataaaagatataatgagaatcatagcaccttcctcacaggactgtgatgaggctcaggttaagcacggatatgaaagccctttgcaaactcaatagcatgaccctgtgagtcactcttcttagtgctggtgagaccagccattgggcagaaatggtgaccagaactttctgtctttgatcatggaaacagttcgggaaattgcctgggggaaccccacttcatcttaggtacttggtagagtttaatgcggataagtctgtgggtcagctttgacctaggaggaaagagtggttctcccagcagctgtagagcaaaatctgcatgccagtggctccaacttaaatgcccttttccaccaaacagtttgcatgtgttgtcttatttgagctgcacaacaaccttatatacataggtactgtgataaaataaggctcagagaggtggagacactgagctaatgtccttcagcttataggtagtaaaatgagtgttcaaacgaaggtcctcctgcttccagaaacttagcctgtaattcctgtaggtgatgggcttctcatttcttctcctaccacagatatctgcaactagcgctagaatttctatcccagattgacatggatttaagggtaaaggttgcttcctaagaatgtcagttttccactatagaccccagtaagaattgtgtacaagaggggaatcgactccaaacagaatatatatatatatatgatttaatttagtcctctttggaatgcaatgagtaaattttagtggttagagtaaaccactaaaatttgggagttaggggtgaagtgcagtgtgaagcagagttgagatctcagtgcttttcctggggcagaaacatccgagagggcccctgtcacccaagcttttggctacagtctactccttccatctgggattaaccaggcgtttcttatccttgctgatctagtgtttcttattgctgctgtaacaaattaccacaaatttcctggcctaaaatggcacacatttattatcttatacttctagatgtcaacattctgaacagcaggtcttccggggctgaaatcgaggtgtcagcagggctgccttccttctggaggctctaggggacaatctgtttcttaccttttctagaggccacccacattccttggcttgcgttcccttccagaaatggcacaattccaacctctgcttccatcatcacgtctcatcctctgactccgagtctcttccctccctcctataaggacccctgtgatcacactgggctcatccagataatctagtataaccccctttctcaagatccttaatttaatcacatctgcaaaatcaattttgtcatgtaagtaatatattcacaggtcccaggattaggacacggatatctggtggtggtgtcagggggtcgggggtaggggatgggaacattattctgcctacagagctggcaggtggcctttcttctttcctttcttttcctttcctttccttcccttcccttccctttcctttccctttcccttcccttttttccctttcttttctccttcccttccttttttccctttctcttccccttccccttcccttccccttcccttccccttccctttcccttccccttcccttccccttcccttccccttcccttccctttcccttccccttcccttccccttcccttccccttcccttccccttcccttccccttcccttccccttccccttcccttcccttcccttccccttccccttcccctccccttccccttcccttccccttcccctccccttccccttcccttccccttccccttcccttcccttccccttcccttccctttcccttccccttcactttcccttccccttcccttccctttcccttccttttcccttccacttcccctttcccttccacttccctttcccttcaccttccccttccctttcccttccccttctctttcccttccctttcccttccctttccttttcccttcccttccctttcccttccccttcccttccctttcccttccctttcccttccccttccctttcccttccctttccctttcccttcctcttcccttccccttcccttccccttcccttcgccttcccttccccttcccttccccttcccttccccttcccttcccttccctttcccttctccttcccttccccttcccttccctttcccttccctttcccttccccttccctttccctttcccttccctttcccttccccttccctttcccttgcctttcccttccccttcgcttctgcttcccttccccttctcttctcttttcttttttttctggagtcagggtctcattctgttgcccaggctggagtgcagtggtgctaacacagctcactacagccttgatttcccagcctcccgggttcaaccaattccccccacctcagcttcccaagtagctgggaccacaggtgcccaccaccaagcctggctaattttaaaaattttttagagatggagtcttgccatgttgcccaggatggtcttgaactcctgggctcaagcaatcctcctgcctcgacctcccaaagtgctaggattataggtgtgagccactgcactcagctgcaggtggcctttctgatcttgcctgtaataagggagggtgggaggtggatagagccggagacatctttttcattctctgctggagctgagtagcaatttccccttttaaacaggccatgtgtgcagtcccctacctggccgtcagacattttcattgctcacctggcccctaggcatttgagtttcagaccccattttgtagttctagtaaagccttgctatagactggggtcagagggctgcaggctttcaacctttgtagagcaaggggttattgaataaattatgaagcatctggagattctgggctcttaactgggtacctgtttgaaagtagggtctagtacatttttttcagtagctcagtaaatgttgcctcttcttaaaaaaaaaaaaaacagaaaacaaaaactggtcttactctgaatttgccaaatagaaatgagggggcgtttatttgtgtcacaaaaggatttgatttctttaaataggcagccctactattttcttcaaagtgttttagttaatgggaaatttgatttgcacaacttttcagaaacacactgtgtaaaggaattacctgcaccagaagctcatgaggtttttcaaagtctgttctcagcttctctgcacatcatgctggggttcacttggcctattgattctgcctcagtggggatggactattcatttctgtgggtaattggaagcctacctaaagtgaccttgtcaatggttggattgacaaatatccaggctggtgggatgtcaggcgatcatccaggagctacatctaccatgaagttggttatgttttctcctttttctatgactgatgatattcattttttggttcattcattcaccaaacatttatttactgaatatcaattatgtaccaggaattgtggtagacactaggagactagagatgagctatctttatccccttctgtctccaaaggggataaagatgaataagataataattgatttttttttttgagacagagtctcgctctgtctcttaggctggagtgcagtggcgtgatctcggctcactgcagcctctgcctccctggttccagtgattctcctgcctcagtctcctgggtagctgggattaccggggcctgccaccacactttgctaatttttgtattttttgtagagaataactgatattttagatgtttggaagaaaggttgtagaataaagcacctacttgaaaatgggggaaactactttcctaaatatttctgggtcaaagaataaattaaaaccatactaatagaccacttagaaacttgatacaatgatgggactaaatataaaacataggatgcagccaaaactgtacttaaaagagggtttttagccataacatctttaaatgtttaatgaagaggaatgggaataaattaattgagcagtcaattcaagaagctttaaaaagaacagtggataatattagctgacatttgtagaatagtcatgatatggttggcatggttctgggcatggaataactcatttagttctgacaacaccactgtgatatgggtcctattgttgctgtcattttccagagaggaaactgaagtacaggaagatgaggtagtgtacctagtcttagagtttgcaaatgatagacacaggatatacacctgatcatcagactccagaattcacattcccaaccaataagtaatacaaatacaagtaagcaatacaatcacagacacacagaacaaaaaaagttaaagtagcaattaataaagtaggctaaaaccaggtagagttgataaatataatcataatctgcttctttaacatgatagaaagataaaaatagacaagaaagaacacaaacttctggaaaaaaaataacgagagactacctaacaatgcaatatgaagaaagaaacaaagaaagagaaaaggtgtaatatcatcccagataagatgctacaatttaaacacgttgagaagaacactgtggataatttccaaggaaaatataaattccaaaagtttgtttgagtagaggtgaaaaactttcctgtgtggttgaagtgtagagagggagagggaggtgaagctggggaaagctcagggatggggcgagactatgctgtcatccctttactttcatgttgaataaaagggaaagttaaacatggaactacgacagggggaaaagagagaataataaaaatattatttggggtaatacggttttctatctggaaaactcaaaggaagcaactaaaactccacaaaagctatttgagtttttttaaaaaatgctttaaaataaatatgctaacaatctattgctttcctattgtttttgtttgtttgtttgttttgtgttttgagatggagtctcgctctgttgcccaggctggagtgcagtggcatgatattggctcacttcaacctccgcctcctgggttcaagcaatctactgcctcagccttccaagtacctgggactactacaggcacctaccaccacgcccagctaattttttttgtatttttaatagagacggggtttcaccatgttggccaggctggtctcgaacttctggcctcaagtgatctgcctgcctcagtctcccaaagtgctaggattacaggcatgaaccactgcgcacagctatttgctttcctatttttaaacaatgaccagttgggaaacaaaatgaagacatgtcaaatttacaatagcataaaaaagaatcccttagatgatgctaaagggaaaatgtgtaggacttatatggagaaaataagagttcaacaaggggacaatcatttcctgatggaaagactcattgttgtcaaggcatcaattatcttgaatttaatttctaaatttaacacaatttcaatcaaagtcccaatcattttttggaggctgagggttgactgaatacaatcccaataaaaattccattggtatttttaaaatcttgataaactgattctaaagtttacttggaagaataaatatgcagtgatagccaagaaaatgttgaaaataaggataatgagggtggacttgccctgccaagatataacatattacagagctactataattaaagcccatattgctatactagaagacagatcagtggcacagaatagaaggcccaaagacagaccccagtatatataattattaaacatataataaagttggcatttgaaatcagtggggaagggatgaattattcaataaaggatgctgggacaattggttacctctttggaaaaaaatggcaaattggattcccatttcacatcagattccaagaaattagacatggatcaaagagtttaaagtggaaatgatgccatataaaagtacaaaaaaactccaaagagtaatatttatatgaccttggagcatgaagaaggctgtttgaggtgtacttggactgtctttctttgtccagttttcccttttagtggtttaaaaggaatacatagtagtttttatatttttatttatttatgtatttatttttgaaacagggtctcattaggtcacccaggctggagtgcagtggtgcagtcatggctcactgcagccccaacttcctgggctcaagcgatcctcccacctcagcctccggagtagctggactgcaggcatgcaccaccatgtctggctaatcttttattttttgtagagatggggtctcactatgttgcccaggttggtcttaaactcctgggctcaagtgatcctcctgccttggtgtcccaaagtgctgggattacagatgtgagccaccacacccggtttctattcttatttttaatacttaattgttaacacgtatatttaaacttataatgtcctatatgcaatttctcaatatcaataatcttttgaggaatataagactcagcacattttcatcttgtaaccctcctgcaactcccatttcttatgacttgggttttctctacttctctatctcttcctctgttgaaaacttttcatattatggaaaaaattaaacatatataaaagtaacattagtataatgcatccttgtgtatgcatcacccagttcaataatgacccatcatgatcaatttctttttcatctgtaatcctcccctttctctccccaccttggcatactgaattattttaaattattttatccataaagatgttaatgtatcctcaaagataaggattctataagcaaagaaaaacaagaccattatcacaccaaatatttttcattccctaatatcagtaacaataattcccttatgtcatcagaaagtgagtatatccatttccctgattgccttacagttttttaaactgttggtttttttccacttagaatccaaacaaggtccacatgttaaatttagttgatatgggttgataggtgcagcaaaccaccatggcacatgtatacctgtgtaacaaacctgaatgttctgcacgtgtatcccagaatttaaagtaaaattaaaaaaatttagttgatatgtttcttaaattcctttgaaaatatacgtttctcgtcctattttctccccacttgcagtcctctcttgtagtctatttgttgaagataccatattctttgccttgtagttttctacattctgggtatttggttggggtgggggggggtgtgtttgctgatcgcatccctgtggtgtcatttaatatgttcctctgtcacttgtattttctgtaaatctgtatttgcatcaagagacttgaaccaatcatatttgattatttgacaagtgtacttcataggtagtgaagtgagctttcctctgtaggcaagtggtatctttttgtgaccttagcaaccatagatgaatgtcacctagactcattgtgtcactagggatggccttgaggtttcctgttctattttcatttactaagcatgcactttagaaaggctctgagctgctccctgaagcatggcacccgtcctccagaaacccgcagtctagaggttgtaaaagaagatttgaacaccaagactgtaaaagatgatttgaacaacaacaacaacaacaaagcagttttattttgtatacattctttcattgtacctcccccagagggatataacctccaaataggggagccataccatagatgcattaaattcacaccaattcaaatgtgtgtatatatgtatttgcttgcagactactaaagtgacaatgtaaacgttgctgcctatttttcccactcttctattagattgacgttgcttttggtgagatggggcatgagtccaccatcctgtcccctctgtttccacatgaccctcatcgtatgaacacctctcttaagtgtgattctaggatttaaagatacatatttcttatgcattatgcacctaaacacaagccaactacttcatctggcacctgatccaagaaacaacattctgttccaaaatcaatagaagacaaggcactttaagggatcttcaagggagtgtaattttgagcatatggaatctttctaaccctagctaactttagaagtttaactcctatgcaagatgaagcatctatgttcccaagagtttgacttcagcaaaggacaagctgcagaagctgacattattgtttattttggcataaaggctttacttgttggtgaagttcaagtttaatgatctcttcctccctttctctctcttcctcctctccgctttccttcttcccttcctcccaccctgattttctcttttgcagtttgctgctttgtggtgcacaagcggtgccatgaatttgtcacattctcctgccctggcgctgacaagggtccagcctccgatgtaagtaatgggcatcgattgcttttctctgtccacagtcaatgctgccttgtgattaaatgtgagtgagcattcttagacgagtaagtgtggacgatctcactctaaggcatgtggtggtccctatagcttttgagacagttttccttttagtggaaaacaaaattttggagggagtgtggctggataggaagtcagctagtttgtctactatgattttgctaatgtcttcactttgagagctggagcacggagggtgagaggcaggggcctacttggtagtgtggctgcaaaaaggtagtttcggtggtactttgcagtgcacgttatggcactttgttagggtgttctttcttttgttattgttattattatttttattatttttcagatggagtcttgctctatcgcccaggctggagtgcagtggagcaatctcagctcactgcaagctccgcctcctgggttcatgccattctcctgcctcagcctcccgaggagctgggactacaggcacctgccactatgcctggctaattttttgttttgtatttttggtagagacggggtttcaccgtgttagacaggatggtctcgatctcctgacctcgtgatccgccgcctcggcctcccaaagtgctgggattacaggtgtgagtcactgtgcccggcctattattattattatttaagagtgttgcccaggctggtctcaaattcctgggctcaagcaatcctcctgccttggcctcccaaagtgttgggattccaggcgtgagccagtgcaccctgcttgttagggtgttcctaatatcagggcccaggaatgaggagga

SEQ ID NO: 120 - DNA, 5917 bp, Homo sapiens
tgttcctgtgtatccacacactatctgtccataaacattattttttatttgaggggcttcccatacatattgctctacaacttgctgcttttcccttaacatgatgtcctgaacatcactccctactgaacatatagagcatctgtcttgcatggatgtgcctagtttagttttccagttgtaaaccaaaaagcaccagatactggtctcaatcaatttacaagtttattttgccaaagttaagaatgtgtgcacctgggagacaggtctgtacctttctccaaagatgattttgagggcttcaatatttaaaggggaaaggtcagatattggggaaagaggaattttttttttttttttagacagggcctcactgtgttgcccaggctggagtgcagtggtgcaatctcagctcactgcaacctctgcctcccgggttcaagcgattctccttcctcagcctcccaagctgctgggactacaggtgcgcgccaccacgctcagctaatttttgtatttttagtagacggggtttcaccatattggccaggctggtcttcaactcccgacctcatgatccacccgcctcggcctcaccaaagggctgggactacaggtgcgagccaccgtgcctggcctgaaagaggaaatttttaaaaggcatgggtaggtaagaggcaaatggctgcattcttctgagtctttgataagcctttcacatgttagagggggatagaggactagtcacttatgcattcatctagctcagtgaatatgcatttttacataagaaaaaataaacatagggcagaggaagcaatgagatatgcatttgtctcaggtgagctgagagatgactttcagtgctgtcaaagcccagcacctgtgaagataagctataaatttacattgtcactgaaattccacacaactgttttagggtacagatttgggggcacacaaggaatttcctagtgggcaagttgtgagggccaggccatatctagcttttttatctttgtagttatcttgtttaagaataaaatgggaggtaggtttccctgatgcagttctcagcttgacttttccctttgacttagtgactttggggtcctgagatttattttcctttcacatagtaacctagagagagacactcagagtatttccaattgtcatctatgacaatcaatgctgccattcacaactttcccaaaaggtccgcagatcccctccccattacggagttggaaagtttcttcccaaaggatccacgtgatgaaaccagcgcaaacctttccaactgcaaatcgaatggcagctgcttccgcttgggcaaagcgtgatttttttttttcctccatcagtggatttttctccagaggaaagcggaagctcctggtgccgtccagaaggtgttaaaaaaaaaaaaaaaaaaaaacccaaacgagaaaacaaacaaaaaagctacacattaacctattaacctggatcccggagtcccagaaaacgggcctctgtctttaaggcgcttcggtcctctgggagttgtagtttcgtgggtcctggagcggcccccttcccatctcccttctggattgcagccccgctgcccttcaggaaagcgctgccccggccacccacgctggcctatgcggtggctccgaccgtgttttttgccggacgggggctcggccttgggggggcgcggaggtgaaactacacttcccggagtgcaccgcgagggtcgcgcagcctcgcgttaaagagcccgctccgccgagcgccgggcgacggcaggtacgtcagtccgcgagggtcgccgcagcgccccttgcgccccttgcgccccttgcgccccctcagctttccggtgcaccctccctgactgggagcaccgagtcgacccgcgggccgcccgggtcctgacagggaagagtccccgggagctctgcggtgccccgggagcccacaggtgtttctacgctcccgcgtccatttggcctgggtcttccaaggggagccccgcgacccggctggtgcggccggacctgctggcagctgggaccgggagggatgcgggcctcagaggatcctcaccctgaggcaggtggggccctggatgccggcgctgctctgattttactttgaggccgcttctcctctctcagtttacccggccagggctcagtattatgcacaaatctcaatgatgtgctcttgggtaatttacaaaacgattttactcccaagtaacttctttcggtctgttatttagaaggcagcaagtcagagtcctccgtgagcctttttttcctctttaaagttctaaaatgtgcagtccctgacccacctgtcttcaaaaggttcatatgaagagttcttagtactttattctatctctggctccccaaccctatcccagtcttggacagcgtggggctgaggacactaaaaaatatttcaacttgatctcagcagatgaggctgtattgaaagtgggtagaggctgggcgccaaggctcatgcctgtaatcccagctacttgggaggctgaggcgagggaatcgcttgaactcaggagatggaggttgcagtgagccaagatcacgccactgcactccaccctgggcgacagagcgagactacgtctcaaaaacaaaacaaaacaaaccaacaacaacaacaacaaaagaaccttagggccttagggcacactttctcaggacctcttgagattgtgtaactccagcaaactattaattaaaaaaaaaaaaaaggccgggcgaggtggctcacgcctgtaatcccagcactgtgggaggcggaagcaggtagatcacctatggtcaggagtttgagaccagcgtggccaacatggcaaaaccccctctctactaataatacaaaaattagctgggcgtggtggtgcacgtctgtaatcccagctacttgggaggctgaggcaggagaatcactttaacctgggaggcggagattgcagtgagccgagatcgcgccattgcactccagcctgacgacagagggagactgtctcaaaaaaaaaaaaagccaggcatggtggcttacacctgtaatcccaacacttaggaaggccaaggcgggaggattacttgagtccgggagttgtaggtcagcctgggcaacaaagggaggccccatctcaacaaaaaataaaaaactagcaggactcatgcatagtcccagctacttgggaggctgggatgggaggatcgctggagcccgggagtttgaggctgcagtgagctgtgatcacatcactgcgttccgccctctggtgacagagccggaccctgtttctcaaaaacaaaacaaaacaaaacaaaagcctagcctgcctgtgctattaaagcaatggcaaaagccaaaattacttttgcaccaacctaatagctatgtttctgctttttaaactacagttttcttgtctagagcttcagtgagataagaaccaattcttaggactgttgggtgggtcatatgaagtgacactgatgtgcctttgccatagtgcctgaaaaagcactccatatgtattagctacttgtatcattttaccttttttgttaatctctcaggggatgtccctcagccttgcttgattcccgaggccttccctgatttttttcttcttcaggacagtctttaactcagagaatgtttgagagcttccagtccttcctccttcagggacaggttaaactctcctgcttccttgcctggctggaaggattatcattcattgagccactggtgtgtgccacatactttacattgtatttcatgctgaaaacagtcctgggaggttgatgtctttggccttaaatttcagattaggaaactgaggcttagagaggttaagtaactgctgggcatggtggctcacgcctgtaatcccagcactttgggaggccgaggcaggcggatcccaaggtcaggagtttgagaccagcctggccagcatggtgaaaccccgtctctactaaaaatacaaaaaattatccaggcatggtggtgcgcgcctgtagtcccagttactcgggaggctgaggcaggagaatggcttgaacctgggaggcggaggttgcagtgagccaagattgcgccactgcactccagcctgggtgacagagcgagactccatcttaaaaaaaaaaatagattaagtaacttgctcaggatcctacaggaagcaggaagaggtagagatggggacagagccttttgggactgatacgcaacccaggactgttcctctgcccctgtcattagtaagggatactctccccactctggccatgacctgtcacctgcccatgtctctctatcactatgctgagatgaagactgggctcagaacttctgggccattggactctctggggcatttcttttttttcttgagacagagtcgctctgttgcccaggctagagtgcagtggcgtgatcttggctcactgcagcctccgtctcctgggttcaagtgattctcctgcctcagcctcctgagtagctgggactacaagcgcgcatcactacacccggctaatttttgtacttttaaaagagatggggttttggcatgttggccaggctggccttgaactcctgaactcaagtgatctgcccactttggcctcccgaagtgctgggattccggatgtgagctaccacatctggccatttcaagggtttctttctttctttctttctttcttttttcctcagacagggtctggctttgttacccagggtggaatgtattggtgccagtttactgcaacctctgcccccagggctgaaacaatgcttccgcctcagcctcctgagtagctgtgactataggcacattcactgtgcctggctaatttttgtatgtgtgtggttttttgtttttttttttttggtagagatggggtttgccatgttgctcaggctggtctcaaactcctgggctcaagccatccgcctgtcttggcctcccaaagtgctggaattacaggtgtgaaccactgcacctggcctcttgctgtctttcagtgcctttgcttgggaccagatatcattatcactatcacctgaataaggatccaaaagacccaggtgtgttgcaactttgactatagcgtctcctggcctctgtgaagtggagataataggagataataatacttatcttgcagggtctaagggtgttgtcaagataaaaaaaaaaaatcacagcaccttaactgtggtccagagtgctcagtcctagtggctattattaattttttttctttctttctttcttttttttttttttgagacaaagtctcactctgtcacccaggctggagtgcagtggaacaatctctgctcactgcaaccaccgcttcccaggttcaagcgattctcctgcctcagcctcctgagtagctgggattacaggcacccgccaccatgcctggctaatttttgaatttttggtagagatggggtttcaccatgctggccaggctggtctcaaactcctgacctcaggtgatccacccgcctcggcctcccaaagtgctgagattataggcgtgagccaccatgcccggcctattaattttaattttattttttttgagacggaatctcactctgtcgcccaggctggagtgcagtggcgtgatcttggctcactgcaacctccacctcccaggttcagcctcccgagtaactgggattacaggtgcctgccaccatgcctggctaatttttgtatttttagtagagacagggtttaccatgttggcgaggctggtctcgaactcctgacctcaggtaatcttcctgccttggccttccaaagtgctgggattacaggcataagccaccatgcctggca
